United States Patent 9,890,389 (ISOLATED POLYNUCLEOTIDES AND POLYPEPTIDES, AND METHODS OF USING SAME FOR INCREASING NITROGEN USE EFFICIENCY OF PLANTS) - sequence listing, part 2

SEQ ID NO: 1206 - DNA, 2012 bp, Primula obconica
taaaagttcagcatgggtaaggaaaagattcatatcagcatcgtcgtcattgggcatgtcgactccggcaagtcgaccaccactggtcaccttatctacaagcttggaggtattgacaagcgtgttatcgagcgttttgagaaagaagctgctgagatgaacaagaggtcattcaagtatgcgtgggtgttggataagctcaaggctgagcgtgaacgtggtattactattgatattgctttgtggaagtttgagaccaccaagtactactgcacagtcatcgatgcccctggacatcgtgatttcatcaagaacatgattacgggaacttcccaagctgattgtgctgtcctcattatcgattccaccactggtggtttttgaggctggtatttccaaggacggtcagacccgtgagcatgcgttgcttgctttcacccttggtgtcaggcaaatgatctgttgctgtaataagatggatgctaccaccccaagtattccaagtcaaggtacgaagaaattgtgaaggaagtgtcgtcttacctgaagaggttggttacaacccgaaaagacccatttgtgcccatctctggattcgaaggtgacaacatgattgagaggtccaccaacctcgactggtacaagggcccgacccttcttgatgctcttgaccaagtctcagagcccaagaggccctcagacaagcccctccgtctcccacttcaggacgtctacaagatcggtggcattggaacggtgccagttggtcgtgtggagacaggtgtcatcaagcccggaatggtcgtcaccttcggcccatctggtctgaccactgaggtcaagtccgtcgagatgcaccacgagtctctccttgaagctcacccaggtgacaacgttgggttcaacgttaagaatgttgctgtgaaggatctcaagcgtgggtatgttgcctctaactcgaaggacgaccctgccaagggagctgccagtttcaccgcacaggtcatcatcatgaaccacccaggccagatcggtaacggctatgctcccgtgctggattgccacacctcccacattgctgtgaaattctctgagattctgaccaagatcgataggcggtctggtaaggaactcgagaaggagcctaagttcttgaagaatggagatgctggaatggtgaagatgattcccaccaagcctatggttgtcgagactttctctgagtatccaccattgggtcgatttgctgtgagggacatgaggcagacagttgctgttggtgtgatcaagagcgttgacaagaaagatccgactggtgccaaggtgaccaaggctgcggtcaagaagggtgccaagtgaatggtgcggtttttgcgatttgttttttgtcgtcgttatgtcaagtcattgaggacttaatttctttttcgggttttggatttctaccttgtttgttacgcattaattctcagaattgggtgcttgacagacggtggcatattctctagtgtcgtgtcagtttttccttatcgtatgtatcttttgggaagtgttggtttgggaatgcttgtgttgcatccgaaggatattttgaacagctttctgtggatttattataatttatttggctcccattacggccgaaattggatgaaggcattcttattaacattggagactcttgcagcttctctcgaacggcaagtttatgagttgccctcacagagtttttgcaacaaaagatgggcctcggcttacaatcgcgagctttatcggctttcataatttgccaaaaaaatacggaccaattaaagagttgctttccgaaactaaccgcccaatatacaaggatgtaattggagatgactacttaactgacgtctataacaagggggctggttttgaaaccgcttttctcgatgcctacaagattgaatattagtcataagatataaattgtccaaacaactgttatatcgtgtggattgaataatgtaatgtgatatttcgat

SEQ ID NO: 1207 - DNA, 1674 bp, Solanum lycopersicum
agagaaattaaaaggcttatataaaatataacttgggcgaacaccaaaagcaaaaatcctgaggcaccatggaaaaccaaggcacctcaacagagtgacaacagtatccaaatcatgctcgccaccgcctgtcaagtacccagttctgagaatgattacatgacatacaaggcacaaaacaagagcctaaaaagcaaatcaaagacaaaactatagcagaagtaaacaaaacagagtctagatagcacactttatgaaaataaatagcattggagacactagcatcacacagcactgttcactttcccttcttttgggcagccttggtcaccttggcaccagttgggtccttcttgtcaacattcttgacaacaccaacagcaacagtttgcctcatgtccctcacagcaaaacgacccaatggtgggtattcggcaaaggtctcaacaaccatgggcttggtggggatcatcttaaccataccagcatcaccattcttcaagaacttaggctctttctcaagttccttacctgaacgcctgtcaatcttggtcaaaatctcggcaaacttgacagcaatgtgggaagtgtggcagtcaagcactggtgcatatccatttccaatctggccaggatggttcataatgatgacctgggcagtgaaactggctgcccccttagctgggtcatcctcggagtttgaggcaacataaccacgcttaagatccttaacagcaacattcttaacattgaacccaacgttgtctccagggagtgcctcctggagagcttcgtggtgcatctcaacagacttgacttcagttgtcaaaccagtagggccaaaggtcacaaccataccaggcttgattacgccagtctctacacgaccaactgggacagttccaataccaccaatcttgtaaacatcctgaagtgggagacggagtggcttgtctgatggcctcttgggctcattaatctggtcaagagcctcaaggagggttggtcccttgtactagtcaaggttggtagacctctcaatcatattatctccttcaaaaccagagatgggaacaaatgggattttgtcagggttgtaaccaaccttcttgaggtaggaagaaacttccttcacgatttcatcgtacctggccttggagtacttgggggtgcaaaccttgttgtagcagcaaatcatttgcttgacaccaagggtgaaagcaagcaatgcatgttcacgggtctgaccatccttagagataccagcttcaaaaccaccagtggtggagtcaataatgaggacagcacagtcagcctgggaggtaccagtgatcatattcttgataaagtccctgtgtccaggggcatcaatcacagtgcagtagtacttggtggtctcaaacttccacaaagcaatatcaatagtgataccacgctcacgttccgccttaagtttgtcaagcacccaggcttacttgaatgacctcttgttcatctcagcagcttccttctcaaacctctcaataacacgcttgtcaataccaccaagtttgtagatcaagtgaccagttgtggtcgacttaccagagtccacatgtccaatgaccacaatactgatgtgaattttctctttacccatattgagttactaaaagactgcaattaatacaaaac

SEQ ID NO: 1208 - DNA, 1740 bp, Olea europaea
cgattttccctgtctacattgctctgctctctacgtttctgcacctgttttatacgctagggtttaagagctatattctttcttttccttagcggctcaaaaatcaagatctaaaatgggaaaggagaaggttcacatcaacattgtggtcattggccacgttgactcaggtaagtcaaccactactggacatctaatctacaagcttggaggcattgacaagcgtgtgattgagagatttgagaaggaagctgctgagatgaacaagaggtctttcaaatatgcctgggtgcttgacaagctcaaggctgagcgggagcgtggtatcaccattgatattgccctgtggaaattcgagaccaccaagtactactgcactgtcattgatgctcctggacatcgtgatttcattaagaatatgattactggtacttcccaagctgactgtgctgtgcttatcattgattccaccactggtggttttgaggctggtatctctaaggatggccagacccgtgagcatgctctccttgcattcacacttggtgtgaggcaaatgatttgctgctgtaacaagatggatgctacaactcccaagtactccaaggcaagatatgatgaaattgtcaaggaagtctcttcctacctgaagaaggttgggtacaatccagataaaattccttttgtgcctatctctggttttgagggtgataacatgattgagaggtccaccaacctcgactggtacaagggcccaaccctccttgaggcacttgaccagatcctggagcccaagaggccctcggacaagccactgcgtctgccactccaggatgtctacaagattggaggtattggtactgtccccgtgggtagagttgaaactggtgtcctgaaacctggtatggttgttacctttgggccaactggtctgacaactgaagttaagtccgttgaaatgcatcatgaagccctctctgaagctctccctggtgacaatgttggcttcaatgtcaagaacgtttctgttaaggatcttaaacgtggatatgttgcatctgactcaaagaatgaccctgccaagggtgccgaaagcttcacatcccaggtcattatcatgaaccatccaggtcaaattggaaatggttatgcccctgttctcgattgtcacacctctcacattgccgtcaaatttgctgagctccttaccaagattgacaggcggtctggcaaagagcttgagaaggaacccaaattcttgaagaatggagattctgggatggttaagatgattccgaccaagcccatggtggtggagactttctctgagtacccccctcttggacgatttgctgtgagggacatgcgccagactgtggctgttggtgttatcaagaatgttgacaagaaggagccaacaggtgccaaggtgaccaaggctgctgccaagaagggtgcaaagtgaatggtgctgccttgggtcgtctactgctttaatattgattacagatacttccgttatcatcctaaagacttgttttattttgttcatgtcgttttgagtcatttgtctcgtcttgtgtgttgtctgcgtcttagttctttgttgttggtgtctgtttgtagttcccagaattgggtgctggacaggcggtggcgacactggcgtgtgagttaatagtctattttcgtaatgtgaagttgctctacatctatggtttttgataatttaaaactttt

SEQ ID NO: 1209 - DNA, 1688 bp, Ceratodon purpureus
cttgcaccgcactatatcagtggtgcccccgcccctctccctccagttgtgatcacttctgcacagtctctgctcgcccccctccgcccccgccctctcttcctgcttcgccaggaccccagctcagactattcaagatgggtaaggagaaggtacatatcaacattgtggtcatcggccatgtcgactccggaaagtcgacgaccaccggacacttgatctataagttgggtggtattgacaagcgtgtgatcgagcgtttcgagaaggaggcggctgagatgaacaagcgttccttcaagtacgcgtgggtgttggacaagctgaaggctgagcgtgagcgtggtattaccatcgatatcgcgttgtggaagttcgagacggtgaagtactactgcaccgtcattgatgcccccggacatcgtgatttcatcaagaacatgattacgggaacttctcaggccgattgcgccgtgctgatcatcgactcgacgaccggaggttttgaggccggtatctcgaaggatgggcagacccgtgagcacgctttgttggctttcactttgggagtgaagcagatgatctgctgctgcaacaagatggacgcgaccaccccgaagtacagcaaggcccgtttcgaggagatcacgaaggaggtgtcctcctacctgaagaaggtgggatacaaccccgacaagatcccgttcgtgcccatctctgggttcgagggtgacaacatgattgagaggtcgtcgaacctggactggtacaagggccctactctgttggaggctctggacgccgttacggagcccaagaggccgtccgacaagcccctccggttgccccttcaggacgtatacaagattggaggcattggaactgtgcctgtgggacgtgtggagactggtgtgatcaagcccggtatgttagtgtgcttcgcccccactggactgaccacggaggtgaagtctgtggagatgcaccacgagtccatgcccgaggcccaccccggtgacaacgtgggattcaacgttaagaacgtggcggtgaaggacctgaagagagggttcgttgcttctgactctaagaacgatcccgcgaaggaggccgccaacttcaccgctcaggttatcatcatgaaccaccccggacagatcggtaacgggtacgccccggtgctggattgccacacttctcacatcgctgtgaagtttgccgagatcttgaccaaggttgacaggcgatcgggtaaggagctggagaaggagcccaagttcctgaagaacggtgacgctggtttcgtgaagatgattccgaccaagccgatgacggtggagactttcgctgagtacccacctttgggtcgtttcgccgtgcgtgacatgaggcagacggtggctgtgggagtgatcaaggctgtggagaagaaggacgcgactggtgccaaggtgaccaaggccgctgccaagaagaagtgaataggtcaggatgagccgcagcagcagttttgtttgtgttctgtagttgttttggcggctctagatttgttcgcactatgtgcgtgttcgatatacttgctgcaggcgcggcagagacagacctgggtacttgaccggagatggcagggcctggcgtgatctgattgttatcattcttctctattataatatctaagtctgcgttga

SEQ ID NO: 1210 - DNA, 1651 bp, Ceratodon purpureus
gatcacttctgcacagcctctgctcgccccctccgcccccgccctctcttcctgcttcgccaggaccccagctcagattattcaagatgggtaaggagaaggtacatatcaacattgtggtcatcggccatgtcgactccggaaagtcgacgaccaccggacacttgatctataagttgggtggtattgacaagcgtgtgatcgagcgtttcgagaaggaggcggctgagatgaacaagcgttccttcaagtacgcgtgggtgttggacaagctgaaggctgagcgtgagcgtggtattaccatcgatatcgcgttgtggaagttcgagacggtgaagtactactgcaccgttatcgatgcccccggacatcgcgatttcatcaagaacatgattacgggaacttctcaggccgactgcgctgtgctgatcatcgactcgacgaccggaggttttgaggccggtatctcgaaggatgggcagacccgtgagcacgctttgttggctttcactttgggagtgaagcagatgatctgctgctgcaacaagatggacgcgaccaccccgaagtacagcaaggcccgtttcgaggagatcacgaaggaggtgtcctcctacctgaagaaggtgggatataaccccgacaagatcccgtttgtgcccatctctgggttcgagggtgacaacatgattgagaggtcgtcgaacctggactggtacaagggccctactctgttggaggcgttggacgccgtgacggagcccaagaggccgtccgacaagcccctccggttgccccttcaggacgtatacaagattggaggcattggaactgtgcctgtgggacgtgtggagactggtgtgatcaagcccggtatgttggtgtgcttcgcccccactggactgaccaccgaggttaagtctgtggagatgcaccacgagtccatgcccgaggcccaccccggtgacaacgtgggattcaacgttaagaacgtggcggtgaaggacctgaagagagggttcgttgcttctgactctaagaacgaccccgcgaaggaggccgccaacttcaccgctcaggttatcatcatgaaccaccccggacagatcggtaacgggtacgccccggtgctggactgccacacttctcacatcgccgtgaagtttgccgagatcttgaccaaggttgacaggcgatcgggtaaggagctggagaaggagcccaagttcttgaagaacggtgacgctggtttcgtgaagatgattccgacgaagccgatgacggtggagactttcgctgagtacccacctttgggtcgtttcgccgtgcgcgacatgaggcagacggtggctgtgggagtgatcaaggctgtggagaagaaggacgcgactggtgccaaggtgaccaaggccgctgccaagaagaagtgaataggtcaggatgagccgcagcagcagttttgtttgtgttctgtagttgttttggcggctctagatttgttcgcactatgtgcgtgttcgatatacttgctgcaggcgcggcagagacagacctgggtacttgaccggagatggcagggcttgtcgtctccgtgattgttatcattcttcttctctattataatatctgaagcttttgcgtgaattcgcga

SEQ ID NO: 1211 - DNA, 1656 bp, Ceratodon purpureus
ggatatttggtttgattttattcttgtgcaccaggatgttggaatgtgatggattttagggttgtggtgtgaagtgctgacggtatttgtgttgacagattattcaagatgggtaaggagaaggtacatatcaacattgtggtcatcggccatgtcgactccggaaagtcgacgaccaccggacacttgatctataagttgggtggtatcgacaagcgtgtgatcgagcgtttcgagaaggaggcggctgagatgaacaagcgttccttcaagtacgcgtgggtgttggacaagctgaaggcggagcgtgagcgtggtattaccatcgatatcgcgttgtggaagttcgagacggtgaagtactactgcaccgttatcgatgcccccggacatcgcgatttcatcaagaacatgattacgggaacttctcaggccgactgcgctgtgctgatcatcgactcgacgaccggaggtttcgaggccggtatctcgaaggatgggcagacccgtgagcacgctttgttggctttcactttgggagtgaagcagatgatctgctgctgcaacaagatggacgcgaccaccccgaagtacagcaaggcccgtttcgaggagatcacgaaggaggtgtcctcctacctgaagaaggtgggatacaaccccgacaagatcccgttcgtgcccatctctgggttcgagggtgacaacatgattgagaggtcgtcgaacctggactggtacaagggccctactctgttggaggcgttggacgccgtgacggagcccaagaggccgtccgacaagcccctccggttgccccttcaggacgtatacaagattggaggcattggaactgtgccggtgggacgtgtggagactggtgtgatcaagcccggtatgttggtgtgcttcgcccctactggactgaccacggaggtgaagtctgtggagatgcaccacgagtctatgccggaggcgcaccccggtgacaacgtgggattcaacgttaagaacgtggcggtgaaggacctgaagagagggttcgttgcttctgactctaagaacgaccccgcgaaggaggccgccaacttcaccgctcaggttatcatcatgaaccaccccggacagatcggtaacgggtacgccccggtgctggattgccacacttctcacatcgccgtgaagtttgccgagatcttgaccaaggttgacaggcgatcgggtaaggagctggagaaggagcccaagttcttgaagaacggtgacgctggtttcgtgaagatgattccgaccaagccgatgacggtggagactttcgctgagtacccacctttgggtcgtttcgccgtgcgcgacatgaggcagacggtggctgtgggagtgatcaaggctgtggagaagaaggacgcgactggtgccaaggtgaccaaggccgctgccaagaagaagtgaataggtcaggatgagccgcagcagcagttttgtttgtgttctgtagttgttttggcggctctagatttgttcgcactatgtgcgtgttcgatatacttgctgcaggcgcggcagagacagacctgggtacttgaccggagatggcagggcctggcgtgatctgattgttatcattcttctctattataatatctaagtctgcgt

SEQ ID NO: 1212 - DNA, 1633 bp, Ceratodon purpureus
cttgcaccgcactatatcagtggtgcccccgccccctctccctccagttgtgatcacttctgcacagcctctgctcgcccccctccgcccccgccctctcttcctgcttcgccaggaccccagctcagattattcaagatgggtaaggagaaggtacatatcaacattgtggtcatcggccatgtcgactccggaaagtcgacgaccaccggacacttgatctataagttgggtggtattgacaagcgtgtgatcgagcgtttcgagaaggaggcggctgagatgaacaagcgttccttcaagtacgcgtgggtgttggacaagctgaaggctgagcgtgagcgtggtattaccatcgatatcgcgttgtggaagttcgagacggtgaagtactactgcaccgttattgatgcccccggacatcgtgatttcatcaagaacatgattacgggaacttctcaggccgattgcgccgtgctgatcatcgactcgacgaccggaggttttgaggccggtatctcgaaggatgggcagacccgtgagcacgctttgttggctttcactttgggagtgaagcagatgatctgctgctgcaacaagatggacgcgaccaccccgaagtacagcaaggcccgtttcgaggagatcacgaaggaggtgtcctcctacctgaagaaggtgggatataaccccgacaagatcccgtttgtgcccatctctgggttcgagggtgacaacatgattgagaggtcgtcgaacctggactggtacaagggccctactctgttggaggcgttggacgccgtgacggagcccaagaggccgtccgacaagcccctccggttgccccttcaggacgtatacaagattggaggcattggaactgtgccggtgggacgtgtggagactggtgtgatcaagcccggtatgttggtgtgcttcgcccccactggactgaccacggaggtgaagtctgtggagatgcaccacgagtctatgccggaggcgcaccccggtgacaacgtgggattcaacgttaagaacgtggcggtgaaggacctgaagagagggttcgttgcttctgactctaagaacgaccccgcgaaggaggccgccaacttcaccgctcaggttatcatcatgaaccaccccggacagatcggtaacgggtacgccccggtgctggattgccacacttctcacatcgccgtgaagtttgccgagatcttgaccaaggttgacaggcgatcgggtaaggagctggagaaggagcccaagttcttgaagaacggtgacgctggtttcgtgaagatgattccgaccaagccgatgacggtggagactttcgctgagtacccacctttgggtcgtttcgccgtgcgcgacatgaggcagacggtggctgtgggagtgatcaaggctgtggagaagaaggacgcgactggtgccaaggtgaccaaggccgctgccaagaagaagtgaataggtcaggatgagccgcagcagcagttttgtttgtgttctgtagttgttttggcggctctagatttgttcgcactatgtgcgtgttcgatatacttgctgcaggcgcggcagagacagacctgggtacttgaccggagatggcagggcc

SEQ ID NO: 1213 - DNA, 1406 bp, Ceratodon purpureus
cctcgccctcttcctgcttcgccaggaactccagattattcaagatgggtaaggagaaggttcatatcaacatcgtggtcattggccatgtcgactccggaaagtcgacaaccaccggacacttgatctataagttgggtggtatcgacaagcgtgtgatcgagcgtttcgagaaggaggcggctgagatgaacaagcgttccttcaagtacgcgtgggtgttggacaagctgaaggctgagcgtgagcgtggtattaccatcgatatcgccttgtggaagttcgagacggtgaagtactactgcaccgttatcgatgcccctggacatcgtgatttcatcaagaacatgattacgggaacttctcaggccgactgcgctgtgctgatcatcgactcgacgaccggaggtttcgaggccggtatctcgaaggatgggcagacccgtgagcacgctttgttggctttcactttgggagtgaagcagatgatttgctgctgcaacaagatggacgcgaccaccccgaagtacagcaaggcccgtttcgaggagatcacgaaggaggtgtcctcctacctgaagaaggtgggatacaaccccgacaagatcccgttcgtgcccatctctgggttcgagggtgacaacatgattgagaggtcgtcgaacctggactggtacaagggccctactctgttggaggcgttggacgccgtgacggagcccaagaggccgtccgacaagcccctccggttgccccttcaggacgtatacaagattggaggcattggaactgtgccggtgggacgtgtggagactggtgtgatcaagcccggtatgttggtgtgcttcgcccccactggactgaccactgaggtgaagtctgtggagatgcaccacgagtctatgccggaggcccaccccggtgacaacgtgggattcaatgttaagaacgtggcggtgaaggacctgaagagagggttcgttgcttctgactctaagaacgaccccgcgaaggaggccgccaacttcaccgctcaggttattatcatgaaccaccccggacagatcggtaacgggtacgccccggtgctggattgccacacttctcacatcgctgtgaagtttgccgagatcttgaccaaggttgacaggcgatctggtaaggagctcgagaaggagcccaagttcttgaagaacggtgacgctggtttcgtgaagatgattcccaccaagccgatgacggtggagactttcgctgagtacccacctttgggtcgtttcgccgtgcgcgacatgaggcagacggtggctgtgggagttatcaaggctgtggagaagaaggacgcgactggtgccaaggtgaccaaggccgctgccaagaagaagtaaaaaggttgtaagaatttt

SEQ ID NO: 1214 - DNA, 1488 bp, Ceratodon purpureus
ccacctcgccctcttcctgcttcgccaggaactccagattattcaagatgggtaaggagaaggttcatatcaacatcgtggtcattggccatgtcgactccggaaagtcgacaaccaccggacacttgatctataagttgggtggtatcgacaagcgtgtgatcgagcgtttcgagaaggaggcggctgagatgaacaagcgttccttcaagtacgcgtgggtgttggacaagctgaaggctgagcgtgagcgtggtattaccatcgatatcgccttgtggaagttcgagacggtgaagtactactgcaccgttatcgatgcccctggacatcgtgattttatcaagaacatgattacgggaacttctcaggccgattgcgctgtgctgatcatcgactcgacgaccggaggtttcgaggccggtatctcgaaggatgggcagacccgtgagcacgctttgttggctttcactttgggagtgaagcagatgatttgctgctgcaacaagatggacgcgaccaccccgaagtacagcaaggctcgtttcgaggagatcacgaaggaggtgtcctcctacctgaagaaggtgggatacaaccccgacaagatcccgtttgtgcccatctctgggttcgagggtgacaacatgattgagaggtcgtcgaacctggactggtacaagggccctactctgttggaggccttggacgccgttacggagcccaagaggccgtccgacaagcccctgcggttgccccttcaggacgtttacaagattggaggcattggaactgtgccggtgggacgtgtggagactggtgtaatcaagcccggtatgttggtgtgcttcgcccccactggactgaccactgaggtgaagtccgtggagatgcaccacgagtctatgccggaggcccaccccggtgacaacgtgggattcaatgttaagaacgtggcggtgaaggacctgaagagagggttcgttgcttctgactctaagaacgaccccgcgaaggaggccgccaacttcaccgctcaggttattatcatgaaccaccccggacagatcggtaacgggtacgccccggtgctggattgccacacttctcacatcgctgtgaagtttgccgagatcttgaccaaggttgacaggcgatctggtaaggagctcgagaaggagcccaagttcttgaagaacggtgacgctggtttcgtgaagatgattcccaccaagccgatgacggtggagactttcgctgagtacccacctttgggtcgtttcgccgtgcgcgacatgaggcagacggtcgctgtgggagttatcaaggctgtggagaagaaggacgcgactggtgccaaggtgaccaaggccgctgccaagaagaagtaaaaggttgtaagaattttggggagcagttggtttggctttggttatgccgttctgtcttcgcacttcggacctgcctgctgtgtctggattggaattt

SEQ ID NO: 1215 - DNA, 1560 bp, Ceratodon purpureus
tcgccgctgctcacctccttcgactccgcctccttcctgctctgccaggaccccagactattcaagatgggtaaggagaaggtacatatcaacattgtggtcatcggccatgtcgactccggaaagtcgacgaccaccggacacttgatctataagttgggtggtatcgacaagcgtgtgatcgagcgtttcgagaaggaggcggctgagatgaacaagcgttccttcaagtacgcgtgggtgttggacaagctgaaggcggagcgtgagcgtggtattaccatcgatatcgcgttgtggaagttcgagacggtgaagtactactgcaccgttatcgatgcccccggacatcgcgatttcatcaagaacatgattacgggaacttctcaggccgactgcgctgtgctgatcatcgactcgacgaccggaggtttcgaggccggtatctcgaaggatgggcagacccgtgagcacgctttgttggctttcactttgggagtgaagcagatgatctgctgctgcaacaagatggacgcgaccaccccgaagtacagcaaggcccgtttcgaggagatcacgaaggaggtgtcctcctacctgaagaaggtgggatacaaccccgacaagatcccgttcgtgcccatctctgggttcgagggtgacaacatgattgagaggtcgtcgaacctggactggtacaagggccctactctgttggaggctctggacgccgttacggagcccaagaggccgtccgacaagcccctccggttgccccttcaggacgtatacaagattggaggcattggaactgtgcctgtgggacgtgtggagactggtgtgatcaagcccggtatgttagtgtgcttcgcccccactggactgaccacggaggtgaagtctgtggagatgcaccacgagtccatgcccgaggcccaccccggtgacaacgtgggattcaacgttaagaacgtggcggtgaaggacctgaagagagggttcgttgcttctgactctaagaacgatcccgcgaaggaggccgccaacttcaccgctcaggttatcatcatgaaccaccccggacagatcggtaacgggtacgccccggtgctggattgccacacttctcacatcgctgtgaagtttgccgagatcttgaccaaggttgacaggcgatcgggtaaggagctggagaaggagcccaagttcctgaagaacggtgacgctggtttcgtgaagatgattccgaccaagccgatgacggtggagactttcgctgagtacccacctttgggtcgtttcgccgtgcgtgacatgaggcagacggtggctgtgggagtgatcaaggctgtggagaagaaggacgcgactggtgccaaggtgaccaaggccgctgccaagaagaagtgaataggtcaggatgagccgcagcagcagttttgtttgtgttctgtagttgttttggcggctctagatttgttcgcactatgtgcgtgttcgatatacttgctgcaggcgcggcagagacagacctgggtacttgaccggagatggcagggc

SEQ ID NO: 1216 - DNA, 1574 bp, Ceratodon purpureus
cttctgcacagcctctgctcgccccctccgcccccgccctctcttcctgcttcgccaggaccccagctcagattattcaagatgggtaaggagaaggtacatatcaacattgtggtcatcggccatgtcgactccggaaagtcgacgaccaccggacacttgatctataagttgggtggtattgacaagcgtgtgatcgagcgtttcgagaaggaggcggctgagatgaacaagcgttccttcaagtacgcgtgggtgttggacaagctgaaggctgagcgtgagcgtggtattaccatcgatatcgcgttgtggaagttcgagacggtgaagtactactgcaccgtcattgatgcccccggacatcgtgatttcatcaagaacatgattacgggaacttctcaggccgattgcgccgtgctgatcatcgactcgacgaccggaggttttgaggccggtatctcgaaggatgggcagacccgtgagcacgctttgttggctttcactttgggagtgaagcagatgatctgctgctgcaacaagatggacgcgaccaccccgaagtacagcaaggcccgtttcgaggagatcacgaaggaggtgtcctcctacctgaagaaggtgggatacaaccccgacaagatcccgttcgtgcccatctctgggttcgagggtgacaacatgattgagaggtcgtcgaacctggactggtacaagggccctactctgttggaggcgttggacgccgtgacggagcccaagaggccgtccgacaagcccctccggttgccccttcaggacgtatacaagattggaggcattggaactgtgccggtgggacgtgtggagactggtgtgatcaagcccggtatgttggtgtgcttcgcccccactggactgaccacggaggtgaagtctgtggagatgcaccacgagtctatgccggaggcgcaccccggtgacaacgtgggattcaacgttaagaacgtggcggtgaaggacctgaagagagggttcgttgcttctgactctaagaacgaccccgcgaaggaggccgccaacttcaccgctcaggttatcatcatgaaccaccccggacagatcggtaacgggtacgctccggtgctggattgccacacttctcacatcgccgtgaagtttgccgagatcttgaccaaggttgacaggcgatcgggtaaggagctggagaaggagcccaagttcttgaagaacggtgacgctggtttcgtgaagatgattccgaccaagccgatgacggtggagactttcgctgagtacccacctttgggtcgtttcgccgtgcgcgacatgaggcagacggtggctgtgggagtgatcaaggctgtggagaagaaggacgcgactggtgccaaggtgaccaaggccgctgccaagaagaagtgaataggtcaggatgagccgcagcagcagttttgttgtgttctgtagttgttttggcggctctagatttgttcgcactatgtgcgtgttcgatatacttgctgcaggcgcggcagagacagacctgggtacttgatcggagatggcagggc

SEQ ID NO: 1217 - DNA, 1620 bp, Ceratodon purpureus
cctcatcaatcctccatcgccgctgctcacctccttcgactccgcctccttcctgctctgccaggaccccagactattcaagatgggtaaggagaaggtacatatcaacattgtggtcatcggccatgtcgactccggaaagtcgacgaccaccggacacttgatctataagttgggtggtatcgacaagcgtgtgatcgagcgtttcgagaaggaggcggctgagatgaacaagcgttccttcaagtacgcgtgggtgttggacaagctgaaggcggagcgtgagcgtggtattaccatcgatatcgcgttgtggaagttcgagacggtgaagtactactgcaccgttatcgatgcccccggacatcgcgatttcatcaagaacatgattacgggaacttctcaggccgactgcgctgtgctgatcatcgactcgacgaccggaggtttcgaggccggtatctcgaaggatgggcagacccgtgagcacgctttgttggctttcactttgggagtgaagcagatgatttgctgctgcaacaagatggacgcgaccaccccgaagtacagcaaggcccgtttcgaggagatcacgaaggaggtgtcctcctacctgaagaaggtgggatacaaccccgacaagatcccgtttgtgcccatctctgggttcgagggtgacaacatgattgagaggtcgtcgaacctggactggtacaagggccctactctgttggaggccttggacgccgttacggagcccaagaggccgtccgacaagcccctgcggttgccccttcaggacgtttacaagattggaggcattggaactgtgccggtgggacgtgtggagactggtgtgatcaagcccggtatgttggtgtgcttcgcccccactggactgaccactgaggtgaagtctgtggagatgcaccacgagtctatgccggaggcccaccccggtgacaacgtgggattcaatgttaagaacgtggcggtgaaggacctgaagagagggttcgttgcttctgactctaagaacgaccccgcgaaggaggccgccaacttcaccgctcaggttatcatcatgaaccaccccggacagatcggtaacgggtacgccccggtgctggactgccacacttctcacatcgccgtgaagtttgccgagatcttgaccaaggttgacaggcgatcgggtaaggagctggagaaggagcccaagttcttgaagaacggtgacgctggtttcgtgaagatgattccgaccaagccgatgacggtggagactttcgctgagtacccacctttgggtcgtttcgccgtgcgcgacatgaggcagacggtggctgtgggagtgatcaaggctgtggagaagaaggacgcgactggtgccaaggtgaccaaggccgctgccaagaagaagtgaataggtcaggatgagccgcagcagcagttttgtttgtgttctgtagttgttttggcggctctagatttgttcgcactatgtgcgtgttcgatatacttgctgcaggcgcggcagagacagacctgggtacttgaccggagatggcagggcttatcgtctccgtgattgttatcattcttcttctctattataat

SEQ ID NO: 1218 - DNA, 1732 bp, Ceratodon purpureus
cgcctccacctcgccctcttcctgcttcgccaggaactccagattattcaagatgggtaaggagaaggttcatatcaacatcgtggtcattggccatgtcgactccggaaagtcgacaaccaccggacacttgatctataagttgggtggtatcgacaagcgtgtgatcgagcgtttcgagaaggaggcggctgagatgaacaagcgttccttcaagtacgcgtgggtgttggacaagctgaaggctgagcgtgagcgtggtattaccatcgatatcgccttgtggaagttcgagacggtgaagtactactgcaccgttatcgatgcccccggacatcgtgatttcatcaagaacatgattacgggaacctctcaggccgattgcgctgtgctgatcatcgactcgacgaccggaggttttgaggccggtatctcgaaggatgggcagacccgtgagcacgctttgttggctttcactttgggagtgaagcagatgatttgctgctgcaacaagatggacgcgaccaccccgaagtacagcaaggctcgtttcgaggagatcacgaaggaggtgtcctcctacctgaagaaggtgggatacaaccccgacaagatcccgtttgtgcccatctctgggtttgagggtgacaacatgattgagaggtcgtcgaacctggactggtacaagggccctactctgttggaggccttggacgccgttacggagcccaagaggccgtccgacaagcccctgcggttgccccttcaggacgtttacaagattggaggcattggaactgtgccggtgggacgtgtggagactggtgtgatcaagcccggtatgttggtgtgcttcgcccccactggactgaccacggaggtgaagtctgtggagatgcaccacgagtccatgcccgaggcccaccccggtgacaacgtgggattcaacgttaagaacgtggcggtgaaggacctgaagagagggttcgttgcttctgactctaagaacgaccccgcgaaggaggccgccaacttcaccgctcaggttattatcatgaaccaccccggacagatcggtaacgggtacgccccggtgctggattgccacacttctcacatcgctgtgaagtttgccgagatcttgaccaaggttgacaggcgatctggtaaggagctcgagaaggagcccaagttcttgaagaacggtgacgctggtttcgtgaagatgattcccaccaagccgatgacggtggagactttcgctgagtacccacctttgggtcgtttcgccgtgcgcgacatgaggcagacggtggctgtgggagttatcaaggctgtggagaagaaggacgcgactggtgccaaggtgaccaaggccgctgccaagaagaagtaaaaaggttgtaagaattttggggagcagttggtttggctttggttatgcccgttctgtcttcgcacttcggacctgcctgctgtgtctggattggaatttgtaatagacaagatgcatcacacatgcatgtgaattttcatcgaataaatacatttccgatctacgatttctttaatttcgaaggataactttacacactaccgaagagaacagtcgatgaaatatcattctccgacttttcaatctttatgtaggaggtttttcagatccttggaggatgctcatttgaaatgtgatattttttcctagtaagccagacagaatatcagatgtatc

SEQ ID NO: 1219 - DNA, 1742 bp, Ceratodon purpureus
tcggccttcgctccttgaacaccgtgtgggctcagctacttgagtgacgatgtcaagcgccgattctacaagaactggtacaagtccaagaagaaagccttctccaagtacagcaagcgctatgagaccgagagggcaagaaggatttggagtcagagctggagcgcatgaagaagtacgcgacccgccctcttcctgcttcgccaggaactccagattattcaagatgggtaaggagaaggttcatatcaacatcgtggtcattggccatgtcgactccggaaagtcgacaaccaccggacacttgatctataagttgggtggtatcgacaagcgtgtgatcgagcgtttcgagaaggaggcggctgagatgaacaagcgttccttcaagtacgcgtgggtgttggacaagctgaaggctgagcgtgagcgtggtattaccatcgatatcgccttgtggaagttcgagacggtgaagtactactgcaccgttatcgatgcccctggacatcgtgattttatcaagaacatgattacgggaacttctcaggccgattgcgctgtgctgatcatcgactcgacgaccggaggtttcgaggccggtatctcgaaggatgggcagacccgtgagcacgctttgttggctttcactttgggagtgaagcagatgatttgctgctgcaacaagatggacgcgaccaccccgaagtacagcaaggctcgtttcgaggagatcacgaaggaggtgtcctcctacctgaagaaggtgggatacaaccccgacaagatcccgtttgtgcccatctctgggttcgagggtgacaacatgattgagaggtcgtcgaacctggactggtacaagggccctactctgttggaggccttggacgccgttacggagcccaagaggccgtccgacaagcccctgcggttgccccttcaggacgtttacaagattggaggcattggaactgtgccggtgggacgtgtggagactggtgtaatcaagcccggtatgttggtgtgcttcgcccccactggactgaccactgaggtgaagtccgtggagatgcaccacgagtctatgccggaggcccaccccggtgacaacgtgggattcaatgttaagaacgtggcggtgaaggacctgaagagagggttcgttgcttctgactctaagaacgaccccgcgaaggaggccgccaacttcaccgctcaggttattatcatgaaccaccccggacagatcggtaacgggtacgccccggtgctggattgccacacttctcacatcgctgtgaagtttgccgagatcttgaccaaggttgacaggcgatctggtaaggagctcgagaaggagcccaagttcttgaagaacggtgacgctggtttcgtgaagatgattcccaccaagccgatgacggtggagactttcgctgagtacccacctttgggtcgtttcgccgtgcgcgacatgaggcagacggtcgctgtgggagttatcaaggctgtggagaagaaggacgcgactggtgccaaggtgaccaaggccgctgccaagaagaagtgaataggtcaggatgagccgcagcagcagtttgttgtgttctgtagttgtttggcggctctagattgttcgcactatgtgcgtgttcgatatacttgctgcaggcgcggcagagacagacctgggtacttgaccggagatggcagggcctggcgtgatctgattgttatcattc

SEQ ID NO: 1220 - DNA, 2182 bp, Ceratodon purpureus
cacagccccgggataaacccccggcaaaagccaccaaccgtgaggagcggaacaccgtcggatcccacatcgacggctgccacagcgcagaaccctggggaaaccctgagaggcaaggcgcggcgcagatcccacgcagcaacggagtatatgacctgctctcgcacacctcagacgcccctttcgccaagactccgccgcctccacctcgccctcttcctgcttcgccaggaactccagattattcaagatgggtaaggagaaggttcatatcaacatcgtggtcattggccatgtcgactccggaaagtcgacaaccaccggacacttgatctataagttgggtggtatcgacaagcgtgtgatcgagcgtttcgagaaggaggcggctgagatgaacaagcgttccttcaagtacgcgtgggtgttggacaagctgaaggctgagcgtgagcgtggtattaccatcgatatcgccttgtggaagttcgagacggtgaagtactactgcaccgttatcgatgcccctggacatcgtgattttatcaagaacatgattacgggaacttctcaggccgattgcgctgtgctgatcatcgactcgacgaccggaggtttcgaggccggtatctcgaaggatgggcagacccgtgagcacgctttgttggctttcactttgggagtgaagcagatgatttgctgctgcaacaagatggacgcgaccaccccgaagtacagcaaggctcgtttcgaggagatcacgaaggaggtgtcctcctacctgaagaaggtgggatacaaccccgacaagatcccgtttgtgcccatctctgggttcgagggtgacaacatgattgagaggtcgtcgaacctggactggtacaagggccctactctgttggaggccttggacgccgttacggagcccaagaggccgtccgacaagcccctgcggttgccccttcaggacgtttacaagattggaggcattggaactgtgccggtgggacgtgtggagactggtgtaatcaagcccggtatgttggtgtgcttcgcccccactggactgaccactgaggtgaagtccgtggagatgcaccacgagtctatgccggaggcccaccccggtgacaacgtgggattcaatgttaagaacgtggcggtgaaggacctgaagagagggttcgttgcttctgactctaagaacgaccccgcgaaggaggccgccaacttcaccgctcaggttattatcatgaaccaccccggacagatcggtaacgggtacgccccggtgctggattgccacacttctcacatcgctgtgaagtttgccgagatcttgaccaaggttgacaggcgatctggtaaggagctcgagaaggagcccaagttcttgaagaacggtgacgctggtttcgtgaagatgattcccaccaagccgatgacggtggagactttcgctgagtacccacctttgggtcgtttcgccgtgcgcgacatgaggcagacggtcgctgtgggagttatcaaggctgtggagaagaaggacgcgactggtgccaaggtgaccaaggccgctgccaagaagaagtaaaaaggttgtaagaattttggggagcagttggtttggctttggttatgcccgttctgtcttcgcacttcggacctgcctgctgtgtctggattggaatttgtaatagacaagatgcatcacacatgcatgtgaattttcatcgaataaatacatttccgatctacgatttctttaatttcgaaggataactttacacactaccgaagagaacagtcgatgaaatatcattctccgacttttcaatctttatgtaggaggttttcagatccttggaggatgctcatttgaaatgtgatattttttcctagtaagccagacagaatatcagatgtatcggacttctagtggagtgatttctaactacttagaaggttttgtagtgaatgtcttgcacaaagttcttacggatttgctgtctggcctgtaaagggggttgtttacttacaaatctctctccacacccactcactgttggcgaaaacagcggaagatcgttgatgttatactatgtgtgatcaggttatcgtcctctattcaagccttaatattttcacctcttcaaaaagttgtaagtcgattataatgtgt

SEQ ID NO: 1221 - DNA, 1622 bp, Ceratodon purpureus
ccccctccgcccccgccctctcttcctgcttcgccaggaccccagctcagattattcaagatgggtaaggagaaggtacatatcaacattgtggtcatcggccatgtcgactccggaaagtcgacgaccaccggacacttgatctataagttgggtggtattgacaagcgtgtgatcgagcgtttcgagaaggaggcggctgagatgaacaagcgttccttcaagtacgcgtgggtgttggacaagctgaaggctgagcgtgagcgtggtattaccatcgatatcgcgttgtggaagttcgagacggtgaagtactactgcaccgttattgatgcccccggacatcgtgatttcatcaagaacatgattacgggaacttctcaggccgattgcgccgtgctgatcatcgactcgacgaccggaggttttgaggccggtatctcgaaggatgggcagacccgtgagcacgctttgttggctttcactttgggagtgaagcagatgatctgctgctgcaacaagatggacgcgaccaccccgaagtacagcaaggcccgtttcgaggagatcacgaaggaggtgtcctcctacctgaagaaggtgggatacaaccccgacaagatcccgttcgtgcccatctctgggttcgagggtgacaacatgattgagaggtcgtcgaacctggactggtacaagggccctactctgttggaggctctggacgccgttacggagcccaagaggccgtccgacaagcccctccggttgccccttcaggacgtatacaagattggaggcattggaactgtgcctgtgggacgtgtggagactggtgtgatcaagcccggtatgttagtgtgcttcgcccccactggactgaccacggaggtgaagtctgtggagatgcaccacgagtccatgcccgaggcccaccccggtgacaacgtgggattcaacgttaagaacgtggcggtgaaggacctgaagagagggttcgttgcttctgactctaagaacgatcccgcgaaggaggccgccaacttcaccgctcaggttatcatcatgaaccaccccggacagatcggtaacgggtacgccccggtgctggattgccacacttctcacatcgctgtgaagtttgccgagatcttgaccaaggttgacaggcgatcgggtaaggagctggagaaggagcccaagttcctgaagaacggtgacgctggtttcgtgaagatgattccgaccaagccgatgacggtggagactttcgctgagtacccacctttgggtcgtttcgccgtgcgtgacatgaggcagacggtggctgtgggagtgatcaaggctgtggagaagaaggacgcgactggtgccaaggtgaccaaggccgctgccaagaagaagtgaataggtcaggatgagccgcagcagcagttttgtttgtgttctgtagttgttttggcggctctagatttgttcgcactatgtgcgtgttcgatatacttgctgcaggcgcggcagagacagacctgggtacttgaccggagatggcagggcctggcgtgatctgattgttatcattcttctctattataatatctaagtctgcgttgattcgcaattcg

SEQ ID NO: 1222 - DNA, 1753 bp, Ceratodon purpureus
ctgctctcgcacacctcagacgcccctttcgccaagactccgccgcctccacctcgccctcttcctgcttcgccaggaactccagattattcaagatgggtaaggagaaggttcatatcaacatcgtggtcattggccatgtcgactccggaaagtcgacaaccaccggacacttgatctataagttgggtggtatcgacaagcgtgtgatcgagcgtttcgagaaggaggcggctgagatgaacaagcgttccttcaagtacgcgtgggtgttggacaagctgaaggctgagcgtgagcgtggtattaccatcgatatcgccttgtggaagttcgagacggtgaagtactactgcaccgttatcgatgcccctggacatcgtgattttatcaagaacatgattacgggaacttctcaggccgattgcgctgtgctgatcatcgactcgacgaccggaggtttcgaggccggtatctcgaaggatgggcagacccgtgagcacgctttgttggctttcactttgggagtgaagcagatgatttgctgctgcaacaagatggacgcgaccaccccgaagtacagcaaggctcgtttcgaggagatcacgaaggaggtgtcctcctacctgaagaaggtgggatacaaccccgacaagatcccgtttgtgcccatctctgggttcgagggtgacaacatgattgagaggtcgtcgaacctggactggtacaagggccctactctgttggaggccttggacgccgttacggagcccaagaggccgtccgacaagcccctgcggttgccccttcaggacgtttacaagattggaggcattggaactgtgccggtgggacgtgtggagactggtgtaatcaagcccggtatgttggtgtgcttcgcccccactggactgaccactgaggtgaagtccgtggagatgcaccacgagtctatgccggaggcccaccccggtgacaacgtgggattcaatgttaagaacgtggcggtgaaggacctgaagagagggttcgttgcttctgactctaagaacgaccccgcgaaggaggccgccaacttcaccgctcaggttattatcatgaaccaccccggacagatcggtaacgggtacgccccggtgctggattgccacacttctcacatcgctgtgaagtttgccgagatcttgaccaaggttgacaggcgatctggtaaggagctcgagaaggagcccaagttcttgaagaacggtgacgctggtttcgtgaagatgattcccaccaagccgatgacggtggagactttcgctgagtacccacctttgggtcgtttcgccgtgcgcgacatgaggcagacggtcgctgtgggagttatcaaggctgtggagaagaaggacgcgactggtgccaaggtgaccaaggccgctgccaagaagaagtaaaaaggttgtaagaattttggggagcagttggtttggctttggttatgcccgttctgtcttcgcacttcggacctgcctgctgtgtctggattggaatttgtaatagacaagatgcatcacacatgcatgtgaattttcatcgaataaatacatttccgatctacgatttctttaatttcgaaggataactttacacactaccgaagagaacagtcgatgaaatatcattctccgacttttcaatctttatgtaggaggttttcagatccttggaggatgctcatttgaaatgtgatattttttcctagtaagcc

SEQ ID NO: 1223 - DNA, 1744 bp, Ceratodon purpureus
gcccctttcgccaagactccgccgcctcccctcgccctcttcctgcttcgccaggaactccagattattcaagatgggtaaggagaaggttcatatcaacatcgtggtcattggccatgtcgactccggaaagtcgacaaccaccggacacttgatctataagttgggtggtatcgacaagcgtgtgatcgagcgtttcgagaaggaggcggctgagatgaacaagcgttccttcaagtacgcgtgggtgttggacaagctgaaggctgagcgtgagcgtggtattaccatcgatatcgccttgtggaagttcgagacggtgaagtactactgcaccgttatcgatgcccccggacatcgtgatttcatcaagaacatgattacgggaacctctcaggccgattgcgctgtgctgatcatcgactcgacgaccggaggttttgaggccggtatctcgaaggatgggcagacccgtgagcacgctttgttggctttcactttgggagtgaagcagatgatttgctgctgcaacaagatggacgcgaccaccccgaagtacagcaaggctcgtttcgaggagatcacgaaggaggtgtcctcctacctgaagaaggtgggatacaaccccgacaagatcccgtttgtgcccatctctgggtttgagggtgacaacatgattgagaggtcgtcgaacctggactggtacaagggccctactctgttggaggccttggacgccgttacggagcccaagaggccgtccgacaagcccctgcggttgccccttcaggacgtttacaagattggaggcattggaactgtgccggtgggacgtgtggagactggtgtgatcaagcccggtatgttggtgtgcttcgcccccactggactgaccactgaggtgaagtctgtggagatgcaccacgagtctatgccggaggcccaccccggtgacaacgtgggattcaatgttaagaacgtggcggtgaaggacctgaagagagggttcgttgcttctgactctaagaacgaccccgcgaaggaggccgccaacttcaccgctcaggttattatcatgaaccaccccggacagatcggtaacgggtacgccccggtgctggattgccacacttctcacatcgctgtgaagtttgccgagatcttgaccaaggttgacaggcgatctggtaaggagctcgagaaggagcccaagttcttgaagaacggtgacgctggtttcgtgaagatgattcccaccaagccgatgacggtggagactttcgctgagtacccacctttgggtcgtttcgccgtgcgcgacatgaggcagacggtcgctgtgggagttatcaaggctgtggagaagaaggacgcgactggtgccaaggtgaccaaggccgctgccaagaagaagtaaaaaggttgtaagaattttggggagcagttggtttggctttggttatgcccgttctgtcttcgcacttcggacctgcctgctgtgtctggattggaatttgtaatagacaagatgcatcacacatgcatgtgaatttcatcgaataaatacatttccgatctacgatttctttaatttcgtaaggataactttacacactaccgaagagaacagtcgatgaaatatcattctccgactttccaatctttatgtaggaggttttcagatccttggaggatgctcatttgaaatgtgatattttcctagtaagccagacagaatatcaga

SEQ ID NO: 1224 - DNA, 1620 bp, Ceratodon purpureus
ccccctccgcccccgccctctcttcctgcttcgccaggaccccagctcagattattcaagatgggtaaggagaaggtacatatcaacattgtggtcatcggccatgtcgactccggaaagtcgacgaccaccggacacttgatctataagttgggtggtattgacaagcgtgtgatcgagcgtttcgagaaggaggcggctgagatgaacaagcgttccttcaagtacgcgtgggtgttggacaagctgaaggctgagcgtgagcgtggtattaccatcgatatcgcgttgtggaagttcgagacggtgaagtactactgcaccgttattgatgcccccggacatcgtgatttcatcaagaacatgattacgggaacttctcaggccgattgcgccgtgctgatcatcgactcgacgaccggaggttttgaggccggtatctcgaaggatgggcagacccgtgagcacgctttgttggctttcactttgggagtgaagcagatgatctgctgctgcaacaagatggacgcgaccaccccgaagtacagcaaggcccgtttcgaggagatcacgaaggaggtgtcctcctacctgaagaaggtgggatataaccccgacaagatcccgtttgtgcccatctctgggttcgagggtgacaacatgattgagaggtcgtcgaacctggactggtacaagggccctactctgttggaggcgttggacgccgtgacggagcccaagaggccgtccgacaagcccctccggttgccccttcaggacgtatacaagattggaggcattggaactgtgcctgtgggacgtgtggagactggtgtgatcaagcccggtatgttggtgtgcttcgcccccactggactgaccaccgaggttaagtctgtggagatgcaccacgagtccatgcccgaggcccaccccggtgacaacgtgggattcaacgttaagaacgtggcggtgaaggacctgaagagagggttcgttgcttctgactctaagaacgaccccgcgaaggaggccgccaacttcaccgctcaggttatcatcatgaaccaccccggacagatcggtaacgggtacgccccggtgctggactgccacacttctcacatcgccgtgaagtttgccgagatcttgaccaaggttgacaggcgatcgggtaaggagctggagaaggagcccaagttcttgaagaacggtgacgctggtttcgtgaagatgattccgacgaagccgatgacggtggagactttcgctgagtacccacctttgggtcgtttcgccgtgcgcgacatgaggcagacggtggctgtgggagtgatcaaggctgtggagaagaaggacgcgactggtgccaaggtgaccaaggccgctgccaagaagaagtgaataggtcaggatgagccgcagcagcagttttgtttgtgttctgtagttgttttggcggctctagatttgttcgcactatgtgcgtgttcgatatacttgctgcaggcgcggcagagacagacctgggtacttgaccggagatggcagggcctggcgtgatctgattgttatcattcttctctattataatatctaagtctgcgttgattcgcaatt

SEQ ID NO: 1225 - DNA, 1622 bp, Ceratodon purpureus
ccccctccgcccccgccctctcttcctgcttcgccaggaccccagctcagattattcaagatgggtaaggagaaggtacatatcaacattgtggtcatcggccatgtcgactccggaaagtcgacgaccaccggacacttgatctataagttgggtggtattgacaagcgtgtgatcgagcgtttcgagaaggaggcggctgagatgaacaagcgttccttcaagtacgcgtgggtgttggacaagctgaaggctgagcgtgagcgtggtattaccatcgatatcgcgttgtggaagttcgagacggtgaagtactactgcaccgttattgatgcccccggacatcgtgatttcatcaagaacatgattacgggaacttctcaggccgattgcgccgtgctgatcatcgactcgacgaccggaggttttgaggccggtatctcgaaggatgggcagacccgtgagcacgctttgttggctttcactttgggagtgaagcagatgatctgctgctgcaacaagatggacgcgaccaccccgaagtacagcaaggcccgtttcgaggagatcacgaaggaggtgtcctcctacctgaagaaggtgggatataaccccgacaagatcccgtttgtgcccatctctgggttcgagggtgacaacatgattgagaggtcgtcgaacctggactggtacaagggccctactctgttggaggcgttggacgccgtgacggagcccaagaggccgtccgacaagcccctccggttgccccttcaggacgtatacaagattggaggcattggaactgtgcctgtgggacgtgtggagactggtgtgatcaagcccggtatgttggtgtgcttcgcccccactggactgaccaccgaggttaagtctgtggagatgcaccacgagtccatgcccgaggcccaccccggtgacaacgtgggattcaacgttaagaacgtggcggtgaaggacctgaagagagggttcgttgcttctgactctaagaacgaccccgcgaaggaggccgccaacttcaccgctcaggttatcatcatgaaccaccccggacagatcggtaacgggtacgccccggtgctggactgccacacttctcacatcgccgtgaagtttgccgagatcttgaccaaggttgacaggcgatcgggtaaggagctggagaaggagcccaagttcttgaagaacggtgacgctggtttcgtgaagatgattccgacgaagccgatgacggtggagactttcgctgagtacccacctttgggtcgtttcgccgtgcgcgacatgaggcagacggtggctgtgggagtgatcaaggctgtggagaagaaggacgcgactggtgccaaggtgaccaaggccgctgccaagaagaagtgaataggtcaggatgagccgcagcagcagttttgtttgtgttctgtagttgttttggcggctctagatttgttcgcactatgtgcgtgttcgatatacttgctgcaggcgcggcagagacagacctgggtacttgaccggagatggcagggcctggcgtgatctgattgttatcattcttctctattataatatctaagtctgcgttgattcgcaattcg

SEQ ID NO: 1226 - DNA, 1652 bp, Ceratodon purpureus
gtcctcatcaatcctccatcgccgctgctcacctccttcgactccgcctccttcctgctctgccaggaccccagactattcaagatgggtaaggagaaggtacatatcaacattgtggtcatcggccatgtcgactccggaaagtcgacgaccaccggacacttgatctataagttgggtggtatcgacaagcgtgtgatcgagcgtttcgagaaggaggcggctgagatgaacaagcgttccttcaagtacgcgtgggtgttggacaagctgaaggcggagcgtgagcgtggtattaccatcgatatcgcgttgtggaagttcgagacggtgaagtactactgcaccgttatcgatgcccccggacatcgcgatttcatcaagaacatgattacgggaacttctcaggccgactgcgctgtgctgatcatcgactcgacgaccggaggtttcgaggccggtatctcgaaggatgggcagacccgtgagcacgctttgttggctttcactttgggagtgaagcagatgatctgctgctgcaacaagatggacgcgaccaccccgaagtacagcaaggcccgtttcgaggagatcacgaaggaggtgtcctcctacctgaagaaggtgggatacaaccccgacaagatcccgttcgtgcccatctctgggttcgagggtgacaacatgattgagaggtcgtcgaacctggactggtacaagggccctactctgttggaggcgttggacgccgtgacggagcccaagaggccgtccgacaagcccctccggttgccccttcaggacgtatacaagattggaggcattggaactgtgccggtgggacgtgtggagactggtgtgatcaagcccggtatgttggtgtgcttcgcccctactggactgaccacggaggtgaagtctgtggagatgcaccacgagtctatgccggaggcgcaccccggtgacaacgtgggattcaacgttaagaacgtggcggtgaaggacctgaagagagggttcgttgcttctgactctaagaacgaccccgcgaaggaggccgccaacttcaccgctcaggttatcatcatgaaccaccccggacagatcggtaacgggtacgccccggtgctggattgccacacttctcacatcgccgtgaagtttgccgagatcttgaccaaggttgacaggcgatcgggtaaggagctggagaaggagcccaagttcttgaagaacggtgacgctggtttcgtgaagatgattccgaccaagccgatgacggtggagactttcgctgagtacccacctttgggtcgtttcgccgtgcgcgacatgaggcagacggtggctgtgggagtgatcaaggctgtggagaagaaggacgcgactggtgccaaggtgaccaaggccgctgccaagaagaagtgaataggtcaggatgagccgcagcagcagttttgtttgtgttctgtagttgttttggcggctctagatttgttcgcactatgtgcgtgttcgatatacttgctgcaggcgcggcagagacagacctgggtacttgatcggagatggcagggcttgtcgtctccgtgattgttatcattcttcttctctattataatatctgaagcttttgcgtgaattcgcgattc

SEQ ID NO: 1227 - DNA, 2052 bp, Ceratodon purpureus
gactccgccgcctccacctcgccctcttcctgcttcgccaggaactccagattattcaagatgggtaaggagaaggttcatatcaacatcgtggtcattggccatgtcgactccggaaagtcgacaaccaccggacacttgatctataagttgggtggtatcgacaagcgtgtgatcgagcgtttcgagaaggaggcggctgagatgaacaagcgttccttcaagtacgcgtgggtgttggacaagctgaaggctgagcgtgagcgtggtattaccatcgatatcgccttgtggaagttcgagacggtgaagtactactgcaccgttatcgatgcccctggacatcgtgattttatcaagaacatgattacgggaacttctcaggccgattgcgctgtgctgatcatcgactcgacgaccggaggtttcgaggccggtatctcgaaggatgggcagacccgtgagcacgctttgttggctttcactttgggagtgaagcagatgatttgctgctgcaacaagatggacgcgaccaccccgaagtacagcaaggctcgtttcgaggagatcacgaaggaggtgtcctcctacctgaagaaggtgggatacaaccccgacaagatcccgtttgtgcccatctctgggtttgagggtgacaacatgattgagaggtcgtcgaacctggactggtacaagggccctactctgttggaggccttggacgccgttacggagcccaagaggccgtccgacaagcccctgcggttgccccttcaggacgtttacaagattggaggcattggaactgtgccggtgggacgtgtggagactggtgtaatcaagcccggtatgttggtgtgcttcgcccccactggactgaccactgaggtgaagtccgtggagatgcaccacgagtctatgccggaggcccaccccggtgacaacgtgggattcaatgttaagaacgtggcggtgaaggacctgaagagagggttcgttgcttctgactctaagaacgaccccgcgaaggaggccgccaacttcaccgctcaggttattatcatgaaccaccccggacagatcggtaacgggtacgccccggtgctggattgccacacttctcacatcgctgtgaagtttgccgagatcttgaccaaggttgacaggcgatctggtaaggagctcgagaaggagcccaagttcttgaagaacggtgacgctggtttcgtgaagatgattcccaccaagccgatgacggtggagactttcgctgagtacccacctttgggtcgtttcgccgtgcgcgacatgaggcagacggtcgctgtgggagttatcaaggctgtggagaagaaggacgcgactggtgccaaggtgaccaaggccgctgccaagaagaagtaaaaaggttgtaagaattttggggagcagttggtttggctttggttatgcccgttctgtcttcgcacttcggacctgcctgctgtgtctggattggaatttgtaatagacaagatgcatcacacatgcatgtgaattttcatcgaataaatacatttccgatctacgatttctttaatttcgaaggataactttacacactaccgaagagaacagtcgatgaaatatcattctccgacttttcaatctttatgtaggaggttttcagatccttggaggatgctcatttgaaatgtgatattttttcctagtaagccagacagaatatcagatgtatcggacttctagtggagtgatttctaactacttagaaggttttgtagtgaatgtcttgcacaaagttcttacggatttgctgtctggcctgtaaaggggggttgtttacttacaaatctctctccacacccactcactgttggcgaaaacagcggaagatcgttgatgttatactatgtgtgatcaggttatcgtcctctattcaagccttaatattttcacctcttcaaaagttgtaagtcgattataatgtgtataggtggccgacgtatctcgcgagtgttcagtgatcatgatggagtaagaataaatgaa

SEQ ID NO: 1228 - DNA, 1980 bp, Ceratodon purpureus
tcgcacacctcagacgcccctttcgccaagactccgccgcctccacctcgccctcttcctgcttcgccaggaactccagattattcaagatgggtaaggagaaggttcatatcaacatcgtggtcattggccatgtcgactccggaaagtcgacaaccaccggacacttgatctataagttgggtggtatcgacaagcgtgtgatcgagcgtttcgagaaggaggcggctgagatgaacaagcgttccttcaagtacgcgtgggtgttggacaagctgaaggctgagcgtgagcgtggtattaccatcgatatcgccttgtggaagttcgagacggtgaagtactactgcaccgttatcgatgcccctggacatcgtgattttatcaagaacatgattacgggaacttctcaggccgattgcgctgtgctgatcatcgactcgacgaccggaggtttcgaggccggtatctcgaaggatgggcagacccgtgagcacgctttgttggctttcactttgggagtgaagcagatgatttgctgctgcaacaagatggacgcgaccaccccgaagtacagcaaggctcgtttcgaggagatcacgaaggaggtgtcctcctacctgaagaaggtgggatacaaccccgacaagatcccgtttgtgcccatctctgggttcgagggtgacaacatgattgagaggtcgtcgaacctggactggtacaagggccctactctgttggaggccttggacgccgttacggagcccaagaggccgtccgacaagcccctgcggttgccccttcaggacgtttacaagattggaggcattggaactgtgccggtgggacgtgtggagactggtgtaatcaagcccggtatgttggtgtgcttcgcccccactggactgaccactgaggtgaagtccgtggagatgcaccacgagtctatgccggaggcccaccccggtgacaacgtgggattcaatgttaagaacgtggcggtgaaggacctgaagagagggttcgttgcttctgactctaagaacgaccccgcgaaggaggccgccaacttcaccgctcaggttattatcatgaaccaccccggacagatcggtaacgggtacgccccggtgctggattgccacacttctcacatcgctgtgaagtttgccgagatcttgaccaaggttgacaggcgatctggtaaggagctcgagaaggagcccaagttcttgaagaacggtgacgctggtttcgtgaagatgattcccaccaagccgatgacggtggagactttcgctgagtacccacctttgggtcgtttcgccgtgcgcgacatgaggcagacggtcgctgtgggagttatcaaggctgtggagaagaaggacgcgactggtgccaaggtgaccaaggccgctgccaagaagaagtaaaaaggttgtaagaattttggggagcagttggtttggctttggttatgcccgttctgtcttcgcacttcggacctgcctgctgtgtctggattggaatttgtaatagacaagatgcatcacacatgcatgtgaattttcatcgaataaatacatttccgatctacgatttctttaatttcgaaggataactttacacactaccgaagagaacagtcgatgaaatatcattctccgacttttcaatctttatgtaggaggttttcagatccttggaggatgctcatttgaaatgtgatatttttcctagtaagccagacagaatatcagatgtatcggacttctagtggagtgatttctaactacttagaaggttttgtagtgaatgtcttgcacaaagttcttacggatttgctgtctggcctgtaaaggggggttgtttacttacaaatctctctccacacccactcactgttggcgaaaacagcggaagatcgttgatgttatactatgtgtgatcaggttatcgtcctctattcaagccttaata

SEQ ID NO: 1229 - DNA, 1804 bp, Ceratodon purpureus
gtcctcatcaatcctccatcgccgctgctcacctccttcgactccgcctccttcctgctctgccaggaccccagactattcaagatgggtaaggagaaggtacatatcaacattgtggtcatcggccatgtcgactccggaaagtcgacgaccaccggacacttgatctataagttgggtggtatcgacaagcgtgtgatcgagcgtttcgagaaggaggcggctgagatgaacaagcgttccttcaagtacgcgtgggtgttggacaagctgaaggctgagcgtgagcgtggtattaccatcgatatcgccttgtggaagttcgagacggtgaagtactactgcaccgttatcgatgcccccggacatcgtgatttcatcaagaacatgattacgggaacctctcaggccgattgcgctgtgctgatcatcgactcgacgaccggaggttttgaggccggtatctcgaaggatgggcagacccgtgagcacgctttgttggctttcactttgggagtgaagcagatgatttgctgctgcaacaagatggacgcgaccaccccgaagtacagcaaggctcgtttcgaggagatcacgaaggaggtgtcctcctacctgaagaaggtgggatacaaccccgacaagatcccgtttgtgcccatctctgggtttgagggtgacaacatgattgagaggtcgtcgaacctggactggtacaagggccctactctgttggaggccttggacgccgttacggagcccaagaggccgtccgacaagcccctgcggttgccccttcaggacgtttacaagattggaggcattggaactgtgccggtgggacgtgtggagactggtgtaatcaagcccggtatgttggtgtgcttcgcccccactggactgaccactgaggtgaagtccgtggagatgcaccacgagtctatgccggaggcccaccccggtgacaacgtgggattcaatgttaagaacgtggcggtgaaggacctgaagagagggttcgttgcttctgactctaagaacgaccccgcgaaggaggccgccaacttcaccgctcaggttattatcatgaaccaccccggacagatcggtaacgggtacgccccggtgctggattgccacacttctcacatcgctgtgaagtttgccgagatcttgaccaaggttgacaggcgatctggtaaggagctcgagaaggagcccaagttcttgaagaacggtgacgctggtttcgtgaagatgattcccaccaagccgatgacggtggagactttcgctgagtacccacctttgggtcgtttcgccgtgcgcgacatgaggcagacggtcgctgtgggagttatcaaggctgtggagaagaaggacgcgactggtgccaaggtgaccaaggccgctgccaagaagaagtaaaaaggttgtaagaattttggggagcagttggtttggctttggttatgcccgttctgtcttcgcacttcggacctgcctgctgtgtctggattggaatttgtaatagacaagatgcatcacacatgcatgtgaattttcatcgaataaatacatttccgatctacgatttctttaatttcgaaggataactttacacactaccgaagagaacagtcgatgaaatatcattctccgactttcaatctttatgtaggaggttttcagatccttggaggatgctcatttgaaatgtgatattttttcctagtaagccagacagaatatcagatgtatcggactcctagtggagtgatttctaactacttagaaggttttg

SEQ ID NO: 1230 - DNA, 1468 bp, Cucumis sativus
tatgggtaaggagaaggttcacattaacattgtggtcattggccatgtcgattctgggaaatcgaccaccactggccatttgatttacaagcttggaggtattgacaagcgtgttattgagaggtttgagaaggaagctgctgagatgaacaagagatcgttcaaatatgcttgggttttggacaagcttaaggctgaacgtgagcgcggaatcacaattgatattgctttgtggaagttcgagaccgccaagtactactgcactgtgattgatgctcctgggcatcgtgatttcatcaagaacatgattactggtacttcccaggctgactgtgctgttcttatcattgattcaactaccggaggttttgaagctggtatttctaaggatgggcagactcgtgaacatgcccttcttgcctttacccttggtgttcgacaaatgatctgctgctgcaacaagatggatgccactactcccaaatactccaaatctagatacgatgaaatcgtcaaagaagtttcatcctacctcaagaaagttggctacaacccggacaaaatcccctttgtccccatctctggatttgaaggtgacaacatgattgaaagatccaccaatctcgactggtacaaaggccctacccttctcgaagctctcgaccaagtccacgagcccaagagaccatctgacaaaccccttcgtcttccacttcaagatgtctacaagatcggcggcattggaacagtcccagtaggccgtgtcgaaactggcattataaaacccggcatggtcgtcaccttcgctccaactggcctcactactgaagtaaaatctgttgaaatgcaccatgaagctctccaagaagctctccctggtgacaatgtgggattcaacgtgaagaatgtcgctgtaaaagatctcaaacgtggctatgttgcatcaaattcgaaagatgatccagccaaagaagctgctagtttcacctcacaagttatcatcatgaaccatccaggacagattggaaatggttatgcccctgttcttgactgccacacctctcacattgcagtcaagtttggggagattctaacaaagattgatagaagatctggtaaagaactggagaaagagcctaaattcttgaaaaatggtgatgctggattcgttaagatgatccccactaagcctatggtggtggaaacgttctctgagtatccaccacttgggagatttgcggtcagagacatgcggcaaactgtggctgttggtgtgatcaagagcgtcgaaaagaaggacccaagtggtgctaaggtcaccaaatcagctgctaagaaatctggtaagtgaattgtgcggtttgaattatgtgttgtgttttgtgtctgttttcttttcaaaacttttctccctttccctagtgagttttcacagaattgggttcttgatcgtcggtggggaaggact

SEQ ID NO: 1231 - DNA, 2109 bp, Eucalyptus grandis
ggccggggagggggcagtgtaccgacccctcgtctgctgggctcacgttgagggcgatcggggtccgccggttccgccgatttcgagcgaaggcccgcacttgcgaggcgctcgtccccgcttcttctataaaacacgaggaagttccccggcggtgggggcagaaaccctaaacccttcctccccagcagcgtcgtcatctcttcgccctctcccgtctcacgtcgcggcctcggcgaatcccgagggccctctcgttctttgagctgttaattcattaaagtttcactatgggtaaggagaaggttcacatcaacattgtggtcattggccatgttgactctgggaagtcgaccaccactggacacttgatctataagcttggaggaattgacaagcgtgttattgagaggtttgagaaggaagctgcggagatgaacaagaggtctttcaagtatgcttgggtgttggacaagctcaaggcagaacgtgaacgtggtattactattgacattgccttgtggaagtttgaaaccaccaagtactactgtactgtcattgacgctcccggtcaccgtgacttcatcaagaatatgatcactggtacctcacaggctgactgtgctgttctgatcattgactctacaactggtggttttgaagctggtatctctaaggatgggcagactagggagcatgctttgctcgctttcactcttggtgtcaagcagatgatctgttgctgcaacaagatggatgccactacccctaagtattccaaggcaaggtacgatgaaatcgttaaggaagtttcttcctacctgaagaaggtgggttataaccctgataagattccatttgtccccatttcgggctttgagggtgacaacatgattgagaggtccacaaaccttgactggtataagggccctacactcctcgaggcccttgacctgatcctagagcccaagaggcccacagacaagccactccgccttcccttacaagacgtctacaagattggtggtattggaaccgtccccgtgggacgtgttgagactgggatcctcaagcctggtatggttgtcacatttggcccttctggattgacaactgaaattaagtctgtagagatgcaccatgaagccctccaggaggctttgcctggtgacaatgttggtttcaatgtcaagaatgttgccgtgaaggatctgaagcgtggttatgtcgcttctaactcgaaggatgatcctgccaaggaggctgctactttcacctctcaggtcatcatcatgaatcatccaggtcaaattggtaatggatatgcccccgtcctcgactgccacacttctcacattgccgtcaaattttctgagatcttgactaagatagacaggcgttctggtaaggagcttgagaaggaacccaagttcttgaagaatggtgatgcaggttttgtgaagatgattcccactaagcctatggttgtggagactttctctgagtaccctccactgggccgttttgctgttagggacatgcgtcagactgtggctgttggagtcatcaagagtgttgagaagaaggacccaagtggagccaaggtgaccaagtctgctgccaagaagggtggaaaatgaactgtgcaggctcatattggttctatagcagatggaactttcattcctaaaggcagtctttttaaaaaatttgcgttcttgttgggtcattacttgctttataccgcgtcttatagtgttctctacaaacattcaagccacagaagttcgcagcactgggtgctcgacaggcgatggtggagactgttgataatctgagtaattagcatgtgaatcgattggccggtcgaggtgcgttggacttccaaggcggcttaaaagttttgaggccttgtccttgtattgaactcccttcgttgtacgtccctttgttgttaatgtcgcatactttatacgtgtccattatctacaactttatccatcggttgaattgcttaggtgatttgatagctttttagtagctggaacatgctgtgagccaagcaagtagaaaagtgatacctaatggaagctgttattcaaaaaccaa

SEQ ID NO: 1232 - DNA, 1381 bp, Fraxinus spp
aaagattcacattagcattgtggtcattggccacgtcgactctggaaagtcaaccaccactggccatttgatctacaagcttggtggtattgacaaacgtgttattgaaaggttcgagaaggaggctgctgagatgaacaagaggtcattcaagtatgcctgggtgctcgacaagctcaaggctgagcgtgaacgtggtattaccattgatattgccttgtggaaattcgagaccaccaaatattactgcacagttatcgatgctccaggacatcgtgactttatcaagaacatgattactggtacttcacaggctgactgtgctgtcctcatcattgactctaccactggtggttttgaagctggtatttccaaggatggtcagacccgtgagcatgcgttgcttgccttcacccttggtgtcaagcaaatgatttgctgctgcaacaagatggatgccactacgcctaaatactcgaagtctaggtatgatgaaattgtgaaggaagtgtcatcctacatcaagaaggtcggatacaaccctgacaagattccatttgtccccatctctggttttgagggtgacaacatgattgagaggtccaccaaccttgattggtacaagggcccaaccctcctcgacgctcttgaccagattctggagcccaagagaccctcagacaagcctctccgtctcccacttcaggatgtctacaagattggtggtattggaactgtccccgtcggccgtgttgagactggtgttatcaagcctggtatggttgtcaccttcggcccaactggtttgacaactgaagtcaagtctgttgaaatgcaccatgaggccctccaggaggctctccccggtgacaatgttgggttcaacgtcaagaatgttgcagtgaaggatctcaagcgtggttatgttgcctccaactccaaggatgaccctgccaagggtgctgctagctttacttcccaggtcatcatcatgaaccaccctggtcagatcggaaatggatatgccccagtgcttgactgccacacatcccacattgctgttaagtttgccgagctccagaccaagattgacaggcgttccggtaaggagctggagaaggagcccaagttcttgaagaacggtgatgctggtcttgttaagatgattcccaccaagcccatggtcgtggagacttttgcagagtatccacctcttggtcgttttgccgtgagggatatgcgccagacagttgctgttggtgtgatcaagagcgtggacaagaaggatccatctggtgccaaggtcaccaaagctgctgctaagaagggcgctaagtgaagaaattttatgttattgattaattacattatctattttcga

SEQ ID NO: 1233 - DNA, 1716 bp, Marchantia polymorpha
cgcaaccctagagttcctttcacttctttctctcttgcgtggagagcatcgacatcgaagagctgcatcttgtcttctgaaaggttgtcaccatgggaaaggagaaattccacatcaacatcgtcgtcattggtcatgtcgactccggaaagtcgacgaccactggtcaccttatctacaagctgggaggtattgacaagcgtgtgatcgagcgtttcgagaaggaagctgctgagatgaacaagcgttcgttcaagtacgcctgggtgctcgacaagctgaaggcagagcgcgagcgtggtatcacgatcgatattgctctgtggaagtttgagaccaacaagtactactgcactgtcatcgatgcccccggtcacagggatttcatcaagaatatgattactggaacttcccaggctgattgcgccgttctcatcatcgactcaaccaccggaggattcgaggcaggtatctctaaggatggccagacccgagagcacgctctcctggctttcactctgggtgtgaagcagatgatctgctgctgcaacaagatggatgcaaccaccccgaagtactcgaagggccgttacgacgagatcatcaaggaggtggctaactatttgaagaaggtcgggtacaaccccgacaagattcccttcgtgccaatttctggattcgaaggagacaatatgattgagcgatctactaaccttgactggtacaagggacctaccctcctcgaagctttggacagcatcagtgagcctaagaggccttccgacaagcccctcaggttgccccttcaggatgtgtacaagattggaggaattggaactgtcccagtgggacgagtggagactggagtcatcaagcccggtatgcttgtgaccttcgctcccaccggtctgaccactgaggttaagtccgtcgagatgcaccacgaagctttactcgaggctctgcccggtgacaacgtcggattcaatgtgaagaatgtcgctgtcaaggacttgaagagaggatttgttgcatccgactccaagaacgaccctgccaaggaggctgcgaacttcacctcccaggttatcatcatgaaccacccgggacagatcggaaacggatacgccccagttctcgactgccacacttcccacattgcagtaaagttttccgagatcctgaccaaggtcgatcgtcgatcaggaaaggaaattgagaaggaaccaaagtttttgaagaatggagacgccggattcgttaagatgattcccaccaagcccatgactgtggagaccttcgctgagtacccacctcttggacgattcgccgtgcgcgacatgaggcagaccgtcgccgtcggagttatcaaagccgtcgaaaagaaggagccctctggcgccaaggtcaccaaggccgccgccaagaaaaagtgaatcggggcgactgacatcacattccggataacggacgatcctgaatctgttgaccgttacgacagatgcgctaagccttgccgattgctcgataggaggaggtttcttgcccgccttcagcagacttgggtcctagacaggcggtggcaaggcttggaggacaccgtaggatatgtttcgtgattatggtgttaaagtcgattttgacacattgagttctgtatcattttcatatcaacctttaccactctgtttcgtattcgtccaaacaaaaaaaaaa

SEQ ID NO: 1234 - DNA, 1796 bp, Medicago truncatula
attttaagacacatgtctttatccttgtgtcttgatcaattgatagtttaccgttaatttccttactttttctttcttttgaagtatatacttatgttgttttctttgttgaatttgcagaactttttgtggttttaaacttttaaggacaatgggtaaggaaaaggttcacattaacattgttgtcattggccatgtcgactctgggaagtcaactaccactggtcacttgatctacaagcttggaggtattgacaagcgtgtgattgagaggtttgagaaagaagctgctgagatgaacaagcgttcatttaagtatgcttgggttcttgacaagctcaaggctgagcgtgaaagaggtatcacaattgacattgctctgtggaagtttgagaccactaagtactactgcactgtcattgatgcccctggacacagggatttcattaagaacatgattactggtacatcccaagctgattgtgctgttctcatcattgattccaccactggtggttttgaagctggtatttccaaggatggtcagactcgtgaacatgctctccttgctttcactcttggtgtgaggcaaatgatctgctgctgcaacaaggtatttgaagccactactcccaagtactccaagagcaggtatgatgaaattgtgaaggaagtatcatcctacatgaagaaggttggctataacccagataaaattccatttgttcccatctctggttttgagggagataacatgattgagcgctctacaaatcttgactggtacaagggtccaacacttcttgaggctcttgatcaaatcaatgagcctaagaggccatcagacaagcccctccgactacctcttcaggatgtctacaagattggaggaattggaactgttcctgtgggacgtgttgagactggtaccatgaaacctggaatggtggtgacttttgctccaactggactgcaaactgaagtcaagtctgtggagatgcatcatgaatctctcactgaggcacttcccggtgacaatgtgggatttaatgttaagaatgtttctgtcaaggatctcaagcgtggttatgttgcctcaaacaccaaggatgacccagccaaggaggctgctaacttcacatctcaggtgattatcatgaatcaccctggccagattggaaatggttatgcccctgttcttgactgccacacctcccacattgcagtcaagtttgctgagcttgttactaagattgacaggcgttctggtaaggagatcgagaaggagcctaaattcctgaagaatggagatgctggtattattaagatgattcccaccaagcccatggtggttgagactttctctgaatatcctccacttggccgttttgctgtcagagatatgcggcaaactgtggctgttggggttatcaagggtgtggagaagaaggaacctggcacagctaagataactaagtcagcagccaagaagaaatgaaccgtgcaggatgattttccttgggaagtttatagtcgttattacaataaatggtttgtggttcttagtatttctatttcgtgtcttgttaagttgttttttggattaagtgtgaagtctgcaccgtcatctcccagcttttgttcccagaactgggttctagatcgacggtggcatgactagttatttttcttgtttctgctttaattgtcttgtcttgtgtgaacacctgaattttacaagcagcaagtttccggacctgctgtttgtttttaatatcaactctatatctgcgtgt

SEQ ID NO: 1235 - DNA, 1769 bp, Elaeis guineensis
cctctgaggagttgaagcagccgccgatcctctccctccgcttctacgactcctcttggcgcataggttaacaacagagtagaaatgggaaaggagaaggttcacatcaacattgtggtcattggccatgtcgactctgggaaatcaactaccactggacatcttatctacaagcttggtggtatcgacaagcgtgtgattgagagattcgagaaagaagctgctgagatgaacaaaaggtcattcaagtatgcttgggtgcttgacaagctgaaggctgaacgtgaacgtggtatcaccattgatattgctctctggaagtttgagaccacaaaatactactgcactgtcatcgatgctcctggccatcgtgatttcatcaagaacatgatcacaggaacttctcaggctgattgtgccgttctcattattgattccaccactggtggttttgaagcaggaatttcgaaggatggccagactcgtgagcatgctcttctcgccttcactcttggagtcaggcagatgatctgttgctgtaataagatggatgccaccacacccaaatactcgaaagctaggtatgatgaaatcgtgaaggaggtttcatcctacctcaagaaggttggttacaaccctgacaagattcccttcgtgccaatctctggttttgaaggagataacatgatcgagaggtctaccaaccttgactggtacaagggccccaccctcctggaagcgctcgacatggtccaagaacccaaacgtccattagacaagcctctccgtcttcctctgcaggatgtctacaagattggaggcattggtactgttcctgtcggtcgtgtagagactggaatcctcaagcctggtatggttgtgacttttggaccttctggacttacaactgaagtcaagtctgtggagatgcaccatgaggctctccaggaggctctacctggagacaacgtcggcttcaatgtcaagaatgttgccgtcaaggatctgaagcgtggttatgttgcttcaaactcaaaggatgacccagcaaagggggcagccagctttaccgctcaggtcatcatcatgaaccacccaggccagattggcaatggttatgccccggttctcgactgtcacacttctcacattgctgttaagtttgcggagctcttgaccaagattgatcgtcgttctggtaaggagctggagaaggagcccaagttcctgaagaatggagatgctggttttgttaagatgattcccaccaagccaatggtagttgagaccttctctgagtaccctcctctgggtaggtttgccgttagagacatgaggcagacggttgcagtgggtgttatcaagagtgtggacaaaaaggatgctagtggagccaagataaccaaagctgcccaaaagaagaaatgaaccgagaactctgtttcgatgttgtttggagtcggtagcggttgtagtaaggtatgttcttgtcgccattatatgttcaccagtacagtatctggagtctggatgcagaactgggtgctggaccggcggtggcattgctgaagtttggtgtcttctattatgatctaccatatgcaaaacagttgagggtgtcgactttttaaatgctattttgagtttgtgttgtgtaggactctggagtgtttgctgtcatttgggtctgttttagatgctttttagtattattaaataaagtggtagttggactaaatgtgtagtatttatttatgtggtggtgattt

SEQ ID NO: 1236 - DNA, 1655 bp, Olea europaea
ctttgttctctgtaatctgcatattagttttggaggctagggtattgtagctagtttatctcttttcatcagcttaaaaatcgagttctaaaatgggcaaggagaagtttcatatcaacattgtggtcattggccatgtcgactctggaaagtcaaccactactggtcatctcatctacaagcttggaggtattgacaagcgtgtgattgagaggtttgagaaggaagctgctgagatgaacaagaggtctttcaagtatgcctgggtgcttgacaagctcaaggctgaacgtgagcgtggtatcaccattgatattgccctgtggaagttcgagaccaccaagtactactgcactgtcattgatgctcctggacatcgtgatttcattaagaatatgattactggtacttcccaggctgactgtgctgtgcttatcattgattcgaccactggtggttttgaggctggtatttctaaggatggccagacccgtgagcatgctcttcttgcttttacacttggtgtgaaacaaatgatctgctgctgtaacaagatggatgctacgacacccaagtactccaaggcaaggtacgatgaaattgttaaggaagtctcttcctacctgaagaaggttggttacaatcctgacaagattccttttgtgcccatctctggtttcgagggtgataacatgattgagagatccaccaacctggactggtacaagggaccaacactccttgaggcccttgaccagatttcggagcccaagaggcccttggacaaaccactccgtctcccacttcaggatgtctacaagattggaggtattggtactgtccctgtggggagagttgaaactggtgtccttaaacctggtatggttgttacctttggtccaactgggctgacaactgaagttaagtctgttgaaatgcatcatgaagccctctctgaagctctccccggtgacaatgttggtttcaatgtcaagaatgtttctgttaaggatcttaagcgtggttatgttgcatctgactcaaagaatgaccctgccaagggagctgagagcttcacatctcaggtcattatcatgaaccacccaggtcagattggtaatggttatgcaccagttcttgattgccacacgtcccacattgctgtcaaatttgccgagctcctgaccaagatagacaggcgttccggtaaagagcttgaaaaggaacccaaattcttgaagaatggtgatgctggaatggttaagatgattccaaccaagcccatggtggttgagactttctctgagtacccccctcttggacgatttgctgtgagggatatgcgccagactgttgccgttggtgttatcaagaatgttgacaagaaggagccatctggtgccaaggtgaccaaggctgctgccaagaagggtgccaagtgaactttgatgcctgggatctactgctgctttaattactacagatatttccattattatcataaagacttgctttatcttattcatgttgttttgagtcgtttatctcgtgttgctggttgttttccttgtcctcgtcagttgtcttcgctgtctggttatggttcccagaattgggtgctagacaggcggtggcgacgctggcatgtgagttta

SEQ ID NO: 1237 - DNA, 1808 bp, Olea europaea
aactagctttcttcagtgctttgttctctgtaatctgcatattagttttggaggctagggtattgtagctagtttatctcttttcatcagcttaaaaatcgagttctaaaatgggcaaggagaagtttcatatcaacattgtggtcattggccatgtcgactctggaaagtcaaccactactggtcatctcatctacaagcttggaggtattgacaagcgtgtgattgagaggtttgagaaggaagctgctgagatgaacaagaggtctttcaagtatgcctgggtgcttgacaagctcaaggctgaacgtgagcgtggtatcaccattgatattgccctgtggaagttcgagaccaccaagtactactgcactgtcattgatgctcctggacatcgtgatttcattaagaatatgattactggtacttcccaggctgactgtgctgtgcttatcattgattcgaccactggtggttttgaggctggtatttctaaggatggccagacccgtgagcatgctcttcttgcttttacacttggtgtgaaacaaatgatctgctgctgtaacaagatggatgctacgacacccaagtactccaaggcaaggtacgatgaaattgttaaggaagtctcttcctacctgaagaaggttggttacaatcctgacaagattccttttgtgcccatctctggtttcgagggtgataacatgattgagagatccaccaacctggactggtacaagggaccaacactccttgaggcccttgaccagatttcggagcccaagaggcccttggacaaaccactccgtctcccacttcaggatgtctacaagattggaggtattggtactgtccctgtggggagagttgaaactggtgtccttaaacctggtatggttgttacctttggtccaactgggctgacaactgaagttaagtctgttgaaatgcatcatgaagccctctctgaagctctccccggtgacaatgttggtttcaatgtcaagaatgtttctgttaaggatcttaagcgtggttatgttgcatctgactcaaagaatgaccctgccaagggagctgagagcttcacatctcaggtcattatcatgaaccacccaggtcagattggtaatggttatgcaccagttcttgattgccacacgtcccacattgctgtcaaatttgccgagctcctgaccaagatagacaggcgttccggtaaagagcttgaaaaggaacccaaattcttgaagaatggtgatgctggaatggttaagatgattccaaccaagcccatggtggttgagactttctctgagtacccccctcttggacgatttgctgtgagggatatgcgccagactgttgccgttggtgttatcaagaatgttgacaagaaggagccatctggtgccaaggtgaccaaggctgctgccaagaagggtgtcaagtgaactttgatgcctgggatctactgctgctttaattactacagatatttccattattatcataaagacttgctttatcttattcatgttgtttcgagtcgtttatctcgtgttgctggttgttttccttgtcctcgtcagttgtcttcgctgtctggttatggttcccagaattgggtgctagacaggcggtggcgacgctggcatgtgagttatttgtctattttgatattttgacattgctttatatttaaggtttctgataattttgtgttcttctcgagacattccattgttccacatctgactcattctgattgccctgcaagttttgaatgtcatgataagcct

SEQ ID NO: 1238 - DNA, 1939 bp, Populus trichocarpa
cccctcactccttccttttgttctttctgcctatcatatcttctttcgcggctagggtttaatcaaaactctctctagttcataatgggtaaagagaagtcgcacatcaacatcgtggtcattggccatgtcgactctggaaagtcgaccaccactggtcacttgatctacaagcttggaggtattgacaagcgtgtcatcgagaggtttgagaaggaagctgctgagatgaacaagaggtcattcaagtatgcttgggtgcttgacaagctcaaggctgagcgtgaacgtggtattaccattgatattgctctgtggaagttcgagaccaccaggtactactgcactgtcatcgatgctcctggacatcgtgactttataaagaacatgattaccggaacctcccaggctgactgtgcagtcctcatcattgactctaccactggtggttttgaggctggtatctccaaggatggtcagacccgtgagcatgcacttcttgcattcacccttggtgtaaagcaaatgatctgctgctgtaacaagatggatgccaccactccaaaatactccaaggctaggtacgatgaaattatcaaggaagtgtcatcctatttgaagaaagttggttacaaccctgacaagattcccttcgtgcctatctctggatttgagggtgataacatgattgagaggtccaccaaccttgactggtacaagggaccaactctcctcgatgccctcgaccagatccaggagcccaagaggccctcggacaagcccctccgtctcccccttcaggacgtgtacaagattggtggtattggaacggtcccagttggtcgtgtggaaactggtgtcatcaagcctggtacgattgtcactttcgggccaactggactaactactgaagttaagtctgttgagatgcaccacgaagcactccaagaggctcttcccggtgacaatgttggatttaatgttaagaatgttgccgtgaaggatctgaagcgtggttttgttgcctcaaactcgaaggatgatcccgccaaggaggctgcgaacttcacctcccaggtgatcatcatgaaccatcctgggcagattggaaatggttatgccccagttcttgactgccacacctgtcacattgctgtcaaatttgctgagatcctcaccaagattgacaggcgatccggcaaggagttggagaaggaacctaaattcctgaagaacggtgatgctggtatgattaagatgattcccacaaagcccatggtggtggagactttctcacagtatcccccacttggtcgttttgctgtgagggatatgcgccagactgttgctgtgggagtgatcaagaacgtggagaagaaggatgcttctagtgctaaggtgaccaaatccgctgtcaagaagggtggcaagtgagccctgcatgttgatgttaatttccatcagctatgttggatgagaattgtagttttatgtcttccgaaaggcagttgagggaattgggctcttgattggcggcggtggttccgtgattctagttttaattgattttcagcattttcttattgtctcgcaagttaaaattttggagatatttttcatgagcttctcgtgaaatttaggtcttgaaaatttggatgctaagaacttgtatcttgctttttgctttgattctgtagtgttctgtttactcattttcaatctgtagtttacaggctctgcatgtttcgtcttatggatctttcttttttgtttatatgttactttaggattataaactcttatatgggtgtcatgttacctcgtatttgtgctgctacgatttctaatgctttctatagctgattgatttagctgttaggtgcccccctctgaagcacatcaatttctccctttgttttgcgttggtcgttattgcgca

SEQ ID NO: 1239 - DNA, 1940 bp, Populus trichocarpa
cccctcactccttccttttgttctttctgcctatcatatcttctttcgcggctagggtttaatcaaaactctctccagttcataatgggtaaagagaagtcgcacatcaacatcgtggtcattggccatgtcgactctggaaagtcgaccaccactggtcacttgatctacaagcttggaggtattgacaagcgtgtcatcgagaggttcgagaaggaagctgctgagatgaacaagaggtcattcaagtatgcttgggtgcttgacaagctcaaggctgagcgtgaacgtggtattaccattgatattgctctgtggaagttcgagaccaccaggtactactgcactgtcatcgatgctcctggacatcgtgactttatcaagaacatgattaccggaacctcccaggctgactgtgcagtcctcatcattgactctaccactggtggttttgaggctggtatctccaaggatggtcagacccgtgagcatgctcttcttgccttcacccttggtgtaaagcaaatgatctgctgctgtaacaagatggatgccaccactccaaaatactccaaggctaggtacgatgaaattatcaaggaagtgtcatcctatttgaagaaagttggttacaaccctgacaagattcccttcgtgcctatctctggatttgagggtgataacatgattgagaggtccaccaaccttgactggtacaagggaccaactctcctcgatgccctcgaccagatccaggagcccaagaggccctcggacaagcccctccgtctcccccttcaggacgtgtacaagattggtggtattggaacggtcccagttggtcgtgtggaaactggtgtcatcaagcctggtacgattgtcactttcgggccaactggactaactactgaagttaagtctgttgagatgcaccacgaagcactccaagaggctcttcccggtgacaatgttggatttaatgttaagaatgttgccgtgaaggatctgaagcgtggttttgttgcctcaaactcgaaggatgatcccgccaaggaggctgcgaacttcacctcccaggtgatcatcatgaaccatcctgggcagattggaaatggttatgcccctgttcttgactgccacacctgtcacattgctgtcaaatttgctgagatcctcaccaagattgacaggcgatccggcaaggagttggagaaggaacctaaattcctgaagaacggtgatgctggtatgattaagatgattcccacgaagcccatggtggtggagactttctcagagtatcccccacttggtcgttttgctgtgagggatatgcgccagactgttgctgtgggagtgatcaagaacgtggagaagaaggatgcttctagtgctaaggtgaccaaatccgctgtcaagaagggtggcaagtgagccctgcatgttgatgttaatttccatcagctatgttggatgagaattgtagttttatgtcttccgaaaggcagttgagagaattgggctcttgattggcggcagtggttccgtgattctagttttaattgattttcagcattttcttattgtctcgcaagttaaaattttggagatatttttcatgagcttctcgtgaaatttaggtcttgaaaatttggatgctaagaacttgtatcttgttttttgctttgattctgtagtgttctgtttactcattttcaatctgtagtttacaggctctgcatgtttcgtcttatggatctttcttttttgtttatatgttactttaggattataaactcttatatgggtgtcatgttacctcgtatttgtgctgctacgatttctaatgctttctatagctgattgatttagctgttaggtgcccccctctgaagcacatcaatttctccctttgttttgcgttggtcgttattgcgcaa

SEQ ID NO: 1240 - DNA, 1673 bp, Primula obconica
gctcgtttctttgcttcggccagaattatctgctaaaagttcagtatgggcaaggaaaaggttcatatcagccttgtcgtcattggccatgtcgactccggcaagtcgacaaccactggtcaccttatctataagcttggaggtattgacaagcgtgttatcgagaggtttgagaaggaagctgctgagatgaacaagaggtcatttaagtatgcgtgggtgttggacaagctcaaggctgagcgtgaacgtggtattaccattgatattgctttgtggaagtttgagaccaccaagtactactgcacagtcatcgatgcccctggacatcgtgatttcatcaagaacatgattacgggtacttcccaagctgattgtgctgtcctcattatcgattctaccactggtggttttgaggctggtatttccaaggacggtcagacccgtgagcatgcgttgcttgctttcacccttggtgtcaggcaaatgatctgttgctgtaataagatggatgctaccacccccaagtattccaagtcaaggtacgaagaaattgtgaaggaagtgtcgtcttacctgaagaaggttggttacaaccccgaaaaagtcccatttgtgcccatctctggattcgaaggtgacaacatgattgagaggtccaccaacctcgactggtacaagggcccgacccttcttgatgctcttgaccaagtctcagagcccaagaggccctcagacaagcccctccgtctcccacttcaggacgtctacaagatcggtggcattggaacggtgccagttggtcgtgtggagacaggtgtcatcaagcccggaatggtcgtcaccttcggcccatctggtctgaccactgaggtcaagtccgtcgagatgcaccacgagtctctccttgaagctcacccaggtgacaacgttgggttcaacgttaagaatgttgctgtgaaggatctcaagcgtgggtatgttgcctctaactcgaaggacgaccctgccaagggagctgccagtttcaccgcacaggtcatcatcatgaaccacccaggccagatcggtaacggctatgctcccgtgctggattgccacacctcccacattgctgtgaaattctctgagattctgaccaagatcgataggcggtctggtaaggaactcgagaaggagcctaagttcttgaagaatggagatgctggaatggtgaagatgattcccaccaagcctatggttgtcgagactttctctgagtatccaccattgggtcgatttgctgtgagggacatgaggcagacagttgctgttggtgtgatcaagagcgttgacaagaaagatccgactggtgccaaggtgaccaaggctgcggtcaagaagggtgccaagtgaatggtgcggtttttgcgatttgttttttgttcgtcgttatgtcaagtcattgaggacttaatttctttttcgggttttggatttctaccttgtttgttacgcattaattctcagaattgggtgcttgacagacggtggcatattctctagtgtcgtgtcagtttttccttatcgtatgtatcttttgggaagtgttggtttgggaatgcttgtgttgcatccgaaggatattttgaacagctttctgtggatttattataatttatttggctagatag

SEQ ID NO: 1241 - DNA, 1843 bp, Picea glauca
cctcttcatcttgtgcgagtctctcttctccctgcgctgctgcgaagctgttcttgggttctctgattctccacactcagctcggcgtttttgttagaggctttaattcaccatgggaaaggaaaaaacccatatcaacattgtggtcattggccatgtcgactccggcaagtcaacaaccactgggcatttgatctacaagcttggaggaattgacaagcgtgtgattgaacgttttgagaaagaagctgctgagatgaacaagagatcattcaagtatgcttgggtgcttgacaagctcaaggctgaacgtgaacgtggtatcacaattgatattgcattgtggaagtttgagacaaacaaatactactgtactgtgattgatgcccctggccatcgtgatttcatcaagaacatgattactggaacctctcaggctgattgtgcagttttgatcattgattctacaactggaggttttgaagctggtatctcgaaggacggtcagactagagaacatgccctattggcgttcaccttgggagtgaagcaaatgatttgttgctgtaacaagatggatgccactactcccaagtactcaaaggctcgttacgatgaaattgtcaaggaagtatcttcttatttgaagagggttggatacaacccagacaagattccttttgtgcctatctctggttttgagggtgacaacatgattgagcgctcgaacaaccttgattggtacaagggcccaacactcttggaagcccttgaccaggtttcggagcctaagcgtcctacagacaagcctctgaggttgccccttcaggatgtttacaaaattggtggtattgggactgtgcctgttggtcgggtggaaactggaatcataaagccaggtacgattgttacctttggtcccactgggctgaccactgaagttaagtctgttgagatgcatcatgaagctctgcaggaggcatatcctggtgacaatgtgggattcaacgttaagaatgttgctgttaaggatctcaaacgtggttatgtggcatctgactccaagaacgatccagccaaggaagctgccaactttaccgctcaagttattattatgaatcatccaggacagattggaaatggttatgcccctgtgttggattgccacacttgccacattgccgtcaagttttctgagatcatgaccaaggttgacaggcgttctggcaaggaactggagaaggaacccaagtttcttaagaatggagatgccgggtttgttaagatgataccaaccaaacccatggttgtggaaaccttcgctgagtatcctccattgggtcgttttgctgtgagggacatgcgtcagacggttgctgtaggagtcatcaaagctgttgaaaagaaggaccctactggtgcaaaggtcaccaaggcagctgccaaaaagaagtgaatgttcaagcaaagtgatcgggaatggagaaatgcttgctgcattttgtgtgcttgcatgcttctctattttcctgatggtatgttagtagagttagattgtcaaatacagaattgggtgcttgatcggcggtggcagagtttacattattttctagtaaatactctttagtggtttagggcaaattgattgagatttcgtagttgtggggaaatcatcagtttgtctgcactgctaggaaatctatgcagttggagtgaggaagggtattaataatttctgttactctgttttatttttaaagcttgtattgccttacatacatggcaattttttccatattgagaagacttggaatttatgttaaagcacagttttgagaaaaaa

SEQ ID NO: 1242 - DNA, 1649 bp, Thalictrum flavum
tcatatcaacattgtcgtcattggacatgtcgactctggcaaatctaccaccactgggcatttgatctacaagctaggaggtattgacaagcgtgtcattgaaaggttcgagaaagaggctgctgagatgaacaagaggtcattcaagtatgcttgggtcctggacaaacttaaggctgaacgagaacgtggtattaccattgacattgccctatggaagtttgagaccacaaaatactactgcactgtcattgatgctccaggacatcgtgatttcattaagaacatgattactggtacatcccaggctgactgtgctgttctcatcattgactctaccactggtggttttgaagctggtatctctaaggatggccagactcgtgagcatgccctgcttgctttcacacttggtgtgaagcagatgatctgctgttgtaataagatggatgccaccaccccaaagtactccaaggctaggtacgatgaaattgtcaaggaagtctcttcctacctgaagaaggttggatacaaccccgacaaaattccatttgtacctatctctggatttgagggtgataacatgattgaaaggtccaccaaccttgactggtacaagggcccaacccttcttgaagctcttgatggtatctcagaacccaagagaccaacagacaagcccctccgtctcccacttcaggatgtttataagattggtggtattggaactgtgcctgttggtcgagttgagactggtgttctcaagcctggtatggtagtcacctttggccccactggactgaccactgaagttaagtctgttgagatgcatcatgaggcactccaagaagctctccctggtgacaatgtgggattcaatgtgaagaatgttgctgttaaggatctcaagcgtgggtttgttgcctccaactccaaggatgatcctgccagggaagctgccaatttcacttcccaagttatcatcatgaaccaccctggacagattggaaatggatatgcaccagttcttgactgccacacctcccacattgctgtcaagtttagtgagatccttaccaagattgatagacgatcaggaaaggagcttgagaaggagcccaagtttgtgaagaacggtgatgcttgttttgttaagatgcttcctaccaagcctatggtggttgagaccttctctgagtatcctccacttggtcgttttgctgtcagggacatgcgtcagacagttgctgtgggagtcatcaagagtgttgagaagaaggatcccactggcgccaaggtcaccaagtctgctgccaagaagaaatgaatcgaggcggagtctggttcatttgaagacttctattattactatcataaagatttggcatggtctactagttgctttgttggtttattttgtggttgttttggtcactataatcttctgtcttcgcaatctcttgttagtctcatccagaattgggtgcttgacaggcggtggcaaagctttagacttctttccttgtcagtttgttgagtcctgttgtagcctacattggtttttggttgttgtgacatttcctgttttgtacctttattgtttggtagtttttactattggtattgtcttccttgtcgtctttgtaatt

SEQ ID NO: 1243 - DNA, 1722 bp, Papaver somniferum
ggttttgtgaaaaagctctgtgccgcggagcttatctaatcgccgtttcagttaatttctaagaattcaatatgggtaaggagaaagttcatatcaacattgttgtcattggacatgtcgactctgggaaatcgaccaccaccggtcacttgatctacaagcttggaggtattgacaagcgtgttattgaaagattcgagaaggaggctgctgagatgaacaagaggtcattcaagtatgcatgggttcttgacaagcttaaggctgaacgtgagcgtggtattaccattgatattgccttgtggaagtttgagaccaccaagtactactgcacagttattgatgctcctggacatcgtgactttatcaaaaacatgattactggtacttctcaggctgattgtgccgtcctcattatcgattctaccactggaggttttgaggctggtatctcaaaggatggtcagactcgtgagcacgctcttcttgctttcacccttggtgtcaagcagatgatctgttgttgtaacaagatggatgccaccacccccaagtactcaaaggctaggtacgatgaaattgtgaaggaggtctcatcttacttgaagaaggttggatacaacccagaaaaaattgcctttgttcctatctctggattcgagggagacaacatgattgaaaggtccaccaaccttgactggtacaagggaccaactctccttgaggctcttgacaacatctccgagccaaagagaccctcagacaagccccttcgtcttccacttcaggatgtttacaagattggaggtattggaactgtgccagtgggacgtgttgaaactggagtcatcaagcctggtatggttgttacttttggacccaccggtttgaccactgaagttaagtctgtggagatgcaccacgaagcccttcaagaagctcttccaggagacaatgttgggttcaatgtcaagaatgttgcagtgaaggatctcaagcgtggtttcgtcgcctccaactcaaaggatgaccctgccagggaagctgccaacttcacctcccaggtcatcatcatgaaccatcctggtcagatcggtaatggttatgctccagttcttgactgtcacacatctcacattgctgtcaagtttgctgagatccaaaccaagatcgataggcgatctggaaaggagcttgagaaggagcccaagttcttgaagaacggtgatgctggtattattaagatgattccaaccaagcccatggttgtagagaccttcgctcagtacccacctcttggacgttttgctgttagggacatgaggcagacagttgctgttggtgtcatcaagggggttgagaagaaggacccaaccggagccaaagggttaccaagtctgctgtcaagaagaagtaaagtactccagtgagtacagggatggtgctaagagggtctgcagaatggttttgtcttgtttacttcagtagtagtcatttttgtttctggtttgctttggttagctatcattgcagttttatatcttttgttgcctttgttttgttgagcatccggatgcaaacctgggtgcttgataggcggtggcaacatgagtttgggctgttcagttaattgaaaaacttgttatggattttggttgtaagttgctgttaacaacttttatttgcatctctcttttcccagttaaatgaaaacagtgttct

SEQ ID NO: 1244 - DNA, 1356 bp, Eucalyptus grandis
catgggtaaagagaaggttcacatcaacatcgtggtcattggccatgtcgactctgggaagtcaactacaactggacacttgatctacaagcttggaggaattgacaagcgtgtgattgagaggtttgagaaggaagctgctgagatgaacaagagatcattcaaatacgcttgggtgcttgacaagctcaaggccgagcgtgagcgtggtatcaccatcgatattgccttgtggaagttcgagaccaccaagtactactgtactgtcattgatgctcctggacatcgtgactttattaagaacatgattacgggaacctcccaggctgactgtgctatcctcatcattgattccaccaccggtggttttgaggctggtatttccaaggatggccagacccgcgagcatgctcttctcgccttcactcttggtgtgaagcagatgatttgctgttgcaacaaggtacatttttttttatatgttacccaagtattccaagtcccgttttgatgaaatcgtgaaggaagtctcttcatacttgaagaaggtcgggtacaaccctgacaagattcccttcgtccccatctctggttttgagggtgacaacatgattgagaggtccaccaaccttgactggtacaagggccccaccctccttgaggctcttgaccagattctggagccaaagaggcctacagacaagcctctccgtctcccacttcaggatgtgtacaagattggtggtattggaactgtccccgttggtcgtgttgagaccggtgtcctcaagcctggtatggttgtcacttttggtccctctgggttgactactgaagttaagtccgtggagatgcaccatgaggctctccaggaggcccttcctggtgacaacgttgggtttaacgtgaagaatgttgctgtcaaggatctcaagcgtggcttcgttgcatccaactcaaaggatgatcccgccaaggaagcagccaacttcacctcccaagttatcatcatgaaccaccctgggcaaattggaaatggttatgcccctgttcttgattgccacacctcccacattgctgtcaagtttgccgagctgttgaccaagatcgacaggcgatcaggtaaggagcttgagaaggagcccaagttcttgaagaatggtgatgctgggatggtgaagatgattcccagcaagcccatggttgtcgagactttctctgagtatcctcctctcggtcgttttgctgtgagggacatgcgccagacggttgccgtcggtgtcatcaagagtgtcgagaagaaggatccttctggtgccaaggtcaccaaatcagccgccaagaagaaatgagaga

SEQ ID NO: 1245 - DNA, 1692 bp, Vitis vinifera
taaaggtaattcaagacgtacaccttaagtctcactgaaatgaaaacatccaagggacgtcaaaacgtttgttatccaatccaaatttgttcttcaactagaaactaaaaactcagtttactaaagaggggaagcacaatataacgggtttgtaggttttgccattgcttgtcaagccactcaggttggagcctaagtgctcaacacctccaccatccccacaagtgaggctagagtgcagcaacaaaggccataaaagcccattgagacaaaattgaccatataactaaagaagaccatagacactacttcccttagcattggttttctaaaacaaacctttcatttcttcttggcagcggacttggtaaccttggcaccacttggatccttcttctcaacactcttgataacaccgacagcaacagtttgacgcatgtccctaacagcaaaacggccaagtggagggtactcggagaaagtttccacaaccatgggcttggttggaatcatcttaacaaatccagcatcaccattcttcaagaacttgggctccttctcaagctccttgccagaccgcctgtcaatcttggtcgtaatctcagcaaacttcaccgcaatgtgggaggtgtgacagtcaaggactggggcataaccatttccaatttggccaggatggttcatgataatgacctgggctgtgaagttggcagcttcctttgcaggatcatctttggagttagatgcaacaaagccacgttttagatccttgacagcaacattcttcacattgaaaccaacattgtcaccaggcagaccctctaccaaagactcatggtgcatttcaactgacttgacttcagtagtgagtccacttggcccaaaggtgacaaccataccgggtttaataataccagtttcaacacgaccaacaggaacagtgccaatgccaccaatcttgtaaacgtcctgtagtgggagacgaaggggcttgtccgagggcctcttgggctcgtgaatcatgtcaagagcctcaaggagggtagggcccttgtaccagtcaaggtttgttgaccgctcaatcatgttgtcaccctcaaatccagagattggaacaaaggggatcttatcagggttgtaaccgaccttcttaagataggaagaaacttccttcacaatttcatcatacctggacttggagtacttcggtcaatagtaataatgcaataccttattgcaacagcagatcatttgcctgacaccaagggtgaaggcaagcaaagcatgctcacgggtctgaccatccttggaaataccagcttcaaaaccaccagtggtagaatcaatgataagcacagcacaatcagcctgtgaggtaccagtgatcatgttcttgatgaagtcacgatgcccaggagcatcaatcacagtgcaataatatttagtggtctcaaacttccacaaagcaatatcaatggtaataccgcgctcacgctcagccttgagcttgtccaagacccaagcatacttgaatgatcttttattcatttcagcggcttctttttcaaaccgctcaataacacgcttgtcaatacctccaagcttgtatatcaaatgaccagtggtggtcgactttccagagtcaacatgaccaatgaccacaatattaatgtgaaccttctccttacccat

SEQ ID NO: 1246 - DNA, 1674 bp, Amsonia hubrichtii
gagcagagccgcagacacgatccctcagtgaagctagggcttaagcacttccgagtttaatctatgggtaaggagaaggttcatattaacattgtggtcattggtcatgtggactctgggaagtccaccaccactggccatctcatttacaagcttggaggaattgacaagcgtgtgattgagaggtttgagaaggaagcagctgagatgaacaagaggtcattcaagtatgcttgggtgcttgataagcttaaggctgagagggagcgtggtattactatcgatattgctttgtggaagtttgagaccacaaagtactactgcactgttattgatgcccctgggcatcgtgactttattaagaacatgattactggaacttcccaggccgactgtggtgtgcttatcattgattccaccactggtggttttgaagctggtatttccaaggatggtcagacccgtgagcatgctcttcttgctttcacacttggagtcaggcaaatgatttgctgttgtaacaagatggatgctactactcccaaatactctaaggcaaggtatgatgaaatcgtaaaggaggtctcatcctatctgaagaaggttggttacaatcctgataagattccttttgttcctatctctggatttgagggtgacaacatgattgagaggtctacaaatctcgattggtacaagggtccaacccttcttgaggcccttgacttgctcaatgagccaaagaggccatcagacaagcctctccgactcccacttcaggatgtctacaagattggtggcattggtactgtcccagtgggaagggttgagactggtgtcctcaagccaggaatggttgtgacctttggacccagcggtcttacaactgaagttaagtctgttgagatgcaccatgaggccctccaagaagctcttcctggggacaatgttggctttaatgttaagaatgtggctgtcaaggatctcaagcgtggttatgttgcatccaactcaaaagatgatccagctaagggagctgcaaatttcaccgctcaggtcatcatcatgaaccaccctggtcaaattgggaatggctatgctcctgttctcgactgccacacttgccatattgccgtcaagttttcagagatcttgaccaagattgacaggcgatcaggtaaggagcttgaaaaggaacccaagttcttgaagaatggtgatgctggctttgtcaagatgattcccaccaagcccatggttgttgagaccttctccgagtatccgccactagggaggtttgccgtcagggacatgcgtcagactgttgctgttggtgttatcaagagtgtggataagaaggatccaagtggagctaaagttacaaaagctgcagtcaagaaatcagggaagtgaatggagctgcaaggaatttccgttgataactatctcaacatacattattgattgcttataagtcatttttacagtctcttaggttcttttagtttgtcattgttgtccggttgctgctaccagaattgggtgttggaccggcggtggtaattttggtttatgtttcgacagtaatatttattatttaaaagtatatagtatttctttgggaaaaaaattctgcctttatctttcccttctcattgatattggcttggactg

SEQ ID NO: 1247 - DNA, 1642 bp, Ceratodon purpureus
ctccagtttcgtgatcacttctgcacagcctctgctcgcccccctccgcccccgccctctcttcctgcttcgccaggaccccagctcagattattcaagatgggtaaggagaaggtacatatcaacattgtggtcatcggccatgtcgactccggaaagtcgacgaccaccggacacttgatctataagttgggtggtattgacaagcgtgtgatcgagcgtttcgagaaggaggcggctgagatgaacaagcgttccttcaagtacgcgtgggtgttggacaagctgaaggctgagcgtgagcgtggtattaccatcgatatcgcgttgtggaagttcgagacggtgaagtactactgcaccgttattgatgcccccggacatcgtgatttcatcaagaacatgattacgggaacttctcaggccgattgcgccgtgctgatcatcgactcgacgaccggaggttttgaggccggtatctcgaaggatgggcagacccgtgagcacgctttgttggctttcactttgggagtgaagcagatgatctgctgctgcaacaagatggacgcgaccaccccgaagtacagcaaggcccgtttcgaggagatcacgaaggaggtgtcctcctacctgaagaaggtgggatataaccccgacaagatcccgtttgtgcccatctctgggttcgagggtgacaacatgattgagaggtcgtcgaacctggactggtacaagggccctactctgttggaggcgttggacgccgtgacggagcccaagaggccgtccgacaagcccctccggttgccccttcaggacgtatacaagattggaggcattggaactgtgccggtgggacgtgtggagactggtgtgatcaagcccggtatgttggtgtgcttcgcccccactggactgaccacggaggtgaagtctgtggagatgcaccacgagtctatgccggaggcgcaccccggtgacaacgtgggattcaacgttaagaacgtggcggtgaaggacctgaagagagggttcgttgcttctgactctaagaacgaccccgcgaaggaggccgccaacttcaccgctcaggttatcatcatgaaccaccccggacagatcggtaacgggtacgccccggtgctggattgccacacttctcacatcgccgtgaagtttgccgagatcttgaccaaggttgacaggcgatcgggtaaggagctggagaaggagcccaagttcttgaagaacggtgacgctggtttcgtgaagatgattccgaccaagccgatgacggtggagactttcgctgagtacccaccttttggtcgtttcgccgtgcgcgacatgaggcagacggtggctgtgggagtgatcaaggctgtggagaagaaggacgcgactggtgccaaggtgaccaaggccgctgccaagaagaagtgaataggtcaggatgagccgcagcagcagttttgtttgtgttctgtagttgttttggcggctctagatttgttcgcactatgtgcgtgttcgatatacttgctgcaggcgcggcagagacagacctgggtacttgatcggagatggcagggcttgtcgtctccgtgattgttatcattcttcttctctattataatatctg

SEQ ID NO: 1248 - DNA, 1857 bp, Pinus pinaster
atgttgagaagaggagagctgatcgtctattttgttgtggagagcgaagcaggggagctctgcgattcttttttgctgggaagctgaagctgcttattcgcgtttttgattcaggaatacttggtttttagaaaaccatgggtaaagagaagacccacatcaatattgtggtcataggacatgtcgactctggcaagtccaccactaccggtcatcttatttacaagcttggcggtatcgacaagcgtgtgatcgagcgatttgagaaggaagctgcggaaatgaacaaaaggtcattcaagtatgcctgggttcttgacaagcttaaggctgagcgcgagcgtggtattactattgacattgctctctggaagtttgagacaaccaagtattactgtaccgttattgatgcaccaggccatcgggactttatcaagaacatgattacgggtacatcacaggccgattgtgctgttttgattattgattctaccaccggaggttttgaagcgggtatttcgaaggatggacagaccagagaacatgctcttttggcattcactctaggagtgagacagatgatttgttgttgtaataagatggatgctaccagccccaagtattccaaggcccgttatgatgaaattgtaaaagaagtgtcatcatacctgaagaaaattgggtacaaccccgataaaattccttttgtccctatttctgggttcgaaggagataacatgattgaaagatccaccaacctggattggtacaagggcccaactctgttggatgcccttgaccaggtatctgagccgaagagaccgtctgacaaaccccttcgattgccattacaagatgtgtacaagattggtggtattggaactgtgccggtgggacgtgttgaaaccggtgtcattaagcccggtacggttgtaaccttcggtcccactgggttgacaactgaagttaagtcagtagaaatgcatcatgaagctctgttagaggcattacccggtgacaatgttggcttcaatgtcaagaacgttgcagtcaaggatttgaaacgtgggtatgttgcatctgactccaaaaacgacccagcaaaggaagcagctagctttacctctcaagtaatcataatgaaccaccctgggcagatttcgaatggctatgcacctgtgttggactgccacacctgccacattgctgtcaaatttgctgaaattatgacaaaggtcgatagacgatccggtaaagaacttgagaaggagcccaaatttctgaagaatggagatgctgggtttattaagatgattccctccaagcccatggttgtggagacattctctgagtaccctccactgggtcgttttgctgtgagagacatgcgtcaaacggttgctgttggagtcatcaagggtgttgagaaaaaggatcccactggtgccaagatcaccaaggctgcggccaagaagggtaaatgaagcttgctgctaccaagtacttttgtgcagaggaaggaagacggttatggataccatacttctacgtggtgtagaagcttgtctgattctgatgcacgagatttggtagttaggggtttagtggctcggcgcatgcaaacatgggttcttgaccggcggtggcagcatattcgtaatgcaatttattgttcctagcattttagtaatttgggcgggtttatagtattatacaactttgtgggtgagggtttagtactgcatcggattttcaaagatcattgcaaccgcaatttaattgtggatttttatgtttgtgcattgtggaagactttttatgtgagctaagttatgagaatattgtgtaaaggttgtt

SEQ ID NO: 1249 - DNA, 1882 bp, Arachis hypogaea
ggggacacattcgcgatcgcaccctttctctgattctcatcctccaatcctcttctttcactgtgttttgttgagttttttctgtagagaatgggaaaagagaagagtcacatcaacatcgtcgttatcggccatgtcgactccggcaagtcgaccaccaccggccacctcatctacaagcttggagggatcgacaagcgtgtgattgagaggttcgagaaggaggctgctgagatgaacaagcgttcattcaagtacgcctgggttctcgacaagctcaaggcagagcgtgagcgtggtattaccattgacatcgccctgtggaagtttgagaccactaagtactactgcactgtgatcgatgcacctggtcatcgtgatttcatcaagaacatgatcactggtaccagccaggctgactgtgctgttctgatcatcgattccaccactggtggttttgaggctggtatctccaaggatggccagacccgtgagcatgctcttcttgctttcacccttggtgttaggcagatgatctgctgttgcaacaagatggatgcaacgaccccaaaatactccaaggctaggtatgatgaaattgtgaaggaggtttcatcctatttgaagaaggttggttacaaccctgacaagatcgcatttgtaccaatatctggttttgagggagacaacatgattgagaggtccaccaaccttgattggtataagggacccaccctgcttgaggctctggaccagatcaatgagccaaagagaccttctgacaagcctctcaggctgccccttcaggatgtctacaagattggcggtattggaactgttccagttggtcgtgtagagactggtatcctcaagcctggtatggtcgtgacctttgcccccactggactccagactgaggttaagtctgtggagatgcaccatgagtctctccctgaggctctccctggtgacaatgttggtttcaatgttaagaatgtttctgtgaaggagttgaagcgtggctttgttgcttctaactcaaaggatgatcctgctaaggaggctggaagcttcacctctcaagttatcatcatgaaccatcctggccagattggccaaggttatgctccagtccttgactgccacacctcacacattgctgtcaagtttgctgagctccagaccaagattgataggcgttctggcaaagagctcgagaaggagcccaagtttcttaagaatggtgatgctggtatggtgaagatgattcccacaaagccaatggttgttgagacttttgctgagtaccctccacttggaaggtttgctgtgagggacatgcgtcaaactgttgctgttggtgtgatcaagagcgttgagaagaaggatgcttcagctaagatcactaaatctgctgcgaagaaagctggcaaatgaaccgtgcgggttcagcatgcttttacatctatgataatgaataaatgtttcgtcagctatgtctctggcggaactaccttaagtatcttgtttagtgtttggtgtcgtaggttgttgctacctctgtacagtactcagtctcagaattgggtgcttgatagacggtggcgatgctagtatttgatttctcggtcgtgttcagttttaaacttcgatgatttggttttctggttaaactttcttttttcgtttatagatctatcttttattatttttattttgcctcttatctttatttccactggtcatatactcagatataactatataatttgtcgtcagcatgatcttcattgcgttaaaatgtccaattcttggcaggtttttgaacaaaattttgataatagcaatgctcttcctctggaagagttaagtgttttcattc

SEQ ID NO: 1250 - DNA, 1700 bp, Physcomitrella patens
ctccccctttcgacttcagaggtctcgtgggggagtttgctccaccgccagtgctgctgctgctgcttcagttggagttgtgcgaacttgttttacaactctcagacagttgagcaatcatgggtaaggagaaggtgcacatcaatatcgtggtcatcggccatgtcgactctggcaagtcgacgaccactgggcacctcatctacaagttgggaggtatcgacaagcgtgtgatcgagcgtttcgagaaggaggcggcggagatgaacaagcgttcgttcaagtatgcgtgggtgctggacaagctgaaggcagagcgcgagcgtggtatcacgattgatattgcgctgtggaagttcgagaccatgaagtactactgcactgtgatcgacgcgcccggacatcgcgatttcatcaagaacatgatcacgggaacgtcgcaggcagactgcgctgtgctgatcatcgactcgacgacgggagggttcgaggccggtatctcgaaggatgggcagacgcgtgagcacgcactgctggcgttcactttgggagtgaagcagatgatttgctgctgcaacaagatggacgcgaccaccccgaagtacagcaaggcccgatatgaggagatcgtgaaggaggtgtcggcgtacctgaagaaggtggggtacaacccggagaaggttccgttcgtgccgatctcagggttcgagggcgacaacatgatcgagaggtcgacgaacctggactggtacaagggcccgactctgttggaggcgttggacaacgtgtcagagccgaagcggccatctgacaagcctctgaggctgccgcttcaggacgtgtacaagattggaggcatcggaactgtgccagtgggacgggtggagacaggaatcatcaggccaggtatgttggtgtgcttcgcaccgacgggactgacgactgaggtgaagtcggtggagatgcatcacgagtcgatgcctgaggcgcacccaggtgacaacgtcgggttcaacgtgaagaacgtggcggtgaaggacctgaagagagggtacgtggcctcagactcgaagaacgaccctgccaaggaggcagccaacttcacggcgcaggttatcatcatgaaccacccgggacagatcgggaacggttacgcaccagtgctggattgccacacgtcgcacattgcggtgaagttcgcggagatcttgacgaaggtggacaggcgatcgggtaaggagctggagaaggagccgaagtttttgaagaacggggacgcagggttcgtgaagatgattccgacgaagccgatgacagtggagacgttcgcggagtacccaccattgggacgtttcgcggtgcgtgatatgaggcagacggtggctgtgggtgttatcaaggccgtagagaagaaggaacccaccggcgccaaggtgacgaaggccgctgcgaagaagaagtgaatagtgcgggaagggggtgaaggcgaggcggagaagggggcggagtggcggtggtgggtggagaggtggatgtggagcatggagttgctgactttgagtggttggtcgatatatttgttgcaagcgcgacagaggcagacttgggtacttgacaggagatggcagggcatagtgggcacgagggcatgggtgtaagagagagggaaataagagaatatatgatctctttttaaagta

SEQ ID NO: 1251 - DNA, 2445 bp, Taxus baccata
ctctatttctgagtattcgtttctcctccatttttctgttccgccgcaccgaggataaccttcttcgatctgccaggcgcctctgcaacaagtttttaatctcaagcaaccatgggaaaggaaaaggttcatatcaacattgttgttattggccatgtcgactctggaaagtcaactactactgggcatctgatttataagttgggtggtattgacaagcgtgtgattgagcgttttgagaaggaagctgctgaaatgaacaaaaggtcattcaagtatgcttgggtgcttgataagctaaaggctgagcgtgaacgtggtattaccattgatattgcactgtggaagtttgagaccactagatactactgcactgtcattgatgctccaggacatcgtgatttcattaagaacatgattacaggaacttctcaggctgattgtgcagtgctgatcattgattcaacgactggaggttttgaggctggtatttccaaagacggtcagacccgagagcatgctcttctagcatttacactgggagtgaggcaaatgatttgctgctgtaacaagatggatgctactacaccaaaatactcaaaggctcggtatgaggaaattgtcaaggaagtgtcttcttatttgaagaaggttggatacaatccagacaagatcccttttgtgccaatctctggttttgagggcgataacatgattgagagatcaagcaaccttgattggtacaagggtccaacactgttggatgcccttgaccaggtttcagagcccaaacgtccatcagacaagccactcaggttgccacttcaggatgtttacaagattggtggtattggaactgtacctgtggggcgagttgagactggagtgataaagccaggtatggttgtaacctttggtccatctgggttgacaactgaagttaagtctgttgaaatgcatcatgaagctttgctagaggcattgcctggtgacaatgtcggattcaatgtcaagaatgttgctgtgaaagatctcaagcgagggtatgtagcctctgattcaaagaatgacccagcgaaggaggctgcaaacttcaccgcccaggtcatcatcatgaaccatccaggacaaattggaaatggttatgcacctgtgctggattgccacacatgccacattgctgttaagttttctgagatcttgactaaggttgacagacgatctggtaaggaacttgagaaggaaccaaagttcattaagaatggggatgctgcatttgtcaagatgattccaaccaagcccatggttgtggaaacattctcggagtaccctccattgggtcgttttgctgtgagggatatgcgtcagactgttgctgttggagtcatcaaggctgttgagaagaaggaaccttctggtgctaaggttaccaaggctgctgctaagaagaagtgaaagtctgtgcaatttgtgcaggaactggggcatgccagaagctttttgcctgcttgtatgctggatttttgcacatatggtacagtagtaggaatattagcttgtcatatgcaaaattgggttcttgatagacggtggcattgttcatttgtttccttttaaagcatttagtagtttaagaaaggtactttgatttctctgcgggaaattttttggtttgtctgcactgctaggaaatctatgtagtctgagcagaggaggatttaaataattttaatttctaatgactggtaaaaattctatacaatgcatataatttttaccagtcattagaaattaagatttttcaaatactaaccctcagcttcatcaacttggatatcgggacaaggcatggagtgtcaacaagcttgctcgtgttgcacgcaagcaagggctttttgatgtctgtgtagctgtgctcaacaaaatgtatggctacgcaaccatggaggttcaagaagcgtttgtgaagataagagagcaagcaaaagcctgcttagaaatgagaggggaattggtaaatggtatcaacttgataaacaataccaatctggaatattttcctgttcagcacaaggcagagatcttccggcttaaggggaatttttgcagaaactgggagagggtgaaagtgctaatactgcatattccagtgctatcagtctcttcaagcatttatcgaaaggatggataagctggggcaattatagtgacaagatgtatcagaaggaacatgaagagatctggctagaatatgctgtaaactcctttcttcagggcattaagcatggtgtatcaaatgctagaagtcatttggctcgtgttttatatttgttgagctttgacaccgtgaatgagccagtggggaaagcatttgacaagtacctggatcacataccccactgggtctggctttcatggataccccagctactcctttctttgcaa

SEQ ID NO: 1252 - DNA, 1795 bp, Tripterygium wilfordii
ccgttgactccacttcccttatccttcctttctcgcgcgttagaagctaagacttgacaatgggtaaagagaaggttcacatcagcattgtggttattggccatgttgactctggtaagtcaactactactggccacttgatctacaagcttggaggcattgacaagcgtgttatcgagagatttgagaaagaagctgctgagatgaacaagaggtcattcaagtatgcctgggtgcttgacaagctcaaggctgagcgtgagcgtggtatcaccattgatatcgccttgtggaagtttgagactaccaagtactactgtactgtcattgatgcccctggacatcgtgacttcattaagaacatgattactggtacctcccaagctgactgtgctgttcttattattgactccactactggaggttttgaagctggtatctccaaggatgggcaaactcgtgagcatgctcttcttgccttcactcttggtgtcagacaaatgatttgctgctgtaacaagatggatgccaccaccccgaagtattcaaaagctagatatgatgaaattgtcaaggaagtttcttcctacctgaagaaggttggatacaaccctgacaagattccttttgtccccatatctggatttgagggtgataacatgattgagaggtccaccaacctggattggtacaagggtccaacccttcttgaagcccttgaccagatcaacgaacccaagagaccctcagacaagcccctccgcctcccactacaggatatatataagattggtggaattggaactgttccagtgggacgtgttgagactggtatcctcaggcctggtacggttgttacttttggtccctctgggttgacaactgaagttaagtctgtggagatgcatcatgaagctcttcaagaggctcttcctggtgacaatgtcggtttcaatgtgaagaatgttgctgtcaaggatctcaagcgtggttttgttgcctcaaattctaaggatgatcctgccaaggaggctgctaacttcactgcccaagttattatcatgaatcacccgggacaaattggaggtggttatgccccagtgcttgattgccacacttcccacattgcagtcaagtttgctgagttgcttaccaaaattgacaggcgatcaggcaaggagcttgaaaaggagcccaaattcttgaagaatggtgatgctgggttcgtgaagatgattcccagcaagcccatggtggtggaggccttctctgagtaccctccactgggtcgttttgctgtcagggatatgcgtcagaccgttgctgttggtgtcatcaaggctgtggaaaagaaggatcccagtggagctaaggtgacaaaatctgctgccaagaagggtggcaagtgagtcgtgctggctggcggcagtcgtagagaagtttatcataaaaaatacaataaagactggattcttgcccagatttcatctactggatgtttactgctttgtttcggtggttatagtttcaggtcgtcacaatcatctcattcctactgttcacagaactgggtattggatcgacggtggcatggttattttctttctttcatgatttgggtcgtttattgagtttgtcatgttgaaccttgagtatgttgctacaatttcctagctttgttcctgtgctggacgggtggttttatctgcgttttacaacttatatctagtatgtattttaaaatttgtggatctcattctgcttattggcttatttgaatttgaaagtggacgat

SEQ ID NO: 1253 - DNA, 1511 bp, Citrullus lanatus
atttgggtttgattgatcttccgagccatctatttagttgtatatattacttttcggtttattcgttgtatgcgtatcattatttcaattccaattttaattttgcaacagattcttttttgttactgagattcaagtatgggtaaggagaaggttcacatcaacattgttgtcattggccatgtcgattctggaaagtcgaccaccactggccatttgatttacaagcttggaggcattgacaagcgtgttattgagaggtttgagaaggaagctgctgagatgaacaagagatcgttcaagtatgcctgggtgttggacaagcttaaggctgaacgtgagcgtggtatcacaattgatattgctctgtggaagttcgagacaaccaagtactactgcactgttattgatgctcctggccatcgtgatttcatcaagaatatgattactggtacttcccaggctgactgtgctattcttatcattgattcaactaccggaggttttgaagctggtatttctaaggatgggcagacacgtgaacatgcccttcttgcctttacccttggtgtcagacaaatgatctgctgctgcaacaagatggatgccacgactcccaaatactctaggtctaggtacgatgaaatcgtcaaggaagtttcatcctacctcaagaaggttggctacaacccagacaaaattcccttcgtccccatctctggatttgagggtgacaacatgattgaaagatccacaaacctcgactggtacaagggccctacccttctggaggctctcgaccaagtccatgagcctaagagaccatcagacaaaccccttcgtcttccacttcaggatgtttacaagattggaggcataggaactgttccagtaggtcgtgtcgaaaccggtattctaaaacccggtatggtcgtaacctttgccccatctggacttactactgaagtaaagtctgttgagatgcaccatgaagctcttcaagaagctctccctggtgacaatgtggggttcaacgtgaagaatgtcgccgtgaaagatctcaagcgtggctatgttgcctcaaattccaaggatgatcctgccaaggaagctgccaatttcacttcccaagttatcatcatgaaccatccaggacagattggaaatggttatgcccctgttcttgactgccacacctctcacattgcagtcaaatttgccgagattttaacgaagatcgacagacgatctggaaaagaactcgagaaagagcccaagttcttgaaaaatggggatgctggatttgttaagatgattcccaccaagcctatggtggtggagacattctctgagtatcctccacttgggcgatttgcagtcagggacatgcggcaaactgtggctgttggtgtcatcaaaagcgttgaaaagaaggatccaagcggtgctaaggtcaccaaatcagctgctaagaaatctggtaagtgaattgtgcggtttgctgttggcgc

SEQ ID NO: 1254 - DNA, 1676 bp, Prunus mume
tttcagttatctttcggaaatcctgtaatgggtaaagagaagttccacatcaacattgtggtcattggccatgtcgactctggtaagtcgactaccactggtcacttgatctacaagcttggtggtatcgacaagcgtgttatcgagaggtttgagaaggaagctgctgagatgaacaagaggtcattcaagtatgcctgggtgctggacaagctcaaggctgagcgtgaacgtggtattacaattgatattgccttgtggaagtttgagaccaccaagtactactgcactgttattgatgctcctggacatcgtgactttatcaagaacatgattactggcacctcccaggctgactgtgccatcctcattattgactccaccactggtggttttgaagccggtatttccaaggatggtcagacccgagagcatgctttacttgcttttactcttggtgtgaggcagatgatttgctgctgtaacaaggtgagccactcccaagtactcaaaggcaaggtacgatgaaattgtgaaggaagtctcatcctatctcaagaaggtcgggtacaacccagaaaagatcccctttgtccccatttctgggttcgagggtgacaacatgattgagaggtccaccaaccttgactggtacaagggtcccacccttcttgaggcccttgacttgatcagtgagcccaagagaccatcagacaagccccttcgacttccacttcaggatgtgtacaagattggtggtattggtaccgtccctgttggacgagttgagactggtaccctgaagcctggtatggttgttacttttgcccccactgggctgactactgaagttaagtctgtggagatgcaccatgaatctctcgtagaggcccttccaggtgacaatgttggattcaacgtgaagaatgttgctgttaaggatctcaagcgtggttatgttgcttccaactccaaggatgatcctgcaaaggaagcagcaaactttacagctcaggtcatcatcatgaaccaccctggccagattggacaaggatatgctcctgttctcgactgtcacacctcccacattgctgttaaatttgctgagatgttgacaaagattgacagacgatctggtaaggaactggagaaggagcccaagttcttgaagaatggtgatgctggatttgtgaagatggttcccaccaagcccatggttgttgagaccttctctgagtaccccccacttggacgatttgctgtgagggacatgcgacagactgttgccgttggtgtcatcaagagtgttgagaagaaggatccaactggtgccaagatcactaaggccgctgctaagaagaagtgaaccggactggctcatcagatttccgcaggggaaatcttatataaatataataatagtagtaaaaacttacctattgtcactattactatggtttgttggtcatactgtttatatagtttttggtcatcattgttaggcattcagtcccagaattgggtgcttgacaggcggtggcgacgttatagcatacggagtccttgtccttcggttaaatatttttgtggttggttctgctactctggattttaatttaaaaaactatgttttattgtcgtaatgattctatatccctttggtatttcacatttcc

SEQ ID NO: 1255 - DNA, 1391 bp, Theobroma cacao
ctgttgcgttgttcactttccacccttcttagctgcagacttggtgaccttggcacctgttggatccttcttctcaacattcttaataacaccaacagccacagtctgccgcatgtccctcacagcaaaacgtcccaatggtgggtactcagagaatgtctccacaaccatgggcttggtgggaaccatcttcaccataccggcatcaccattcttcaagaacttgggttccttctcaagctccttgccagatcgccggtcaatcttggtcagcaactcagaaaacttgacagcaatgtgggaggtgtgacagtcgaggactggggcataaccattaccaatctggccggggtggttcatgatgatgacctgagaggtgaagctggcagcctccttggcaggatcatccttggagttagaagcaacgaaaccacgcttgagatccttaacagcaacattcttcacattgaaccctacattgtcaccagggagagcctcctggagagcttcgtggtgcatctcaacagacttaacttcagtggtaagaccagaaggaccaaaggtcacaaccataccaggcttcaagataccagtctcaacacgaccgactgggacagttccaataccaccaatcttgtacacgtcctgaagtgggagacggaggggcttgtcggagggcctcttgggctcattgatctggtcaagagcctcaagaagagtagggcccttgtaccagtcaaggttggtagacctttcaatcatgttgtcaccctcgaaaccggaaatgggaacaaatggaattttatctgggttgtaacccaccttcttcaagtaagaagagacttccttcacaatttcatcataccgagccttggagcttgctataaatccaaccttgttgcagcagcaaatcatttgcttgacaccaagggtaaaggcaagcaaagcgtgctcacgagtctgaccgtccttggaaataccagcctcgaaaccaccagtggtggaatcaataatcaagacagcacagtcagcctgtgaggtaccagtgatcatgttcttgataaagtcacgatgtccaggagcatcgatcactgtgcagtagtacttggtggtctcgaacttccacaaggcgatatcgatggtaataccacgctcacgctcggccttgagcttgtcaagcacccaagcatacttgaacgacctcttgttcatctcagcagcttccttctcgaacctctcgatcacacgcttgtcgataccaccgagcttgtagatcaagtgaccggtggtggtcgacttaccagaatcgacgtggccgatgaccacgatgctaatgtgaaccttttccttacccattctgattcactgggaaacaaatctaagaaaggcaa

SEQ ID NO: 1256 - DNA, 1661 bp, Ceratodon purpureus
atcaatcctccatcgccgctgctcacctccttcgactccgcctccttcctgctctgccaggaccccagactattcaagatgggtaaggagaaggtacatatcaacattgtggtcatcggccatgtcgactccggaaagtcgacgaccaccggacacttgatctataagttgggtggtatcgacaagcgtgtgatcgagcgtttcgagaaggaggcggctgagatgaacaagcgttccttcaagtacgcgtgggtgttggacaagctgaaggcggagcgtgagcgtggtattaccatcgatatcgcgttgtggaagttcgagacggtgaagtactactgcaccgttatcgatgcccccggacatcgcgatttcatcaagaacatgattacgggaacttctcaggccgactgcgctgtgctgatcatcgactcgacgaccggaggtttcgaggccggtatctcgaaggatgggcagacccgtgagcacgctttgttggctttcactttgggagtgaagcagatgatctgctgctgcaacagatggacgcgaccaccccgaagtacagcaaggcccgtttcgaggagatcacgaaggaggtgtcctcctacctgaagaaggtgggatacaaccccgacaagatcccgttcgtgcccatctctgggttcgagggtgacaacatgattgagaggtcgtcgaacctggactggtacaagggccctactctgttggaggcgttggacgccgtgacggagcccaagaggccgtccgacaagcccctccggttgccccttcaggacgtatacaagattggaggcattggaactgtgccggtgggacgtgtggagactggtgtgatcaagcccggtatgttggtgtgcttcgcccctactggactgaccacggaggtgaagtctgtggagatgcaccacgagtctatgccggaggcgcaccccggtgacaacgtgggattcaacgttaagaacgtggcggtgaaggacctgaagagagggttcgttgcttctgactctaagaacgaccccgcgaaggaggccgccaacttcaccgctcaggttatcatcatgaaccaccccggacagatcggtaacgggtacgctccggtgctggattgccacacttctcacatcgccgtgaagtttgccgagatcttgaccaaggttgacaggcgatcgggtaaggagctggagaaggagcccaagttcttgaagaacggtgacgctggtttcgtgaagatgattccgaccaagccgatgacggtggagactttcgctgagtacccacctttgggtcgtttcgccgtgcgcgacatgaggcagacggtggctgtgggagtgatcaaggctgtggagaagaaggacgcgactggtgccaaggtgaccaaggccgctgccaagaagaagtgaataggtcaggatgagccgcagcagcagttttgtttgtgttctgtagttgttttggcggctctagatttgttcgcactatgtgcgtgttcgatatacttgctgcaggcgcggcagagacagacctgggtacttgaccggagatggcagggcttatcgtctccgtgattgttatcattcttcttctctattataatatctgaagcttttgcgtgaattcgcgattcataaaaaaggagatct

SEQ ID NO: 1257 - DNA, 1650 bp, Ceratodon purpureus
cctcatcaatcctccatcgccgctgctcacctccttcgactccgcctccttcctgctctgccaggaccccagactattcaagatgggtaaggagaaggtacatatcaacattgtggtcatcggccatgtcgactccggaaagtcgacgaccaccggacacttgatctataagttgggtggtatcgacaagcgtgtgatcgagcgtttcgagaaggaggcggctgagatgaacaagcgttccttcaagtacgcgtgggtgttggacaagctgaaggcggagcgtgagcgtggtattaccatcgatatcgcgttgtggaagttcgagacggtgaagtactactgcaccgttatcgatgcccccggacatcgcgatttcatcaagaacatgattacgggaacttctcaggccgactgcgctgtgctgatcatcgactcgacgaccggaggtttcgaggccggtatctcgaaggatgggcagacccgtgagcacgctttgttggctttcactttgggagtgaagcagatgatctgctgctgcaacaagatggacgcgaccacccgaagtacagcaaggcccgtttcgaggagatcacgaaggaggtgtcctcctacctgaagaaggtgggatataaccccgacaagatcccgttttgtgcccatctctgggttcgagggtgacaacatgattgagaggtcgtcgaacctggactggtacaagggccctactctgttggaggcgttggacgccgtgacggagcccaagaggccgtccgacaagcccctccggttgccccttcaggacgtatacaagattggaggcattggaactgtgccggtgggacgtgtggagactggtgtgatcaagcccggtatgttggtgtgcttcgcccctactggactgaccacggaggtgaagtctgtggagatgcaccacgagtctatgccggaggcgcaccccggtgacaacgtgggattcaacgttaagaacgtggcggtgaaggacctgaagagagggttcgttgcttctgactctaagaacgaccccgcgaaggaggccgccaacttcaccgctcaggttatcatcatgaaccaccccggacagatcggtaacgggtacgccccggtgctggattgccacacttctcacatcgccgtgaagtttgccgagatcttgaccaaggttgacaggcgatcgggtaaggagctggagaaggagcccaagttcttgaagaacggtgacgctggtttcgtgaagatgattccgaccaagccgatgacggtggagactttcgctgagtacccacctttgggtcgtttcgccgtgcgcgacatgaggcagacggtggctgtgggagtgatcaaggctgtggagaagaaggacgcgactggtgccaaggtgaccaaggccgctgccaagaagaagtgaataggtcaggatgagccgcagcagcagttttgtttgtgttctgtagttgttttggcggctctagatttgttcgcactatgtgcgtgttcgatatacttgctgcaggcgcggcagagacagacctgggtacttgatcggagatggcagggcttgtcgtctccgtgattgttatcattcttcttctctattataatatctgaagcttttgcgtgaattcgcgattc

SEQ ID NO: 1258 - DNA, 1630 bp, Ceratodon purpureus
cagcctctgctcgcccccctccgcccccgccctctcttcctgcttcgccaggaccccagctcagattattcaagatgggtaaggagaaggtacatatcaacattgtggtcatcggccatgtcgactccggaaagtcgacgaccaccggacacttgatctataagttgggtggtattgacaagcgtgtgatcgagcgtttcgagaaggaggcggctgagatgaacaagcgttccttcaagtacgcgtgggtgttggacaagctgaaggctgagcgtgagcgtggtattaccatcgatatcgcgttgtggaagttcgagacggtgaagtactactgcaccgtcattgatgccccggacatcgtgatttcatcaagaacatgattacgggaacttctcaggccgattgcgccgtgctgatcatcgactcgacgaccggaggttttgaggccggtatctcgaaggatgggcagacccgtgagcacgctttgttggctttcactttgggagtgaagcagatgatctgctgctgcaacaagatggacgcgaccaccccgaagtacagcaaggcccgtttcgaggagatcacgaaggaggtgtcctcctacctgaagaaggtgggatacaaccccgacaagatcccgtttgtgcccatctctgggttcgagggtgacaacatgattgagaggtcgtcgaacctggactggtacaagggccctactctgttggaggccttggacgccgttacggagcccaagaggccgtccgacaagcccctgcggttgccccttcaggacgtttacaagattggaggcattggaactgtgccggtgggacgtgtggagactggtgtaatcaagcccggtatgttggtgtgcttcgcccccactggactgaccactgaggtgaagtccgtggagatgcaccacgagtctatgccggaggcccaccccggtgacaacgtgggattcaatgttaagaacgtggcggtgaaggacctgaagagagggttcgttgcttctgactctaagaacgaccccgcgaaggaggccgccaacttcaccgctcaggttattatcatgaaccaccccggacagatcggtaacgggtacgccccggtgctggattgccacacttctcacatcgctgtgaagtttgccgagatcttgaccaaggttgacaggcgatctggtaaggagctcgagaaggagcccaagttcttgaagaacggtgacgctggtttcgtgaagatgattccgaccaagccgatgacggtggagactttcgctgagtacccacctttgggtcgtttcgccgtgcgcgacatgaggcagacggtggctgtgggagtgatcaaggctgtggagaagaaggacgcgactggtgccaaggtgaccaaggccgctgccaagaagaagtgaataggtcaggatgagccgcagcagcagttttgtttgtgttctgtagttgttttggcggctctagatttgttcgcactatgtgcgtgttcgatatacttgctgcaggcgcggcagagacagacctgggtacttgaccggagatggcagggcctggcgtgatctgattgttatcattcttctctattattatatctaagtctgcgttgattcgca

SEQ ID NO: 1259 - DNA, 1406 bp, Euphorbia peplus
aaaattacacatcagtattgtggtcgataggacatgtcgactccggccaagtccaccaccactggacatccttatctacaggcttggaggtattgacaagcgtgtcattgaaagatttgagaaggtaagctgctgagatgacaaaaggtcattcaagtatgcctgggtgcttgacaagcttaaggctgagcgtgaacgtggtatcaccattgatattgctttgtggaagtttgagaccaccaagtactactgcactgttattgatgctcctggacacagggatttcatcaagaacatgattactggaacttctcaggctgattgtgctgttcttatcattgattccaccactggtggttttgaggctggtatctctaaggatggccagactcgtgagcatgctctccttgctttcacccttggtgtcaagcagatgatctgctgttgtaacaaaatggatgctacaactcccaagtactccaaggccaggtatgaggaaattgtgaaggaagtgtcctcctacctcaagaaggttggatacaaccctgataaaattccattcgtgcccatctctgggttcgaaggtgacaacatgattgagagatcaaccaacctcgactggtacaagggacccactctgcttgatgctcttgaccagatcaatgagccaaagaggccatcagacaagcccctccgtttacctcttcaggacgtttacaagattggtggtattggaactgtgccagtgggtcgtgtggagactggggtcatcaagccaggtatggttgtgacctttggacccagtggactgaccactgaagttaagtccgttgagatgcatcacgaggctctgcaggaggctcttcctggtgacaatgtggggttcgaatgtgaagaaatgttgcagtgaaggatcttaagagaggttttgttgcatccaactcaaaggatgaccctgccaaggaagctgccaacttcacttctcaggttatcatcatgaaccaccctggccagattggtaatgggtatgcaccagtgttggattgccacacctcccacattgctgtgaagttctctgagatcctcaccaagattgatcgccgatctggcaaggagcttgagaaggagcccaagtttttgaagaatggagatgctggtatgattaagatgattccaaccaagcctatggtggtagagacctttgctgagtacccaccattgggtcgttttgctgtgagagacatgagacaaactgtttgctgttggtgtcatcaagagtgtggagaagaaggatccatctggagccaaggtcaccaagtctgctgccaagaagaagtgagatgtttctcgatgattgtttaccattggtgacaattttgagtacccaagtcttgggtatttttttt

SEQ ID NO: 1260 - DNA, 1745 bp, Fraxinus spp
ggctctgctctgctctctccgtttctgcacatcggttttataagctagggtttaacagctattttcgttctttgccgcagaagcctaaaaatcaagatctaaaatgggaaaggagaaggttcacatcaacattgtggtcattggccacgtcgactcagggaagtcaaccactactggacatctcatctacaagcttggaggcattgacaagcgtgtgattgaaagattcgaaaaggaagctgctgagatgaacaagaggtctttcaagtatgcctgggtgcttgacaagctcaaggctgagcgggagcgtggtatcaccattgatattgccctgtggaagtttgagaccaccaagtactactgcactgtcattgatgctcctggacatcgtgatttcattaagaatatgattactggtacttcccaggctgactgtgctgtgcttatcattgattccaccactggtggttttgaggctggtatctctaaggatggccagacccgtgagcatgctctccttgctttcacacttggtgtgaagcaaatgatctgctgctgtaacaagatggatgctacaactcccaagtactccaaggcaagatatgaagaaattgtcaaggaagtctcttcctacctgaagaaggttgggtacaatccggacaaaatccttttgtgcctatctctggttttgagggtgataacatgattgagagatccacgaacctcgactggtacaagggcccaaccctccttgaggcacttgaccagatccaggaacccaagaggcccacagacaagcccctgcgtctgccacttcaggatgtctacaagattggaggtattggtactgtccccgtgggaagagttgaaactggtatcctgaaacctggtacggttgtacctttgggccaactggtctgacaactgaagttaagtccgttgaaatgcatcatgaagccctctctgaagctctccccggtgacaatgttggcttcaatgtcaagaacgttgctgttaaggatattaaacgtggatatgttgcatctgactcaaagaatgaccctgccaagggtactgaaagctttacatcccaggtcattatcatgaaccacccaggtcaaattggaaatggttatgcccctgttcttgactgtcacacctctcacattgctgtcaaattcgctgagctccttaccaagattgacaggcggtctggtaaagagcttgagaaggaacccaaattcttgaagaatggtgatgctgggatggtgaagatgattccaaccaagcccatggtggtggagactttctccgagtacccccctcttggacgatttgctgtgagggacatgcgccagactgttgctgttggagttatcaagaatgttgacaagaaggagccatcaggtgccaaggtgaccaaggctgctgccaagaagggtgccaagtgaatggtgctgcctggggtctactactgctttcataatgattacaaatatttccgttatcatcctaaagacttgttttatgttgttcatgtcgttttgagtcatttgtctcgtcttgtgtgttgtctgcgtcttagttatttgacgttgctgtctgtttgtgattcccagaattgggttctggacaggcggtggcgacacttgcgtgtgagttaatagtctatttttgtaatttgacgtcgctctataaattattactgtggtttttgataatttaaaagttttccttgatattcg

SEQ ID NO: 1261 - DNA, 1537 bp, Avena sativa
ttaacagctctagcagccatggggaaggagaagattcacatcagcattgtggtcattggccatgtcgactctggcaagtcgacaaccactggccacctcatctacaagcttggaggcatcgacaagcgtgtgatcgagaggttcgagaaggaagctgctgagatgaacaagaggtctttcaagtacgcctgggtgcttgacaagctcaaggccgagcgtgagaggggtatcaccattgatattgccctctggaagtttgagacgaccaagtactcctgcactgtcattgatgctcctggacaccgtgacttcatcaagaacatgatcactgggacatcccaggctgattgtgctgtgcttatcattgactccaccactggtggttttgaggccggtatctccaaggatggccagacccgtgagcatgctctccttgctttcacccttggagtgaagcagatgatctgctgctgcaacaagatggatgccaccactcccaagtactccaagggccgttttgaagaaattgtcaaggaagttggctcctacttgaagaaggtgggctacaaccctgacaaggtcccatttgtccccatctcaggtttcgagggtgacaacatgagaggtccagcaaccttgattggtacaagggcccaaccttgcttgaggcgcttgaccagatcaatgagcccaagaggccctcagacaagcccctccgccttccccttcaggatgtctacaagattggtggcattggaactgtgccagtggggcgtgttgagactggagtgatcaagcctggcatgcttgtcacctttggcccaactgggctgaccactgaggtgaagtctgtggagatgcaccacgagtccatgctggaggctgtgccaggtgacaatgttggcttcaacgtgaagaatgttgctgtgaaggatatcaagcgtgggtacgtcgcctccaatgccaaggacgaccctgccaaggaggctgccaacttcgttgcccaggtcatcatcatgaaccaccctggccagatcggcaacggctacgccccagtgctggactgccatacgtcccacattgctgtcaagttctctgaaatccagaccaaggttgacaggcgttctggcaaggagattgagtccttccccaagttcctcaagaacggtgatgctggcttcgtgaagatgattcccaccaagcccatggtggtggagaccttctcccagtaccctccccttggccgctttgcggtgcgtgacatgaggcagaccgttgctgttggtgtgatcaagagcgtggagaagaaggaacccactggcgcaaaggtgaccaaggctgctgccaagaagaaatgagatggatgatgcccggtggatagctaccactacacctgtagtggttgcggaatatcgtgtagtcgagttagtgaatttgggaacttgtcccgttttgagtttattatcctggtcgtagtatctttggttgtgttgtgaaacaatgttctgctatcttcgattaaaagttgctactctat

SEQ ID NO: 1262 - DNA, 1659 bp, Ambrosia trifida
taacaaccattctttcagtcactctctctgctaatccatccatttcttcagcaaagattgtttgatatctcagaatgggtaaagaaaagattcacatcagcattgttgtcattggacatgtcgactccggcaagtcaaccactacaggtcacttgatctataagttgggaggaatcgataagagagttatcgagaggtttgagaaggaagctgctgaaatgaacaaaaggtccttcaagtatgcctgggttcttgacaaactcaaagctgagcgagaacgtggaatcacaatcgatattgcattgtggaaatttgagaccaccaagtactactgtaccgtcattgatgctcctggacatcgtgatttcattaagaacatgattactggtacatcccaggctgattgtgctgtcttgattattgactcgaccactggtgggtttgaagctggtatctctaaggatggtcagacccgagaacatgctctgcttgctttcactcttggtgtgaagcaaatgatctgctgttgtaacaagatggatgcaaccactcctaagtactcaaaggcaaggtatgacgaaattgtgaaggaagtctcttcttacttgaagaaggtcggttacaacccgacaaatccattgtcccatctctggtttgaggtgacaacatgattgagaggtcgacaaaccttgactggtacaagggcccaacccttcttgaagctcttgaccagatcaacgagcccaagagaccctcagacaagccacttcgtctcccacttcaggatgtgtacaagatcggtggtattggaactgtgccagtgggacgtgtcgagactggtgtgatcaagcctggtatggttgttacctttggaccatccgggttgactactgaagttaagtctgttgagatgcaccatgaagccctacaagaggctcttcctggtgacaacgttgggttcaacgtcaagaacgttgcagtcaaggatctaaaacgtgggtatgttgcttccaactccaaggatgacccagctaagggcacagcaagtttcacctcacaggttatcatcatgaatcaccctggtcagattggaaacggttatgctccagttctcgattgccacacttctcacattgctgtcaagttctccgagcttttgaccaagatcgacaggcgatccggaaaagagcttgagaaagaacccaagtttttgaagaatggagatgcaggtatggttaagatgcttccaaccaagcctatggtggtcgagactttcgcagagtacccacctctcggtaggttcgctgttcgtgacatgaggcagacagttgctgttggtgtgatcaagagtgttgagaagaaggacccgactggagctaaggtgaccaaggctgcagtgaagaagggtgccaagtgaattttctggaccaatgaagttttaattacgtatttgaacaattttaattatgtttattattttgtgtcaaggtatttttggtattatgtgttgtggcttgcattcctgtactctagcctcgcttgcgaggatgggtggaggtatcgagcaacttgttgcttgatgacggtagtgcaagctcacaaacatccagattttgacttattatcgtggttaaactattatgatgtctctcttattat

SEQ ID NO: 1263 - DNA, 2448 bp, Brassica rapa
gcaaatgcgaaagccctagagctcgcagctataaattacaatgacttagggtgcgtcctcatttacttgtctcactcatcagtttcgtagccgcatctctcacattctaactcgcagctatgggtaaagagaagtttcacatcaacattgtggtcatcggccatgtcgactctggaaaatcgaccaccactggtcacttgatctacaagctcggtggtattgacaagcgtgtcatcgagaggttcgagaaggaggctgctgagatgaacaagaggtccttcaagtacgcctgggtcttagacaaacttaaggccgagcgtgagcgtggtatcaccattgatatcgctctctggaagttcgagaccaccaagtactactgcacggtcattgacgctcctggacatcgtgatttcatcaagaacatgattactggtacctcccaggctgattgtgctgttttgatcattgactccaccactggtggttttgaggctggtatctccaaggatggtcagacccgtgagcatgctcttcttgctttcacccttggtgtcaagcagatgatttgctgctgtaacaagatggatgctactacccctaagtactccaaggctaggtacgatgagatcatcaaggaggtgtcttcctacttgaagaaggttgggtacaaccctgacaaaatcccattcgttccaatctctgggttcgagggtgacaacatgattgagaggtccaccaaccttgactggtacaagggaccaactctccttgaggctcttgaccagatcaacgagccaaagaggccctcagacaagcccctccgtctcccacttcaggatgtctacaagatcggtggtattggaacggtgccagtgggacgtgttgagaccggtatgctcaagcccggtatggttgtgaccttcgctccttcagggttgaccactgaggttaagtccgttgagatgcaccacgagtctcttgtggaggcgcttccaggtgacaacgttgggttcaatgttaagaatgttgctgtcaaggatcttaagagagggtatgttgcatccaactccaaggatgaccctgccaagggtgctgccaacttcacctcccaggtcatcatcctgaaccaccctggtcagatcggtaacggatacgccccggttcttgattgtcacacatcccacattgcagtcaagttctctgagatcctcaccaagattgacgggcgatctggaaaggagatggagaaggagcccaagtacttgaagaatggtgatgctggcatggttaagatgactccaaccaagcccatggttgttgagactttctctgagtacccaccattgggtcgtttcgctgttagggacatgaggcagacggtggctgttggtgttatcaagagcgttgacaagaagtgcccaaccggtgctaaggtcaccaaggctgcagtcaagaagggagccaaatgatgagtgacctctcagtctttggtttttctttgcattacaaaaactttgatggcgtttgagccttttccttattttctgcgacttttttctaccttgtttttggatctctgagactattgtggttttcaattatgcagcttctggataattttgcctaaatgctttatgctctcgagtgttcgttaagttgcttttcttttgtttaagatctgaattgatgacggattgtttgaaattactcaatgctgatagatgttaagtgttctttatacaagcgaacaagagtaataacggatattaccaaacaaatactttctgatcttaaagattagagttaatggatcatgacgtcgaccaaagaatcacagaacaaaattccaaaataataataggataaggccaaaagaggcagcagaacatcacaccagcgacagagtagacgtgtcaacaacactgaaaacaaccaggaatgttttaaagatttttgatctgcagttttacaagaagcatacataactcaatgagatctaaaagagttgttatgggtttcttcaaacactaaggagctttagctgtgtaagaagaaaagctccatgaccctagatcttctagtaaagcaactagatctctaaaatcctcactctctgccatctcttgaagccatagctcatggaatctctccacacccatttcttctccaccatggcttctggactcatctgatctacttctcttcttcatccccttccttctcttgtcatgatctgccattcttcaacatagagggagagagatacaagtcagaaagaaaacagagatctcaagagagagaagacagataaacataagaaacatgtttactctttggagagagataactgctgagcgatcccagagatgcaaagagggaagccatagttgccactaagagttgttgtcagcatttttctctttgtagattcagaatttgtgatctttt

SEQ ID NO: 1264 - DNA, 1693 bp, Bruguiera gymnorhiza
gatctcttcttacattgagtggcttggagctagggttttagcattacagattctctctttacaggttaaagctaagactttataatgggtaaggagaagattcacattaacattgtggttattggccatgtcgactccggaaagtcaaccacgactggccacttgatttacaagcttggaggtatcgacaagcgtgtgattgagaggtttgagaaggaagctgctgagatgaacaagaggtcattcaagtatgcctgggtgcttgacaagctgaaggctgagcgtgagcgtggtatcaccattgatattgccttgtggaagttcgagacaaccaaatattactgcacggtcattgatgctcctggacatcgtgactttattaagaatatgatcaccgggacttcccaagctgactgtgctgtcctcatcattgactctaccactggtggctttgaggctggtatctctaaagatggtcagacccgcgagcatgccctgcttgccttcacccttggtgttaagcaaatgatttgctgctgcaacaagatggatgctaccacttccaagtattctaaggcaagatatgatgaaattgttaaggaagtgtcatcctacttgaagaaggttggttacaacccagagaagattccttttgtccccatatctggatttgagggtgacaacatgattgagagatccaccaaccttgactggtacaagggcccaactcttcttgaggccctggacatgatccaggagccaaagaggccatcagataagcccctccgtctcccacttcaggatgtgtacaagattggtggtattgggacagtcccagtgggtcgtgttgaaactggtgtcctgaagcctggaatggttgttacttttggtccctcaggactgaccactgaagttaagtctgtggagatgcaccatgaagctctccaagaggctcttcccggagacaacgttggcttcaatgttaagaatgtttccgtgaaggatcttaagcggggttatgttgcctcaaactccaaggatgatcctgccaaggaggcatctagcttcacctcccaagttatcatcatgaaccaccctggtcagattggaaatggttatgcccctgttctggattgccacacctctcacattgctgtcaagttttctgagatcctcacaaagattgataggcgatctggcaaggagcttgaaaaggagcccaagttcttgaagaatggtgatgctgggttcgtgaagatgattccgaccaagcctatggtggtggaaactttctccgagtatcctccgcttggtagatttgccgtcagggacatgcgccagactgttgcagtgggagtcatcaagagtgtcgagaaaaaggaaccttctggagctaaggtgactaaatctgctgccaagaagggtggcaaatgaaccgtgcaagtcagagttgatgtagatgaaggctattggaagaataaagactgggccctggttagcggtctaattattggatgttcagcagttggtttcgagaactacagtttcaattcagcgccatcatcacggagctgttgttcccagaattgggttcttgaccgtcggtggcattggctgttggtttgagtgacttctttgtgtcatgtttagactttatcggatttgctatttcataaagcggcttgggaatttt

SEQ ID NO: 1265 - DNA, 1721 bp, Distylium racemosum
cagtttttttttggtgttttaatcaacaatgggtaaggagaagacgcatatcaacattgtggtcattggacatgtcgactctggaaagtccaccactaccgggcatttgatctacaagcttggaggtattgacaagcgtgtaatcgagcgttttgagaaggaagcagctgagatgaacaaaaggtcattcaagtatgcctgggtcctggacaaactgaaggcagagcgcgagcgtggtattaccatcgatattgctctttggaaattcgagacaaacaagtactactgcaccgttatcgatgctcctggccacagggactttattaagaacatgattactggcacatcacaggctgattgtgccgttctgattatcgactccaccacgggaggtttcgaagctggtatctccaaggacggccagaccagagagcatgctctcttggccttcaccttgggagtcagacaaatgatctgctgttgtaacaagatggacgcaacgactcccaagtatgccaaggcccgttacgatgaaatagtgaaggaagtctcatcctacatgaagaaggtgggctacaaccctgacaaaatcccattcgtacccatttccgggttcgaaggagacaacatgattgagagatcgtccaacctggactggtacaagggaccgacccttctggaggctctggacatggtgaacgagcccaagaggcccacagacaaacccctgcgtctgcccctgcaggacgtctacaagatcggaggtatcggaacggtgcccgtgggcagagtcgaaaccggtgtcctgaagcccggcacggtggtcacattcggtccaacggggctgacaactgaagtaaagtccgtggagatgcaccacgaggcccttgtggaggccctgcctggtgacaatgtgggcttcaacgtgaagaacgttgctgtcaaggatctcaagcgtggctacgttgcttcagactcgaagaacgacccggccaaggaggcggccaacttcacctcgcaggtgatcatcatgaaccacccgggccagattggcaacggctacgcccccgtgctggactgccatacctgccacatcgccgtcaagtttgccgagatcctgaccaaggtggacaggcgatctggcaaggagctcgagaaggagcccaagttcatcaagaacggtgatgccgggttcgtgaagatgattcccaccaagcccatggtggtggagacgttctctgagtacccgccactggggcgttttgccgtgagggacatgcgccagactgtagctgtgggtgtgatcaagagcgtggagaagaaggaaccctccggcgccaaggtcaccaaggcggccgccaagaagaaatgaacagtgcttatgtgtgcaggggagtccgtggctatccatgcgcgccgtggcgggtgcgtatatcttaatcgttcctccgcacgggatatggtagtgaggtgtttggtatctcgacgcatgcaaacatgggttcttgacaggcggtggcatgccataataaaaagtctctatagctgttgttagtgtttttgggagggatagtgtgtcgtccgggaaggggttactatatttttgagactctgaagctgctgcaacggtacaatattgcagcagtattatcttatctgctttgcgacttttgtgtgtgagtaatttaagagcatattgattttaagttctggatttgatt

SEQ ID NO: 1266 - DNA, 1318 bp, Pennisetum glaucum
cgcgagattaagctttgcttttagccatgggcaaggagaagagtcacattaacatcgtggtcattggccatgtcgactctggcaagtcgaccaccactggccacctgatctacaagcttggaggtattgacaagcgtgtgatcgagaggttcgagaaggaggccgcagaaatgaacaagaggtccttcaagtatgcgtgggtgcttgacaagctgaaggctgagcgtgaaagaggtatcaccatcgacattgccctgtggaagttcgagaccaccaagtactactgcacggtcatcgatgcccctggtcaccgtgacttcatcaagaacatgattaccggcacctcccaggccgactgtgctgtcctcatcattgactctaccactggtggttttgaggctggtatctctaaggatggccagacccgtgagcatgctctccttgctttcactcttggagtgaagcagatgatctgctgctgcaacaagatggatgccaccactcccaagtactccaaggcccgttatgatgagattgttaaggaagtctcctcgtacctcaagaaggtgggttacaacccagacaagattgccttcgtccccatctctggtttcgagggtgacaacatgattgagaggtccaccaaccttgactggtacaagggcccaaccctgcttgaggctcttgaccagatcaacgagcccaagaggccttccgacaagcccctgcgtctcccccttcaggacgtgtacaagattggtggtattggaactgtccctgttggccgtgttgagactggtgtgatcaagcctggtatggttgtcacctttggtccaactggcctgactactgaggttaagtctgttgagatgcaccacgaggctctccaggaggcccttcccggtgacaatgttgggttcaacgtgaagaacgttgctgtgaaggatctcaagcgtgggtacgtggcttccaactccaaggacgaccctgccaaggaggctgccagcttcacctcccaggttatcatcatgaaccaccctgggcagattggcaacgggtatgcgccagtgctggactgccacacctcccacatcgctgtcaagtttgctgagcttgtcaccaagatcgacagacgatctggtaaggagcttgagaaggagcccaagttcctgaagaacggtgatgctggtatggtgaagatgattcccacgaagcccatggttgttgagacattctctgagtaccctcctcttggtcgctttgctgttcgtgacatgaggcagacggttgctgttggcgtcatcaagagcgtggagaa

SEQ ID NO: 1267 - DNA, 1803 bp, Sciadopitys verticillata
catgggaaaggaaaagactcacatcaacattgtggtcattggacatgtcgactctggcaagtccaccaccactgggcaccttatctataagcttggaggcattgacaagcgtgtgattgagcggtttgagaaggaagctgctgaaatgaacaaaaggtcattcaagtatgcttgggttcttgacaagctcaaggcagagcgtgaacgtggtattaccattgatattgccttgtggaagtttgagactaccaggtactactgcactgtcattgatgcccctggtcacagggacttcatcaagaacatgattaccggtacctcacaggctgactgtgctgttctgatcattgactccaccactggaggttttgaagctggtatttccaaagacggacagaccagagagcatgctctattggccttcactttgggagtgaaacagatgatttgctgttgcaacaagatggatgccacaacccccaaatactccaaggcccgttatgatgaaattgtaaaggaagtgtcctcctacctgaagaaagttggttacaaccctgacaagattccgtttgtccccatctctggatttgaaggagataacatgattgaacgctcaaccaaccttgagtggtacaagggaccaacccttttggatgccctggaccaagtgagtgagccgaagaggcctaccgacaagcctctcaggctgccccttcaggacgtttacaagattggtggtattggaactgtgccagttggtcgtgttgaaactggtgtcctcaagcccggtatgttggtaacctttggcccctctggactgacaactgaagttaagtccgtagaaatgcaccatgaagcccttgtggaggctctgcccggtgacaatgttgggttcaatgtgaaaaacgttgcagtcaaggatcttaagcgaggttatgttgcctcggactccaagaatgatcctgccaaggaggctgccaacttcacttcccaggtgatcatcatgaaccaccctggccagattggcaatggctatgcccctgttctggactgccacacctgtcatattgctgtgaagtttgctgagatcctgaccaaggtggacaggcggtctggtaaggagcttgagaaggagcccaaatttatcaagaatggagatgcagcgtttgtgaagatggttcccaccaaacccatggttgtggagactttctccgagtatcctccactgggtcgttttgcagtgagggacatgcgacaaactgttgctgtgggtgtgatcaagagtgttgagaagaaggagcctacgggtgccaaggtgaccaaggctgccgccaaaaagaaatgaacagtgctcaagtgtgccgggcatggtcatggtaatatattgtgcctctcacaatcctgtgcacgggatatggtggtgaggtgtttggaagctcggcgcatgcaaacttgggttcttgacaggcggtggcatgaagaagttagtattggtgtttattgttgttttagggaaagtaatattttggtagtagagtatactgaacttttttcggagactgctgctgcaattcatttgaaatctgcagcgtatttaatgtttttgcacttctgttggcacatttattgtggtaaaattgttggaatatatatgttttcagagagtattttgataaattgtcaatgattgtgattcacttaaatggttattgattagtgtcacttggttatggcaagttgggcattaattttaagttgtttggaatggctgtatacttcgtattgggaaaagttttataagac

SEQ ID NO: 1268 - DNA, 1366 bp, Selaginella moellendorffii
gggttcttcagcggcttcgcgagccggcttgcgcattgcgaatcatggggaaggagaaggctcacatcaacatcgtggtcattggacatgtcgactccggcaagtccactaccacggggcatctcatctacaagctgggaggaatcgacaagcgaacgattgagaggttcgagaaggaggcggccgagatgaacaagcggtcgttcaagtacgcctgggtgctggacaaactcaaggccgagcgcgagcgtggaatcaccatcgatattgcgctgtggaagttcgagaccaacaggtactactgcaccgtcatcgacgctcccggtcaccgtgatttcatcaagaacatgatcacgggaacttcccaggctgactgcgctgttctcatcatcgattccaccactggaggttttgaggctggtatctccaaagacggtcagacccgtgagcacgctcttctcgcttttactcttggagtgaggcagatgatctgctgctgtaacaagatggacgctaccacccccaagtactccaaggcgaggtacgaagaaatcgtcaaggaggtgtcgtcctacctcaagaaggtcggctacaaccctgacaagatccccttcgttcccatttccggtttcgagggtgacaacatgatcgagaggtcgaccaacctcgactggtacaagggcccgactcttctcgaggcgttggaccaggtgaccgagcccaagaggccatcagacaagcccctccgcctcccactccaggacgtttacaagatcggaggaattggaaccgtccccgtgggacgagtggagaccggagtcctcaagcccggtatggtggtgactttcggcccaaccggactgacgactgaggtgaagtccgtggagatgcaccacgagtcccttgtggaggcacttcccggtgacaacgtcgggttcaacgtgaagaacgtcgcggtgaaggatctcaagcgtggtttcgtggcgtccgactcgaagaacgatccggccaaggaggctgccagcttcactgcccaggtgatcatcatgaaccaccccggacagattggaaacggctacaccccggtgctcgactgccacacctctcacatcgctgtcaagttcgccgagctcctgaccaaggtggacaggcgatccggaaaggagctggagcaggaaccgaagttcctgaagaacggtgacgctgggttcgtgaagatgctgccgacgaagcccatggttgtggagacgttcgcggagtatcctccattgggacgctttgcggtgcgtgacatgaggcagacggtggcagtgggagtgatcaaggccgtggagaagaaggaacccaccggtgccaaggtgaccaa

SEQ ID NO: 1269 - DNA, 1575 bp, Ambrosia trifida
aatgggtaaggaaaagattcatatcagtcattgttgtcattggtcatgtcgactccggtaagtcgaccacaactggtcatctcatctacaagttgggtgggattgacaagagggttatcgaaaggttcgagaaagaagctgctgagatgaacaagaggtccttcaagtacgcatgggttcttgacaaactaaaggctgagcgtgaacgtggtatcaccattgatatcgctctgtggaagtttgagaccaccaagtattactgcactgttattgatgctcccggacatcgtgatttcattaagaacatgattactggtacttcccaggctgattgtgctgttctgattattgactccaccactggtggttttgaagctggtatttccaaggatggtcagacccgtgaacacgctctgcttgccttcactcttggtgtgaagcaaatgatctgctgttgtaacaagatggatgcaaccactcccaagtactcaaaggcaagatatgatgaaattgtgaaggaagtgtcatcctacttgaagaaggttggttacaaccccgacaaaattccttttgtgcccatctctggatttgagggtgacaacatgattgagaggtctaccaaccttgactggtacaagggtccaacccttcttgaagctcttgaccagatcaacgagcccaagagaccctcagacaagcccctacgtctcccacttcaggacgtgtacaagatcggtggtattggaactgtgccagtgggacgtgttgagactggtgtgatcaagcctggtatggttgttaccttcggaccatctgggttgaccactgaagttaagtctgttgagatgcaccatgaagctttacagaggctctccctggtgacacgttgggttcatgtcaagacgttgctgtcaggatctgaaacgtggtttacgttgcatccaactcaaaggatgaccctgctaagggtgctgccagttcactcccaagtcatcatcatgaacaccctggtcaaatcggaaacggttatgctccggttttggattgccacacatctcacattgccgtcaagttttctgagctgttgaccaagatcgacagacggtctggaaaagagctggagaaggagcccaaatttttgaagaatggtgatgctggtatggttaagatgcttccgacaaagcccatggttgttgagacttttgctgagtacccaccactcggtcggtttgctgttcgtgacatgcgtcagactgttgctgttggtgttatcaagagtgttgacaagaaggacccaactggagctaaggtgaccaaggctgcagtgaagaagggagctaaatgaaacggtttgagtggttttatattttatgaagtttttatcgtattttggaactattttcatatttggttaagaatttttggtaattggtctttctggtgcttgcactactgtactctagcctcacttgtgaggatgggtggaggtattgagcaactttgtagttgcttgatgacggcggtgtaagttatccagaggccagcttttgtggttgattatgttgaacttctatg

SEQ ID NO: 1270 - DNA, 1321 bp, Ambrosia trifida
aaagaattcatatccgtatcgttgtcattggacatgtcgactccggcaagtccacaaccacaggacatcttatctacaagttgggaggtatcgataagcgtgtgatcgaaagattcgagaaggaagcagctgagatgaacaaaaggtccttcaaatacgcctgggtgcttgacaagcttaaggccgaacgtgaaagaggtatcacccatccgatatcgccttgtggaagtttgagaccaccaagtactactgcactgtcattgatgcccccggacatcgtgatttcattaagaacatgattactggtacttcccaagcggattgtgctgttcttatcatcgattccaccactggtggttttcaggctggatttccaaggacggtcagacccgtgagcacgctcttcttgctttcacccttggtgtcaagcaaatgatctgctgctgtaacaagatggatgccactacaccaaagtactccaaggcaaggtacgatgaaatcgtcaaggaagtgtcatcttacttgaagaaggttggatacaaccccgacaaaatcccattcgtgcccatctctggttttgagggagacaacatgattgagaggtcaaccaaccttgactggtacaagggtccaacccttcttgaagctcttgaccagatcaacgagcccaagagaccctcagacaagcccctccgtctcccacttcaggacgtgtacaagatcggtggcattggaactgtgccagtgggtcgtgttgagactggtgtgatcaagcctggtatggttgttaccttcggaccatctgggttgaccactgaagttaagtccgttgagatgcaccacgaagctttgcaagaggctctccctggtgacaatgttgggttcaacgtcaagaacgttgctgtcaaggatctcaagcgtggttacgtcgcatccaactccaaggatgatcctgctaagggtgctgccagtttcacatcccaggttatcatcatgaaccaccctggccagatcggtaacggttacgccccagttcttgattgccacacctcccacattgctgtcaagttctctgagctattgaccaagatcgacagacgatccggtaaggagcttgaaaaggagcctaagttcttgaagaacggagatgccggtatggttaagatgcttcccaccaagcccatggtggttgagacctttgctgaatacccaccacttggtcggtttgctgtgagagacatgcgtcagacagttgcagtcggagtcatcaagagcgttgataagaaggacccaaccggagccaaggtgacaaaggccgcag

SEQ ID NO: 1271 - DNA, 1399 bp, Brassica napus
agattcttacttgcagctatgggtaaagagaagtttcacatcaacattgtggtcattggccatgtcgactctgggaaatcgaccaccactggtcacttgatctacaagcttggaggtattgacaagcgtgtcatcgagaggttcgagaaggaggctgctgagatgaacaagaggtccttcaagtacgcatgggtcttggacaaacttaaggctgagcgtgagcgtggtatcaccattgacattgctctctggaagttcgagaccaccaagtactactgtactgtcattgatgcccctggtcatcgtgatttcatcaagaacatgattactggtacctcccaggctgattgtgctgttcttatcattgactctaccactggtggttttgaggctggtatctccaaggatggtcagacccgagagcacgctcttcttgctttcacccttggtgtcaagcaaatgatttgctgctgtaacaagatggatgccacaaccccaagtactccaaggctaggtacgatgagatcatcaaggaggtgtcttcctacttgaagtaggttggtacaaccctgacaaactcccattcgtcccatctctggtttcgagggtgacaacatgattgagaggtccaccaaccttgactggtacaagggaccaactctccttgaggctcttgaccagatcaacgagccaaagcggccttcagacaagcccctgcgtctaccacttcaggatgtctacaagatcggtggtattggaacggtgccagtgggtcgtgtggagactgggtatgctcaagcccggtatggttgtgacattcgctccttcagggttgaccactgaggtcaagtccgttgagatgcaccacgagtctcttgtggaggcacttccaggtgacaacgtcggattcaatgttaagaatgttgccgtcaaggatcttaagcgtgggtatgttgcatccaactccaacggatgaccctgccaaggtgctgctaacttcacttcccaggtcatcatcatgaaccaccctggtcagatcggtaacggttagcccctgtgcttgattgccacacctcccacattgcagtcaagttctctgagatcctcaccaagattgacaggcgatctggtaaagagatcgagaaggagcctaagtttttgaagaatggagatgctggtatggtgaagatgactccaaccaagcccatggttgttgagactttctcagagtacccaccattgggacgttttgctgttagggacatgaggcagacggttgctgttggagttatcaagagtgttgacaagaaggacccaaccggtgctaaggtcaccaaggctgcagtcaagaagggtgccaaatgatgagccttctctatttctattacttttaaaaaaa

SEQ ID NO: 1272 - DNA, 1550 bp, Ceratodon purpureus
gcacagtctctgctcgcccccctccgcccccgccctctcttcctgcttcgccaggaccccagctcagactattcaagatggggtaaggagaaggtacatatcaacattgtggtcatcggccatgtcgactccgggaaagtcgacgaccaccggacacttgatctataagttgggtggtattgacaagcgtgtgatcgagcgtttcgagaaggaggcggctgagatgaacaagcgttcttcaagtacgcgtgggtgttggacaagctgaaggctgagcgtgagcgtggtattaccatcgatatcgcgttgtggaagttcgagacggtgaagtactactgcaccgttattgatgcccccggacatcgtgatttcatcaagaacatgattacgggaacttctcaggccgattgcgccgtgctgatcatcgactcgacgaccggaggttttgaggccggtatctcgaaggatgggcagacccgtgagcacgctttgttggctttcactttgggagtgaagcagatgatctgctgctgcaacaagatggacgcgaccaccccgaagtacagcaaggcccgtttcgaggagatcacgaaggaggtgtcctcctacctgaagaaggtgggatataaccccgacaagatcccgtttgtgcccatctctgggttcgagggtgacaacatgattgagaggtcgtcgaacctggactggtacaagggccctactctgttggaggcgttggacgccgtgacggagcccaagaggccgtccgacaagcccctccggttgccccttcaggacgtatacaagattggaggcattggaactgtgcctgtgggacgtgtggagactggtgtgatcaagcccggtatgttggtgtgcttcgcccccactggactgaccaccgaggttaagtctgtggagatgcaccacgagtccatgcccgaggcccaccccggtgacaacgtgggattcaacgttaagaacgtggcggtgaaggacctgaagagagggttcgttgcttctgactctaagaacgaccccgcgaaggaggccgccaacttcaccgctcaggttatcatcatgaaccaccccggacagatcggtaacgggtacgccccggtgctggactgccacacttctcacatcgccgtgaagtttgccgagatcttgaccaaggttgacaggcgatcgggtaaggagctggagaaggagcccaagttcttgaagaacggtgacgctggtttcgtgaagatgattccgacgaagccgatgacggtggagactttcgctgagtacccacctttgggtcgtttcgccgtgcgcgacatgaggcagacggtggctgtgggagtgatcaaggctgtggagaagaaggacgcgactggtgccaaggtgaccaaggccgctgccaagaagaagtgaataggtcaggatgagccgcagcagcagttttgtttgtgttctgtagttgttttggcggctctagatttgttcgcactatgtgcgtgttcgatatacttgctgcaggcgcggcagagacagacctgggt

SEQ ID NO: 1273 - DNA, 1599 bp, Ceratodon purpureus
cccccctccgcccccgccctctcttcctgcttcgccaggaccccagctcagactattcaagatgggtaaggagaaggtacatatcaacattgtggtcatcggccatgtcgactccggaaagtcgacgaccaccggacacttgatctataagttgggtggtattgacaagcgtgtgatcgagcgtttcgagaaggaggcggctgagatgaacaagcgttccttcaagtacgcgtgggtgttggacaagctgaaggctgagcgtgagcgtggtattaccatcgatatcgcgttgtggaagttcgagacggtgaagtactactgcaccgtcattgatgcccccggacatcgtgatttcatcaagaacatgattacgggaacttctcaggccgattgcgccgtgctgatcatcgactcgacgaccggaggttttgaggccggtatctcgaaggatgggcagacccgtgagcacgctttgttggctttcactttgggagtgaagcagatgatctgctgctgcaacaagatggacgcgacaccccgaagtacagcaaggcccgtttcgaggagatcacgaaggaggtgtcctcctacctgaagaaggtgggatacaaccccgacaagatcccgttcgtgcccatctctgggttcgagggtgacaacatgattgagaggtcgtcgaacctggactggtacaagggccctactctgttggaggctctggacgccgttacggagcccaagaggccgtccgacaagcccctccggttgccccttcaggacgtatacaagattggaggcattggaactgtgcctgtgggacgtgtggagactggtgtgatcaagcccggtatgttagtgtgcttcgcccccatggactgaccacggaggtgaagtctgtggagatgcaccacgagtccatgcccgaggcccaccccggtgacaacgtgggattcaacgttaagaacgtggcggtgaaggacctgaagagagggttcgttgcttctgactctaagaacgatcccgcgaaggaggccgccaacttcaccgctcaggttatcatcatgaaccaccccggacagatcggtaacgggtacgccccggtgctggattgccacacttctcacatcgccgtgaagtttgccgagatcttgaccaaggttgacaggcgatcgggtaaggagctggagaaggagcccaagttcttgaagaacggtgacgctggtttcgtgaagatgattccgaccaagccgatgacggtggagactttcgctgagtacccacctttgggtcgtttcgccgtgcgcgacatgaggcagacggtggctgtgggagtgatcaaggctgtggagaagaaggacgcgactggtgccaaggtgaccaaggccgctgccaagaagaagtgaataggtcaggatgagccgcagcagccttggtcaccttggcaccagttttgttgtgttctgtagttgttttggcggctctagatttgttcgcactatgtgcgtgttcgatatacttgctgcaggcgcggcagagacagacctgggtacttgatcggagatggcagggcttgtcgtctccgtgattgttatcattctt

SEQ ID NO: 1274 - DNA, 1638 bp, Papaver somniferum
gggtaaagagaaggttcacatcaatattgttgtcattggacatgtcgactctggtaaatcgaccaccactggtcacttgatctacaagcttggaggtattgacaagcgtgtattgaaagattcgagaaggaggctgctgagatgaacaagaggtcattcaagtacgcttgggtcttgacaagcttaaggctgaacgtgagcgtggtattaccattgatattgccttgtggaagtttgagaccaccaagtactactgcacagttattgatgctcctggacatcgtgactttatcaaaaacatgatcactggtacttctcaggctgattgtgccgtcctcattatcgattctaccaccggaggttttgaggctggtatctcaaaggatggtcagactcgtgagcacgctcttcttgctttcacccttggtgtcaagcagatgatctgttgttgtacaagatggatgccaccaccccaagtactcaaagggtaggtacgaagaaattgtaaaggaagtctcttcatacttgaagaaggttggatacaacccagacaaaattgccttcgtccccatctctggtttcgagggagacaacatgattgagaggtccaccaaccttgactggtacaagggaccaactcttctcgaggctcttgacaacatctctgagcctaagagaccccacagacaagccccttcgtcttcccttcaagatgtttacaagattggaggtattggaactgtgccagttggacgtgttgaaactggagtcatcaagcctggtatggtgttcctttggacccactggttgaccactgaagttaagtctgtggagatgcaccacgaagcccttctagaagctcttccaggagacaatgttgggttcaatgtcaagaatgttgcagtgaaggatctcaagcgtggtttcgtcgcctccaactcaaaggatgaccctgccagggaagctgccaacttcacctcccaggtcatcatcatgaaccatcctggtcagatcggtaatggttatgctccagttcttgactgtcacacatctcacattgctgtcaagtttgctgagatccaaaccaagatcgataggcgatctggaaaggagcttgagaaggagcccaagttcttgaagaacggtgatgctggtattattaagatgattccaaccaagcccatggttgtagagacctttgctcagtacccacctcttggacgttttgctgttagggacatgaggcagacagttgctgttggtgtcatcaagggagttgagaagaaggatcacagagccaggttaccaagtctgctgtcaagaagaagtaaagtactccagtaagtacagggatggtgctaagagggtctgcagaagggttttgtcttgtttacttcagtagtagtcatttttgtttcttgtttgctttggttagctatcattgcagttttatatcttttgttgcctttgttttgttgagcatccagatgcaaacctgggtgcttgataggcggtggcaacatgagtttgggctgttcagttaattgaaaacttgttatggattttggtttgtaagttgctgttaacaactttttatttgcgcatctctttcccagtttaatgaaaatagtgtctgca

SEQ ID NO: 1275 - DNA, 1461 bp, Phaseolus vulgaris
aatgggtaaagagaaggttcacattagcatagtggtgattggccatgtggactcagggaagtcaactaccactggtcacctcatctacaagctgggaggtattgacaagcgtgtgatagagagattcgagaaggaggctgctgagatgaacaagaggtctttcaagtatgcttgggttcttgacaagctgaaggctgagcgtgaaagaggaatcaccattgacattgctctctggaagtttgagaccaccaagtactactgcacagtcattgatgcccccggacacagggatttcatcaaaaatatgatcactgggacatcccaagctgactgtgctgttcttattattgattccaccactggtggttttgaagctggtatttctaaggatggacagacccgtgaacatgctctccttgctttcactctcggtgtgaggcagatgatttgctgctgtaacaaggtatatatatagtaaacttctacacacctaactactccaaggcgagatatgatgaaattgtgaaggaagtgtcttcttacatgaagaaggttggttacaaccctgagaagatcccttttgttcccatatctggttttgagggagataacatgattgagaggtctaccaaccttgactggtacaagggtcctacccttcttgaggcgcttgatcagatcaatgagcccaagaggccatcagataagcctcttcgattaccccttcaggatgtgtacaagattggaggaattggaactgtacctgttggacgtgtggaaactggtgtcttgaaacctggaatgcttgttacttttgcaccaactggactcacaactgaagttaagtctgtggagatgcaccacgaagctctcactgaggctcttcctggtgacaatgtgggattcaacgtgaagaatgttgctgtcaaggatctgaaacgtggtttcgttgcgtcaaactccaaggacgaccctgccaaggaggctgccaacttcacgtcgcaggttatcatcatgaatcaccctggacagattggaaagggttatgcaccagttcttgattgccacacctcccacattgccgtgaagtttgccgaacttgtgaccaagattgacagacggtctggtaaagagcttgagaaggagcccaagttcctgaagaacggagatgctggttttgtgaagatgattccctctaagcccatggtggttgaaaccttctccgaatatcctccacttggtcgttttgctgttagagacatgcgtcaaactgtggctgtgggagtcatcaagagcgtggagaagaaggaccctgctggagctaaggtcaccaaggctgcacagaagaagggcaagtgaatcgtgcaggatggtctattaagaaatccctattacatgactatgatgaatgttgtcttgtttgcagtagtactttttttcatgttcttgtttatcagttta

SEQ ID NO: 1276 - DNA, 1599 bp, Brassica napus
gtttcacatcaacattgtggtcatcggccacgtcgactctggaaagtcaaccaccactggtcacttgatctacaagcttggtggtattgacaagcgtgtgattgagaggttcgagaaggaggctgctgagatgaacaagaggtctttcaagtatgcgtgggtgttggacaaacttaaggctgagcgtgagcgtggtatcaccattgacattgctctctggaagtttgagaccaccaagtactactgcactgtcattgatgctcctggacatcgtgatttcatcaagaacatgattactggtacctcccaggctgattgtgctgtcctcatcattgactccaccaccggtggttttgaagctggtatctccaaggatggtcagacccgtgagcatgctcttcttgctttcacccttggtgtcaagcagatgatttgctgctgtaacaagatggatgctactactcctaagtactccaaggccaggtacgatgagatcatcaaggaggtgtcttcctacttgaagaaggttggatacaaccctgacaaaatcccattcgtccccatctctggatttgagggtgacaacatgattgagaggtccaccaaccttgactggtacaagggaccaactctccttgaggcacttgaccagatcaacgagccaaagaggccctcagacaagccccttcgtctcccacttcaggatgtctacaagattggtggtattggaacggtgcccgtgggtcgtgttgagactggtatgctcaagcctggtatggttgtgaccttcgctccttcagggttgaccactgaggtgaagtctgttgaaatgcaccacgagtctcttgtggaggcacttccaggtgacaacgtcggattcaacgtcaagaatgttgctgtgaaggatctcaagcgtgggtacgttgcatccaactccaaggatgaccctgctaagggtgctgctaacttcacttcccaggtcatcatcatgaaccaccctggtcagattggtaacggttacgctccagttcttgactgccacacctcccacattgccgtcaagttctctgagatcctcacgaagattgacaggcgttctggaaaagagatcgagaaggagcccaagttcttgaagaatggtgacgctggtatggtgaagatgactccaaccaagcccatggttgttgagaccttctccgagtacccaccccttggacgtttcgctgttagggacatgaggcagactgttgcagtcggtgtcatcaagagcgttgacaagaaggacccaacgggagccaaggtgaccaaggctgccgtcaagaagggtgccaagtgaactaccttgaggaaaactctatcacccgcagttgaatggaaagacaaatttagtttttatgttacattagttttgtatttggtcgcttgtttgtgttgcagcttcgttacttctccgtcagagctctgttcacgtaactgggttcttgatcggaggtggcgaagcttctcattactctagcttccttcttttttactttgttttgctttcggattctgaactattttggatcctctctttataatgaatatggtatgtcgttc

SEQ ID NO: 1277 - DNA, 1560 bp, Flaveria ramosissima
ttattggccatgtcgactctggcaagtcaaccactactggtcaccttatttacaagcttggaggtattgacaagcgtgttattgagagatttgagaaagaagctgctgaaatgaacaagaggtcattcaaatacgcatgggttcttgacaaactaaaggctgagcgtgaacgtggtatcaccattgatattgctttgtggaagtttgagaccaccaagtactactgtactgtcattgatgctcctggacatcgtgatttcattaagaacatgattactggtacctctcaggctgattgtgctgttctgatcattgactcaaccactggtggttttgaagctggtatttccaaagatggtcagacacgtgaacatgctttgcttgccttcacccttggtgtgaagcaaatgatctgctgctgtaacaagatggatgccactacccccaagtactctaaggcaaggtatgatgaaattgtcaaggaagtctcatcctacctgaagaaggttggctacaacccagacaaaattccatttgtacccatctccggatttgagggtgacaacatgattgagaggtcaacaaaccttgactggtacaagggtccaactcttctggaagctcttgaccagattaacgaacctaaaagaccatctgacaaaccactccgtctaccacttcaagacgtgtacaagattggtggaattggaactgtccctgttggacgtgttgaaactggtgtcatcaaacctggtatggttgtcacttttggtccatctgggttgaccactgaagttaagtcagttgagatgcaccacgaggcactgactgaagctctccctggtgacaacgttgggttcaacgtcaagaatgttgctgtcaaggatctgaagcgtggttatgttgcatctaactcaaaggatgaccctgctaagggtgcagccagtttcacctcacaggtcatcatcatgaaccaccctggtcagattggaaacggttatgccccagttctggattgccacacctctcacattgcagtcaagttctctgagcttttgaccaaaatcgacagacggtctggtaaagagctggaaaaggagcccaaatttttgaagaatggtgatgccgggatggttaagatgcttcccactaagcccatggttgttgagacttttgctgagtacccaccacttggtcggtttgctgttcgtgacatgcgtcagactgttgctgttggtgtgatcaagagtgtggagaagaaggacccaactggagctaaggtgaccaaggctgcagtcaagaagggagctaaatgagtggggttggagtcgttttgttatcgaatgttgatggagcttttatcgtattttggaactatctctattatgtttatttttggttaagaatttttggtgtttggtcttcttggtgcttgcatttctgtactctagcctcactttgtgaggatggtggaggtattgagcaacttgttgcttgatgacggtggtgcaagttaccagaggacaacttttgtttgaatggttatgttgaacttctatg

SEQ ID NO: 1278 - DNA, 2775 bp, Brassica rapa
aaaaagggtggaaaacaacagttctgaaacaatggtgtcgtcgaagaaaccgaaccaggagaagaagccgaagaatggtgacggtctcaacacgcgcagctccggctccaaaacgaagaagaagacgccgaataaggcgaagttaaaggacgttgcggagaaggagccggaggttcacgagatctcggaatcgtcgagcagcgaagggaggcgtgatgagccgaaggaaagcaatggcgtcgtcgtttcggaagacgctaagatggttaggttcccgatgaatcggattcggaggatcatgagaagcgataactcagctcctcagatcatgcaggacgctgtctttcttgtcaacaaagccacggaattgttcattgagcggttttctgaagaagcttacggaagttctgtccaggacaagaagaagttcatccactacaaacatctatcatctgtagtgagtaacgaggagagatatgagttccttgcagattgtgttcctgagaaactaaaaggagaggtggcattggaggaatgggaaagaagcatgacagatgtaggctgagatgagataaaacctgttggaacctaacctgaacctttgggaatttgagtcatatcctggtcatttggttccatctggccaatcttcacattcctttataatccataatgtgatttcacatacagtagttcatttctagaatatattaccttttttttttactagttcgagtttgtaagattataaggttttataatttggctacattgaaatttatgatcggcaatatgacttactatcgcccggatcatgtgtaacattgtgaacgcaagcattattactgtgtggagtatgctgtaacatattgtaaacgcaggcatcaagaagaacttgtcattgtccaaaatcagtttagtagatgtaagaacgagagatgaggtttgaaatgggcatgtgagttattcattacaaatttagttcaaaatgcaagaaaaaatatgtagtactcgagaggtggaattcatttaagaagcgtatgggtagagttacagctcatgcaacatcagtattaaatcgatagatgtgatatgcgattaacgaccaggaaatgaaacaggcaacataagtaaattagacgagagacaataaccgcaggaatgtcatcattttcataacaaaatattcaaaacagttcataatccaaaagcaaaaagaatcagaaagcttgagagactagtagctccgccacctccgatcaagaacccaattacgagaagagagttctgacggagacgaaacgaagctcttactcaaacaagcgacacaaaaccatactaacaatgcaagaaaactaaaataggaattggattcatctgcggatgatagagacttgatgaccgaactttacttcgcacccttcttgacggcagccttggtcaccttggctccggtaggatccttcttgtccacgctcttgatgacaccgactgcaacagtctgcctcatgtccctcacagcgaaacgtccaagtggtgggtactcagagaaggtctcaacaaccatgggcttggtcggagtcatcttcaccataccagcatcaccattcttcaaaaacttgggctccttctcaatctccttaccagaacgcctgtcgatcttggtgaggatctcagagaacttcaccgcaatgtgggacgtgtggcaatcaagaaccggggcgtaaccgttaccaatctgcccagggtggttcatgatgataacctgggaggtgaagttagcagcacccttggcaggatcatccttggagttggatgcaacatacccacgcttgagatccttgacagcaacattcttcacgttgaacccgacgttgtcacctggaagcgcctccacaagtgactcgtggtgcatctcaacagacttaacctcagtggtcaagcctgaaggagcaaaggtcacaaccataccaggcttgagcataccggtctcaacacgacccactggcaccgttccaataccaccaatcttgtagacatcctgaagtggtagacggaggggcttgtctgaaggcctctttggctcgttgatctggtcaagagcctcaaggagggttggccccttgtaccagtcaaggttggtggacctctcaatcatgttgtcaccctcgaaaccagagatggggacgaaggggattttgtcagggttgtacccaaccttcttcaagtaggaagacacctccttgataatctcatcgtacctagccttggagtacttgggggtacaatgaaaaatccaattccaccttgttacagcagcaaatcatctgcttaacaccaagtgtgaaagcaagaagagcatgctcacgagtctgaccatccttagagataccagcctcaaacccaccagtagtggagtcaataatcaaaacagcacaatcagcctgggaggtaccagtgatcatgttcttaatgaaatcacgatgaccaggagcgtcaataaccgtgcagtagtacttggtggtctcaaacttccaaagagcaatatcaatggtgataccacgctcacgctcagccttaagcttgtccaacacccacgcgtacttgaaggacctcttgttcatctcagcagcctccttctcgaacctctcgatcacacgcttgtcgataccgccgagcttgtagatcaagtgacccgtggtggttgacttcccggagtcgacgtggccgatgaccacaatgttgatgtgaaacttctctttacccatggcttaa

SEQ ID NO: 1279 - DNA, 1564 bp, Flaveria ramosissima
cttcctccatctaccacacaagtcgtctgcagataaattcgttaaggattggggtaaagaaaagaactacatatcagtattgttgtcattggaccatgttcgactctggcaagtccacaacaactggacacttgatctataagcttggaggaattgacaagagagtcatcgaaagagttcgagaaggaggctgctgagatgacaaaaggtcattcaaatacgcctgggtctttgacaagactcaacggctgagcgtgaaagaggtatcaccattgatattgcctttgtggaagtttcgagacaaccaagtactactgtactgtcattgatgctcctggacatcgtgactttatcaagaacatgattacgggtacctcccaagctgactgtgccgtgcttatcattgattccaccacgggtggttttgaagctggtatttccaaggatggtcagacccgtgagcacgctcttcttgctttcactcttggtgtcaagcaaatgatttgctgctgtaacaagatggatgccacaacaccaaagtactccaagtcaaggtatgaggaaattgtgaaggaagtgtcatcttacttgaagaaggtgggatacaaccctgacaaaatcccattcgttccaatctctgggtttgaaggagacaacatgattgagaggtcgaccaaccttgactggtacaagggtccaacccttcttgaagctcttgaccagatcaatgagcccaagagaccatcagacaagccccttcgtcttccacttcaggacgtgtacaagattggtggtattggaactgtgccagtgggacgtgttgagactggtgtgatcaagcctggtatggttgtcacttttggaccatctggattgaccactgaagttaagtctgttgagatgcaccatgaagctcttactgaggctcttcctggtgacaatgttgggttcaacgttaagaatgttgctgtcaaggatctcaagcgtggttatgtagcatcaaactccaaagatgacccagctaagggtgctgctagcttcacctcccaggttatcatcatgaaccaccctggtcagattggtaatggttatgcacctgttcttgattgtcacacctcccacattgctgtcaagttctctgaacttttgaccaagatcgacagacgatctggtaaggaacttgagaaggagcctaaattcttgaagaatggtgatgctggtatggtaaagatgcttcccaccaagcctatggttgttgagactttcgcagagtatccaccacttggtaggtttgctgtcagagacatgcgtcaaacggttgctgtgggtgtgatcaagagtgtcgagaagaaggacccaacaggagccaaggttaccaaggccgcagtgaagaagggagccaagtgaggtggttttgtgttttggtttaatggtgtatttttattttcaatgtttcatttactagttttggacttatattttcttgagagttttgttatttgatccttgaagctttcattgttgtgaaaggttttgggttgcagacatttgttgtgggtttaaa

SEQ ID NO: 1280 - DNA, 1656 bp, Ceratodon purpureus
ctggagtctcttgttgtttcctccctcagtcctcatcaatcctccatcgccgctgctcacctccttcgactccgcctccttcctgctctgccaggaccccagactattcaagatgggtaaggagaaggtacatatcaacattgtggtcatcggccatgtcgactccggaaagtcgacgaccaccggacacttgatctataagttgggtggtatcgacaagcgtgtgatcgagcgtttcgagaaggaggcggctgagatgaacaagcgttccttcaagtacgcgtgggtgttggacaagctgaaggcggagcgtgagcgtggtattaccatcgatatcgcgttgtggaagttcgagacggtgaagtactactgcaccgttatcgatgcccccggacatcgcgatttcatcaagaacatgattacgggaacttctcaggccgactgcgctgtgctgatcatcgactcgacgaccggaggtttcgaggccggtatctcgaaggatgggcagacccgtgagcacgctttgttggctttcactttgggagtgaagcagatgatctgctgctgcaacagatggacgcgacaccccgaagtacagcaaggcccgtttcgaggagatcacgaaggaggtgtcctcctacctgaagaaggtgggatacaaccccgacaagatcccgtttgtgcccatctctgggttcgagggtgacaacatgattgagaggtcgtcgaacctggactggtacaaggggcctactctgttggaggcgttggacgccgtgacggagcccaagaggccgtccgacaagccctccggttgccccttcaggacgtatacaagattggaggcattggaactgtgcctgtgggacgtgtggagactggtgtgatcaagcccggtatgttggtgtgcttcgcccccactggactgaccaccgaggttaagtctgtggagatgcaccacgagtccatgcccgaggcccaccccggtgacaacgtgggattcaacgttaagaacgtggcggtgaaggacctgaagagagggttcgttgcttctgactctaagaacgaccccgcgaaggaggccgccaacttcaccgctcaggttatcatcatgaaccaccccggacagatcggtaacgggtacgctccggtgctggattgccacacttctcacatcgccgtgaagtttgccgagatcttgaccaaggttgacaggcgatcgggtaaggagctggagaaggagcccaagttcttgaagaacggtgacgctggtttcgtgaagatgattccgaccaagccgatgacggtggagactttcgctgagtacccacctttgggtcgtttcgccgtgcgcgacatgaggcagacggtggctgtgggagtgatcaaggctgtggagaagaaggacgcgactggtgccaaggtgaccaaggccgctgccaagaagaagtgaataggtcaggatgagccgcagcagcagttttgtttgtgttctgtagttgttttggcggctctagatttgttcgcactatgtgcgtgttcgatatacttgctgcaggcgcggcagagacagacctgggtacttgaccggagatggcagggcttatcgtctccgtgattgttatcattcttcttctctattataatatctgaagc

SEQ ID NO: 1281 - DNA, 1806 bp, Ceratodon purpureus
ccgccgcctccacctcgccctcttcctgcttcgccaggaactccagattattcaagatgggtaaggagaaggttcatatcaacatcgtggtcattggccatgtcgactccggaaagtcgacaaccaccggacacttgatctataagttgggtggtatcgacaagcgtgtgatcgagcgtttcgagaaggaggcggctgagatgaacaagcgttccttcaagtacgcgtgggtgttggacaagctgaaggctgagcgtgagcgtggtattaccatcgatatcgccttgtggaagttcgagacggtgaagtactactgcaccgttatcgatgcccctggacatcgtgattttatcaagaacatgattacgggaacttctcaggccgattgcgctgtgctgatcatcgactcgacgaccggaggtttcgaggccggtatctcgaaggatgggcagacccgtgagcacgctttgtggctttcactttgggagtgaagcagatgatttgctgctgcaacagatggacgcgacaccccgaagtacagcaaggctcgtttcgaggagatcacgaaggaggtgtcctcctacctgaagaaggtgggatacaaccccgacaagatcccgtttgtgcccatctctgggttcgagggtgacaacatgattgagaggtcgtcgaacctggactggtacaagggccctactctgttggaggccttggacgccgttacggagcccaagaggccgtccgacaagcccctgcggttgccccttcaggacgtttacaagattggaggcattggaactgtgccggtgggacgtgtggagactggtgtaatcaagcccggtatgttggtgtgcttcgcccccactggactgaccactgaggtgaagtccgtggagatgcaccacgagtctatgccggaggcccaccccggtgacaacgtgggattcaatgttaagaacgtggcggtgaaggacctgaagagagggttcgttgcttctgactctaagaacgaccccgcgaaggaggccgccaacttcaccgctcaggttattatcatgaaccaccccggacagatcggtaacgggtacgccccggtgctggattgccacacttctcacatcgctgtgaagtttgccgagatcttgaccaaggttgacaggcgatctggtaaggagctcgagaaggagcccaagttcttgaagaacggtgacgctggtttcgtgaagatgattcccaccaagccgatgacggtggagactttcgctgagtacccacctttgggtcgtttcgccgtgcgcgacatgaggcagacggtcgctgtgggagttatcaaggctgtggagaagaaggacgcgactggtgccaaggtgaccaaggccgctgccaagaagaagtaaaaaggttgtaagaattttggggagcagttggtttggctttggttatgcccgttctgtcttcgcacttcggacctgcctgctgtgtctggattggaatttgtaatagacaagatgcatcacacatgcatgtgaattttcatcgaataaatacatttccgatctacgatttctttaatttcgaaggataactttacacactaccgaagagaacagtcgatgaaatatcattctccgacttttcaatctttatgtaggaggttttcagatccttggaggatgctcatttgaaatgtgatattttttcctagtaagccagacagaatatcagatgtatcggacttctagtggagtgatttctaactacttagaaggttttgtagtgaatgtcttgcacaaagttcttacggac

SEQ ID NO: 1282 - DNA, 1702 bp, Fraxinus spp
ctctgctctctatctctgcatatggttttggaggctagggttcttatagctagtttatctctttttatcagcttaaaaatcaagttctaaaatgggcaaggagaaggttcatatcaacattgtggtcattggccacgtcgactcaggaaagtcaaccaccactggtcatctcatctacaagcttggaggtattgacaagcgtgtgattgagaggttcgagaaggaagctgctgaaatgaacaagaggtctttcaagtatgcctgggtgcttgacaagctcaaggctgaacgtgagcgtggtatcaccattgatattgccctgtggaagtttgagaccaccaagtactactgcactgttattgatgctcctggacatcgtgatttcattaagaatatgattactggtacttcccaggctgactgtgctgttcttatcattgattcaaccactggtgggtttgaggctggtatttctaaggatggacagacccgtgagcatgctcttctcgcttttacacttggtgtgaacaaatgatctgttgctgtaacaagatggatgctacaacacccaagtactccaaggcaaggtacgaagaaattgttaaggaagtctcttcctacttgaagaagttgggtacaatcctgacaagatccttttgtgcccatctctggttttgagggtgacaacatgattgagagatccaccaaccttgactggtacaagggaccaaccctccttgaggcccttgaccagatttcggagcccaagaggcccaccgacaaaccactacgtctcccacttcaggatgtctacaagatcggaggtattggtactgtccctgtgggtagagttgaaactggtatcttaaaacctggtacggttgttacctttggtccaagtgggctgacaactgaagttaagtctgttgaaatgcatcatgaagccctctctgaagcctcccgggtgataatgttggcttcaatgtgaagaatgttgctgttaaggatcttaagcgtggttatgttgcatctgactcaaagaatgaccctgccaagggaactgagagcttcacatcccaggtcattatcatgaaccacccaggtcagattggtagtggttatgctccagttctcgattgccacacctcccacattgctgtcaaatttgctgagctcctgaccaagatagacaggcgttctggtaaagagcttgaaaaggaacccaaattcttgaagaatggtgatgctgggatggttaagatgattccaaccaagcccatggtggttgagactttctctgagtacccccctcttggacgatttgctgtgagggatatgcgccagactgttgctgttggtgttattaagaatgtcgagaagaaggagccatctggtgccaaggtgaccaaggctgctgccaagaagggtgtcaagtgaactgtgctgcctgggatctactactgctttaattactactacagatctttccattatcatcataaagacttgctttattttattcatgctgtttcgagtcgtttatcacatgttgctggttgttttctgtgtcctcgtcagttgtctttgccatctggttatggttcccagaattgggtgctagacaggcggtggcgacactggcacgtgagttgttcgtctattttgatagtttgacattgctttatattttaaggtttttgat

SEQ ID NO: 1283 - DNA, 1831 bp, Elaeis guineensis
cttcgataaaaggcttgcggtgctccagtcgaaagccctctccgcctctcggttctcgtcgcccccgttctttcccgagagggttcgatctccccgccaccggccgagccatcatgggaaaggaaaaggtacacattaacattgtggtcattggccatgtcgattctggcaagtcaaccaccactgggcatcttatctacaagcttggtggtattgacaagcgtgtgattgagagattcgaaaaggaagcagctgaaatgaacaagaggtcattcaagtatgcttgggttcttgacaagctgaaggccgagcgagaacgtggtatcacaattgatattgctctgtggaagtttgagaccacaaagtactactgcactgtcattgatgcccctgggcatcgtgacttcatcaagaacatgatcactggcacctcccaggccgactgtgctgtccttatcatagactccacaactggtggttttgaagcaggtatctcaaaggatggacagacccgtgaacatgcattgcttgcctttactcttggtgtcaagcagatgatctgctgctgcaacaagatggatgccactactccgaagtattcaaaggctaggtatgatgaaattgtcaaggaagtttcttcctatctgaagaaggtcggttacaatcctgataagattcccttcgttcccatctctgggtttgaaggtgacaacatgattgacaggtccaccaaccttgattggtacaagggcccaacccttcttgaggctcttgacttgatacaggagcccaagaggccctcagacaagcccctccgtcttccacttcaggatgtgtacaagattggtggtatcggcactgtcccagtcggacgtgttgaaactggtatcctcaggcctggtatggtggttacctttggtcccagtggtctgacaactgaagtcaagtctgtggagatgcaccatgaggccctgcaggaggccctccctggcgataacgtgggtttcaatgttaagaatgttgctgtgaaggatctcaagcgtggttatgtggcctctaattcgaaggatgatcctgcaaaggaggccgccagcttcacttctcaggttattattatgaatcatcctggtcagattggcaacggctatgctcctgtgcttgactgtcacacctcccatattgctgttaagtttgccgagatccttactaagattgacaggcggtctggtaaggaacttgagaaggagcccaaatttttgaagaatggtgatgcaggttttgttaagatgattcccaccaagcccatggttgttgagaccttctctgagtacccacctcttggtcgatttgctgtgagggacatgcgccagacagtggcagtgggtgtcatcaagagcgtggagaagaaggatccaactggtgcccaagatcaccaaggcagctgctaagaagaagtgaacaatgtcaatgtgcgcttgggttattggcgatgataatattagactgtctttgattgttttgtctatgataatattagactgtctttgatgtttcttttaagagtcttggtaggagggggcagccttcatcttcggttttctggctcctattttctggacggtggtggtctttgagcggtagaatgcataactggattcttgaccggaggtggtggtagacaaatttgttttccttgtagtttttttttttttttgtgtgtgtccgttaaaatcacagattaaaattcagtgcaggtcttttctttttctatttaagaatgagaattttggacatctgatttataattttgagacagctgttactattttaa

SEQ ID NO: 1284 - DNA, 1793 bp, Physcomitrella patens
gaaccattccttcaagtagcagaatcgcacctgagcttgcccctttcgacctgagagctctcgtgcgagagcctgcaccgccgctgacgctgtgtgcatttccgacttcgattaatcgtttcattttgagttagttcaagatgggtaaggagaaggtccacatcaacatcgtggtcatcggccatgtcgactccggcaagtcgacgaccactgggcaccttatctacaagttgggaggtatcgacaagcgtgtgatcgagcgtttcgagaaggaggcggcggagatgaacaagcgttcgttcaagtacgcgtgggtgctggacaagctgaaggcagagcgcgagcgtggtatcacgatcgatatcgcgttgtggaagttcgagaccgtgaagtactactgcactgttatcgacgcgcccggacatcgcgatttcatcaagaacatgatcacgggaacgtcgcaggcggactgtgccgtgctgatcatcgactcgacgacgggagggttcgaggccggtatctcgaaggatgggcagacgcgtgaacacgcactgctggcgttcactttgggagtgaagcagatgatttgctgctgcaacaagatggacgcgacgaccccgaagtacagcaaggcccgatttgaggagatcagcaaggaggtgtcggcgtacctgaagaaggtggggtacaacccggacaagattccgttcgtgccgatctcagggttcgagggtgacaacatgatcgagaggtcgacgaacctggactggtacaagggtccgactctgttggaggcgttggacaacgtgtcggagccgaagaggccatctgacaagcctctgaggctgccgcttcaggacgtgtacaagattggaggcattggaactgtgccagtgggacgggtggagacgggaatcatcaggccgggcatgttggtgtgcttcgcaccgacgggactgacgactgaggtgaagtctgtggagatgcaccacgagtcgatgcccgaggcacacccgggtgacaacgttgggttcaacgtgaagaatgtggcggtgaaggacctgaagagagggtacgtggcctcagactcgaagaatgaccctgcaaaggaggcagcaaactttacggcgcaggttatcatcatgaaccacccgggacagatcggtaacggttatgcgccagtgctggattgccacacgtcgcacattgcggtgaagtttgcggagatcttgacgaaggtggacaggcgatcgggtaaggagctggagaaggagccgaagtttttgaagaacggagacgcagggttcgtgaagatgattccgacgaagccgatgacggtggagacgttcgcggagtacccaccattgggacggttcgcggtgcgggacatgaggcagacggtggctgtgggtgtcatcaaggctgtggagaagaaggagccaactggtgccaaggtgaccaaggccgccgccaagaagaagtgaggggttgggttttagtcggtgacataatttatttgttcgatgccgcctctggcgtcggcacttctcgagcttgtttatgccgttttctttgggtggaatggcaacgctgttaaatggttatctgcactgcactgcgtctcgttttttgtatccaactgtatctttatattgtttgcttgttgtctgaacatgtttttgttcggtgctccttgcgtgctggtgtgacagtctgaaatgtgttctgtctaaccgtaattccatttcttagttacttctacccctcatttgtcatggcacttagatgtatgt

SEQ ID NO: 1285 - DNA, 1721 bp, Physcomitrella patens
agaatgctctcccacccctcccacttccctactctctcccaggcaggacggcaggagagattggtcgttgttgcgcacttcactgttacagatagaaacctccgcttcttcagatagttcaagatgggtaaggagaaggtccacatcaacatcgtggtcatcggccatgtcgactccggcaagtcgacgaccactgggcaccttatctacaagttgggaggtatcgacaagcgtgtgatcgagcgttttgagaaggaggcggcggagatgaacaagcgttcgttcaagtacgcgtgggtgctggacaagctgaaggcagagcgcgagcgtggtatcacgatcgatatcgcgttgtggaagttcgagaccgtgaagtactactgcactgtgatcgacgcgcccggacatcgcgatttcatcaagaacatgatcacgggaacgtcgcaggcggactgtgctgtgttgatcatcgactcgacgacgggagggttcgaggccggtatctcgaaggatggacagacgcgtgagcacgcactgctggcgttcactttgggagtgaagcagatgatttgctgctgcaacaagatggacgcgacgaccccgaagtacagcaaggcccgatttgaggagatcagcaaggaggtgtcggcgtacctgaagaaggtggggtacaacccggacaagattccgttcgtgccgatctcagggttcgagggtgacaacatgatcgagaggtcgacgaacctggactggtacaagggtccgactctgttggaggcgttggacaacgtgtcggagccgaagaggccatctgacaagcctctgaggctgccgcttcaggacgtgtacaagattgggggcattggaactgtgccagtgggacgggtggagacgggaatcatcaggccgggcatgttggtgtgcttcgcaccgacgggactgacgactgaggtgaagtctgtggagatgcaccacgagtcgatgcccgaggcacacccgggtgacaacgttgggttcaacgtgaagaatgtggcggtgaaggacctgaagagagggtacgtggcctcagactcgaagaatgaccctgcaaaggaggcagcaaactttacggcgcaggttatcatcatgaaccacccgggacagatcgggaacggttacgcaccagtgctggattgccacacgtcgcacattgcggtgaagtttgcggagatcttgacgaaggtggacaggcgatcgggtaaggagctggagaaggagccgaagtttttgaagaacggggacgcagggttcgtgaagatgattccgacgaagccgatgacggtggagacgttcgcggagtacccaccattgggacggtttgcggtgcgtgatatgaggcagacggtggctgtgggtgttatcaaggccgtagagaagaaggaacccaccggcgccaaggtgaccaaggccgctgccaagaagaagtagttttattggtattgcggagttggcagttttggtattggttcggggatatttttctgaatctagggatattgaggtgctgtgcttgctcgaaatacttggtgcggtctttacttagtccaagttgggttccgctcattttatctcgatgctgagatgtatgtaatgcgcttactcttgattttatttttactgatttgggccagcgtccaaagttgattcaatgaatttccagatgtctgctatctttcaagtcc

SEQ ID NO: 1286 - DNA, 1963 bp, Physcomitrella patens
gcaaacaacaaagcccgccgttgagaaaactccgccgtcggattcagcctcggaccagcgcggcttccacaccctaagggacaggagcccttcaagaggccgcgccgcacagcatcccacttcacagtgatcgcgagaggtctcggagcagagatttttgtacctattcgcaacctgcttaaattttgagttagttcaagatgggtaaggagaaggtccacatcaacatcgtggtcatcggccacgtcgactccggcaagtcgacgaccactgggcaccttatctacaagttgggaggtatcgacaagcgtgtgatcgagcgtttcgagaaggaggcggcggagatgaacaagcgttcgttcaagtacgcgtgggtgctggacaagctgaaggcagagcgcgagcgtggtatcacgatcgatatcgcgttgtggaagttcgagaccgtgaagtactactgcactgttatcgacgcgcccggacatcgcgatttcatcaagaacatgatcacgggaacgtcgcaggcggactgtgccgtgctgatcatcgactcgacgacgggagggttcgaggccggtatctcgaaggatgggcagacgcgtgaacacgcactgctggcgttcactttgggagtgaagcagatgatttgctgctgcaacaagatggacgcgacgaccccgaagtacagcaaggcccgatttgaggagatcagcaaggaggtgtcggcgtacctgaagaaggtggggtacaacccggacaagattccgttcgtgccgatctcagggttcgagggtgacaacatgatcgagaggtcgacgaacctggactggtacaagggtccgactctgttggaggcgttggacaacgtgtcggagccgaagaggccatctgacaagcctctgaggctgccgcttcaggacgtgtacaagattggaggcattggaactgtgccagtgggacgggtggagacgggaatcatcaggccgggcatgttggtgtgcttcgcaccgacgggactgacgactgaggtgaagtctgtggagatgcaccacgagtcgatgcccgaggcacacccgggtgacaacgttgggttcaacgtgaagaatgtggcggtgaaggacctgaagagagggtacgtggcctcagactcgaagaatgaccctgcaaaggaggcagcaaactttacggcgcaggttatcatcatgaaccacccgggacagatcggtaacggttatgcgccagtgctggattgccacacgtcgcacattgcggtgaagtttgcggagatcttgacgaaggtggacaggcgatcgggtaaggagctggagaaggagccgaagtttttgaagaacggagacgcagggttcgtgaagatgattccgacgaagccgatgacggtggagacgttcgcggagtacccaccattgggacggttcgcggtgcgggacatgaggcagacggtggctgtgggtgtcatcaaggctgtggagaagaaggagccaactggtgccaaggtgaccaaggccgccgccaagaagaagtaaatctcctgggattgaagagactttttattcctgagtactcggacttgataatttttcggagtatatgcagcgcatttcgctgatgcttgtggagacttaattttcattcttacccgcctgaagatagtcatgtagttcatcttggtgtcaggattattttagcgagttcatgtcacggatacctttactatttcctgagttctcctttaatgccctctgtcatatcccgaatacttgacatgtttccgttcaagttcattcgttgaccgtcttgattccatggttgttttgatatgctcgacagaatatgtcaattctgttgtcgacgttacagtttgtctgttgattgagcccctctatgttatcattttacaattactgtgaagtttgactgaagaaaatcctttttttttttgcct

SEQ ID NO: 1287 - DNA, 1673 bp, Physcomitrella patens
acactctcttccacacactctactgtctctctctcccccccccccacctttgcgtggatacggtggcgttactgctgcaccctaaaaccctcatcttccctaggtaaaccaagatgggtaaggagaaggttcacattaacatcgtggtcatcggccatgtcgactccggaaagtcgacgaccactggtcaccttatttacaagttgggaggtatcgacaagcgtgtcatcgagcgtttcgagaaggaagctgctgagatgaacaagcgttccttcaagtacgcgtgggtgttggacaagctgaaggccgagcgagagcgtggtatcactattgatattgcgttgtggaagttcgagaccgtgaagtactactgcactgtcatcgacgcccctggacatcgtgatttcatcaagaacatgattacgggaacctcgcaggctgattgtgcggtgctcatcattgattcgacgaccggaggttttgaggccggtatctcgaaggatggtcagactagggagcacgcgttgttggctttcactttgggagtcaagcagatgatctgctgttgcaacaagatggacgcaaccaccccgaagtactccagtgcacgttatgaagagattgtcaaggaggtgtcttcctacctgaagaaggttggatacaaccctgataagattccattcgttcccatctctgggttcgagggtgacaacatgattgagaggtcgacaaacctatcctggtacaaggggcccactctcttggaggcgctcgacaatgtgtcagaacccaaaaggccgtctgacaagccccttaggttgccgttacaagatgtgtacaagataggaggaattggaactgtgcctgtgggtcgtgtggagactggaatcatcaggcccggtatgttggtttgcttcgcacccactggactgacgacggaggtgaagtccgtggagatgcaccacgagtcgatgcctgaggcgcacccaggtgacaacgttgggttcaacgtgaagaatgtggcggtgaaggaccttaagagagggtacgtggcttcggattcgaagaacgatccagcgaaggaggctgcgaacttcacagcccaggttatcatcatgaaccacccaggccagatcggcaacgggtacgctccagtgctggactgccacacatctcacattgcggttaagttcgcagagatcttgaccaaggtggacaggcgatcaggtaaggagctggagaaggagcccaagtttttgaagaacggagacgcagggttcgtgaagatgattccgaccaagcccatgaccgtggagaccttttctgagtaccctcctttgggtcgtttcgcggtgcgcgacatgagacagactgtggccgttggtgttatcaaggccgtggagaagaaggagccaactggtgccaaggtgaccaaggctgccgcgaagaagaagtgaatagtatttgcatggtggtttgtggtgaattcgctaggacttggctgtaatgatcagtgggtagaagtgactagttcatgtttttgttcgatgcgctgggtggaagcgcggcagaggcagagttgggtacttgatagaaggtggcgaggtgaaatgtatgattctcagttaatcttataatgtgatcgcacttaagcgcacattgcttcattgctc

SEQ ID NO: 1288 - DNA, 1913 bp, Ceratodon purpureus
ctgctctcgcacacctcagacgcccctttcgccaagactccgccgcctcccctcgccctcttcctgcttcgccaggaactccagattattcaagatgggtaaggagaaggttcatatcaacatcgtggtcattggccatgtcgactccggaaagtcgacaaccaccggacacttgatctataagttgggtggtatcgacaagcgtgtgatcgagcgtttcgagaaggaggcggctgagatgaacaagcgttccttcaagtacgcgtgggtgttggacaagctgaaggctgagcgtgagcgtggtattaccatcgatatcgccttgtggaagttcgagacggtgaagtactactgcaccgttatcgatgcccccggacatcgtgatttcatcaagaacatgattacgggaacctctcaggccgattgcgctgtgctgatcatcgactcgacgaccggaggttttgaggccggtatctcgaaggatgggcagacccgtgagcacgctttgttggctttcactttgggagtgaagcagatgatttgctgctgcaacaagatggacgcgaccaccccgaagtacagcaaggctcgtttcgaggagatcacgaaggaggtgtcctcctacctgaagaaggtgggatacaaccccgacaagatcccgtttgtgcccatctctgggttcgagggtgacaacatgattgagaggtcgtcgaacctggactggtacaagggccctactctgttggaggccttggacgccgttacggagcccaagaggccgtccgacaagcccctgcggttgccccttcaggacgtttacaagattggaggcattggaactgtgccggtgggacgtgtggagactggtgtaatcaagcccggtatgttggtgtgcttcgcccccactggactgaccactgaggtgaagtccgtggagatgcaccacgagtctatgccggaggcccaccccggtgacaacgtgggattcaatgttaagaacgtggcggtgaaggacctgaagagagggttcgttgcttctgactctaagaacgaccccgcgaaggaggccgccaacttcaccgctcaggttattatcatgaaccaccccggacagatcggtaacgggtacgccccggtgctggattgccacacttctcacatcgctgtgaagtttgccgagatcttgaccaaggttgacaggcgatctggtaaggagctcgagaaggagcccaagttcttgaagaacggtgacgctggtttcgtgaagatgattcccaccaagccgatgacggtggagactttcgctgagtacccacctttgggtcgtttcgccgtgcgcgacatgaggcagacggtcgctgtgggagttatcaaggctgtggagaagaaggacgcgactggtgccaaggtgaccaaggccgctgccaagaagagtaaaaggttgtaagaattttggggagcagttggtttggctttggttatgcccgttctgtcttcgcacttcggacctgcctgctgtgtctggattggaatttgtaatagacaagatgcatcacacatgcatgtgaattttcatcgaataaatacatttctgatctacgatttctttaatttcgaaggataactttacacactatcgaagggaacagtcgatgaaatatcattctccgacttttcaatctttatgtaggaggttttcagatccttggaggatgctcatttgaaatgtgatattttttcctagtaaatcagacagaatatcagatgtatcggacttctagtggagtgatttctaactacttagaaggttttgtagtgaatgtcttgcacaaagttcttacggatttgctgtctggcctgtaaagggggttgtttacttacaaatctctctccacacccactcactgttggcg

SEQ ID NO: 1289 - DNA, 1652 bp, Pennisetum glaucum
cccaaccctaccccgcagccgccgtccctctcccctccctcttcttctccgccgctccgcgagattaacctttgcttttagccatgggcaaggagaagagtcacattaacatcgtggtcattggccatgtcgactctggcaagtcaaccaccactggccacctgatctacaagcttggaggtattgacaagcgtgtgatcgagaggttcgagaaggaggccgcagaaatgaacaagaggtccttcaagtacgcgtgggtgcttgacaagctgaaggctgagcgtgagagaggtatcaccatcgacattgccctgtggaagttcgagaccaccaagtactactgcacggtcatcgatgcccctggtcaccgtgacttcatcaagaacatgattaccggcacctcccaggctgactgcgctgtcctcatcattgactctaccactggtggttttgaggctggtatctctaaggatggccagacccgtgagcatgctctgcttgctttcactcttggagtgaagcagatgatctgctgctgtaacaagatggatgccaccactcccaagtactccaaggcccgttatgatgagattgttaaggaagtctcctcgtacctcaagaaggtgggttacaacccagacaagattgccttcgtccccatctccggtttcgagggtgacaacatgattgagaggtccaccaaccttgactggtacaagggcccaaccctgcttgaggctctggaccagatcaacgagcccaagaggccctccgacaagcccctgcgtctcccccttcaggatgtgtacaagatcggtggtattggaactgtccctgttggccgtgttgagactggtgtgatcaagcctggtatggttgtcacctttggtccaactggcctgactactgaggttaagtctgttgagatgcaccacgaggctctccaggaggcccttcccggtgacaatgttgggttcaacgtgaagaacgttgctgtgaaggatctcaagcgtgggtacgtggcctccaactccaaggacgaccctgccaaggaggctgccagcttcacctcccaggttatcatcatgaaccaccctgggcagattggcaacgggtatgcaccagtgctggactgccacacctcccacatcgctgtcaagtttgctgagcttgtcaccaagatcgacagacgatctggtaaggagctcgagaaggagcccaagttcctgaagaacggtgatgctggtatggtgaagatgattcccacgaagcccatggttgttgagacattctctgagtaccctcctcttggtcgctttgctgttcgggacatgaggcagacggttgctgttggtgtcatcaagagcgtcgagaagaaggaccccactggtgccaaggttaccaaggctgctgccaagaagaatgagagggttgacattgtctgctgtgtttcatctatcttagtactcttgctgttttaagctttgttatgctattgtttttgcagttggtagcaactgtaatttctgctggcaatgtgccctagtctgctgtcctgtaaacgctactgttattttggttgtggttaaacctggctactttgagtgagttaaacgctctgtagtaacaatcttgctgttctgcacctaaaa

SEQ ID NO: 1290 - DNA, 1798 bp, Pseudotsuga menziesii
gcgaagctgttactgggttccctgattctccagactctgccaggcgatttgttgaaggctttaagtcatcatgggaaaggagaaaacccatatcaacattgtggtcattggccatgtcgactctggcaagtcaactaccactggccatttgatctacaagcttggagggattgacaagcgtgtgattgaacgatttgagaaagaagccgctgagatgaacaagaggtcattcaagtatgcttgggttcttgacaagctcaaggctgaacgtgaacccaagcatacttgaacgtggtatcacaattgatattgcactgtggaagtttgagacaactaaatactactgcactgtgattgatgcccctggccatcgtgatttcatcaagaacatgattactggaacctctcaggctgattgtgcagtgttgattattgactcaacaactggaggttttgaggctggtatctccaaggatggtcagactagagaacatgctctactggcattcaccctgggagtgaagcaaatgatttgctgctgtaacagatggatgccatacccccaagtactcaaaggctcgttatgatgaaatttgtcaaagaagtatcttcttatttgaagagggttgggatacaacccagacaagattccttttgtgcctatctctggttttgaaggtgacaacatgattgagcgctcgaccaaccttgattggtacaagggtccaactctcttggatgcccttgaccaggtttcagagcccaagcgaccttcagacaagcctctgaggttgcctcttcaggatgtttacaagattggtggtattggaactgtgcctgttggtcgtgtggaaactggtgtcatcaagccaggtaccattgttacctttggtcctaccgggctgacaactgaggttaagtccgttgagatgcatcatgaagctctgcaggaggcattgcctggtgacaatgtgggattcaacgtgaagaatgttgctgttaaggatctgaaacgtggttatgtggcatctgattccaagaatgatccagccaaggaagctgccaactttaccgctcaggttattattatgaatcatccaggacagattggaaatggttatgcccctgtattggattgccacacttgccacattgcggtcaagttttctgagatcatgaccaaggttgacaggcgttctggcaaggagctggagaaggaacccaagttccttaagaacggagatgctgggtttgtcaagatgattccaaccaaaccaatggttgtggaaacctttgccgagtatcctccattgggtcgttttgcagtgagggacatgcgtcagacggttgctgttggagtcattaaagctgttgaaaagaggaccctactggtgcaaaggtcaccaaggcagctgctaagaagaagtgaatattgaatagaagtgattgggaatggaggagtttgtaccgcattacgcgtgcttgcatctttctctattttcctgatggtatgttagtagagttagtttatcaaatgcagaattgggtgcttgatcggcggtggcagagtttacattattttccagtaagtactctttagtagcttagggcaagttgattgagatttcgtattttcggggaaatcatcagtttgtctgcattgctaatatgcagttggagtgtgagggagaaaggatattaataatttctgttactctgttttttattttaaatcatgtattgccgtacatatggctattttccagattgaagaaaacttggaattaatattaaatcg

SEQ ID NO: 1291 - DNA, 1464 bp, Cicer arietinum
cccccctatcccctgtcgtgccttgcctcccacgacttattccgaacgagtcttagatttcatttcttctttgctaagatatcatgggtaaagaaaagtttcatatcaacattgtcgtcattggacatgtcgactctggaaaatcaaccaccactggtcacttgatctacaagcttggaggtattgacaagcgtgtcattgagaggttcgagaaggaggctgctgagatgaacaaacgttcattcaagtacgcctgggtgctcgacaagcttaaggctgagcgtgaaagaggtattaccatcgatattgccttgtggaaattcgagaccaccaagtactactgcacagtcatcgatgcccccggacatcgtgatttcattaagaacatgattactggtacctcccaagctgattgtgctgtccttatcattgactccaccactggtggttttgaggctggtatctctaaggatggacagacccgtgagcacgcccttcttgctttcactcttggagtgaaacagatgatctgttgttgtaacaagatggatgccactacacccaagtactcaaaggccaggtacgatgaaatcgtgaaggaagtttcttcatacttgaagaaggttggttacaaccctgacaaatcccttcgttccaatctctggatttgagggagacaacatgattgagaggtccaccaaccttgactggtacaagggaccaactctccttgaggctcttgaccagatcaaacgagcccaagagaccctcagacaagcccctcaggcttccattgcaagatgtttacaagatcggtggtattggaactgtgccagtcggacgtgttgagactggagtcatcaagcctggtgtgatcgttacctttggccctaccggtctgacaactgaagttaagtctgttgagatgcaccacgaggctctcaccgaagctctccctggagacaatgttggattcaatgttaagaatgttgcagtgaaggatctcaagcgtggtttcgttgcatccaactccaaggatgaccctgctaaggaagctgccaacttcacttcccaagtcatcatcatgaaccatccaggacagatttggaaacggttatgcccccagtcctcgactgtcacacctcccacattgctgttaagttcgctgagcttctcaccaagattgacagacgatctggtaaggaactcgagaaggagcctaagtttttgaagaatggtgatgctggtcttgttaagatgattccaacaaagcctatggttgtggaaactttctccgagtatccaccacttggtcgttttgtctgtgagggacgatgcgtcaaactagttgtctgtcggtgtcattaagtagtgttgagaagaaggatccaacctaggaggccaacgaatcacccaaacggacgtgcagtcaagaagaagtgagtttgtcacatcatcatcacc

SEQ ID NO: 1292 - DNA, 1456 bp, Ceratodon purpureus
ggaactccagattattcaagatgggtaaggagaaggttcatatcaacatcgtggtcatttggccatgtcgactccggaaagtcgacaaccaccggacacttgatctataagttggatggtatcgacaagcgtgtgatcgagcgttcgagaaggaggcggctgagatgaacaagcgttccttcaagtacgcgtggtgttggacaagctgaaggctgagcgtgagcgtggtattaccatcgatatcgccttgtggaagttcgagacggtgaagtactactgcaccgttatcgatgcccctggacatcgtgattttatcaagaacatgattacgggaacttctcaggccgattgcgctgtgctgatcatcgactcgacgaccggaggtttcgaggccggtatctcgaaggatgggcagacccgtgagcacgctttgttggctttcactttgggagtgaagcagatgatttgctgctgcaacaagatggacgcgaccaccccgaagtacagcaaggctcgtttcgaggagatcacgaaggaggtgtcctcctacctgaagaaggtgggatacaaccccgacaagatccccttttgtgccccatctctgggttcgagggtgacaacatgattgagaggtcgtcgaacctggactggtacaagggccctactctgttggaggccttggacgccgtgacggagcccaagaggccgtccgacaagcccctccggttgcccccttcaggacgtatacaagattggaggcattggaactgtgccggtgggacgtgtggagactggtgtgatcaagccccggtatgttggtgtgcttcgcccccactggactgaccacggaggtgaagtctgtggagatgcaccacgagtctatgccggaggcgcaccccggtgacaacgtgggattcaacgttaagaacgtggcggtgaaggacctgaagagagggttcgttgcttctgactctaagaacgaccccgcgaaggaggccgccaacttcaccgctcaggttatcatcatgaaccaccccggacagatcggtaacgggtacgccccggtgctggattgccacacttctcacatcgccgtgaagtttgccgagatcttgaccaaggttgacaggcgatcgggtaaggagctggagaaggagcccaagttcttgaagaacggtgacgctggtttcgtgaagatgattccgaccaagccgatgacggtggagactttcgctgagtacccacctttgggtcgtttcgccgtgcgcgacatgaggcagacggtggctgtgggagtgatcaaggctgtggagaagaaggacgcgactggtgccaaggtgaccaaggccgctgccaagaagaagtgaataggtcaggatgagccgcagcagcagttttgtttgtgttctgtagttgttttggcggctctagattttgttcgcactatgtgcgtgtt

SEQ ID NO: 1293 - DNA, 1748 bp, Cucurbita pepo
atttcggtcggtctagtcttcttcttctatttcatcaatcttcgttttttgaggttataagtttaaaatgggaaaagagaagactcacatcaacattgtagtcattggccatgtcgactctggaagtctaccaccaccggacacttgatctacaagcttggtggtatcgacaagcgtgttattgaaaggttcgagaaagagctgctgagatgaacaagaggtcattcaaatatgcctgggtgttggacaaactcaaggctgagcgtgaacgtggtatcaccatcgatattgctttgtggaagttcgagaccaccaaatactactgcaccgttattgatgcccctggacatcgtgatttcattaagaacatgattactggtacctcacaggccgattgcgctgttctcattattgattccactactggtggttttgaagccggtatttctagggatgggcaaacccgtgagcatgctttgcttgcgtttactcttggtgtcaagcagatgatctgctgctgcaacaagatggatgccacaccccaagtactccaaggcaggtatgacgaaattgtgaaggaagtttcgtcctacctcaagaaggttggatacaaccctgacaaaatcccattcgtccccatctctggtttcgaaggagacaacatgattgagaggtcaacaaacctcgactggtacaagggtccaaccctcctcgaggctcttgacttgatccaggagcccaagaggccctcggacaagccactccgtcttccactccaggatgtgtacaagattggtggtattggcactgtacctgttggacgtgttgagactggtgtactcaagcctggtatggtcgtcactttggcccatctggattgaccactgaagttaagtctgtggagatgcaccatgaagctctcccagaggctcttcccggcgacaatgtcggattcaatgtgaagaatgttgctgtcaaggatctcaagcgtggtttcgttgcttccaattcaaaggatgatcctgccagggaggctgccaacttcacatctcaggtcattatcatgaaccacccagggcagattggcaatggttatgctccagtgctggattgccacacctctcacattgccgtgaagttcgctgagattctgaccaagatcgacaggcgatcgggtaaagaacttgagaaggagccgaagttcttgaaaaatggtgatgcgggtatgattaagatggttcccaccaagcccatggtggtggaaaccttctcccagtacccacctcttggacgttttgctgtgagggacatgagacagaccgtggctgtgggagtcatcaagtcggtcgagaagaaggatccaagtggtgccaaggttaccaagtccgcagtgaagaagggtggaaagtgaaccgtagtgggaaaacctcagctgggtctgcctgaggtttacaagtataaatgtcgaaataaagacctgatggtttttcgtggtggtggtgctgctttatcgagtcttttcatctacttttgtgattatagttgttggcgttggtcattattaggtacccagtcccagaattgggtgcttgatagacggtggcgcagctatatggctcaaaaggtcttttttgtgtttgttgtttggtcttatgctcttatcgccctgttgctctaaagttttcgagttctatgtttctgctgagatactcataatattactaaacactaaatgtcgttgcttatat

SEQ ID NO: 1294 - DNA, 1681 bp, Fraxinus spp
aacattgtggtcattggccatgtcgattctggaaaatcaaccaccactggtcacttgatctacaagcttggtggtattgacaagcgtgtcattgaaaggttgagaaggaggctgctgagatgaacaagaggtcatttaagtatgcctgggtgctcgacaagctcaaggctgagcgtgagcgtggtattaccattgatattgccttgtggaaattcgagaccaccaagtactactgcactgtcattgatgctccaggacatcgtgactttatcaagaacatgattactggtacctcacaggctgactgtgccgtcctaatcattgattccaccactggtggatttgaagctggtatctccaaggatggtcagacccgtgagcatgctttgcttgctttcacactcggtgtcaggcagatgatttgctgctgcaacaagatggatgccaccacgccgaagtactccaagcctagatttgatgaaattgtgaaggaagtttcttcctacatcaagaaggttggttacaaccctgacaagattccattcgtccccatttctggttttgagggtgacaacatgattgagaggtccaccaacctcgactggtacaagggcccaaccctgctagaagccctcgaccagattcaggagcccaagaggccctcggataagcctcttcgtctcccacttcaggatgtctacaagattggtggtattggtactgtcccagtgggtcgtgtggagactggtgtcatcaagcctggtatggttgtgactttcggtccctctggtttgaccactgaagttaagtctgttgagatgcaccacgaagcccttcaggaggctctccctggtgataatgttgggttcaatgtcaagaatgttgctgtcaaggatctcaagcgtggttacgtggcttccaactccaaggatgatcctgctaagggagctgctagctttactcccaggtcatcatcatgaaccaccctggtcagattggaaatggatatgctcctgtgcttgactgccacacctctcacattgctgttaagtttgctgaactccaaactaagattgacaggcgatctggtaaggagcttgagaaggagcccaagtttttgaagaatggtgatgctggtattgttaagatgattccaaccaagcccatggtggtggagactttctctgagtacccacctcttggtcgttttgctgttagggatatgcgtcagactgttgctgttggagtcatcaagagtgtggacaagaaggatccatccggtgccaaggtgaccaaagctgctgccaagaagggtgccaagtgaggctggatagatactgtgtttttcatcattgcattctttattttctattttttttttgggacatcttctgcaattttggttctttttatccattgatatgcttttatcacattttacctgcctattttctgagagaaggtgggggtgagctttgaacatggtgctcaaatgggcagtggtgaaagctatctggatgcgtttcttgcttaggataatataggcgtaagatgagtttgtagctcttgttttggtagacaatttggatttgagtgtgttgactttatttcattctacattctacattctacatatttatttcattgcttatagtgagaagtttgcaatgaatcttgcgtc

SEQ ID NO: 1295 - DNA, 1602 bp, Phalaenopsis aphrodite
ccctgagcagctgccagagagacgaaattcttcagctgttgttcaactctgcaatcgcgtttaagaagataagctatgggaaaggagaaggttcacatcagcattgtggtcattggtcatgttgattccggaaaatcaaccaccactggtcacctcatatacaagcttggtggtattgataagcgagttatcgagcggttcgagaaggaagcggctgagatgaacaagaggtcattcaagtatgcatgggtgcttgacaaactcaaggccgagcgcgagcgtggtatcactattgacatcgccttgtggaagtttgagaccacaaaatactattgtaccgtcattgatgctcccggccatcgtgattttatcaagaatatgatcactggaacttctcaggcagattgtgctgtgctgatcattgattccaccactggaggttttgaagccggtatttccaaggatggccagacacgtgagcatgcccttcttgctttcacccttggtgtgaagcagatgatttgctgttgcaacaagatggatgccaccacgccaaagtctctaaggcgaggtatgatgaaattgtgaaggaggtttcgtcctacttgaagtaaggtgggttacaatcctgagaaaattccctttgtgccaatatctggatttgaaggcgacaatatgattgagagatctagcaaccttgactggtacaagggtccaactctgcttgaagccctggacttgattcaggaaccaaagcgtcctgacaagccctccgtcttccgctccacggatgtctacaagaattggaggcgattggaactgttcctgtgggaagagttgagacaggagtcctcaaacccggaattgtggtgacgtttggacctactggcctcacaactgaagtcaagtctgttgagatgcaccacgaggctcttcaggaagcccttcctggggacaatgttggctttaatgtcaagaatgttgctgttaaggacttgaagcgtggatttgtggcctcaaactccaaggatgatccagcaaaggaagctgcaaattttacttcgcaggtcatcattatgaatcatccaggccagattggcaatggctacgcccctgttctagactgtcacacctcccacattgctgttaagttttctgagatattgaccaagattgacaggcgctctggtaaggagcttgagaaggagcctaagttcctgaagaatggggatgctggatttgtgaagatgattcctacaaagcccatggttgttgagacattttctgagtatcctccgcttgggagatttgctgttagggacatgaggcggactgttgctgtcggagttataaggagtggggagaagaaggatccggctggagccaaaggtaccaggtctgctgtgaagaagaaatgaggggaggactgcttcgtttcagtggtgtgcgagtcatttgttggtcgcggctgcaggtttgtaattaataagtgtgatttggtcgactcggcatcttgtgtttggatgcacaactggctgcttgaccgggaggctggcggctgaaaaaatttattctggcttggtatgatggttaatttattct

SEQ ID NO: 1296 - DNA, 1456 bp, Papaver somniferum
ttgttgtcattggacatgtcgactctggtaaatcaaccaccactggtcacttgatctacaagcttggaggtattgacaagcgtgtgatcgagaggttcgagaaagaggctgctgagatgaacaagaggtcattcaagtacgcatgggttcttgacaagcttaaggctgaacgtgagcgtggtattaccattgatattgccttgtggaagtttgagaccacaaagtactactgcacaattattgatgctcctggacatcgtgatttttattaagaacatgattactggtacctctcaggccgattgtgccgtgcttattattgactccaccactggaggttttgaggctggtatctccaaggatggccagactcgtgagcacgcccttcttggctttcacgcttggtgtcaagcagatgatctgctgctgtaacaagatggatgccacacccccaagtactcgaaggctagatatgatgaaattgtgaaggaggtctcatcttacttgaagaaggttgggtacaatccagacaaaattgccttcgttcccatctctggatttgagggagacaacatgattgagaggtccaccaaccttgactggtacaagggaccaactcttcttgaggctcttgacaatatctctgagccaaagaggccctcagacaagcccctccgtctcccacttcaggatgtttacaagattggaggtattggaactgtgccagtgggacgtgttgaaactggtttcatcaagcctggaatggttgtcacttttggacccactgggttgactactgaagttaagtctgtggagatgcaccacgaggctctccaagaagctcttccaggtgacaatgtcgggttcaacgttaagaatgttgctgttaaggatctcaagcgtggtttcgtggcttccaactccaaggatgaccctgccagggaagcggctaacttcacctcccaggtcatcatcatgaaccaccccggtcagattggtaatggttatgccccagtccttgactgtcacacttctcacattgctgttaagtttgccgaaatcctcaccaagattgataggcggtctggaaaggagcttgagaaggagcccaagttcttgaagaacggtgatgctggtattattaagatgcttccaaccaagcccatggttgtggagaccttctctcagtacccacctcttggacgatttgctgtcagggacatgaggcagacagttgctgttggtgttatcaaggaagttgagaagaaagacccatcaggtgccaaggtcaccaagtctgctgccaagaagaaatgaagtgtgcgcttgggtagaggggtgatgttgagagcagtcagaggaaggaactgtcttgttctcattagtaatatgttttatatgatcttgtttgtggtctgcttgatccgttgtcattgcagtcttctcgcttgttttg

SEQ ID NO: 1297 - DNA, 1720 bp, Physcomitrella patens
gaagagggagcgccgcacgctaatctgtcgtcccgtgacatactctccagagctctcctgcgagattagtcgccactgtcgttttttcctacgctgctcggaacctctgcctcgttttccagataatcgaagatgggtaaggagaaagttcacatcaacattgtggtcatcggccatgtcgactccggcaagtctacgaccacaggccacctgatctacaagctaggagggatcgacaagcgtgtgatcgagcgctttgagaaggaagcggctgagatgaacaagcgttcgttcaagtacgcgtgggtgctggacaagctgaaggctgagcgcgagcgtggtatcacgatcgatattgcgctgtggaagttcgagaccgtgaagtactactgcactgtgatcgacgctcccggacatcgcgatttcatcaagaacatgattacgggaacgtcgcaggcggactgcgcagtgctgatcattgactccaccaccggaggattcgaggctggtatctccaaggatgggcagacccgtgagcatgcactgttggctttcaccttgggagtgaagcagatgatctgctgctgcaacaagatggacgctaccacgccgaagtacagcaaggctcgattcgatgagatcagcaaggaggtgtcgacgtacctcaagaaggtcggttacaacccggacaagattccgttcgtgcccatttcagggtttgagggtgataacatgatcgagcgatcgacgaacttggactggtacaagggcccaacccttctcgaggccctggacaacgtgtcagagcccaagaggccatccgacaaacccctgcggttgccccttcaggatgtctacaagattggaggtattggaactgtgccagtgggacgtgtggagactggaatcatcaggccgggtatgttggtgtgctttgcacccactggactgacgactgaggtgaagtcggtggagatgcaccacgagtcgatgcctgaggctcaccccggagacaacgtcgggttcaatgtgaagaacgtggcggtgaaggacctgaagagaggatacgtggcttcggactcgaagaacgaccctgcgaaggaagcagccaacttcactgcccaggttatcatcatgaaccacccgggacagatcggaaacggttacgcgccggtgctggactgtcacacctctcacattgccgtgaagtttgccgagatcttgacgaaggtggacaggcgatcgggtaaggagctggagaaggagcccaagtttttgaagaacggagacgcagggttcgtgaagatgattccgaccaagcccatgactgtggagactttcgcggaatacccgccattgggacgtttcgccgtgcgtgacatgagacagacggtggccgtaggtgttatcaaggccgtggagaagaaggaaccaactggtgcgaaggttactaaggccgctgccaagaagaagtgaatagtgcgggatttggttttggcggagcagtcaccgggtgtccagagcggggttgatattggggtaggtatcttatgttggagcgtgcacttgttgagttgcttgtgtgcttgttcgatatacttgctgcaggcgagtgagaggcaaaggcagacttgggtactggaccgaagatggcagggctcttggagtccggaacattgaatgtcatattgatacgtaattgaattgcgcatgagctaaa

SEQ ID NO: 1298 - DNA, 1588 bp, Physcomitrella patens
cagcttgaccgacatgggtaaggaaaaggtacacatcaacatcgtggtcattggccatgtcgactccggaaaatcgaccaccactggtcatcttatctacaagctgggaggaatcgacaagcgtgtgattgagcgtttcgagaaggaagcggcggagatgaacaagcgttctttcaagtatgcgtgggtgttggacaagctcaaggccgagcgtgagcgtggtatcacaattgacattgctctgtggaagttcgagacagtgaaatactactgtactgtgattgatgctcccggacatcgtgatttcatcaagaacatgatcacgggtacctcccaggctgactgcgcggttctcatcattgactctaccaccggaggttttgaagctggtatttccaaggatggacagacccgtgagcacgctctgttggctttcaccttgggagtgaagcagatgatatgctgctgcaacaagatggacgctaccacgccgaagtacagcaaggctcgattcgatgagatcagcaaggaggtgtcgacttacctcaagaaggtcggttacaaccccgacaagatccccttcgtgcccatctcagggttcgagggtgataacatgatcgagcgatcgacgaacttggactggtacaagggcccaacccttctcgaggccctggacaacgtgtcagagcccaagaggccgtccgacaaacccctgcggttgccccttcaggatgtctacaagattggaggtattggaactgtgccagtgggacgtgtggagactggaatcatcaggccgggtatgttggtgtgctttgcacccactggactgacgactgaggtgaagtcggtagagatgcaccacgagtcgatgcctgaggctcaccccggagacaacgtcgggttcaacgtgaagaacgtggcggtgaaggacctgaagagaggatacgtggcttcggactcgaagaacgaccctgcgaaggaagcagccaacttcactgcccaggttatcatcatgaaccacccgggacagatcggaaacggttacgcgccggtgctggactgccacacctctcacattgctgtgaagtttgccgagatcttgacgaaggtggacaggcgatcgggtaaggagctggagaaggagcccaagtttttgaagaacggagacgcagggttcgtaaagatgattccgaccaagcccatgactgtggagactttcgcggaatacccgccattgggacgtttcgccgtgcgtgacatgagacagacggtggccgtaggtgttatcaaggccgtggagaagaaggaaccaactggtgcgaaggttactaaggccgctgccaagaagaagtgaatagtgcgggatttggttttggcggagcagttacagggtgtccagaacggtgttgtttttgggattgaaatgtcgtgttgcagtgtacggttgttaatttgcttgtgtgcttgttcgatatacctgctggaagctagagcgaggcagacgtgggtacttgaccgaagatggcagggctatatgcctgcctgatgattaatgcattcttaatataacagacccaatttctca

SEQ ID NO: 1299 - DNA, 2052 bp, Physcomitrella patens
cgtgtggaagggcctctacaagaggagtgtttgtgcagcgaaaggatcctcctcctccttcagcctctcgcaggttggaattcagctgtccaggccctcgtccttcacttctcctcctccgcaccctctcgccaccatcaccgggtaatcgaagatgggtaaggagaaggttcacatcaacattgtggtcatcggccatgtcgactccggcaagtctacgaccacaggccacctgatctacaagctgggagggatcgacaagcgtgtgatcgagcgctttgagaaggaggcggctgagatgaacaagcgttcgttcaagtacgcgtgggtgctggacaagctgaaggctgagcgcgagcgtggtatcacgatcgatattgcgctgtggaagttcgagaccgtgaagtactactgcactgtgatcgacgctcccggacatcgcgatttcatcaagaacatgattacgggaacgtcgcaggcggactgcgcagtgctgatcatcgactccaccaccggaggattcgaggctggtatctccaaggatgggcagacccgtgagcacgcactgttggctttcaccttgggagtgaagcagatgatctgctgctgtaacaagatggacgcgacgacgccgaagtatagcaaggctcgattcgatgagatcagcaaggaggtgtcgacgtacctcaagaaggtggggtacaacccggacaagattccgttcgtgcccatttcagggttcgagggtgacaacatgatcgagcgatcgacgaacttggaatggtacaagggtccgacgcttctggaggccctggacaacgtgtcagagccgaagaggccatctgacaagcccctgcggttgcccctccaggatgtctacaagatcggaggtattggaactgtgccagtgggacgtgtggagactggaatcatcaagccgggtatgttagttaccttcgcacccactggactgacgactgaggtgaagtcggtggagatgcaccacgagtcgttgttggaggcgcaccccggagacaacgtcgggttcaatgtgaagaacgtggctgtgaaggacctgaagagaggatacgtggcttcggactcgaagaacgatcctgcaaaggaggccgccaacttcactgcccaggttatcatcatgaaccacccgggacagatcggaaacggttacgcgccggtgctggactgtcacacttctcacattgccgtgaagtttgccgagatcttgacgaaggtggacaggcgatcgggtaaggagctggagaaggagcccaagtttttgaagaacggagacgcaggattcgtgaagatggtaccgacaaaggcaatgactgtggagacttttgcacagtacccaccattgggacgcttcgcggttagggacatgaggcagacggtggctgtgggtgttatcaaggcggtagagaagaaagaaccgtctggagcgaaggttactaaggccgctgccaagaagaagtgaatattgctggagacgagcggggtgaagcagttaggggctgaccgggtcagggttgggtttggtgttgcggcattgttttggagggtgcggttattgttttgcctgtgtgcttgttcaatatacttgctgcaggcgagggagaagcagaggcagacttgggtactggacagaagatggcagggctcgtcggatccgcgacagtgaatgttatatttatacgtgaataaagtactttatgtggcctcgacattggggtggacataaagctagtgatggtgtctttggaaaggacgttgtgctggtggtatggttagtgttatatgtatgtgagggtgcaacgaagccattacgtcaaggagaaattttgaattctcgtctgagctgtttaagtgcacttcacatggatttgggaagggcaacaagttattcggattacataatgtgaactggaatttctagttttgcactttataacaagtgttacaaagcatgttgaattgatgtgtattagaatatccattctttggattattttataattcttgctgcaatgc

SEQ ID NO: 1300 - DNA, 1615 bp, Physcomitrella patens
actcttgcgagagtttcctcgtccatagttgtgattctctctgctgcatcgaccttctgcgataatcttcaggtgagagaagatggggaaggagaaggtgcacatcaacatcgtggtgatcggtcatgtggactccgggaagtcgacgacaacgggacacttgatctacaagctgggagggatcgacaagcgtgtgatcgagcgtttcgagaaggaggcggcggagatgaacaagcggtcgttcaagtacgcgtgggtgctggacaagctgaaggcggagcgcgagcggggtatcacgatcgatatcgcgctgtggaagttcgagacggtgaagtactactgcactgtgatcgacgcgcccgggcatcgcgatttcatcaagaacatgattacgggaacgtcgcaggcggattgcgcggtgctgatcatcgactcgacgacgggaggtttcgaggccggtatctcgaaggatggtcagactcgggagcacgcgttgctggcgttcacgctgggagtgaagcagatgatctgctgctgcaacaagatggacgcgacgacgccgaagtacagcaaggcccgatttgatgagatcagcaaggaggtgtcggcgtacctgaagaaggtggggtacaacccggacaagattccgttcgtgccgatttcggggttcgagggtgacaacatgatcgagcgatcgacgaacttggagtggtacaaggggccaaccctgctggaggcactggacaacgtgtcggagccgaagaggccatcggacaagccgctgcggttgccgctgcaggacgtgtacaagattggaggtattggaactgtgccagtgggtcgtgtggagacaggggtgatcaggccgggtatgttggtgtgcttcgcaccgactggactgacgacggaggtgaagtcggtggagatgcaccacgagtcgatgccggaggcgcacccgggtgacaacgtggggttcaacgtgaagaatgtggcggtgaaggatctgaagagagggtatgtggcatcggattcgaagaacgaccccgcaaaggaggcagccaacttcactgcccaggtgatcatcatgaaccacccgggacagatcgggaacgggtacgcgccagtgctggactgccacacatcccacattgcggtgaagtttgcggagatattgacgaaggtggacaggcgatcgggcaaggagctggagaaggagccgaagtttttgaagaacggagacgcagggttcgtgaagatgattccgacgaagccgatgactgtggagacattcgctgagtacccaccactgggacgtttcgcggtgcgtgacatgaggcagacggtggcagtgggagtgatcaaggccgtggagaagaaggaaccaaccggtgccaaggtgacgaaggccgctgcgaagaagaagtgaatgagaggggggatgtgggaaggtgggggttatgggggtggtgtagaagtgaggggcatatgtttttgttcggtgcgctgggcggaagcgcggcagaggcagagttgggtactagataggagatggcgagggcgagatgtaggaaggcgagtgacgcaattgtaataaagattgtgatgatttggtggc

SEQ ID NO: 1301 - DNA, 1384 bp, Brassica napus
ttcgtagccgcaagactccctctcagattcttacttgcagctatgggtaaagagaagtttcacatcaacattgtggtcattggccatgtcgactctggcaaatcgactacaactggtcacttgatctacaagcttggtggtattgacaagcgtgtcatcgagaggttcgagaaggaggctgctgagatgaacaagaggtccttcaagtacgcgtgggtcttggacaaacttaaggccgagcgtgagcgtggtatcaccattgacattgctctctggaagttcgagaccaccaagtactactgcactgtcattgatgcccctggacatcgtgatttcatcaagaacatgattactggtacctcccaggctgattgtgctgttcttatcattgactctaccactggtggttttgaagctggtatctccaaggatggtcagacccgtgagcatgctcttcttgccttcacccttggtgtcaagcaaatgatttgctgctgtaacaagatggatgccactacccccaagtactccaaggctaggtacgatgagatcatcaaggaggtgtcttcctacttgaagaaggtcgggtacaaccctgacaaaatcccattcgtccccatctctggattcgagggtgacaacatgattgagaggtccaccaaccttgactggtacaagggaccaactctccttgaggctcttgaccagatcaacgagccaaagaggccttcagacaagcccttgcgtctaccacttcaggatgtctacaagatcggtggtattggaacggtgccagtgggtcgtgtggagactggtatgctcaagcccggtatggttgtgacattcgctccttcagggttgaccactgaggtcaagtccgttgagatgcaccacgagtctcttgtggaagcgcttccaggtgacaatgtcggattcaatgtcaagaatgttgctgtcaaggatcttaagcgtgggtatgttgcatccaactccaaggatgaccctgccaagggagctgctaacttcacttcccaagtcatcatcatgaaccaccctggtcagatcggtaacggttacgcccctgtccttgattgccacacctcccacattgcagtcaagttctctgagatactcaccaagattgacagacgatctggtaaagagatagagaaggagcccaagtttttgaagaatggagatgctggtatggtgaagatgactccgaccaagcccatggttgttgagacgttctcagagtacccaccattgggacgtttcgctgttagggacatgaggcagactgttgctgttggtgtcatcaagagcgttgacaagagaccaacggtgccaaggtcacaagctgcagtcaagaggtgactaaatg

SEQ ID NO: 1302 - DNA, 1314 bp, Brassica napus
tgcagctatgggtaaagagaagtttcacatcaacattgtggtcattggccatgtcgactctgggaaatcgaccaccactggtcacttgatctacaagcttggaggtattgacaagcgtgtcatcgagaggttcgagaaggaggctgctgagatgaacaagaggtccttcaagtacgcatgggtcttggacaaacttaaggctgagcgtgagcgtggtatcaccattgacattgctctctggaagttcgagaccaccaagtactactgtactgtcattgatgcccctggtcatcgtgatttcatcaagaacatgattactggtacctcccaggctgattgtgctgttcttatcattgactctaccactggtggttttgaggctggtatctccaaggatggtcagacccgagagcacgctcttcttgctttcacccttggtgtcaagcaaatgatttgctgctgtaacaagatggatgccacaacccccaagtactccaaggctaggtacgatgagatcatcaaggaggtgtcttcctacttgaagaaggttgggtacaaccctgacaaaatcccattcgtccccatctctggtttcgagggtgacaacatgattgagaggtccaccaaccttgactggtacaagggaccaactctccttgaggctcttgaccagatcaacgagcccaagaggccctcagacaagcccctccgtctcccacttcaggacgtctacaagatcggtggtattggaacggtgccagtgggtcgtgttgagaccggtatgctcaagcctggtatggttgtgacctttgctccttcagggttgaccactgaggttaagtctgttgagatgcaccacgagtctcttgtggaggcacttccaggtgacaacgttggattcaatgttaagaacgttgctgtgaaggatcttaagcgtgggtatgttgcatctaactccaaggatgacccagctaaggagctgccaacttcacatcccaggtcatcatcatgaaccaccctggtcagatcggtaacggatacgccccagtcctcgattgccacacgtcccacattgcagtcaagttctctgagatcttgaccaagattgacaggcgatctggtaaggagatcgagaaggagcccaagtttttgaagaatggtgatgctggtatggttaagatgactccaaccaagcccatggttgtcgagactttctcagagtacccaccgttgggacgtttcgctgtcagggacatgaggcagaccgttgctgttggtgtcatcaagagtgttgacaagaaggacccaaccggt

SEQ ID NO: 1303 - DNA, 1389 bp, Ceratodon purpureus
aagactccgccgcctcccctcgccctcttcctgcttcgccaggaactccagattattcaagatgggtaaggagaaggttcatatcaacatcgtggtcattggccatgtcgactccggaaagtcgacaaccaccggacacttgatctataagttgggtggtatcgacaagcgtgtgatcgagcgtttcgagaaggaggcggctgagatgaacaagcgttccttcaagtacgcgtgggtgttggacaagctgaaggctgagcgtgagcgtggtattaccatcgatatcgccttgtggaagttcgagacggtgaagtactactgcaccgttatcgatgcccccggacatcgtgatttcatcaagaacatgattacgggaacctctcaggccgattgcgctgtgctgatcatcgactcgacgaccggagtttcgaggccggtatctcgaaggatgggcagacccgtgagcacgctttgttggctttcactttgggagtgaagcagatgatctgctgctgcaacaagatggacgcgaccaccccgaagtacagcaaggcccgtttcgaggagatcacgaaggaggtgtcctcctacctgaagaaggtgggatacaaccccgacaagatcccgttcgtgcccatctctgggttcgagggtgacaacatgattgagaggtcgtcgaacctggactggtacaagggccctactctgttggaggcgttggacgccgtgacggagcccaagaggccgtccgacaagcccctccggttgccccttcaggacgtatacaagattggaggcattggaactgtgccggtgggacgtgtggagactggtgtgatcaagcccggtatgttggtgtgcttcgcccctactggactgaccacggaggtgaagtctgtggagatgcaccacgagtctatgccggaggcgcaccccggtgacaacgtgggattcaacgttaagaacgtggcggtgaaggacctgaagagagggttcgttgcttctgactctaagaacgaccccgcgaaggaggccgccaacttcaccgctcaggttatcatcatgaaccaccccggacagatcggtaacgggtacgccccggtgctggattgccacacttctcacatcgccgtgaagtttgccgagatcttgaccaaggttgacaggcgatcgggtaaggagctggagaaggagcccaagttcttgaagaacggtgacgctggtttcgtgaagatgattccgaccaagccgatgacggtggagactttcgctgagtaccacctttgggtcgtttcgccgtgcgcgacatgaggcagacggtggctgtgggagtgatcaaggctgtggagaagaaggacgcgactggtgccaaggtgaccaaggccgctg

SEQ ID NO: 1304 - DNA, 1639 bp, Gossypium hirsutum
gtatcgttttagttttaagtctcttattttttgaaagttcctagttaataactacataatgggtaaggagaaggttcacatcaacattgttgtcattggccatgttgactctgggaagtcaaccacaacgggtcacttgatctacaagcttggaggtattgacaagcgtgtgattgagagatttgagaaggaagctgctgagatgaacaaaaggtcattcaagtatgcctgggtgctcgacaagttgaaggctgagcgtgagcgtggtatcaccattgatattgccttgtggaagtttgagacaaccaagtactactgcactgtcattgatgctcctggacatcgtgacttcattaagaatatgattacgggtacttctcaagctgactgtgctgtccttatcattgactccacaactggaggttttgaagctggtatttccaaggatgggcagacccgtgagcatgctctccttgccttcactcttggtgtcaagcaaatgatttgctgctgcaacaagatggatgccacagcccccacgtactcaaaggcaaggtatgatgaaattgttaatgaagtttcttcctaccagaagaaggttggttacaaccctgagaagattccattcatacccatctctggttttgagggtgacaacatgattgagaggtccaccaacctcaattggaacaagggtccaaccctccttgaggctcttgaccagatcaatgatcccaagagaccctctgacaagcccctccgtctcccacttcaggatgtctactatatcggtggtattggaactgtcccggtgggtcgagttgaaacccgcacccttaagcctggaatggttgttacatactgaccttctggattgaccactgaagttaagtctgttgagatgcatcatgaagctcttcaagaggctcttcctggtgacaatgttgggttcaatgtgaagaatgttgctgtcaaggatctcaagcgtggatatgtcgcctccaactccaaggatgatcctgccaaggaggcagccaacttcacctcccaagttatcattatgaaccatccaggacagataggaaatggttatgcacctgtcctcgattgccacacctcccacattgctgtgaagtttgcagagctcttgaccaagattgacagacgatctggtaaggagctagagaaggagcctaagttcttgaagaatggtgatgctggtatgattaagatggttccgaccaagcccatggttgtggaaaccttctccgagtaccctccacttggacgttttgccgttagggacatgagacagactgttgctgttggtgtgatcaagagtgtggagaagaaggacccaactggagccaaggtgaccaagtctgctgccaagaagggcaagtgaacctcaggggattttgttgattcaacaaaagtttatcatggttactacaataaaactttggttcatgttagtaggtccatcactggacgtttagttacatgttttaatggttcaccgtcatctcttggatattggtcccagaactgggttcttgataggcggtggtgaggtttatctttggagtccatagtgtgtcatcattaatattattacgccttatcgagctataaactt

SEQ ID NO: 1305 - DNA, 1681 bp, Phalaenopsis aphrodite
cctagttttgctccgagctcacgtcggcagagccgcgccttcttctcctcttgcttgtagttttctccggccatgggtaaggagaaggtacacatcaacattgtggtcattggccatgtcgactctggcaagtccaccaccaccggccatctcatttacaagcttggcggtattgacaagcgtgtgattgagaggtttgagaaggaggctgccgaaatgaacaagaggtcattcaaatatgcttgggttctcgacaagctcaaggctgagcgtgaaagaggaatcaccattgatatcgcactctggaaattcgagaccaccaagtattactgcactgttattgatgctcctggccatcgcgacttcatcaaaaacatgattactggaacttctcaggctgactgcgctgtcctgatcattgattccaccactggtggttttgaagctggtatctccaaggatggccagactcgcgagcatgctttgcttgctttcactcttggggtgaagcagatgatttgctgctgcaacaagatggatgccaccacccctaagtactcaaaggctaggtatgatgaaatcgtcaaggaagtctcctcctatctaaagaaggttggctacaaccctgagaagattccatttgttcccatctctgggtttgagggtgacaacatgatagagagatccacaaaccttgactggtacaaaggtccaactcttctcgacgctctcgacctgatccaagagcccaagaggccaacggacaagcccctccgcctcccccttcaggacgtctacaagatcggtggcattggaaccgtccccgtcggtcgagtcgagactggcgttttgaagcctggcatggtagtcacctttggtcccaccggtctcaccactgaagtaaagtctgttgagatgcaccatgaagctcttcaggaggccctccctggcgacaatgttgggttcaatgtgaagaatgttgcagtaaaagatctgaagcggggtttcgttgcctcaaactccaaggatgatcctgccagggaagccgccaacttcacttcccaggtcatcataatgaatcaccctggtcagattggcaacggctacgctcccgtgctggactgccacacctcccacatagctgtcaaatttgccgaaatcctgaccaagatcgacaggcggtctggcaaggagctcgagaagagccaagttcctgaagatggcgatgcgggtttcgtgaagatggttcccacgaagccgatggtggtcgagaccttctccgagtatcctccactgggccgtttcgccgtaagggacatgaggcaaactgtggctgttggagtcatcaagagcgttgagaagaaggatcccagtggagccaaggttaccaaatctgctgccaagaagaaataccaaaagccttcctaatttattggtaagattgtatcgttatatatatacttctatatattttgtgagttttatttatgctttagtcttcgagtcctctagtaagagtgtctaatccggtatcgctatcttgcatccatttgaatgagtgggtgtcggatgggcgctggcggtgggattttgatttgtttttatttccatgtttttgagtttatgtgaaccgaacaatatttgtctttaatttatcatgttgtgatgttaactttgaact

SEQ ID NO: 1306 - DNA, 1422 bp, Ambrosia trifida
aaatcttagaatgggtaaggtaaagattcatatcagcattgtcgtcattggtcatgtcgactccggtaagtcgaccacaaccggtcatctcatctacaagttgggtgggattgacaagagggttatcgaaaggttcgagaaagaagctgctgagatgaacaagaggtccttcaagtacgcttgggttcttgacaaactaaaggctgaacgtgaacgtggtatcaccattgatatcgctctgtggaagtttgagaccaccaagtattactgcactgttattgatgctcccggacatcgtgatttcattaagaacatgattactggtacttcccaggctgattgtgctgttctgattattgactccaccactggtggttttgaagctggtatttccaaggatggtcagacccgtgaacacgctctgcttgccttcactcttggtgtgaagcaaatgatctgctgctgtaacaagatggatgcaaccactcccaagtactcaaaggcaagatatgatgaaattgtgaaggaagtgtcatcctacttgaagaaggttggttacaacccagacaaaattccattcgtgcccatctctggatttgagggtgacaacatgattgagaggtctaccaaccttgactggtacaagggtccaacccttcttgaagctcttgaccagatcaatgagcccaagagaccatcagacaagcctcttcgtctcccacttcaggacgtgtacaagatcggtggtattggaactgtgccagtgggacgtgttgagactggtgtgatcaagcctggtatggttgttacctttggaccatctgggttgaccactgaagttaagtctgttgagatgcaccatgaagctctccaagaggctctccctggtgacaatgttgggttcaacgtcaagaatgttgcagtcaaggatctgaaacgtggttacgttgcatccaactcaaaggatgaccctgctaagggtgctgccagtttcacctcccaagtcatcatcatgaatcaccctggtcaaattggaaacggttatgctccggttttggattgccacacatctcacattgctgtcaagttttctgaacttttgaccaagattgacagacggtctggaaaagagctggagaaggagcccaaatttttgaagaacggagatgcgggtatggttaagatgcttccaactaagcccatggttgttgagacctttgctgagtacccgccacttggtcggtttgctgttcgtgacatgcgtcagactgttgctgttggtgttatcaagagtgttgacaagaaggcccaactggagctaaggtgaccaaggctgcagccaagaagggagctaaatgaaacggtttatattttatgaagtttttatcgtattttggaactattttcatatttggttaagaa

SEQ ID NO: 1307 - DNA, 2472 bp, Centaurea maculosa
catgtcgactccggcaagtctacaaccaccggtcacttgatctacaagcttggaggtattgacaagcgtgtgatcgaacgtttcgagaaggaagcagctgagatgaacaaaaggtcattcaagtacgcatgggtgcttgacaaacttaaggccgagcgtgaacgtggtattaccatcgatattgccttgtggaagtttgagaccaccaagtactactgcacagtcatcgatgcccccggacatcgtgatttcatcaagaacatgattactggtacctcccaggctgattgtgctgtcctcattatcgactcgaccactggtggttttgaggccggtatttccaaggatggacagacccgtgagcacgctcttcttgctttcacccttggtgtcaagcagatgatctgttgttgtaacaagatggatgccaccacacccaagtactcaaagtcgaggtacgaggaaatcgtgaaggaagtttcttcatacttgaagaaggttggatacaaccctgacaaaatcccattcgtgccaatctctggtttcgagggagacaacatgattgagaggtccaccaacctcgactggtacaagggaccaacccttcttgatgctcttgaccagatcagcgagcccaagagaccatcagacaagcccctccgtcttccactccaggatgtttacaagattggtggtattggaactgtgcctgtgggacgtgttgagactggtgtcatcaagcctggtatggttgttacctttggaccatctgggttgaccactgaagttaagtctgttgagatgcaccacgaagcccttctcgaggctctccccggtgacaatgttgggtttaacgtcaagaacgttgctgtcaaggatctcaagcgtgggtatgttgcatccaactccaaggatgaccccgccaagggtgctgccagtttcacctcgcaggttatcatcatgaaccacccagggcagatcggaaacggttatgcaccggttctggattgccacacctcccacattgctgtcaagttccaggagctagtgaccaagatcgacagacgatctggaaaggagattgagaaggagcccaagttcttgaagaacggagatgccggtatggttaagatgattcccaccaagcccatggttgtcgagacttttgccgagtacccaccccttggaaggtttgccgttagggacatgcgtcagacggttgctgttggagtcatcaagagcgttgacaagaaggatcccaccggagctaaggtgaccaaggccgccgtgaagaagggagccaagtgatctgcagtttgattgtgttttggttattgtgtctttatcttttatgtcgtttcatttactagttttgaagaactttacattttgttgaagagttttggtattgcagacttttgttgtgggttaaaaatttatagtggtctaccgcaatgagtttgttgttggagtcggtaaacaatttctatatctgttatccaacagtttacattttcaaaaaagaaaaacagtattgaacaaaaaaacatataatggaaggagggattgaattcaagcaacatagtaaagagaattgggaagcttgaatgttcttttagctgatggaagcccctgaaggctactccactggtcacccaagatcccccaaatatggtatccattcttcatcaactcattccttaccccagccttgtatgcctctaccgtttcacaatcgttctctgtcccccttaagaaaagactcttccagccatagaaaccaacgttaacaaggttgtcaactgtagcagatctaagatgttccctcctcgaagaaaccaacatgatctgcattcctcttttcttaatatcattgaacaagtttaagctataatcaattgccgtagccttgccctgtttcatccactcttcaagatcagtcacattcagcttctcccccccgtatccatgcttcttgtagtaaggcacggttgatagaagggtgtcatcaatgtcaaagatccaagcatccttgccgtctttctttagatcacagatggtgttgaggtagacgctgcattcctctaccgcgctttccgagtctaccttgtactgagtccctgtcatgtactttccgatgtaacttgtacactcggatggaactacggagaattctcgaatgttgtttagctcaacattcatcctccagctttcacaatagttctttaaggtgatgttgaggccagacttggttctttgattcaaaatattccaatctgcagctgctgtcaagacgttacttgcacacattgcgaccaagaaaaaaacaacatatctcccccccatcctcctgctgctgctgatgtattttctacaaagaaaaaagcttgagaacaggtccagtttaaataggcacaatgagatgagatggtcggtcaacaggtatttgtttatcacatcatattgtacaac

SEQ ID NO: 1308 - DNA, 1641 bp, Cucumis sativus
atcaacattgtggtcattggtcatgtcgactctggcaagtcgaccactactggccatttgatttacaagcttggaggtattgacaagcgtgttattgagaggtttgagaaggaagctgctgagatgaacaagagatcgttcaagtatgcctgggtgttggacaaacttaaggccgaacgtgagcgtggtatcacaattgatattcctctgtggaagttcgagaccaccaagtattactgcactgtgattgatgctcctgggcatcgtgatttcatcaagaacatgattactggtacttcccaggctgactgtgctgttcttattatcgactccactactggaggttttgaagctggtatttctaaggatgggcagacccgtgaacacgcccttcttgcatttacccttggtgtcaagcaaatgatttgctgctgtaacaagatggatgccaccacgcccaagtactcgaaatctaggtacgatgaaattgtgaaggaagtttcttcctacctcaagaaggttggctacaacccagaaaaaattcccttcgtccccatctctggctttgagggtgacaacatgattgaaagatccaccaacctcgactggtacaagggaccgacccttcttgaggctctcgatctgatccaagagcctaagaggccatctgacaaaccccttcgtcttccacttcaggatgtctacaagattggaggtattggaactgttccagtgggtcgtgttgaaactggcattataaagcctggtatggtggtaacctttgctccatctggactgactactgaagttaagtctgtggagatgcaccacgaagctctccaagaagctctccctggtgacaacgtggggttcaacgtgaagaatgttgctgtgaaggatctcaagcgtggttatgttgcctcaaattccaaggatgatcctgccaaggaagctgccaatttcacgtcccaagttatcatcatgaaccatccaggacagattggaaatggttatgcacctgtactcgattgccacacatctcacattgctgtcaaatttgccgagattttaactaagattgacaggcgatctggtaaagaactggagaaagagcccaagtttttgaagaacggagatgctggatttgttaagatgattcccaccaagcctatggtggtggaaacattctctgcgtatccccctcttggacgatttgccgtgagggacatgcgtcaaaccgtggctgttggtgtcatcaaggccgttgagaagaaggatgcatcgggcgccaaggtcaccaagtctgcagcaaagaaatcagggaagtgaatggtacgagtagccgttggctgtggtgaagtttgtcagaatgatgagtgggttcttattaaattactatctggttggggtttgttttgtctctgtttcgttggttgcgtctttaagtttcctccatcgtcgttaagcagattctctcagaattgggtgcttgatcggcggtggcaagtccttcctaattaaggttatatgttctatgctcgttttacttcaaactacttttttctggtattgatctttgtttctgtttcttatatacgttgttttgtttgagtatattgtcaaggcccccctttgtgacca

SEQ ID NO: 1309 - DNA, 1587 bp, Flaveria ramosissima
aatatagacgcatatcagtattgttgtcattggacaatgtcgactccgggaagtctaccactaccggacatcttatctacaagcttggtggtatcgacaagcgtgtgatcgaaaggttcgagaaggaagctgctgagatgaacaagaggtccttcaaatacgcttgggtgctcgacaagctcaaggcagagcgtgaaagaggtattaccattgatattgccttgtggaagtttgagaccaccaagtactactgcactgtcattgatgctcccggacatcgtgatttcattaagaacatgattactggtacctcccaagctgactgtgctgtcctcatcattgactcgactactggtggttttgaggctggtatttccaaggatggtcagacccgtgaacacgctcttcttgctttcactcttggtgtcaagcaaatgatctgctgctgtaacaagatggatgccaccacaccgaaatactccaaggcaaggtatgatgaaattgtgaaagaagtttcttcatacttgaagaaggtcggatacaaccccgacaaaatcccatttgtgcctatctctggttttgaaggagataacatgattgagaggtccaccaaccttgactggtacaagggtcccacccttcttgaagctcttgaccagattaacgagcccaagagaccctccgacaagccactccgtctcccacttcaggacgtgtacaagattggtggtattggaactgtgccagttggacgtgttgagactggtgtgatcaagcctggtatggttgtcaccttcggaccatctgggttgacaactgaagtcaagtctgttgagatgcaccatgaagccctaaccgaggctctccctggtgacaatgttgggttcaacgtcaagaacgttgctgtcaaggatctcaagcgtggttacgttgcctcaaactccaaggatgatcctgccaagggtgcagctagcttcacctctcaggtcatcatcatgaaccacccaggccagatcggtaacggatacgccccagttcttgattgccacacctcccacattgccgtcaagttctccgagcttttgaccaagatcgacagacgatctggtaaggaactcgagaaggagcctaagttcttgaagaacggtgatgccggtatggttaagatgcttcccaccaagcccatggttgtcgagacctttgctgaatacccaccactcggaaggtttgccgtgagagacatgcgtcagacggttgccgtcggtgttatcaagagcgtcgagaagaaggacccgaccggtgccaaggtgaccaaggctgcggtgaagaagggagccaagtgaggtgaggtggtttgtggtttggtttatggagtattttatgttttgtcatttgatttactagttttgaactttattttgttgaggagttttgtttgtttttcgatctttgaagctttcattattattgtgggagttttatgggttgcagacttttgttgtgggttaatttatggtgggtctacttcaatgagtttgtagttggtggttgaaaaacttatatttatgatatccaactctttttatc

SEQ ID NO: 1310 - DNA, 1585 bp, Ceratodon purpureus
tattcaagatgggtaaggaagaaggtacatatcaacattgtggtcatcggccatgtcgactccggaaagtcgacgaccaccggacacttgatctataagttgggtggtattgacaagcgtgtgatcgagcgtttcgagaaggaggcggctgagatgaacaagcgttccttcaagtacgcgtgggtgttggacaagctgaaggctgagcgtgagcgtggtattaccatcgatatcgcgttgtggaagttcgagacggtgaagtactactgcaccgttattgatgcccccggacatcgtgatttcatcaagaacatgattacgggaacttctcaggccgattgcgccgtgctgatcatcgactcgacgaccggaggttttgaggccggtatctcgaaggatgggcagacccgtgagcacgctttgttggctttcactttgggagtgaagcagatgatctgctgctgcaacaagatggacgcgaccaccccgaagtacagcaaggcccgtttcgaggagatcacgaaggaggtgtcctcctacctgaagaaggtgggatacaaccccgacaagatcccgttcgtgcccatctctgggttcgagggtgacaacatgattgagaggtcgtcgaacctggactggtacaagggccctactctgttggaggcgttggacgccgtgacggagcccaagaggccgtccgacaagcccctccggttgccccttcaggacgtatacaagattggaggcattggaactgtgccggtgggacgtgtggagactggtgtgatcaagcccggtatgttggtgtgcttcgcccctactggactgaccacggaggtgaagtctgtggagatgcaccacgagtctatgccggaggcgcaccccggtgacaacgtgggattcaacgttaagaacgtggcggtgaaggacctgaagagagggttcgttgcttctgactctaagaacgaccccgcgaaggaggccgccaacttcaccgctcaggttatcatcatgaaccaccccggacagatcggtaacgggtacgccccggtgctggattgccacacttctcacatcgccgtgaagtttgccgagatcttgaccaaggttgacaggcgatcgggtaaggagctggagaaggagcccaagttcttgaagaacggtgacgctggtttcgtgaagatgattccgaccaagccgatgacggtggagactttcgctgagtacccacctttgggtcgtttcgccgtgcgcgacatgaggcagacggtggctgtgggagtgatcaaggctgtggagaagaaggacgcgactggtgccaaggtgaccaaggccgctgccaagaagaagtgaataggtcaggatgagccgcagcagcagttttgtttgtgttctgtagttgttttggcggctctagatttgttcgcactatgtgcgtgttcgatatacttgctgcaggcgcggcagagacagacctgggtacttgatcggagatggcagggcttgtcgtctccgtgattgttatcattcttcttctctattataatatctgaagcttttgcgtgaattcgcgattcataaaaaa

SEQ ID NO: 1311 - DNA, 1725 bp, Ceratodon purpureus
caagactccgccgcctccacctcgccctcttcctgcttcgccaggaactccagattattcaagatgggtaaggagaaggttcatatcaacatcgtggtcattggccatgtcgactccggaaagtcgacaaccaccggacacttgatctataagttgggtggtatcgacaagcgtgtgatcgagcgtttcgagaaggaggcggctgagatgaacaagcgttccttcaagtacgcgtgggtgttggacaagctgaaggctgagcgtgagcgtggtattaccatcgatatcgccttgtggaagttcgagacggtgaagtactactgcaccgttatcgatgcccctggacatcgtgattttatcaagaacatgattacgggaacttctcaggccgattgcgctgtgctgatcatcgactcgacgaccggtaggtttcgaggccggtatctcgaaggagtgggcacgacccgtgagcacgtcttttgttggtctttctactttgggagtgaagcagatgatttgctgctgcaacaagatggacgcgaccaccccgaagtacagcaaggctcgtttcgaggagatcacgaaggaggtgtcctcctacctgaagaaggtgggatacaaccccgacaagatcccgtttgtgcccatctctgggtttgagggtgacaacatgattgagaggtcgtcgaacctggactggtacaagggccctactctgttggaggccttggacgccgttacggagcccaagaggccgtccgacaagcccctgcggttgccccttcaggacgtttacaagattggaggcattggaactgtgccggtgggacgtgtggagactggtgtgatcaagcccggtatgttggtgtgcttcgcccccactggactgaccactgaggtgaagtctgtggagatgcaccacgagtctatgccggaggcccaccccggtgacaacgtgggattcaatgttaagaacgtggcggtgaaggacctgaagagagggttcgttgcttctgactctaagaacgaccccgcgaaggaggccgccaacttcaccgctcaggttattatcatgaaccaccccggacagatcggtaacgggtacgccccggtgctggattgccacacttctcacatcgctgtgaagtttgccgagatcttgaccaaggttgacaggcgatctggtaaggagctcgagaaggagcccaagttcttgaagaacggtgacgctggtttcgtgaagatgattcccaccaagccgatgacggtggagactttcgctgagtacccacctttgggtcgtttcgccgtgcgcgacatgaggcagacggtggctgtgggagttatcaaggctgtggagaagaaggacgcgactggtgccaaggtgaccaaggccgctgccaagaagaagtaaaaaggttgtaagaattttggggagcagttggtttggctttggttatgcccgttctgtcttcgcacttcggacctgcctgctgtgtctggattggaatttgtaatagacaagatgcatcacacatgcatgtgaattttcatcgaataaatacatttctgatctacgatttctttaatttcgaaggataactttacacactatcgaagggaacagtcgatgaaatatcattctccgacttttcaatctttatgtaggaggttttcagatccttggaggatgctcatttgaaatgtgatatttttcctagtaaa

SEQ ID NO: 1312 - DNA, 1578 bp, Ambrosia trifida
aaagaattcatatcagtatcgtcgtcattggacatgtcgactccggcaagtccacaaccacaggacaccttatctacaagttgggagggtatcgacaagcgtgtgatcgaaagattcgagaaggaagcagctgagatgaacaaaaggtccttcaaatacgcctgggtgcttgacaagcttaaggccgagcgtgaaagaggtatcaccatcgatatcgccttgtggaagttcgagacaactaagtactactgcactgtcattgatgcccctggacatcgtgatttcattaagagcatgattactggtacttcccaagctgattgtgctgttcttatcatcgatcaccactggggttttgaggccagatttccaaggacggtcagacccgtgagcacgctcttcttgctttcacccttggtgtcaagcaaatgatctgctgctgtaacaagatggatgccactacaccaaagtactccaaggcaaggtacgatgaaatcgtcaaggaagtgtcatcttacttgaagaaggttggatacaaccccgacaaaatcccattcgtgcccatctccggttttgagggagacaacatgattgagaggtcaaccaaccttgactggtacaagggtccaacccttcttgaagctcttgaccagatcaacgaagcccaagagaccctcagacaagcccctccgtctcccacttcaggacgtgtacaagatcggtggtattggaactgtgccagtgggacgtgttgagactggtgtgatcaagcctggtatggttgtcacctttggaccatctgggttgaccactgaagttaagtctgttgagatgcaccatgaagctcttcaagaggctcttcctggtgacaacgttgggttcaatgtcaagaacgttgcagtcaaggatctgaaactgggtatgttgcgttccaactccaaggacgacccagctaagggtgcagccagtttcacctcacaggtcatcatcatgaacaccctggtcagattggaaacggttatgctccagttctcgattgccacacttctcacatcgctgtcaagttctccgagcttttgaccaagatcgacagacgatccggaaaagagcttgagaaagagcccaagtttttgaagaacggagatgcaggtatggttaagatgcttccaaccaagcccatggtggtcgagactttcgcagagtacccacctcttggtaggtttgctgttcgtgacatgaggcagacagttgctgtaggtgtgatcaagagtgttgacaagaaggacccgactggagctaaggtgaccaaggctgcagtcaagaagggtgccaagtgaatctgctggaccgatgaagttgtttaagcgcgtattgaactaattttaattatgtttattttgtgtcaaggtattttggtattatgtgttgtggcttgcattcctgtactctagcctcgcttgcgaggatgggtgaggtatcgagcaacctgttgcttgatgacggtagtgcaagctcaacaaacatccagtattttgacttattatcgtggttaaactattatgatgtctttcttattat

SEQ ID NO: 1313 - DNA, 1558 bp, Eschscholzia californica
ggccgcttcctcctcagactctcttcacttcgaaagctcttattggcgagagcttttttccttgacgttttcatcaccaaagttatttgattttctgaggaactcaacatgggaaaagagaagattcatatcagtattgtcgtcattggacatgtcgactctggaaagtctaccaccactggtcacttgatctacaagttgggaggtattgacaagcgtgttatcgaaagattcgagaaagaggctgctgagatgaacaagaggtcattcaagtatgcatgggttcttgacaagcttaaggctgaacgtgagcgtggtattaccattgatattgccttgtggaagtttgagaccaccaagtactactgcactgttattgatgcccccggacatcgtgatttcatcaagaacatgattactggtacctctcaggctgattgtgctgtcctcatcattgactccaccactggaggatttgaagctggtatctctaaggatggacagacccgtgagcacgctcttcttgctttcacccttggtgtcaagcagatgatctgttgttgtaacaagatggatgctaccaccccaagtactcaaaggcaaggtacgagaatcgtaagaagtctcatcttactgaagaaggttggatacaaccagacaaaatcgcctttgttcccatctctgggtttgaaggtgacaacatgattgagagatccaccaaccttgactggtacaagggacaaccttcttgaggcacttgaccagatcaatgagccaaagagaccctcagacaagccactccgtcttccacttcaggatggttaacaagattggtggtattggaactgtgccagtggacgtgttgagactggagtcatcaagcccggtatggttgtcaacttttggaccccactggattggaccactgaggttaagtccgtggagatggcaccacgaggctctccaggaaagctcttccaggtggactaatgttgggttcaatgttaagaatgttgctgtcaaggatactcaagcgtggtttgtgacctcaactccaaggatgacccagccagggaagctgccaaacttcacctcccaggtcatcatcatgaaccaccctggtcagatcggtaacggatatgctccagttcttgattgccacacctcccacattgctgtgaagttcggtgagatcctcaccaagattgacagacgatctggaaaggagttcgagaaggagccgaagtttttgaagaatggtgatgccggtatggttaagatgcttccaaccaagcccatggttgtggagacctttgccgaatacccaccccttggtcgtttcgctgttagggatatgcgacagacagttgctgtgggagtcatcaagagtgtggagaagaaggatccatcaggtgccaaggtcaccaagtcagctgccaagaagaaatgagcaatgggaattggtttggcaggagaagcaacagggtcagagaggtagtagagagaaattttgttgggtaatggtttttatgatttgaatcagtttatgatttgtggt

SEQ ID NO: 1314 - DNA, 1330 bp, Ambrosia trifida
ctccatcttttctctagagctcgtttgcatacactttgttaaggatgggtaaggaaaagattcatatcagtatcgtcgtcattggacatgtcgactccggcaagtccacaaccacaggacaccttatctacaagttgggaggtatcgacaagcgtgtgatcgaaagattcgagaaagaagccgctgagatgaacaaaaggtccttcaaatacgcctgggtgcttgacaaacttaaggccgagcgtgaaagaggtatcaccatcgatatcgccttgtggaagtttgagaccactaagtactactgcactgttatcgatgcccccggacatcgtgatttcattaagaacatgattactggtacttcccaagctgattgtgctgttcttatcatcgattccaccactggtggttttgaggctggtatttccaaggacggtcagacccgtgagcacgctcttcttgctttcacccttggtgtcaagcaaatgatctgctgctgtaacaagatggatgccaccacaccaaagtactctaaggcaaggtacgatgaaatcgtcaaggaagtgtcatcttacttgaagaaggttggatacaaccccgacaaaatcccattcgtgccaatctctggatttgagggagacaacatgattgagaggtcgaccaacctcgactggtacaagggaccaacccttcttgaagctcttgaccagatcaatgagcccaagagaccctcagacaagcccctacgtctcccacttcaggacgtgtacaagatcggtggtattggaactgtgccagtgggacgtgttgagactggtgtgatcaagcctggtatggttgttaccttcggaccatctgggttgaccactgaagttaagtcggttgagatgcaccacgaagccctccaagaggctctccccggtgacaatgttgggttcaacgtcaagaacgttgctgttaaggatctcaagcgtggttacgtcgcatccaactccaaggatgatccagctaagggtgctgccagtttcacctcccaggttatcatcatgaaccaccctggccagatcggtaacggttacgccccggttcttgattgtcacacctcccacattgctgtcaagttctctgaacttttgaccaagatcgacagacgatctggtaaggagcttgaaaaggagcctaagttcttgaagaacggagatgccggtatggttaagatgcttccaaccaagccaatggttgtcgagacctttgctgaatacccaccacttggtcggtttgctgtgagagacatgcgtcagacggttgcagtcggagtcatcaagagcgt

SEQ ID NO: 1315 - DNA, 1887 bp, Trigonella foenum-graecum
tctctacgctcattctcttccttgctgctagggttttagcgcatccttcaaaagaactttttgtggttttaagcttttaaggacaaatgggtaaggaaaaggttcacattaacattgttgtcattggccatgtcgactctgggaagtcaactaccaccggtcacttgatctacaagcttggaggtattgacaagcgtgttatcgagaggtttgagaaagaagctgctgagatgaacaagcgttcattcaagtatgcctgggtgcttgacaagctcaaggctgagcgtgaaagaggtatcacaattgacattgctctgtggaagtttgagacaactaagtactactgcaccgtcattgatgcccccggacacagggatttcatcaagaacatgattaccgggacatcccaagctgattgtgctgttctcatcattgattccactactggtggttttgaagccggtatttccaaggatggtcagacccgtgaacatgctctccttgctttcactcttggtgtgaggcaaatgatctgctgctgcaacaagatggatgccactacacccaagtactccaagagtaggtatgatgaaattgtgaaggaggtttcatcctatatgaagaaggttggctataacccagataaaattccatttgttcccatctctggttttgagggagataacatgattgagcgctctacaaatcttgaccaaatcaatgagcctaagaggccatcagacaagcccctccgactaccacttcaggatgtctacaagattggaggaattggaactgtgcctgtgggacgtgttgagactggtaccatgaaacctggaatggtggtgacttttgcgccaactggactgcaaactgaagtcaagtctgtggagatgcaccatgagtctctcaccgaggcccttcccggtgacaatgtgggatttaatgttaagaatgttgctgtcaaggatctcaagcgtggttatgttgcctcaaacaccaaggatgacccagccaaggaggctgctaacttcacatctcaagtgattatcatgaatcaccctggtcagattggaaatggatatgcccctgttcttgactgccacacctcccacattgctgtcaagtttgctgagcttgttactaagattgacaggcgttctggtaaggagatcgagaaggagcccaaattcctgaagaatggtgatgctggtattatcaagatgattcccaccaagcccatggtggttgagactttctctgaatatcctccacttggtcgttttgctgtcagagatatgcgtcaaactgtggctgttggggttatcaagggtgtggagaagaaggaacccggcacagctaagataactaagtcagcagccaagaagaaatgaaccgtgcaggatgatttttctagggaagtctatggtcgttattacaataaatggttcgtggttctcagtattcctatttctcgtctagttaacttgtttttcagattaagtgtgaagtctgcaccgtcatctcgcagcttttgttcccagaactgggttctagatcgacggtggcaggattatttctttttctttatgctttaattgttgtgtcttgtgtgaaacacctgaattttgcaaagcagcaagtttccggacctgctgatttgttttaatatcaactctatatttgtgtgtttattccttggtgtgatgtctctgaatgttttaggcaatatcattgcctagaatttcaggagcatgtatgcatttagatcgtgtgaatcatcaatctattattcttctctaaattttccatttgtttagtagtaacccctaattgacagcaatgttgtttttgccaaatgccaatgttatattactggacagagca

SEQ ID NO: 1316 - DNA, 1437 bp, Ceratodon purpureus
caagactccgccgcctccacctcgccctcttcctgcttcgccaggaactccagattattcaagatgggtaaggagaaggttcatatcaacatcgtggtcattggccatgtcgactccggaaagtcgacaaccaccggacacttgatctataagttgggtggtatcgacaagcgtgtgatcgagcgtttcgagaaggaggcggctgagatgaacaagcgttccttcaagtacgcgtgggtgttggacaagctgaaggctgagcgtgagcgtggtattaccatcgatatcgccttgtggaagttcgagacggtgaagtactactgcaccgttatcgatgcccctggacatcgtgattttatcaagaacatgattacgggaacttctcaggccgattgcgctgtgctgatcatcgactcgacgaccggtaggtttcgaggccggtatctcgaaggagtgggcacgacccgtgagcacgtctttgttggtctttctactttgggagtgaagcagatgatttgctgctgcaacaagatggacgcgacaccccgaagtacagcaaggcccgtttcgaggagatcacgaaggaggtgtcctcctacctgaagaaggtgggatacaaccccgacaagatcccgttcgtgcccatctctgggttcgagggtgacaacatgattgagaggtcgtcgaacctggactggtacaagggccctactctgttggaggccttggacgccgttacggagcccaagaggccgtccgacaagcccctgcggttgccccttcaggacgtttacaagattggaggcattggaactgtgccggtgggacgtgtggagactggtgtgatcaagcccggtatgttggtgtgcttcgcccccactggactgaccacggaggtgaagtctgtggagatgcaccacgagtctatgccggaggcgcaccccggtgacaacgtgggattcaacgttaagaacgtggcggtgaaggacctgaagagagggttcgttgcttctgactctaagaacgaccccgcgaaggaggccgccaacttcaccgctcaggttattatcatgaaccaccccggacagatcggtaacgggtacgccccggtgctggattgccacacttctcacatcgctgtgaagtttgccgagatcttgaccaaggttgacaggcgatctggtaaggagctcgagaaggagcccaagttcttgaagaacggtgacgctggtttcgtgaagatgattcccaccaagccgatgacggtggagactttcgctgagtacccacctttgggtcgtttcgccgtgcgcgacatgaggcagacggtcgctgtgggagttatcaaggctgtggagaagaaggacgcgactggtgccaaggtgaccaaggccgctgccaagaagaagtaaaaaggttgtaagaattttggggtag

SEQ ID NO: 1317 - DNA, 1328 bp, Papaver somniferum
ggagcttatctaatcgccgtttcagttaatttctaagaattcattatgggtaaagagaaggttcatatcaacattgtcgtcattggacatgttgactctgggaaatcgaccaccactggtcacttgatctacaagcttggaggtatcgataagcgtgttattgaaagattcgagaaggaggctgctgagatgaataagaggtcattcaagtatgcatgggttcttgacaagcttaaggctgaacgtgagcgtggtattaccattgatattgccttatggaagtttgaaactaccaagtactactgcacagttattgatgctcctggacatcgtgattttatcaaaaacatgattactggtacttctcaggctgattgtgccgtcctcattatcgattctaccactggaggttttgaggctggtatctcaaaggatggtcagactcgtgagcatgctcttcttgctttcactcttggtgtcaagcagatgatctgttgttgtaacaagatggatgccaccacccccaagtactcaaaggctaggtacgatgaaattgtgaaggaggtctcatcttacttgaagaaggttggatacaacccagacaaaattgcctttgttcccatctctggattcgagggagacaacatgattgagaggtccaccaaccttgactggtacaagggaccaactctccttgaggctcttgacaatatctctgagccaaagagaccctcagacaagccccttcgtcttccacttcaggatgtgtacaagattggaggtattggaactgtgccagtaggacgtgttgaaactggattcatcaagcctggtatggttgttacttttggacccaccgggttgaccactgaagttaagtctgtggagatgcaccacgaagcccttcaagaagctcttccaggagacaatgttgggttcaatgtcaagaatgttgccgtgaaggatctcaagcgtggtttcgtcgcctccaactccaaggatgaccctgccagggaagcagccaacttcacctcccaggtcatcatcatgaaccatcctggtcagatcggtaacggttatgccccagttcttgactgtcacacatctcacattgctgttaagtttgctgagatcctcaccaagattgataggcgatctggaaaggagcttgagaaggagcccaagttcttgaagaatggtgatgctggtattattaagatgcttccaacaaagcccatggttgttgagaccttctctcagtacccacctcttggacgttttgctgttagggacatgaggcagacagttgctgttggtgtcatcaagga

SEQ ID NO: 1318 - DNA, 1758 bp, Ceratodon purpureus
gcgggcacaggcgcccgatgcgcgatcggacggccggcgaactccggggttgcgggagggagtgttgaagtagcagctgcgcagtggagctcctcccttccgatccgagaactctcctgcgcaggagagtcacgctaccgatcgctcgctcgcccgctcgcgctttcgagctgctgtgcatcatctctcaggtcgttcaagatgggtaaggagaaggttcatatcaatattgtggtgatcggccatgtcgactctgggaagtcgacgactacggggcacttgatctacaagctgggtggtatcgacaagcgtgtgatcgagcgtttcgagaaggaggcggctgagatgaacaagcgttcgtttaagtacgcgtgggtgttggacaagctgaaggcggagcgtgagcgtggtattaccatcgatatcgcgttgtggaagttcgagacggtgaagtactactgcaccgtgatcgacgcccccgggcatcgcgattttattaagaatatgattacgggaacgtcgcaggctgattgtgcggtgttgatcatcgactcgacgactggagggttcgaggctggtatttcgaaggacgggcagacgcgtgagcatgctctgttggcgtttacgctaggagtgaggcagatgatctgctgctgcaacaagatggacgcgaccaccccgaagtatagtaaggctcgttatgaggagattacgaaggaagtgtcggcgtatctgaagaaggtgggatataaccccgagaaggtcccatttgtgccgatttccgggttcgagggagataacatgatcgagaggtcgtcgaacctggagtggtacaaggggccgaccctgttggaggctttggacaacgtgtctgagccgaagaggccgtccgacaagccactgcgtctgcctctccaggatgtgtacaagattggaggcattggaactgtgccggtgggacgtgtggagaccggagtgatcaagcccggtatgttggtgtgcttcgcgcctaccggattggtgactgaggtgaagtcggtggagatgcaccacgagtcgatggcggaggcccacccgggagacaacgtgggattcaacgtgaagaacgtggcggtgaaggatctgaagagaggatacgtggcttctgactcgaagaacgaccccgcgaaggaggccgccaacttcacggcgcaggtgatcatcatgaaccaccccgggcagatcggcaacgggtacgccccggtgctggattgccacacttctcacatcgcggtgaagttctcggagatcctgacgaaggtggacaggcgatcgggtaaggagctggagaaggagcccaagtttctgaagaatggtgacgcgggggtcgtgaagatggttccgacgaagccgatgacggtggagactttcgctgagtacccacctttgggtcgtttcgccgtgcgcgacatgaggcagacggtggcggtgggagtgatcaaggctgtggagaagaaggagccgagtggggccaagataacgaagtccgctaagacgaagaagtgaatagtgtgggaggagtcgccagggcagttttgtttgtggggtggaattctgtgggcggctttggacttgttcactctatgtgcgtgttcgatatacctactgcaagcgcggcagaggcaaacttgggtacttgaccggagatggcagggcttgccgtgtctgtgattattagaacctaaatcttttataatataataagccttttgcggcgat

SEQ ID NO: 1319 - DNA, 1458 bp, Triticum aestivum
ctctcggttccttctccttcctcggagcttcagccatgggtaaagagaagactcacatcaacatcgtggtcattggccatgtcgactctggcaagtcgaccaccactggccatctgatctacaagcttggaggtattgacaagcgtgtgatcgagaggttcgagaaggaagccgccgagatgaacaagaggtctttcaagtacgcctgggtgcttgacaagctgaaggccgagcgtgagaggggtatcaccattgatattgccctgtggaagttcgagaccaccaagtactactgcaccgtcattgatgctcctggtcaccgtgacttcatcaagaacatgattactggtacctcccaggctgactgtgctgtgctcatcattgactccaccactggtggttttgaggctggtatctccaaggatggccagacccgtgagcatgccctccttgctttcactcttggagtgaagcagatgatctgctgctgtaacaagatggacgccaccactcccaagtactcaaaggcccgttacgaggaaattgtcaaggaagtctcttcgtacctgaagaaggtcggctacaaccctgacaaggttccctttgttcccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggacgtttacaagattggtggcattggaactgtgcctgttggccgtgttgagactggtgtcatcaagcctggtatggttgttacctttggtcccactggtctgacaactgaggtcaagtccgttgagatgcaccacgagtccctcctggaggcgcttcctggtgacaatgttggcttcaacgtgaagaacgttgctgttaaggatctgaagcgtgggtttgttgcatccaactccaaggatgaccctgccaaggaggcagccaacttcacctcccaggtcatcatcatgaaccaccctggtcagatcggcaacggctacgccccagtgctggactgccacacctcccacattgctgtgaagtttgctgagctggtgactaagatcgacaggcgatctggtaaggagctggaggcgctgcccaagttcctgaagaacggtgtcatcaagggcgtggagaagaaggaccccaccggcgccaaggttaccaaggctgccatcaagaagaaataggcatctatctagcagaaggtttttgttcatggtcattgcttttgttgctgcagactcttatcccgggcgagcaatgatcctgtctgtcgtttaattactgtatttctattcctgcttcggctaaactcctgtgccttgagactgatttgttgtgaaatgcaagttattagattgcaaacctcggccgcgaccacgc

SEQ ID NO: 1320 - DNA, 1342 bp, Ambrosia trifida
tcttcccccatctatcactcaaatcgtctgaacatcttttgctaaggatgggtaaggaaaagattcatatcagtattgttgttattggacatgtcgactccggcaagtcgacaacaaccggtcacttgatctacaagctcggtggtatcgataaaagagttatcgagcggttcgaaagggagccgctgaaatgaacaagaggtcattcaaatacgcttgggttcttgacaaacttaaggctgagcgtgaaagaggtatcacaattgacattgcgttgtggaagttcgagacaacgaagtattactgtacggttatcgatgctcccgggcatcgggatttcatcaagaatatgattactggtacctcacaggctgactgtgctgtgcttattattgattcgactactggtgggtttgaagctggtatttctaaagacgggcagacccgcgaacacgcgcttcttgcttttactcttggtgtcaagcaaatgatttgttgttgtaataagatggatgccaccacacctaagtactcgaaggcaaggtacgatgaaattgttaaggaagtgtcatcatacttgaagaaggtcggatacaacccggacaaaatcccatttgttccaatctctggatttgaaggagataatatgattgagaggtctactaaccttgactggtacaagggaccaactcttcttgaagcgcttgaccagattaatgagcccaagagaccgtcggacaagcctcttcgtctcccgcttcaggatgtgtacaagattggtggtattggaactgtgccggttggacgtgttgagaccggtgttatcaagcctggtatggttgttactttcggaccttctgggttgactactgaagttaagtcagttgagatgcatcatgaagcgttgcaagaggctcttcctggtgacaatgttgggtttaatgttaagaacgttgcggttaaggatctcaagcgtggttatgtcgcatcaaactcaaaggatgatcctgccaagggagctgctagtttcacctcgcaggttatcatcatgaaccaccctggacagattggaaatggttatgcaccggttcttgattgccacacatcccacattgctgttaaattctctgagcttttgaccaagatcggcagacgatctggaaaggagcttgagaaggagcctaagttcttgaagaacggtgacgcagggatggttaagatgcttcccaccaagcctatggttgtggagactttcgctgagtacccaccacttggaaggtttgctgtgagagacatgcgtcaacggttgctgtggtgtgatcaagagcgttgacaagaagga

SEQ ID NO: 1321 - DNA, 1787 bp, Gossypium raimondii
ggtgcagcttgaagggaatactgcagaatgggtaaggaaaagactcacattaacattgtcgtaattggccatgttgactctggaaagtcaaccaccactggtcacttgatctacaagcttggaggtattgacaagcgtgtcattgaaaggtttgagaaggaagctgctgagatgaacaagaggtcattcaagtatgcttgggtgcttgacaagttgaaggctgagcgtgaacgtggtattaccattgatattgccttgtggaagtttgagaccaccaaattctactgcactgtcattgatgcccctggacatcgtgactttatcaagaacatgattactggtacctcccaggccgactgtgctgtccttatcattgactctaccactggaggttttgaggcaggtatttccaaggatggacagacccgtgagcatgctctgcttgctttcactctcggtgtcaagcaaatgatttgctgctgcaacaagatggatgccacaacccccaaatactcaaaaggctaggtatgatgaaattgtgaaggaagtgtcttcctacttgaagaaggttggttacaaccctgagaagattccttttgtccccatctccggttttgaatgtgacaacatgattgaaaggtccaccaaccttgattggtacaagggtccaactctgacaagccactccgtcttccacttcaggatgtgtacaagattggaggtattggaactgtcccccgtgggtcgtgttgaaactggtatcctcaagcctggtatggttgcaacctttggtccctctggattgaccattgaagttaaatctgttgagatgcaccatgagtctcttacagaggctcttccaggtgacaatgtcggcttcaatgtcaagaatgttgctgtgaaggatctgaagcgaggatatgttgcttcgaactcgaaggatgatcctgccaaggaggcagctaatttcacttcccaagtcatcatcatgaaccacccagcgcagattggaaatggatatgcacctgtccttgattgccacacctcccacattgcagtcaagtttgcagagctggtgactaagattgacaggcgttctggtaaggagcttgagaaggaacccaagtttttgaagaatggtgatgcaggatttgttaagatggttcccaccaaacccatggttgtggaaaccttctctgagtatcccccactgggtcgttttgctgtgagggacatgaggcagactgttgctgtcggcgttatcaagagcgtggagaagaaagatccatctggagccaaggtgacaaagtctgctgccaagaagggtggcaagtgaaccgtgcgggttttagttgatccaaccaaactatatcattacaatataacttttgttatgtccatcatagtcagttgtttaaatagttatagtttcaagtcatcaccgtcttgtggaggatattgttcgcagaactgggttcttgataggcggtggtgagtccgttgtgtagtttcaaactctttaaaatgtgtccatgttaaatacaggagattttaggtggattcctggactcttattggctttgaatgtttgttacacgcagcattttgatatctaaactttggtttgttttaatgcacatttatttagtaaaaaatgtgtaataaatattaattgatagattaaacttgactgataaatacaggtattagagttttggtttggattttggcacatttctttgttttggagatggagcttatataagataaatattattttcttctca

SEQ ID NO: 1322 - DNA, 1770 bp, Quercus alba
ctctccacactctttctctgcctctctctctcgctcttcacattgagctctttcgaaagtgcggcgagagagtctatctatctaagaagcgagtttcatatcatcagaatgggtaaagagaaggttcacatcaacattgtggtcattggccatgtcgactctggaaagtcgaccaccactggacacttgatctacaagcttggaggtattgacaagcgtgttattgagaggtttgagaaggaggctgctgagatgaacaagaggtcgttcaagtatgcctgggtgttggacaagctcaaggctgagcgtgagcgtggtattaccattgatattgccttgtggaagtttgagaccaccagatactactgcacagtcattgatgctcctggacatcgtgactttattaagaacatgattactggtacctcacaggctgactgtgccgtcctcattattgactccaccactggaggttttgaagctggtatttctaaggatggtcagacccgtgagcatgccttgcttgcatttacccttggtgttaagcagatgatttgctgctgtaacaagatggatgccacaaccccaaagtactctaaggccaggtacgatgaaattattaaggaagtctcatcctatttgaagaaggttggttacaaccctgacaagatcccctttgtccccatttctggttttgagggtgacaacatgattgagaggtctaccaaccttgactggtacaagggccgaggctcttgaccagatttctgagcccaagaggccctcagacaagcccctccgtcttccactccaggatgtctacaagattggtggtattggaactgtcccagttggaagagttgagactggtatcatcaagcctggtatggttgtgacatttggccctactggattgacaactgaagttaagtctgtggagatgcaccatgaagctctcctggaggcccttcccggtgacaatgttggcttcaatgtgaagaatgttgctgtgaaggatctcaagcgtggttttgttgcttccaactccaaggatgatcccgccagggaggctgctaacttcacctcccaggtcatcatcatgaaccaccctggtcagattggcaatggctatgctcctgtccttgactgtcacacctcccacattgctgttaagtttaccaagattgacaggcgatctggtaaggagattgagaaggagccaaagtttttgaagaacggagatgctgggatcccaccaagcccatggttgttgagactttctctgagtacccacctcttggtcgttttgctgtgagggacatgcgtcagactgtggctgttggtgtcatcaagagtgtcgagaagaaggatccttctggtcgcgtgaaatgtgcttttgaggtttatcttagtcagactagttttgtctatttatggtgctactggttttcaattttgttttggtcgttcttgcagttttgaggacagctttattagtttccatcacagtcctctagccttgcttctgaggatggtggaggggttgagcaatcagatttcttctggttgcttgacaagctgtggtggaaactctgttttacaaattatgttttaagttttttatctcaatgagatgagtcgtgatttaagttttagtgagatgagtcgggtagttgattattgatgaagaacttcactttaatgtcaagtactctggtttttaagttcattatttaaacttgctggttcttatcaaaaagttaattaatc

SEQ ID NO: 1323 - DNA, 1555 bp, Helianthus annuus
aacatcgtggtcattggtcatgttgactctggaaagtcaaccacaacaggccacttgatctacaagcttggaggcatagacgagcgagtgatcgagaggttcgaaaaagaagctgccgaaatgaacaaacgttccttcaagtacgcctgggtgctagacaagctcaaagccgaacgtgaacgtggtatcaccattgatatccccttgtggaagttcgaaaccaccaagtactattgcacagtcatcgatgcgccaggtcatcgcgatttcatcaagaacatgattaccgggacatctcaggctgattgcgctgtcttgatcatcgactccaccacaggtggtttcgaagctggtatttccaaagatggtcagactcgtgaacatgctttgcttgctttcaccctcggtgtcaggcaaatgatatgttgttgtaacaagatggacgctacaacacctaaatactcgaagcctaggtatgacgagattgttaaggaagtgtcgtcgtaccttaaaaaagtcggatacaaccccgaaaaaatcccatttgttccaatttctggtttcgaaggagataacatgattgagaggtcaacaaaccttgattggtataaggggccaacacttcttgaagcacttaacaatgttagtgaaccaaagaggccttcagacaagccgcttcgtctcccactccaggacgtgtacaagattgtgggattggaactgtgcccgtgggtcgggttgagacgggtattatcaagcccggtatggtcgtcactttcggcccgtccggtctcaccactgaagtgaaatcggtcgaaatgcatcatgaagcacttcaagaggcattgccaggggataatgttgggttcaatgtgaagaatgttgcggtgaaggatcttaaacgcggttatgttgcttcaaactcgaaagatgatccagcaaagggtgctgctggcttcacttctcaggttattatcatgaaccatcctggccagattgggaacggttatgcaccggtgcttgactgccatacttctcacattgctgttaagtttgctgagctgcagaccaagattgaccgcaggtctggtaaggagctcgagaaggagcctaattttttgaaaaacggtgatgcggggattgtgaaaatggttccaaccaagcccatggtggtggagacgttctctgagtatccgcctttggggcgttttgctgtgagggatatgcgacagacggttgctgttggtgtgatcaagagtgtagacaaaaaggacccaactggtgttaagatcaccaaggctgcagccaagaagaaatgaatcgatgcttttatgaagctcatgttcacagtgcactttgttattgtcttgttatttgtttttaacttttgtgtgtgtcgttgttgccatcgtttactgccgttcacggtggttctgttgcgttttcgggttgatgatcatacatgggtccttgacagacggtggcacaacgcaagtaatactacttattttcgttgtcgtggagggtttatatatgaacttgaagaataaaatac

SEQ ID NO: 1324 - DNA, 1514 bp, Flaveria ramosissima
atcactctccacaaatcggctagcagattattccccaacgcttttttgtatatctcagaatgggtaaggaaaagactcacatcagcattgtggtcattggacatgtcgactccggccaagtcaacgaccactggccatttgatttacaagcttggaggaattgacaagcgtgttatcgagaggtttgagaaagaagctgctgaaatgaacaagaggtcattcaagtacgcctgggttcttgacaaactgaaagctgaacgagaacgtggaattaccattgatattgctttgtggaagtttgagactaccaagtactattgcactgttattgatgcacccggacacagagatttcatcaagaatatgattactggtacatcccaagctgattgtgctgtcttgattatcgactcgactactggtggttttgaagctggtatctctaaagatggtcagacccgagagcatgctctgcttgcttttactcttggtgtgaagcaaatgatctgctgttgtaacaagatggatgccaccactcctaaatactccaaatcaaggtatgaagaaattgttaaggaagtttcttcatacttgaagaaggttggctacaacccagacaaaatcccatttgtacccatctccggtttcgagggtgacaacatgattgagaggtctacaaaccttgactggtacaagggtccaacacttcttgaagctcttgaccagatcaacgagccaaaaagaccctctgacaaaccacttcgtctaccccttcaagacgtgtacaagatcggaggtattggaactgtgcccgtcggtcgtgtcgaaaccggtgtaatcaaacccggtatggttgtcacttttggtccatctgggttgaccactgaagtcaagtcagtcgaaatgcaccacgaggccctaaccgaagctctacctggtgacaatgtcgggttcaacgtcaagaacgttgcagtcaaggatcttaaacgtggttacgttgcttccaactccaaggacgaccccgccaagggtgcagccagtttcacctcacaggtcatcatcatgaaccaccctggtcagatcggaaacgggtatgccccagttctggattgccacacttctcacattgcagtcaagttctccgagcttttgaccaagattgaccgtcggtccggtaaagaactcgagaaagagcccaagtttttgaagaacggtgatgctggtatggttaagatgcttccaaccaagcccatggttgttgaaactttcgcagagtacccaccacttggcaggtttgcagttcgtgacatgaggcagacggttgctgttggtgtgatcaagagtgtcgataagaaggacccgactggagccaaggtgaccaaggctgcagccaagaagggagccaagtgatggtgtgggcgtgtgtcgtttgggactgatggacttgttttaatcatgttttggactattttaattatgtttattttggtatttggtcttgtggtcttgctatt

SEQ ID NO: 1325 - DNA, 1476 bp, Pteridium aquilinum
gctctttcgcagtgtttctgctgctgcctttctgtggttgaaggagcccttcgcattttcacttcgcagccatgggaaaggagaagacacacatcaacatagtggtcattggccatgtcgactccggaaaatcaaccaccactggtcatcttatctacaagcttggtggtattgacaagcgtgtcattgagcgtttcgagaaggaagcagctgaaatgaacaagaggtctttcaagtatgcctgggtgttggataagctgaaggctgagcgtgagcgtggtatcaccattgatatcgctctctggaagtttgagacaaccaagtactattgcactgttattgatgctccgggccatcgtgatttcatcaagaacatgattaccggaacttctcaggctgattgtgctgtcctgattattgactccacaactggaggatttgaggctggtatttcgaaggatgggcaaactcgtgagcatgcgctgcttgcattcactcttggagtgaggcaaatgatttgctgctgtaacaagatggatgctactaccccaaagtactctaaagctcgttatgatgaaatcatgaaggaagtgtctgcttatctcaagaaggttgggtacaaccctgacaaaataccctttgttcccatctctggttttgagggggacaacatgattgaaaggtcttccaaccttgattggtacaagggcccaacactccttgatgctctggatatggtccaggagcccaagaggccctctgacaagcctctccgcctgcctctgcaagatgtctacaagattggtggtattggaactgtgccggttggtcgtgtggagactggtatcatcaagcctggtatggttgtcacctttgccccaactggactgaccactgaggttaagtctgtggagatgcatcatgaggctctccttgaggctcttcctggtgacaatgttggatttaatgtgaagaacgtggctgtcaaggatctcaagcgtgggtttgttgcctcggactccaagaatgatcctgccaaggaggcagctaacttcacctcccaggtcatcatcatgaaccaccctgggcagattggtaatggatacgcacctgtgctggattgtcacacttcccacattgctgtgaagtttgcagagatccttactaagattgacaggcgttctggcaaggagattgagaaagagccaaaatttttgaagaatggagatgctggtattattaagatgattcctaccaagcctatgacagtggaaacctttgctgaatatcctccacttggtcgctttgctgtgcgtgacatgaggcagacagtggctgtaggtgtcatcaaggcagtggaaaaagaaggatcctactggagccaaggttactaaggctgctgcaaagagaaatgaaccaaattgtgtgccagactgatggtggatgttgagtcaggctgcgtagttttatttgttt

SEQ ID NO: 1326 - DNA, 1742 bp, Secale cereale
ggctctcactcctcttcgtccccggacagccaggtagttatcagccatgggtaaggagaagatccacatcagcattgtggtcattggccatgtcgactctggcaagtcaaccacgactggccacctcatctacaagcttggaggcattgacaagcgtgtgatcgagaggttcgagaaggaagccgctgagatgaacaagaggtcgttcaagtacgcctgggtgcttgacaagctcaaggctgagcgtgagagaggtatcaccattgatattgctctgtggaagttcgagaccaccaagtactcctgcaccgtcattgatgctcctggtcaccgtgatttcatcaagaacatgatcactggtacctcccaggctgattgtgctgtgcttatcattgactccaccactggtggttttgaggctggtatctccaaggatggccagacccgtgagcatgctctccttgctttcactcttggtgtgaagcagatgatctgctgctgcaacaagatggacgccaccactcccaagtactcaaagtcccgttatgaagaaattgttaaggaagtctcttcatacctgaagaaggtcggttacaaccctgacaaggttcccttcgtccccatctctgggttcgagggtgacaacatgattgagaggtccaccaaccttgactggtacaagggccccaccttcttgaggcccttgaccagatcaatgagcccaagaggccctcagacaagcccctccgccttccccttcaggatgtctacaagattggtggcgattggaactgtgccagtggggcgtgttgagactggtgtcatcaagccaggtatggttgtcacctttggccctactggcctgaccactgaggtgaagtctgtggagatgcaccacgagtctctcctggaggcgcttcctggtgacaatgtcggcttcaacgtcaagaacgtggccgtcaaggatctcaagcgtgggtatgttgcctccaactctaaggacgaccccgccaaggaggctgccaacttcactgcccaggtcatcatcatgaaccaccccggccagatcagcaacggctatgccccagtgctggactgccacacgtgccacatcgccgtcaagtttgctgagatccagaccaagattgacaggcggtccggcaaggagctggaggctgcgcccaagttcctcaagaacggtgacgccgggttcgtcaagatgattcccaccaagcccatggtggtggagacctttgcccagtaccctcccctgggccgctttgctgtgcgcgacatgaggcagacagttgctgtgggtgtgatcaagagcgtggagaagaaggagccgaccggtgccaaggtgaccaaggctgcgatcaagaagaaatgagatggtgtctggcagtgctgttgttggcgggtggtggtgacggtatacggcggttgcggtagtcgtcttagtcgattcaaaaactcgttaagctttggttatttgtgtcgagcagtgttggaactgcttttttctctgctcgttgtatcatttagttgtgttggtgaaacttcgtcagttaaaattaatgttgctatctactatagtcgtcttgtttggagtactaaaaaaaaaaaaaaaagaaaaaaaaaaacgtaaaaataacctgtcgtacgttagtactaccgtactctacgttgggtaacgggtacacggacgagaaccgaggtagggagaggtgacgggggggggg

SEQ ID NO: 1327 - DNA, 1443 bp, Utricularia gibba
tccaccaccaccggtcacttgatctacaagcttggcggtatcgacaagcgtgtgatcgaaaggttcgagaaagaagctgctgagatgaacaagaggtcattcaagtatgcgtgggtgctcgacaagttgaaagctgagcgcgagcgtggtatcaccatcgatattgctctatggaagttcgagaccacaaagtactactgcaccgtcattgatgctcctgggcatcgtgatttcatcaagaatatgattactggtacctcacaagccgactgcgctgtgctgatcatcgattccaccactggtggtttcgaagctggtatctccaaggatgggcagacccgagagcatgctctgcttgcgttcacccttggcgtgaagcaaatgatctgctgctgcaacaagatggacgccacgacaccaaaatactccaaggccaggtacgatgaaattgtgaaggaggtgtcctcctatctgaagaaggtgggctacaatcctgaaaagatccccttcgtgccaatttctggtttcgagggagacaacatgatcgagaggtccaacaacctggactggtacaaggggccgacccttcttgaggctcttgatctgatcaacgagccaaagaggccctcggataagcccctccggctcccgcttcaggacgtgtacaagatcggtggtatcggcactgtgcctgtggggcgtgtcgagacgggtgtcctgaagccgggtatggtggtcaccttcggtccctctgggttgacgactgaagtaaagtccgtggagatgcaccacgaagcgctgctggaggctctgccgggtgacaacgtgggtttcaacgtgaagaacgtggcggtgaaggacctgaagcgtgggtatgtggcgtccaactccaaggatgaccccgccaaggaagccgccaacttcacctcccaggtgatcatcatgaaccaccccgggcagatcgggaacggatacgcccccgtgctggattgccacacctcccacattgccgtgaagttcgcggagatcctgaccaagatcgacagacggtctggaaaggagctggagaaggagcccaagttcctgaagaacggcgacgccggcctcgtgaagatgattcccaccaaacccatggtcgtggagacgttctccgagtaccctcctctggggcgtttcgcagtgcgtgacatgcgtcaaacggtggcggtgggtgtcatcaagagcgtggagaagaaggacccaaccggcgccaaggtgaccaaggcggccgccaagaaaggagcgaagtaaattcagccttcagtgagattccaacagttctcggcgttcatgaagcaagttcttgtctacttttcaattttgcgtttgttgttctgtactctttatctgcgcatttttccggctcattggtgtcttgtttgtccgcgtccagagagttagtag

SEQ ID NO: 1328 - DNA, 1362 bp, Brassica napus
ggcgtcctcatttacttgtctcactcagtttcgtagccgcatctcatattctaactcgcagctgtggggaaagagaagtttcacatcaacattgtggtcatcggccatgtcgactctggaaaatcaaccaccactggtcacttgatttacaagctcggtggtattgacaagcgtgtcatcgagaggttcgagaaggaggctgctgagatgaacaagaggtccttcaagtacgcgtgggtgttggacaaacttaaggccgagcgtgagcgtggtatcaccattgatatcgctctctggaagttcgagaccaccaagtactactgcacggtcattgacgctcctggacatcgtgatttcatcaagaacatgattactggtacctcccaggctgattgtgctgttttgatcattgactctaccactggtggtttcgaggctggtatctccaaggatggtcagacccgtgagcatgctcttcttgctttcacccttggtgtcaagcagatgatttgctgctgtaacaagatggatgctactaccctaagtactccaaggctaggtacgatgagatcatcaaggaggtgtcttcctacttgaagaaggttgggtacaaccctgacaaaatcccattcgtcccaatctctggtttcgagggtgacaacatgatcgagaggtcaaccaaccttgactggtacaagggaccaactctccttgaggctcttgaccagatcaacgagccaaagaggccctctgacaagcccctccgtctgccacttcaggatgtctacaagatcggtggtattggaacggtgccagtgggacgtgttgagaccggtatgctcaagcccggtatggttgtgaccttcgctccttcagggttgaccactgaggttaagtccgttgagatgcaccacgagtctcttgtggaggcgcttccaggtgacaacgtcgggttcaatgttaagaatgttgccgtcaaggatcttaagagagggtatgttgcatccaactccaaggatgaccctgccaagggtgccgccaacttcacctcccaggtcatcatcatgaaccaccctggtcagatcggtaacggttacgccccggttctcgattgccacacatcccacattacagtcaagttctctgagatcctcaccaagattgacaggcgatctggaaaagagattgagaaggagcccaagttcttgaagaatggtgatgctggtatggttaaaatgactccgaccaagcccatggttggtgagactttctctgagtacccaccattgggtcgtttcgctgttagggacatgaggcagacggtggctgttggtgttatcaagagcgttgacaagaaggacc

SEQ ID NO: 1329 - DNA, 1325 bp, Ambrosia trifida
tcttcctcttcccccatctatcacacaaatcgtctgaacatcttttgctaaggatgggtaaggaaaagattcatattagtattgttgttattggacatgtcgattccggcaagtcgacgacaaccggtcacttgatctacaagctcggcggtatcgataaaagagttatcgagcggttcgaaaaggaagccgctgaaatgaacaagaggtcattcaaatacgcttgggttcttgacaaacttaaggcagagcgtgaaagaggtatcacaattgacattgcgttgtggaagtttgagacaacaaaatactattgcacggttatcgatgctcccgggcatagggatttcatcaagaatatgattactgtactcacaggctgactgtgctgttcttattattgattcgactactggtgggtttgaagctggtatttctaaagatgggcagacccgtgaacacgcgcttctcgcttttactcttggtgtcaaacaaatgatttgttgttgtaataagatggatgccaccacacctaagtactcgaaggcaaggtacgatgaaattgtgaaggaagtgtcatcatacttgaagaaggtcggatataacccggacaaaatcccatttgttccaatctctggatttgaaggagataatatgattgagaggtctactaaccttgactggtacaagggaccaactcttcttgaagcgcttgatcagattaatgagcccaagagaccatcagacaagcctcttcgtctcccgcttcaggatgtgtacaagattggtggtattggaactgtgcctgtgggacgtgttgagaccggtgttatcaagcctggtatggttgttactttcggaccttctgggttgactactgaagtaaagtcagttgagatgcatcatgaagcgttgcaagaggctcttcctggtgacaatgttgggtttaatgttaagaacgttgcggttaaggatctcaagcgtggttacgtcgcatcaaactcaaaggatgatcctgccaagggagctgctagtttcacctcgcaggttatcatcatgaaccaccctggacagattggaaatggttatgcaccggttcttgattgccacacatcccacattgctgttaaattctctgagcttttgaccaagatcgacagacgatctggaaaggagcttgagaaggagcctaagttcttgaagaacggtgacgcagggatggttaagatgcttcccaccaagcctatggttgtggagactttcgctgagtacccaccacttggaaggtttgctgtgagagacatgcgtcaaacggttgctgttggtgt

SEQ ID NO: 1330 - DNA, 1598 bp, Secale cereale
ctcttcgtccccggacagccaggtagttatcagccatgggtaaggagaagatccacatcagcattgtggtcattggccatgtcgactctggcaagtcaaccacgactggccacctcatctacaagcttggaggcattgacaagcgtgtgatcgagaggttcgagaaggaagccgctgagatgaacaagaggtcgttcaagtacgcctgggtgcttgacaagctcaaggctgagcgtgagagaggtatcaccattgatattgctctgtggaagttcgagaccaccaagtactcctgcaccgtcattgatgctcctggtcaccgtgatttcatcaagaacatgatcactggtacctcccaggctgattgtgctgtgcttatcattgactccaccactggtggttttgaggctggtatctccaaggatggccagacccgtgagcatgctctccttgctttcactcttggtgtgaagcagatgatctgctgctgcaacaagatggacgccaccactcccaagtactcaaagtcccgttatgaagaaattgttaaggaagtctcttcatacctgaagaaggtcggttacaaccctgacaaggttcccttcgtccccatctctgggttcgagggtgacaacatgattgagaggtccaccaaccttgactggtacaagggccccacccttcttgaggcccttgaccagatcaatgagcccaagaggccctcagacaagcctctccgccttcccttcaggatgtctacaagattggtggcattggaactgtgccagtggggcggtgttgagactggtgtcatcaagccaggtatgttgtcacctttggtccactggcctgacactgaggtgaagtctgtggagatgcaccacgagtctctcctggaggcgcttcccggtgacaatgtcggcttcaacgtcaagaacgtggccgtcaaggatctcaagcgtgggtatgttgcgtccaactctaaggacgaccctgccaaggaggctgccaacttcactgcccaggtcatcatcatgaaccaccctggccagatcagcaatggctatgccccagtgctggactgccacacgtgccacatcgccgtcaagtttgctgagatccagaccaagattgacaggcggtccggcaaggagctggaggctgcgcccaagttcctcaagaacggtgacgccgggttcgtcaagatgattcccaccaagcccatggtggtggagacctttgcccagtaccctcccctgggccgctttgctgtgcgcgacatgaggcagacagttgctgtgggtgtgatcaagagcgtggagaagaaggagccgaccggtgccaaggtgaccaaggctgcgatcaagaagaaatgagatggtgtctggcagtgctgttgttggcgggtggtggtgacggtatacggcggttgcggtagtcgtcttagtcgattcaaaaactcgttaagctttggttatttgtgtcgagcagtgttggaactgcttttttctctgctcgttgtatcatttagttgtgttggtgaaacttcgtcagttaaaattaatgttgctatctactatagtcgtcttgtttggagt

SEQ ID NO: 1331 - DNA, 1264 bp, Ambrosia trifida
aagtccacaaccacaggacatcttatctacaagttgggaggtatcgacaagcgtgtgatcgaaagattcgagaaggaagcagctgagatgaacaaaaggtccttcaaatacgcctgggtgcttgacaagcttaaggccgagcgtgaaagaggtatcaccatcgatatcgccttgtggaagtttgagaccaccaagtactactgcactgtcatcgatgcccccggacatcgtgatttcattaagaacatgattactggcacttcccaagctgattgtgctgttcttatcatcgattccaccactggtggtttcgaggctggtatttccaaggatggtcagacccgtgagcacgctcttcttgctttcacccttggtgtcaagcaaatgatctgctgctgtaacaagatggatgctaccacccctaagtactccaaggctaggtacgatgaaatcgtcaaggaagtgtcatcttacttgaagaaggtcggatacaaccccgacaaaatcccattcgtgccaatctctggatttgagggagacaacatgattgagaggtcgaccaacctcgactggtacaagggtccaacccttcttgaagctcttgaccagatcaacgagcccaagagaccctcagacaagcccctccgtctcccacttcaggacgtgtacaagatcggtggtattggaactgtgcccgtgggacgtgttgagactggtgtgatcaagcctggtatggttgttaccttcggaccatctgggttgaccactgaagtcaagtctgttgagatgcaccacgaagccctccaagaggctctccccggtgacaatgttgggttcaacgtcaagaacgttgctgtcaaggatctcaagcgtggttacgtcgcatcaaactccaaggatgatcctgccaagggtgctgccagtttcacctcccaggttatcatcatgaaccaccctggccagatcggtaacggttacgccccagttcttgattgccacacctcccacattgctgtcaagttctctgaactcttgaccaagatcgacagacgatccggtaaggagcttgagaaggagcccaagttcttgaagaacggagatgccggtatggttaagatgcttcccaccaagcccatggttgtcgagacctttgctgaatacccaccacttggtcggtttgctgtgagagacatgcgtcagacagttgcagtcggagtcatcaagagcgtcgataagaaggacccaaccggagccaaggtgacaa

SEQ ID NO: 1332 - DNA, 2043 bp, Quercus alba
ctctttcgctttcgctcttcactcccttcttagctactgcttcttgctcagattttagaatgggtaaggagaaggttcacattagcattgtggtcattggccatgtcgactctggaaagtcgaccaccactggacatttgatttacaagcttggagggattgacaagcgtgtaattgagaggtttgagaaggaggctgctgagatgaacaaaaggtcattcaagtatgcatgggttttggacaagctcaaggctgagcgggagcgtggtattaccattgacattgcactgtggaagtttgagactactaaatattactgcactgtcattgatgctcctggacatcgcgattttatcaagaacatgattactggtacctcacaggctgattgtgctgtccttattattgactccactactggtggatttgaagcgggtatttccaaggatggtcagactcgtgagcatgctttgcttgccttcacccttggtgtcaagcaaatgatctgctgttgcaacaagatggatgcaacaaccccaaaatactctaaggcaaggtatgaagaaatcgtaaaggaagtttcttcctatcttaagaaagtaggatataaccctgacaagatcccctttgttcctatttctgggtttgagggtgataacatgattgagaggtcaaccaaccttgactggtacaagggccctacccttcttgaggctcttgacttgattttggagccaaagaggccctcagacaagcctctccgactcccacttcaggatgtctacaagattggtggtattggaactgtccctgtggggcgtgttgaaacgggtgtgctcaaaccaggtattgttgttacttttggccctactgggctgacaactgaagttaagtcagttgagatgcatcacgagtctctcctagaggctttgcctggtgacaatgttggtttcaatgtgaaaaatgttgccgtcaaggatctcaaacgtgggtttgtggcatccaactcaaaggatgatcctgcaaaggaagctgctaacttcaccgcccaggtcattatcatgaaccatcctggccagattggcaatggttatgccccagtacttgactgccacacctcccacattgctgtgaaattttctgaaattttgaccaagattgataggaggtcgggcaaggagcttgagaaggagcccaaatttttgaagaatggagatgctggttttgttaagatgattcccaccaagcctatggtggtggagactttctccgagtacccaccacttggacgatttgctgtgagggacatgcgtccaaactgtggctgttggtgttgtcaagagtgtggagaagaaggatccaagtggtgccaaggtcaccaagtctgctgctaaaaagaaatgagtgttttattttaggaagtcaatagcaaaagaaatgggttggttttgtggcttttgttattgcagcctcttatataggggccttgactgcctggtggttttgagcacccaggccacctgggtggcttgaccgtcggtggcaaaagctgcatctatctggttgatgctgtttttagtagtatagagcttcatagttgcaagtgagagaacaaattggcatttaatttgatttccaaattgttggtttttaaatgtatttatgagactcaaatattttacgtttgaaatgtcacccctaagtagtggtgatatctcatatctgtggggactttttgttttgttttgttttttccttccaaaaaaggaaagaaaaaaaacaatattgtttctctttcggtttttgggctttgcattatttcaataagagggttcatacgtttctgagggcagaattctgtccaattaattaggcacgcgggctcatggatactatggaaattgtaaaattatctagtaggagactgtgttccctttgttaggagctacacagggaatgtttacttaaggaactagattgcaaggtctaccataatttatgtcctgtaattcaataatttgcgtcctctacaaggtccatatc

SEQ ID NO: 1333 - DNA, 1720 bp, Artemisia annua
gtggtatcaacgcagtactccgacggggattcttcatttttccttcacatctcactctctctctttttgccgttaattctctctaagatgggtaaggaaaagattcatatcagtattgtcgtcattggacatgtcgactccggcaagtctacaaccactggtcacttgatctacaagttgggaggtattgacaagcgtgtgattgagcgtttcgagaaggaagctgctgagatgaacaagaggtccttcaagtacgcatgggtgttggacaaacttaaggcagagcgtgaacgtggtatcaccatcgatattgctttgtggaagtttgaaaccaccaagtactactgcacagttattgatgctcccggacatcgtgatttcattaagaatatgattactggaacttcacaggctgattgtgctgtcttgattattgactcgaccactggtggttttgaagctggtatttccaaggatggtcagacccgtgagcacgcacttcttgctttcacccttggtgtcaagcaaatgatttgctgttgtaacaagatggatgctacgactcccaagtactccaagtcaaggtacgaggaaatcgtgaaggaatcatacttgaagaaggttggatacaacccagacaaaattgctttgtgcccatctctggttttgaaggtgacaacatgattgagcgatccaccaaccttgactggtacaagggacctactctccttgaagcccttgaccagatcaacgagcccaagagaccatcagacaagccccttcgtctacctcttcaggatgtttacaagattggtggtattggaactgtgccagtgggacgtgttgagactggtgtcatcaagccaggtatggttgtcacttttggaccatctggtttgaccactgaagtcaagtcagttgagatgcaccacgaagctctatctgaagctcttcctggtgacaatgttgggtcaatgtgaagaatgttgctgttaaggatttgaaacgtggttatgttgcatcaaactccaaggatgacccagctaagggtgctgccagtttcacctcgcagtgaaccaccctggtcagattggaaacggttatgctccagttctcgactgtcacacatcacacattgctgttaagttcggtgagatcttgaccaagattgacaggcgatctggaaaggagttggagaaggaacccaagttcttgaagaacggagatgctggtatggttaagatgcttccaaccaagcccatgctgaatacccacctcttggaaggtttgctgttagggacatgaggcagaatcaagtctgtggacaagaaggacccaactggagccaaggtgaccaaggctgcagtcaagaagggtgccaagtttggagtttatttctatcataagttttggttattgatccttatggatcagacttttgttgtggtgaaatctatgcaatgcaatgaacttgttagttgatgggtaaacattgatgtttgttatccaatattctagtcggtttctgggttttgtgcttgtattcttttggtcatatggttactgtggtctgtttccagttttttacttgccctgtttgcttatctgattgctggagttttaaaacactgcttttaaaaagcaaatgtgtactggaattcaacattgttgaatgatatcctgcaattaatctactgctggtttacgaaagacacgcgag

SEQ ID NO: 1334 - DNA, 1709 bp, Gossypium raimondii
gcggccacgttttatcaatgttggatctgttgaatttaaatgtggcttgattttctttttagaaattgacttgaactgttcttcgtaaacaataaaagtgggtcccagattcattgtttcttgttcgcaagatgttggtcttcttgtgtgattttgacttggaattatgttttgagcttattttatgaatatgtttcttctcgatttttagctcctctcttgagtactataatgggtaaggagaaggttcacatcaacattgtggtcatcggccatgtcgactctgggaagtctacaaccactggtcatttgatctacaagcttggtggtattgacaagcgtgtgattgagaggtttgagaaggaggctgctgagatgaacaaaaggtcatttaagtatgcatgggtgcttgacaagcttaaggccgaacgtgaacgtggtattaccatcgatattgccctctggaagtttgagactaccaaatactactgcactgtcattgatgcccctggacaccgtgactttatcaagaacatgattactggtacctcacaggctgactgtgctgttctcattatcgactcgaccactggtggttttgaagctggtatctcaaaggatggtcagacacgtgagcatgctttgcttgcatttacccttggtgtcaagcagatgatttgcatggatgcaacaactccaaaatactccaaggcaaggtatgatgaaattgtgaaggaagtctcctcatatcttaagaaagttggttacaaccctgacaagatcccatttgtcccaatctctggatttgagggtgataacatgattgagaggtctaccaaccttgactggtacaagggtcccactctccttgaggctcttgaccagatcaatgagcccaagaggccttcagacaagccactccggctcccacttcaggatgtctacaagattggtggcattggaactgcccctctggtctgaccactgaagttaagtctgttgagatgcaccatgaagccctctctgaggctctccctggtgacaatgttggattcaatgtcaagaacgttgctgttaaggatctcaagcgtggtttcgttgcttcaaactctaaggatgatcctgcaaaggaggctgccagcttcacctctcaggtcatcatcatgaaccaccctgggcagattggaaacggatatgccccagtccttgactgccatacctcccacattgctgtgaaattttccgaattgctaaccaagatcgacaggcgatctggaaaggagcttgagaaggagcccaagttcttgaagaatggtgatgcagggatgataaagatggttcccaccaagcctatggttgtggagactttctctgagtacccaccacttggacggtttgctgtcagggacatgcgtcagactgtggctgttggtgtcatcaagagcgttgagaagaaggatccaaccggtgctaaggtcaccaaatctgctgccaagaagaaatgagattgcatttgagaagccaggatagtttctgagttttggtcttatttttgtctggtagtaattgtatggaaatattttgaccattttttatatgctttatcgtgtattgttttggttccgaaattgatcaagaattgttgaattttcttgtttaacttttcctggttaattttagattaaggtaccgtgtttttaatttttctt

SEQ ID NO: 1335 - DNA, 1723 bp, Ambrosia trifida
gcgggggggggcaaagatgtatatataaagcacccgatacttcttttctacccatcatctcaaccttaacgtttctcaatttcgacaacgtagaaatccaagcaacaagaacagttgcatcatgggtaaggagaaggttcacataaacatagtggtcattggccatgttgactctggaaagtcaaccactacagggcacttgatctacaagctaggcggtattgataagcgagtgatcgaacgcttcgaaaaagaagctgctgagatgaacaaacgttcgtttaagtacgcttgggtgctagacaagcttaaagccgaacgtgaacgtggtatcaccattgatatcgccttgtggaagtttgaaactactaagtactattgcacagtcattgatgcgccaggtcatcgcgatttcatcaagaacatgattaccgggacgtctcaggctgattgtgctgttttgatcattgactccaccacaggtggttttgaagctggtatttcgaaagatggtcagactcgcgagcatgctttgctcgcgtttactcttggtgttaggcaaatgatatgttgttgtaacaaaatggacgctactacgcctaaatactccaagtctaggtacgacgagattgttaaggaagtgtcgtcttaccttaaaaaggtcggatacaatcctgaaaagatcccatttgttccaatttcgggttttgaaggagataacatgattgaaaggtcaacaaaccttgattggtacaagggtccaacacttcttgaagcacttgacaatgttagtgaaccaaagaggccttcagacaagccgcttcgtctcccactccaggatgtgtataagattggtgggattggaactgtgccagtgggtcgggttgagactggtattatcaagcctggtatggtcgtcacttttggcccgtctggtcttaccactgaagttaaatcggtcgaaatgcatcatgaagcgcttcaagaggcattgccaggggataatgttgggttcaatgtgaagaatgttgctgtgaaggatctgaaacgtggttatgtcgcctcaaactcgaaagatgatccagcaaagggtgctgctagctttacttctcaagtcattatcatgaaccaccctggccagattggaaacggttatgcaccggtgcttgattgccacacttctcacattgctgttaagtttgctgagctgcagaccaagattgaccgcaggtctggtaaggagctcgagaaggagcctaagtttttgaaaaacggtgatgcagggattgtgaagatggttccaaccaaacccatggtggtggagacgttctctgagtatccgcctttgggacgttttgctgttagggatatgcgacagacggttgcagttggtgtgataaagagtgtggacaaaaaggcccaactggtgctaagattaccaaggctgcagccaagaagaaatgaaccgctatgtttatgagcctcgtattcacagtgaactttgttattgtgttgttatttgtttttcaacttttgtttgtgtgtatgtcgttgctgccttcgtttactgccgttcctaggaatggtggttctgttgcgtttccgggttcatacatgggtgcttgacagacggtggcacaacttgtttttgttgtcatggagtgtttatgtaaaaacttggagaataaaatttatgtatttctgggtacttatcaaaaaagaa

SEQ ID NO: 1336 - DNA, 1637 bp, Medicago truncatula
gttgaattggcagatcttttcgtggttttaagcttttaaggacaaatgggtaaggaaaaggttcacattaacattgttgtcattggtcatgtcgactccgggaagtcaaccaccaccggtcacttgatctacaagcttggaggtattgacaagcgtgtgattgagaggtttgagaaagaagctgctgagatgaacaagcgttcattcaagtatgcttgggtgctcgacaagctcaaggctgaatgtgaaagaggtatcacaattgacattgctctgtggaagtttgagactactaagtactactgcactgtcattgatgcccccggacacagggatttcattaagaacatgattactggaacatcccaagctgattgtgctgttctgatcattgattccactaccggtggttttgaagccggtatatcaaaggatgggcagacccgtgaacacgctcttcttgctttcactcttggtgtgaagcaaatgatttttatggatgccactacacctaagtactcgaagggtaggtatgaagaaattgtgaaggaagtttcatcctatttgaagaaggttggctataacccagacaaaattccatttgttcccatctctggttttgagggagataacatgatcgagcgctctacaaatcttgactggtacaagggtcctacccttcttgaggctcttgaccaaatcaacgagcctaagaggccatcagacaagcccctccgtctaccgcttcaggatgtctacaagattggaggaattgggactgtgcctgtggggcgtgtcgagactggtgtcataaaacctggaatggttgtcacttttgcccctactggactgacaactgaagtgaagtctgtggagatgcatcatgaagctctcactgaggctcttcctggtgacaatgtgggatttaatgttaagaacgttgctgttaaggatctcaagcgtggttatgttgcctcaaactccaaggatgaccctgccaaggaggctgctaactttacatctcaagtgatcattatgaatcaccctggccagattggaaatggctatgcccctgttcttgactgccacacctcccacattgctgtcaaatttgctgagcttgttactaagattgacaggcgttctggaaaggagattgagaaggagcccaaattcttgaagaacggtgatgctggtattattaagatgattcccaccaagcccatggtggttgagactttctctgagtatcctccacttggccgtttcgctgtcagggatatgcgtcagactgtggctgttggtgtcatcaaggctgtggagaagaaggatcccagcggaggacttaataaaaacaaagtcagcattgaagaagaagtgaaccgtgcaggaagatctatccaaggaagtctattatggtgattacaagaaatggtttgctctatgtagtacttttatttttcgtcttgttaacttgtttttcggattaagtgtcaagtctgcaccgtcatctcgcaacttttgttcccaaaactgggttcttgatcgacggtggcagggctatttcttttccgtgtttatgctttgacttctgtgttttgttagaactataactatatgattttgtaagcagatag

SEQ ID NO: 1337 - DNA, 1688 bp, Amorphophallus konjac
caccggtgttctttcgcagagaaggcttcttctcctaccccacgccgcctcttctcaagcatttctatctcgtttgtctgtatggctggccattttgcacacctgctgttgttgacatgttgatgtaatgtcataatcttccagaatcttcaaaaaaagcttccaatcgcacgtcagcatgggtaaggaaaaggtgcacatcaacattgtcgtcattggacatgtcgactccggcaagtctaccaccacaggccatcttatctacaagcttggtggtattgacaagcgtgtcattgagaggttcgagaaagaggctgctgagatgaacaaaaggtcaattcaagtatgcctgggtccttgacaagctgaaggctgagcgtgagcgtggtatcactattgacattgctctctggaaatttgagaccaccaagtactactgtactgtcatcgatgctcctgggcatcgtgacttcatcaagaacatgatcacggtacttctcagccgactgtgccgtctcatcattgactcgaccaccgggggttttgaggccggtatcgtccaaggacggccaagactcgggagcatgctttgcttgccttcgacactcggacgtccaaagtcaagatgaattttgctgttgcgtaacaagatgggattagcaactaacccccacgtactccaaggccaggtatgatgaaattgttaaggaagtctcatcctacctgaagaaggtgggatacaacccagacaagattccttttgttcccatctctgggtttgaaggtgacaacatgatcgagaggtccaccaacctcgactggtacaagggacccacgctccttgacgctcttgacctgattcaggagcccaagaggcctactgacaagcccctccgcctccctcttcaggatgtctataagattggtggtattggtaccgtgcccgtcgggcgggttgagaccggcatcctgaagcctggtatggtggtctgtttcggccccaccggcctgaccactgaagtgaagtctgttgagatgcaccacgaggcccttgtggaagctctccctggtgacaacgtgggcttcaacgtgaagaacgtcgccgtgaaggacctgaagcgtggattcgttgcctccaactccaaggatgacccggcgaaggaagccgccaacttcacttctcaggtcatcatcatgaaccacccggggcagatcggcaacggatacgcgcccgtgctcgactgtcacacctcccacatcgccgccaagtttgcggagatcctcaccaagattgacaggcgttctgggaaagagctggagaaggagcccaagttcctgaagaacggcgatgccggtttcgtgaagatgattcccaccaagcccatggtggtggagacgttctccgagtatcctccctcggccgtttcgccgtgagggacatgcggcagactgtggccgtcggtgtcatcaagagcgtcgacaagaaggacccaactggtgccaaggtcaccaagtctgctgccaagaagaagtgagagagagagagcaggtgtgtgttagtggttacgtggtcggtatgctcttcgttttcttcttttttctttaattatcggggcagccttcatcagccatttctctgcctccataacgagtagaatggtgttgacaggcggctttagtagtgttct

SEQ ID NO: 1338 - DNA, 1432 bp, Avena sativa
cccagttccctcccacccccttccgccgccacctgctcctctcggtccgttcttcatccttcgagtttgttagctgacacttcagccatgggtaaggagaagacgcacattaacatcgtggtcattggccacgtcgactctggcaagtcgaccaccactggccacctgatttacaagcttggaggaattgacaagcgtgtgatcgagaggttcgagaaggaagctgctgagatgaacaagaggtcgttcaagtacgcgtgggtgcttgacaagctgaaggctgagcgtgagagaggtatcaccattgatattgctctctggaagtttgagacaacgaaatactactgcacggtcattgacgcccctggtcaccgtgacttcatcaagaacatgatcaccggtacctcccaggctgactgtgctgtcctcatcattgactccaccactggtggatttgaggctggtatctccaaggatggccagactcgtgagcatgctctccttgctttcacccttggagtcaagcagatgatctgctgctgcaacaagatggatgccaccactcccaagtactcaaaggcacgttatgaagaaattgtgaaggaagtctcttcttacctgaagaaggtcggctacaaccctgacaaggtgccatttgtccccatctctgggtttgagggtgacaacatgattgagaggtcgaccaaccttgactggtacaagggccccaccttgcttgaggcgctcgaccagatcaacgagcccaagaggccctcagacaagcccctccgtcttcccctccaggatgtttacaagattggtggcattggaactgtgcctgttggccgtgttgagaccggtgtcatcaagcctggcatggttgtcacctttggtccaactggtctgaccaccgaggttaagtctgttgagatgcaccacgagtctctcctggaggcgctccctggtgacaacgtggggttcaacgtcaagaatgttgctgtgaaggatctcaagcgtgggtttgtggcgtccaactccaaggatgaccctgccaaggaggcagccaacttcacctcccaggtcatcatcatgaaccaccctggtcaaataggcaatggctatgctccagtgctggactgccacacttcgcacattgctgtgaagtttgctgagctggtgaccaagattgacagacgatctggcaaggagattgagaaggagcccaagttcctgaagaatggtgatgctgggatagtaaagatgattcccaccaagcccatggttgtggagaccttttctacttaccccctcttggtcgctttgctgttcgtgacatgagacagacggtagctgttggtgtcatcaagggcgtggagaagaaggacccaaccggtgccaaggtgaccaaggctgctgccaagaagaaatgagg

SEQ ID NO: 1339 - DNA, 1374 bp, Fraxinus spp
ctcttgatagaaatcagaacgctctctgcagtcggcgggtgagagattttttctgtactacattcgaagctttctttttaatagtaaaacatgggtaaggaaaagattcacattagcattgtggtcattggccacgtcgactctggaaagtcaaccaccactggccatttgatctacaagcttggtggtattgacaaacgtgttattgaaaggttcgagaaggaggctgctgagatgaacaagaggtcattcaagtatgcctgggtgctcgacaagctcaaggctgagcgtgaacgtggtattaccattgatattgccttgtggaagtttgagaccaccaaatattactgcacagttatcgatgctccaggacatcgtgactttatcaagaacatgattactggtacttcacaggctgactgtgccgtccttatcattgactctaccactggtggtttcgaagctggtatttccaaggatggtcagacccgtgagcatgcgttgcttgccttcacccttggtgtcaagcaaatgatttgctgctgcaacaagatggatgccactacacctaaatactcgaagtctaggtatgatgaaattgtgaaggaagtgtcatcctacatcaagaagtcggatataaccctgacaagatcccatttgtgcccatctctggttttgagggtgacaacatgattgagaggtccaccaaccttgattggtacaagggcccaaccctcctcgatgctcttgacagattcaggagcccaagagaccctcagacaagcctctccgtctcccactgcaggatgtctacaagattggtggtattggaactgtccccgttggccgtgttgagactggtgttatcaagcctggcatggttgtcaccttcggcccaactggtttgacaactgaagtcaagtctgttgagatgcaccatgaggccctccaggaggctctccccggtgacaatgttgggttcaacgtcaagaatgttgcagtgaaggatctcaagcgtggttatgttgcctccaactccaaggatgaccctgccaagggtgctgccagcttcacttcccaggtcatcatcatgaaccaccctggtcagatcggaaatggatatgccccagtgctcgactgccacacatcccacattgctgttaagtttgctgagctccagaccaagatcgacaggcgttctggtaaggagcttggagaaggagccccaaaattcttgaagaacggtgatgctggtcttgttaagatgattccacaagcccatggttgtggagacttttgcagagtatccacctcttggtcgttttgctgtgagggatatgccccagacagttgcagtggtgtgatcaagagcgt

SEQ ID NO: 1340 - DNA, 1866 bp, Aquilegia formosa
catttctatatttctttctcactcggcaactagggtttgccgatatcaaatcttagtttttcttctttgtgagttattgatcatgggtaaagagaagtttcatatcaacattgtggtcattggccatgtcgactctggaaaatcgaccactactggtcatttgatctataagcttggaggtattgacaagcgtgttattgagaggtttgagaaggaggctgctgagatgaacaaaaggtcattcaagtatgcctgggttttggacaagcttaaggctgaacgagaacgtggtatcaccattgacattgccctatggaaatttgagaccaccaagtactactgcactgtcattgatgctcctggccatcgtgatttcatcaagaacatgattactgctggtatttccaaagatggtcagacccgtgagcatgctcttcttgccttcactcttggagtcaagcagatgatttgctgctgtaacaagatggatgccacgactcctaagtattcaaaggctaggtacgaggaaattattaaggaagtatcttcctacctgaagaaggtgggctacaaccccgacaaaattccctttgttcccatctctggttttgagggtgacaacatgattgagagatctaccaaccttgactggtacaaggggccaacccttcttgaggcacttgacttgatatcagaacccaagagacctacagacaagcctcttcgccttccacttcaggatgtttacaagatcggtgggattggaactgtaccagtcggtcgtgttgaaactggtttgctgaaacccggtatggtgatcaccttcggccctactggattgaccactgaagttaagtcagttgagatgcaccacgaggctcttcaggaggccctgccaggtgacaatgtcggtttcaatgtgaagaatgttgctgtcaaggatcttaaacgtggatttgttgcatccaactcaaaggatgatcctgctagggaggctgccaactttacctcccaggttatcatcatgaatcaccctggtcagatagggaacggatatgccccagtgcttgactgccacacttcccacattgctgtcaagttcggtgagattctcaccaagattgacagacgatcaggaaaggagattgaaaaggagccgaaatttctgaagaatggtgacgcagggtttgttaagatgattccatcgaagcctatggttgtcgagactttctctgagtacccaccacttggtcgttttgctgtgagggacatgcgtcagactgttgctgtcggagtcatcaagagtgtggagaagaaagacccaactggagccaaggtcacgaagtctgcagtcaagaagaaatgatccaagcatttcagtggtgagcttgtttttgttggctattactgccattattttatagacttggtacttggtaatagttttgttgaatgtttaggtgatgttagtagtggctttggccatttgccttttccttttttgagcagccattcacagaattgggtgctctataggcggtggtacagctattacatcttatattttgtgttgttgtaagaatttttgttttcttcgtttaatcttgttcaaggtgaaattcaagagttgatgaacacttaattctgcctccgcagtgtccagatctggtgctactgagctgcagatcggattgtttagttctgtttccatgttaatgatccatgatccatctagttaatattttcttatcatatttggaagttaataattatatcccagttagtgctattttggtgtttcagtgaaataaatggaactccagtggtcctattggctacctgaaatatgctaaatctgcagcagct

SEQ ID NO: 1341 - DNA, 1505 bp, Brassica rapa
tagccatgggtaaagagaagttccacatcaacatcgtggtcatcggccacgtcgactccggaaaatccacaaccaccggtcacttgatctacaagctcggcggtatcgacaagcgtgtcatcgagaggttcgagaaggaagccgccgagatgaacaagaggtctttcaagtacgcgtgggtccttgacaagctcaaggccgagcgcgagcgtggtatcaccatcgacattgctctctggaagttcgagaccaccaagtactactgcaccgtcatcgacgctcctggccatcgtgatttcatcaagaacatgatcactggtacctcccaggctgattgtgctgttctcattatcgattccaccacgggtgggtttgaggctgggatctctaaggatggtcagactcgtgagcatgctcttcttgctttcacgcttggtgttaagcaaatgatttgctgctgtaacaaggtgtgaatgattctcttttactctttactttgaagaaggttggttacaaccctgataaaatcccgtttgttcccatctctggtttcgagggtgacaacatgattgagaggtccaccacccttgactggtacaagggaccgactcttctcgaggctcttgatcagatcaacgagccaaagaggccgtcagacaagcctctccgtcttccactccaggatgtgtacaagattggtggtattggaacggtgccggtaggacgtgttgagaccggtatgctcaagcctggtatggttgtgacttttgctccttcgggtttgaccactgaggttaagtctgttgagatgcatcatgagtctcttgttgaggcgcttccaggtgacaacgttgggttcaatgttaagaacgttgctgtcaaggatcttaagcgtgggtacgttgcttccaactccaaggatgatcctgctaaaggtgctgctaacttcacctcacaggttatcatcatgaaccaccctggtcagattggtaacggttacgctccggttcttgattgccacacgtcccacattgctgtcaagttctctgagattttgaccaagattgataggcgttctggtaaggagattgagaaggagcccaagtttttgaagaatggtgatgctggtatggttaagatgactcccaccaagccaatggttgttgagactttctctgagtacccgccgcttggacgtttcgctgttagggacatgaggcagactgttgcagttggtgtcatcaagagcgttgacaagaaggacccgaccggagccaaggtgaccaaggctgccgtcaagaagggtgccaagtaaagcaccttcagcaagagtctttcatccgaagacgattttagtttttttacattagtgtggtgtttggtcgtttgtttgtgttatagcttcgtctcttgtccgtcagaaccatgttctcgtaattgggttcttgatcggaggtggcggagctatgttgaagtctagctttactgtttttttgttttacttt

SEQ ID NO: 1342 - DNA, 1359 bp, Fragaria vesca
gcgcacaattcacttcttcttggctgcagacttggtaaccttggctccgctaggatccttcttctccacagccttgatgactcccacagcaacagtctggcgcatgtccctcacagcaaaacgaccaagtgggggatactcagagaaagtttcaacaaccatgggcttggtgggaagcatcttaacaaaaccagcatcaccattcttcaaaaacttgggctccttctcaagctccttgccagaacgtctgtcaatcttggtcagaatctcaccgaacttgacagcaatgtgagaggtgtggcaatcaagcacaggagcataaccgtttccaatctggccagggtgattcatgatgatgacctgggcggtgaagttggctgcctccttggcaggatcatccttggagtttgaagcaacatacccacgcttgagatccttgactgcaacgttcttgacgttgaaaccaacattgtcaccaggaagagcctcctggagagcctcgtggtgcatctccacagacttaacttcagtggtcaatccagtgggagcgaaagtcacaaccataccaggcttgataataccagtctcaacacgtccaacaggaacagttccaatacctccaatcttgtagacatcctgaagtggtagtcggaggggcttgtcagagggcctcttaggctcgttgatcatgtcaagggcctcaagaagggttggacccttgtaccaatcaaggttggtggacctctcaatcatgttgtcaccctcaaaaccagagatgggaacaaaaggaattttgtctgggttgtatccaatcttcttcagctaaatactcaattacaatataaatacatcaatggaagatcaagcctcagaatgacccaaaaatgtaccttgttgcagcagcagatcatttgcctaacaccaagggtgaaagcaaggagagcatgctcacgagtctgaccatccttcgagataccagcctcaaaacctccagtggtggagtcaataatgaggacagcacaatcagcctgggaagttccagtaatcatgttcttgatgaagtcacgatgtccaggagcatcaatgacagtgcagtagtacttggtggtctcaaacttccagagagcaatatcaatagtaatacccctctcacgctcagccttgagcttgtcaagcacccaagcatacttgaaagaacgcttgttcatctcagcagcctccttctcaaacctctcaatgacacgcttgtcaatacccccaagcttgtagatcaaatgaccagtggtggtcgacttcccagagtcaacatggccaatgaccacaatgttgatgtgaaacttttccttgcccatagttgaa

SEQ ID NO: 1343 - DNA, 1305 bp, Pennisetum glaucum
cttttagccatgggtaaggagaagagtcacattaacattgtggtcattggccatgtcgactctggcaagtcgaccaccactggccacctgatctacaagcttggaggtattgacaagcgtgtgatcgagaggttcgagaaggaggccgcagaaatgaacaagaggtccttcaagtacgcgtgggtgctcgacaagctgaaggctgagcgtgagagaggtatcaccatcgacattgccctgtggaagtttgagaccaccaagtactactgcacggtcatcgatgcccctggtcaccgtgacttcatcaagaacatgattaccggtacctcccaggccgactgtgctgtcctcatcattgactccaccactggtggttttgaggctggtatctctaaggatggccagacccgtgagcatgctctccttgctttcactcttggagtgaagcaaatgatctgctgctgtaacaagatggatgccaccactcccaagtactccaaggcccgttatgatgagattgttaaggaagtctcctcgtacctcaagaaggtgggttacaacccagacaagattgccttcgtccccatctccggtttcgagggtgacaacatgattgagaggtccaccaaccttgactggtacaagggcccaaccctgcttgaggctctggaccagatcaacgagcccagaggccctccgacaagcccctgcgtctccccttcaggatgtgtacagatcggtggtattggaaacgtccctgttggccgtgttgagactagtgtgatcaagcctggtatggttgtcacctttggtccaactggcctgactactgaggttaagtctgttgagatgcaccacgaggctctccaggaggcccttcccggtgacaatgttgggttcaacgtgaagaatgttgctgtggaggatctcaagcgtgtttatgtggcctccaactccaaggatgaccctgccaaggaggctgccagcttcacctcccaggtcatcatcatgaaccaccctgggcagatcggcaatggctatgccccagtgctcgactgccacacctcccacattgctgtcaagtttgctgagcttgtcaccaagatcgacagacgatctggtaaggagcttgagaaggagcccaaattcctgaagaatggtgatgctggtatggtgaagatgattcccacgaagcccatggttgttgagacattctctgagtaccctcctcttggtcgctttgctgttcgtgacatgaggcagacggttgctgttggcgtcatcaagagcgtggagaagaaggac

SEQ ID NO: 1344 - DNA, 1587 bp, Cicer arietinum
tctgcggctgaggattccgaacgagtcttagatttcatttcttctttgctaagatatcatgggtaaagaaaagtttcatatcaacattgtcgtcattggacatgtcgactctggaaaatcaaccaccactggtcacttgatctacaagcttggaggtattgacaagcgtgtcattgagaggttcgagaaggaggctgctgagatgaacaaacgttcattcaagtacgcctgggtgctcgacaagcttaaggctgagcgtgaaagaggtattaccatcgatattgccttgtggaaattcgagaccaccaagtactactgcacagtcatcgatcgcccccggacatcgtgatttcattaagaacatgattactggtacctcccaagctgattgtgctgtccttatctattgacctccacctacgtggttggttttgaggtctggtatctctaaggatggacagacccgtgagcacgccttctttagcttttcactcttggagtgaaacagatgatctgttctttgtaacaagatggatgccactacacccaagtactcaaaaggccaggtacgatgaaatcgtgaaggaagtttcttcatacttgaagaaggttggttacaaccctgacaaaaatccccttcgtttccaatcttctggatttgagggagacaacatgattgagaggtccacaaccttgactggtacaagggaccaactctccttgaggctcttgaccagatcaacgagcccaagagacctcagacaagccctcaggcttccattgcaagatgtttacaagatcggtggtattggaactgtgccagtcggacgtgttgagactggagtcatcaagcctggtgtgatcgttacctttggccctaccggtctggacaaacttgaagttaaagtcccgtttgaggaattgcaccacgagggctctcacccgaaaggctcttcccccggagaccaacgtttggattccaacgtttaagaatgttgcagttcaagggatctcaagcgtggtttcgttgcatccaactccaaggatgaccctgctaaggaagctgccaacttcacttcccaagtcatcatcatgaaccatccaggacagattggaaacggttatgccccagtcctcgactgtcacacctcccacattgctgttaagttcgctgagcttctcaccaagattgacagacgatctggtaaggaactcgagaaggagcctaagtttttgaagaatggtgatgctggtcttgttaagatgattccaacaaaagcctatggttgtggaaactttctccgagtatccaccacttggtcgttttgctgtgagggacatgcgtcaaactgttgctgtcggtgtcattaagagtgttgagaagaaggatccaactggagccaagatcaccaaggctgcagtcaagaagaagtgagtttgcacatcatcatcaccatggttgctgctgaagttgttcctttatagtagtttatctttccggagtcttagtttaattttgcagtttattttgcaagtctttgccggtttcattcagccaaacttacaaaactgggttcttgatcggcg

SEQ ID NO: 1345 - DNA, 1465 bp, Flaveria ramosissima
gcggcgaagtagatcattaacaaagatatcttagaatgggtaaagaaaatactcacatgagcattgtggttattggccatgtcgactctggcaagtcaaccactactggtcaccttatttacaagcttggaggtattgacaagcgtgttattgagagatttgagaaagaagctgctgaaatgaacaagaggtcattcaaatacgcatgggttcttgacaaactaaaggctgagcgtgaacgtggtatcaccattgatattgctttgtggaagtttgagaccaccaagtactactgtactgttattgatgctcctggacatcgtgatttcattaagaacatgattactggtacctctcaggctgattgtgctgttctgatcattgactcaaccactggtggttttgaagctggtatttccaaagatggtcagacacgtgaacatgctttgcttgccttcacccttggtgtgaagcaaatgatctgctgctgtaacaagatggatgccactacccccaagtactctaaggcaaggtatgatgaaattgtcaaggaagtctcatcctacctgaagaaggttggctacaaccctgacaaaattccatttgtacccatttctggatttgagggtgacaacatgattgagaggtcaacaaaccttgactggtacaagggtccaactcttctggaagctcttgaccagattaacgaacctaaaagaccatctgacaagccacttcgtcttccacttcaagacgtgtacaagattggtggtattggaactgtgcctgtcggacgtgttgaaactggtgtcatcaaacctggtatggttgtcacttttggtccatctgggttgaccactgaagttaagtcagttgagatgcaccacgaggcactgactgaagctctccctggtgacaacgttgggttcaatgtcaagaatgttgctgtcaaggatctgaagcgtggttatgttgcatccaactcaaaggatgaccctgctaagggtgcagccagtttcacctcacaggtcatcatcatgaaccaccctggtcagattggaaacggttatgccccagttctggattgccacacctctcacattgcagtcaagttttctgagcttttgaccaaaatcgacagacggtctggtaaagagctggaaaaggagcccaaatttttgaagaatggtgatgccgggatggttaagatgcttcccactaagcccatggttgttgagacttttgctgagtacccaccacttggtcggtttgctgttcgtgacatgcgtcagactgttgctgttggtgtgatcaagagcgtggagaagaaggacccaactggagctaaggtgaccaaggctgcagtcaagaaggagctaaatgatgggttgagcgttttgtatcgaatgttgatggagcttttatcgtattttggaactatctctattatgtttattttggttaa

SEQ ID NO: 1346 - DNA, 1266 bp, Pennisetum glaucum
attgacaagcgtgtgatcgagaggttcgagaaggaggccgcagaaatgaacaagaggtccttcaaagtacgcgtgggtgcttgacaagctgaaggctgagcgtgagagaggtatcaccatcgacattgccctgtggaagttcgagaccaccaagtactactgcactgttatcgatgcccctggtcaccgtgacttcatcaagaacatgattaccggcacctcccaggccgactgtgctgtcctcatcattgactctaccactggtggttttgaggctggtatctctaaggatggccagacccgtgagcatgctctccttgctttcactcttggagtgaagcagatgatctgctgctgcaacaagatggatgccaccactcccaagtactccaaggcccgttatgatgagattgttaaggaagtctcctcgtacctcaagaaggtgggttacaacccagacaagattgccttcgtccccatctctggtttcgagggtgacaacatgattgagaggtccaccaaccttgactggtacaagggcccaaccctgcttgaggctcttgaccagatcaacgagcccaagaggccttccgacaagcccctgcgtctcccccttcaggacgtgtacaagatcggtggtattggaactgtccctgttggccgtgttgagactggtgtgatcaagcctggtatggttgtcacctttggtccaactggcctgactactgaggttaagtctgttgagatgcaccacgaggctctccaggaggcccttcctggtgacaatgttggtttcaatgtgaagaacgttgctgtgaaggatctcaagcgtggttatgtggcctccaactccaaggatgaccctgccaaggaggctgccagcttcacctcccaggtcatcatcatgaaccaccctgggcagatcggcaatggctatgccccagtgctggactgccacacctcccacattgctgtcaagtttgctgagcttgtcaccaagatcgacaggcggtctggtaaggagctcgagaaggagcccaagtttctgaagaacggtgatgctggtatggtgaagatgattcccacgaagcccatggttgtggagacattctctgagtaccctcctcttggtcgctttgctgttcgtgacatgaggcagacggttgctgttggtgtcatcaagagcgtggagaagaaggatcccaccggtgccaaggttaccaaggctgctgccaagaagaaatgagaggtctgagggttgttatc

SEQ ID NO: 1347 - DNA, 1655 bp, Brassica juncea
gccgcaagtcctcctctcagattcttacttgcagctatgggtaaagagaagtttcacatcaacattgtggttcattggccatgtcgactctggaaaatcgaccaccactggtcacttgatctacaagcttggtggtatcgacaagcgtgtgatcgagaggttcgagaaggaagctgctgagatgaacaagaggtctttcaagtatgcgtgggtgttggacaaattgaaggctgagcgtgagcgtggtatcaccattgatattgctctctggaagttcgagaccactaagtactactgcacagtcattgatgctcctggacatcgtgatttcatcaagaacatgattactggtacctcccaggctgattgtgctgtcttgatcattgattccaccactggtggtttcgaagctggtatctccaaggatggtcagacacgtgagcatgctcttcttgctttcactcttggtgtcaagcagatgatttgctgctgtaacaagatggatgccaccacccccaagtactctaaggctaggtacgatgagattatcaaggaggtgtcttcttacttgaagaaggttggatacaaccctgacaaaatcccatttgtccccatctctgggttcgagggtgacaacatgattgagaggtctaccaaccttgactggtacaagggaccaactctccttgaggctcttgaccagatcaacgagcccaagaggccatcagacaagcccctccgtctgccacttcaggatgtctacaagattggtggtattggaacggtgccagtgggtcgtgttgagactggtatgcttaagcctggtatggttgtgacctttgctccctcagggttgaccactgaggtcaagtccgtcgagatgcaccacgagtctcttgtggaggctcttccaggtgacaatgtgggattcaatgttaagaatgttgctgtcaaggatctcaagcgtgggtatgttgcatccaactccaaggatgaccctgccaagggtgctgccaatttcacttcccaggtcatcatcatgaaccaccctggtcagattggtaacggttacgctccagttctcgattgccacacttcccacattgctgtcaagttctctgagatcctcaccaagattgacaggcgttctggtaaagagattgagaaggagcccaagttcttgaagaatggtgacgctggtatggtgaagatgactccaaccaagcccatggttgttgagaccttctctgagtacccacctcttggacgtttcgctgtgagggacatgaggcagactgttgcagtcggtgtcattaagagcgttgacaagaaagacccaaccggagccaaggtgaccaaggctgccgtcaagaagggtgccaagtaaagtacgttgagggaaattctatcatccgcagttgaatcaaaagacggttttagttttttactttagtttggtatttggtcgcatgtttgtgttgcagctttgtttcgtctccgtcagagctctgttctcgtaactgggttcttgatcggaggtggcgaagctactcagcactctagcttccttttctttattttactatcttttgctttcggattctgaactattttggatactcttttataatgaatatgatgtcattccggcggtt

SEQ ID NO: 1348 - DNA, 1570 bp, Secale cereale
cttggaggtatcgacaagcgtgtgatcgagaggtttgagaaggaagccgctgagatgaacaagaggtcgttcaagtacgcctgggtgcttgacaagctgaaggctgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcccaagtactcgaaggcccgttatgaggaaattgtcaaggaagtctcttcgtacctgaagaaggtcggctacaaccctgacaaggttcccttcgtccccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggatgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgttggcttcaacgtcaagaatgttgctgtgaaggatctgaagcgtgggtttgttgcatccaactccaaggatgaccctgccaaggaggcagccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgacgctggtatcgtgaagatgattcccaccaagcccatggttgtggagaccttcgccacctaccctcctcttggccgcttcgctgtgcgtgacatgagacaaacagttgctgttggtgtcatcaagggcgtggagaagaaggaccccaccggtgccaaggttaccaaggccgccatcaagaagaaataggcttctatctagcagaaggtttttgttcatggtcattgctttcgttgcttcagactcttatcccgggcgagcaatgatcctgtctgtcgtttaattactgtatttctattcctgcgtaaactcctgtgccctgagactgatttgttgtgaaatgcaagctattagattgcaacttatgtcacacttgtttctctaactattcggttttctttttcttcgaagaaaaagaaaaaaaaaaaaaaaacaaaaaaaaaaaataaaaaaaaaaaagaaaaaacaaaaataagatagactagaactctagatacactactac

SEQ ID NO: 1349 - DNA, 1409 bp, Secale cereale
ccgctgagatgaacaagaggtcgttcaagtatgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcatgccctcctcgctttcactcttggagtgaagcagatgatctgctgctgcaacaagatggatgccaccactcccaagtactcgaaggcccgttatgaggaaattgtcaaggaagtctcttcgtacctgaagaaggtcggctacaaccctgacaaggttccctttgtccccatctctgggtttgagggtgacaacatgatcgagaggtccaccaaccttgactggtacaagggccctaccctgcttgaggcgcttgaccagatcaatgagcccaagaggccctcagacaagcccctgcgtcttccccttcaggatgtttacaagattggtggcattggaactgtgcctgttggccgtgttgagactggtgtcatcaagcctggtatggttgttacctttggtcccactggtctgacaactgaggtcaagtctgttgagatgcaccatgagtctctcctggaggcgcttcctggtgacaacgttggcttcaacgtcaagaatgttgctgtgaaggatctgaagcgtgggtttgttgcatccaactccaaggatgaccctgccaaggaggcagccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgacgctggtatcgtgaagatgattcccaccaagcccatggttgtggagaccttcgccacctaccctcctcttggccgctttgctgtgcgtgacatgagacaaacggttgctgttggtgtcatcaagggcgtggagaagaaggatcccaccggtgccaaggttaccaaggccgccatcaagaagaaatgagtgctctggtctcagccatcgagttatctagcagaagttttagtgtcaagtcttttttggagaatcttagtgtatgttaagtgttgttcctgggcgttgttgcactttgactcctgcacttgtgtgcgagctatgatgtgtcgtttgaatactctattccgattccattattgtgctcttatcccatttgtggttttgtct

SEQ ID NO: 1350 - DNA, 1314 bp, Pennisetum glaucum
ctctctccctcccccgcagccgccgttcccacgcatcctcttctccgccgctccgcgagattaagctttgcttttagccatgggaaaggagaagagtcacattaacatcgtggtgattggccatgtcgactctggcaagtcgaccaccactggccacctgatctacaagcttggaggtattgacaagcgtgtgatcgagaggttcgagaaggaggccgcagaaatgaacaagaggtccttcaagtatgcgtgggtgcttgacaagctgaaggctgagcgtgaaagaggtatcaccatcgacattgccctgtggaagttcgagaccaccaagtactactgcacggtcatcgatgcccctggtcaccgtgacttcatcaagaacatgattaccggcacctcccaggctgactgcgctgtcctcatcattgactctaccactggtggttttgaggctggtatctctaaggatggccagacccgtgagcatgctctgcttgctttcactcttggagtgaagcagatgatctgctgctgtaacaagatggatgccaccactcccaagtactccaaggcccgttatgatgagattgttaaggaagtctcctcgtacctcaagaaggtgggttacaacccagacaagattgccttcgtccccatctctggtttcgagggtgacaacatgattgagaggtccaccaaccttgactggtacaagggcccaaccctgcttgaggctcttgaccagatcaacgagcccaagaggccttccgacaagcccctgcgtctcccccttcaggatgtgtacaagatcggtggtattggaactgtccctgttggccgtgttgagactggtgtaatcaagcctggtatggttgtcacctttggtccaactggcctgactactgaggttaagtctgttgagatgcaccacgaggctctccaggaggcccttcccggttgacaatgttgggttcaacgtgaagaatgttgctgtgaaggatctcaagcgtgggtacgtggcgtccaactccaaggacgaccctgccaaggaggctgccagcttcacctcccaggttatcatcatgaaccaccctgggcagattggcaacgggtatgcgccagtgttggactgccacacctcccacatcgctgtcaagtttgctgagcttgtcaccaagattgacagacgatctggtaaggagcttgagaaggagcccaaattcctgaagaatggtgatgctggtatggtgaagatgattcccacgaagcccatggttgtggagacattctctgagtaccctcctcttggtcgct

SEQ ID NO: 1351 - DNA, 1474 bp, Brassica napus
ggtcacttgatctacaagcttggtggtattgacaagcgtgtcatcgagaggttcgagaaggaggctgctgagatgaacaagaggtccttcaagtacgcatgggtcttggacaaacttaaggctgagcgtgagcgtggtatcaccattgacattgctctctggaagttcgagaccaccaagtactactgcactgtcattgatgcccctggacatcgtgatttcatcaagaacatgattactggtacctcccaggctgattgtgctgttcttatcattgactctaccactggtggttttgaagctggtatctccaaggatggtcagacccgtgagcatgctcttcttgccttcacccttggtgtcaagcaaatgatttgctgctgtaacaagatggatgccactacccccaagtactccaaggctaggtacgatgagatcatcaaggaggtgtcttcctacttgaagaaggtcgggtacaaccctgacaaaatcccattcgtccccatctctggattcgagggtgacaacatgattgagaggtccaccaaccttgactggtacaagggaccaactctccttgaggctcttgaccagatcaacgagccaaagaggccttcagacaagcccctgcgtctaccacttcaggatgtctacaagatcggtggtattggaacggtgccagtgggtcgtgtggagactggtatgctcaagcccggtatggttgtgacattcgctccttcagggttgaccactgaggtcaagtccgttgagatgcaccacgagtctcttgttgaagcgcttccaggtgacaacgtgggtttcaatgttaagaatgttgccgtcaaggatcttaagcgtgggtatgttgcatccaactccaaggatgaccctgccaagggagctgctaacttcacttcccaagtcatcatcatgaaccaccctggtcagatcggtaacggttacgcccctgtccttgattgccacacctcccacattgcagtcaagttctctgagatcctcaccaagattgacagacgatctggtaaagagatcgagaaggagcctaagtttttgaagaatggagatgctggtatggtgaagatgactccaaccaagcccatggttgttgagactttctcagagtacccacctttgggacgtttcgctgttagggacatgaggcagaccgtggctgttggtgtcatcaagagtgttgacaagaaggacccaaccggtgccaaggtcaccaaggctgcagtcaagaagggtgccaaatgatgagacttatctcttgcttggttcactttgctttaaaaaactttgatgtgtttgaggctttttttttttttacaactctcatctctctacctttttttgatatctctgttacttatggttttagttatgcattttctggataattttgccaatgctttttagtgttcattgaatgtttattgaagttgcttgtcct

SEQ ID NO: 1352 - DNA, 1578 bp, Curcuma longa
aagctgggtggtattgataagcgtgttattgagagattcgagaaggaagcagctgagatgaacaagcgttcatttaagtatgcctgggtgcttgacaagctgaaagctgagagagagcgtggtatcaccattgatatttctctgtggaaatttgagaaacaaagtactactgcacggttattgatgccccaggccatcgtgatttcatcaagaacatgattactggaacatctcaggctgactgtgctgttctcatcattgattcgacaactggtggttttgaggctggtatttcaaaggatgggcagactcgtgaacatgcactccttgctttcactcttggcgtcaagcaaatgatttgttgctgcaacaagatggatgctactactccaaagtactcaaaggcacgatatgatgaaattgtaaaggaagtttcttcttacttgaagaaagttggatacaaccctgacaagactcctttcgttccaatctctggttttgagggggataacatgattgagagatccacaaatcttgactggtacaagggcccaacacttcttgaagcccttgacttgatcaatgagccaaagcgtccaacagacaagcccctccgtcttcctttgcaggatgtttacaagattggtggcattggaactgtccctgttggtcgggttgagactggaatcttgaagcctggtattgttgtgacttttggtcctacaggactgacaactgaagtcaagtctgtggagatgcaccatgaggccctccaggaggctctcccaggtgataatgtgggcttcaacgtaaagaatgttgctgttaaggatctaaagcgaggttttgttgcctcaaactccaaggatgatcctgcaaaggaggctgccaatttcatctcgcaagtcatcatcatgaaccaccctggtcagattggcaacggttatgctcctgtcttggattgccacacatctcatattgctgtcaaatttgcggaattgcttaccaagattgacaggcgatctggcaaggagcttgagaaggagcccaagttcctcaagaatggtgatgcaggtttagttaagatgattcccaccaagccaatggtggtggaaacattctctgagtatccacctcttggtaggtttgccgtcagggacatgaggcagactgtagcagtcggtgttatcaagagcgtggagaagaaggatccaactggtgccaagatcaccaaagctgcccagaagaagaaatgaactgaggattgcaagtcagggttgtctggagtcgtcgttagctgttgtgttgtccgtctgtttcattgcctttacaagttcgcgtgtatgttatctggagtctggatgcagaactgggtgctcgacaggcgatggcaggctttaaggtctatttatgttttccatagtaaaaaccattcggatttttacaagtctatgtgctgttgagtgccctctgttgttacttgtattgtattaaactgtactggtcgtagtgcctgcatgagtaaatatgtatttatatatgcttattgttaatctgttatattgtctcaaaaaaaga

SEQ ID NO: 1353 - DNA, 1556 bp, Secale cereale
caagcgtgtgatcgagaggttcgagaaggaagccgctgagatgacaagaggtcgttcaagtacgcctgggtgcttgacaagctcaaggctgagcgtgagagaggtatcaccattgatattgctctgtggaagttcgagaccaccaagtactcctgcaccgtcattgatgctcctggtcaccgtgatttcatcaagaacatgatcactggtacctcccaggctgattgtgctgtgcttatcattgactccaccactggtggttttgaggctggtatctccaaggatggccagacccgtgagcatgctctccttgctttcactcttggtgtgaagcagatgatctgctgctgcaacaagatggacgccaccactcccaagtactcaaagtcccgttatgaagaaattgttaaggaagtctcttcatacctgaagaaggtcggttacaaccctgacaaggttcccttcgtccccatctctgggttcgagggtgacaacatgattgagaggtccaccaaccttgactggtacaagggccccacccttcttgaggcccttgaccagatcaatgagcccaagaggccctcagacaagcccctccgccttccccttcaggatgtctacaagattggtggcattggaactgtgccagtggggcgtgttgagactggtgtcatcaagccaggcatggttgtcacctttggccctactggcctgaccactgaggtgaagtctgtggagatgcaccacgagtctctcctggaggcgcttcctggtgacaatgtcggcttcaacgtcaagaacgtggctgtcaaggatctcaagcgtgggtatgttgcctccaactctaaggacgaccccgccaaggaggctgccaacttcactgcccaggtcatcatcatgaaccaccccggccagatcagcaatggctacgccccagtgctggactgccacacgtgccacatcgccgtcaagtttgctgagatccagaccaagatcgacaggcggtccggcaaggagctggaggctgcgcccaagttcctcaagaacggtgacgccgggttcgtcaagatgatccccaccaagcccatggtggtggagacctttgcccagtacccctcccctcgggccgctttgctgtgcgcgacatgaggcagacggttgctgtgggtgtggatcaagagcgtggagaagaaggagccgaccggtgccaaggtgaccaaggctgcgatcaagaagaaaatgagatggtgtctggcagtgctgttgttggcgggtggtggtgacggtatacggcggttgcggttgcggtagtcgtcttagtcgattcaaaaactctttaagctttggttatttgtgtcgagcagtgttggaactgcttttttcttctgctcgttgtatcatttagttgtgttggtgaaacttcgtcagttaaaattaaatgttgctatctactatagtcgtcttgtttggagtcattttatatctgttgccttcatgtttttgtcttgcatagttgattttgcataactacgtgagcagtggattttttcccagtc

SEQ ID NO: 1354 - DNA, 1762 bp, Nicotiana tabacum
ttcacatcaacattgtggtcattggccacgtcgactctggtaagtcgactaccactggtcacttgatctaccttggtggtattgacaagcgtgtcattgagaggtttgagaaagaagctgctgagatgcacaagcggtcattcaagtatgcctgggtgcttgacaaactaaaggctgagcgtgaccggggtatcactattgatatcgccttgtggaagtttgagaccaccaagtactactgcactgtgattgatcgtcctggacacagggatttcatcaagaatatgattactggtacctcccgtgcctgtcgtgtcctgattgttgcctccaccactggctttgcacaagctggtaatctcaaggatggacagacccgtgaaagactgcttattgactccaccactggtaacacccttggtgtcacccaaatgatttgctgctgcaacaagatggatgctaccacccccaagtattccaaggctaggtacgatgaaatcgtgaaggaggtttcttcctacctcaagaaggtaggatacaaccctgacaagatcccctttgtccccatctctggttttgaaggtgacaacatgatcgaaagatcaacaaaccttgactggtacaagggcccaacacttcttgatgctcttgaccagattaatgagcccaagaggcccacagacaagcctctcaggctcccacttcaggatgtttacaagattggtggaattggtactgtccctgttggtcgtgtggaaactggtgtcctcaagcctggtatggttgttacttttggtcccactggtctgaccactgaagttaaatctgttgagatgcaccacgaagctcttcaggaggcacttcctggtgacaatgttggatttaatgtcaagaatgttgcggttaaggatctcaagcgtgggtttgttgcttccaactccaaggatgacccagctaagggtgcttccagctttacctcccaagtcatcatcatgaaccatccaggacagattggaaatggatatgctccagttcttgactgccacacctcccacattgctgtcaagtttgcagaaattttgaccaagattgacaggcgttctggtaaggagattgagaaggagcccaagttcttgaagaatggtgatgccggtatggttaagatgattcccaccaagcccatggttgttgagaccttctctgagtacccaccattgggacgttttgctgtgagggacatgcgtcaaactgttgctgttggtgttatcaagaacgttgacaagaaggacccaactggtgctaaggtcaccaaggctgctcagaagaagaaatgaacgttgcagttcaattctggtgttactcgtgatatctactacaataaagtgtgttttggagacattgttttctctgcttgtggtgtttttgtacggtctttaatgtggttcttaggttcttgttttctgctgtgtatgtctggaaccagctctcagagctgggtgcttgacaggcggtggcgaggaaaactttgttggctgtctgtattttcttttgaggtaccttggttatccaaggtggctcggaagttttgtttgttatgttgcttaagatactgaattcgaacttatttttgtgttgaatatgtttttctattccttttttctggtagttgtatacctatagctttaaaggaccttgctttctccatgatcttggtttatactacttgttaccttagtgtgtgtttgtaatttcaacctctgct

SEQ ID NO: 1355 - DNA, 1685 bp, Brassica napus
cagtcctacgacggtacgttttacggttttcggttacgccgacaagacctccctctcagtatttcctttacgtttcgcacgactagtggtaaagagaagtttcacatcaacattgtggtcattggccatgtcgactctggcaaatcgactacaactggtcacttgatctacaagcttggtggtattgacaagcgtgtcatcgagaggttcgagaaggaggctgctgagatgaacaagaggtccttcaagtacgcgtgggtcttggacaaacttaaggctgagcgtgagcgtggtatcaccattgacattgctctctggaagttcgagaccaccaagtactactgcactgtcattgatgcccctggacatcgtgatttcatcaagaacatgattactggtacctcccaggctgattgtgctgttcttatcattgactctaccactggtggttttgaagctggtatctccaaggatggtcagacccgtgagcatgctcttcttgccttcacccttggtgtcaagcaaatgatttgctgctgtaacaagatggatgccactacccccaagtactccaaggctaggtacgatgagatcatcaaggaggtgtcttcctacttgaagaaggttgggtacaaccctgacaaaatcccattcgtccccatctctggattcgagggtgacaacatgattgagaggtccaccaaccttgactggtacaagggaccaactctccttgaggctcttgaccagatcaacgagccaaagaggccttcagacaagcccttgcgtctaccacttcaggatgtctacaagatcggtggtattggaacggtgccagtgggtcgtgtggagactggtatgctcaagcccggtatggttgtgacattcgctccttcagggttaaccactgaggtcaagtccgttgagatgcaccacgagtctcttgttgaagcgcttccaggtgacaacgtgggtttcaatgttaagaatgttgccgtcaaggatcttaagcgtgggtatgttgcatccaactccaaggatgaccctgccaagggagctgctaacttcacttcccaggtcatcatcatgaaccaccctggtcagatcggtaacggttacgcaccagtgcttgattgccacacctcccacattgcagtcaagttctctgagatcctcaccaagattgacagacgatctggtaaagagatcgagaaggagcccaagtttttgaagaatggagatgctggtatggtgaagatgactccgaccaagcccatggttgtcgagacgttctcagagtacccaccattgggacgtttcgctgttagggacatgaggcagactgttgctgttggtgtcatcaagagcgttgacaagaaggacccaaccggtgccaaggtcaccaaggctgcagtcaagaagggtgctaaatgatgagacttctctattacttttaaaaaaactttgatggcgtttgagcctttttttatattttctgcgacattgtttcaattatgctgtttgtggatggttttggctaatgatttttagtgcttctttgttcttgaatgtccttgttagttgcttttactcatctagagtttttagaccagtctgttcaagattttgttgggaagcaacgactagaaaacgtttaaaccccttggtgttcaatattcaatttt

SEQ ID NO: 1356 - DNA, 1423 bp, Secale cereale
cctcctctcctcggctccttctccttcattcgagtttcagccatgggtaaggagaagactcacatcaacatcgtggtcattggccatgtcgactctggcaagtcgaccaccactggccatctgatctacaagcttggaggtatcgacaagcgtgtgatcgagaggttcgagaaggaagccgctgagatgaacaagaggtcgttcaagtacgcctgggtgcttgacaagctgaaggccgagcgtgagaggggtatcacaattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcccaagtactcgaaggcccgttatgaggaaattgtcaaggaagtctcttcgtacctgaagaaggtcggctacaaccctgacaaggtccccttcgtccccatctctgggtttgagggtgacaacatgattgagaggtccaccaaccttgactggtacaagggccctaccctgcttgaggcgcttgaccagatcaacgagcccaagaggccctcagacaagcccctgcgtcttccccttcaggatgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgttggcttcaacgtcaagaatgttgctgtgaaggatctgaagcgtgggtttgttgcatccaactccaaggatgaccctgccaaggaggccgccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgatgctggtatcgtgaagatgacttcccaccacgcccatggttgtggagaccttcgccacctaccctcctcttggccgcttcgctgtgcgtgacatgagacaaacagttgctgttggtgtcatcaagggcgtggagaagaaggaccccaccggtgccaaggttaccaaggccgccatcaagaagaaataggcttctatctagcagaaggtttttttcatggtcatt

SEQ ID NO: 1357 - DNA, 1792 bp, Solanum phureja
gtgattcccttctctctgctgtgccgcaatatcctaaattctgttctctaagtctttaagtaactcaagatgggtaaagagaagattcacatcagtattgtggtcattggtcatgtcgactctggtaagtcgaccacatctggtcacttgatctacaagcttggtggaattgacaagcgtgttattgagaggtttgagaaggaagctgctgagatgaacaagaggtcattcaagtatatatgcctgggtgcttgacaaacttaaggctgaacgtgagcgtggtatcactattgatattgctttgtggaagtttgagaccactaagtactactgcactgtgattgatgcccctggtcacagggacttcatcaagaacatgatcactggtacctcccaggccgactgtgctgtcctcattatcgactccaccactggtggttttgaagcagatggatgctaccacccccaagtactccaaggctaggtacgatgaaattgtgaaagaagtttcttcctacctcaagaaggttggttacaaccctgacaaaatcccatttgtccccatctccggttttgaaggagataacatgattgagaggtctaccaaccttgactggtacaagggaccaaccctccttgatgctctcgaccagattaatgagcccaagagaccaacagacaagccactccgtctcccacttcaggatgtttacaagattggtggtattggaactgtcccagttggtcgtgtagagactggtgtgatcaagcctggtatggttgtgacctttggccctactggtttgacaactgaagtcaagtctgttgagatgcaccacgaagctcttctggaggcactccctggtgacaatgttgggttcaatgttaagaatgttgctgttaaggatctgaagcgtggttttgttgcctcaaactccaaggatgacccagctaagggggcagccagtttcactgcccaggtcatcatcatgaaccatcctggccagattggaaatggatatgcaccagtgctcgactgccacacttcccacattgctgtcaagtttgctgagatcttgaccaagattgacaggcgttcaggtaaggaacttgagaaggagcctaagttcttgaagaatggtgatgctggtatggttaagatgattcccactaagcccatggttgttgagacctttgccgaatacccaccattgggtcgtttcgctgtgagagacatgaggcaaactgttgctgtcggtgttgtcaagaatgttgacaagaaggacccaactggtgccaaggtcaccaaggctgcccagaagaagggaaagtgaacagtgcagtgtgatgctagtgtttccaatgctatttattttcatcaagtgtgctatcaagactctgttttgtttacttctgctatagtgtctttgatttgctttttaggctcttgttttctgccttgtatgtcatgtaaccattctcagaactgggtacttgacaggcggtggcgagcatgatttggagtctgttttcattctgttgaggtgccttggttttccaggtgcctcaggatatttgcttttggtgttgcgtaagttatattttatgagcttttaaatttttctacttgttcctgtttgttgaagatttggagttataatgctgctggggaatcagttcagctttagaattagttgtggttgttcctccttatcatacttgataggttatctgagaattcaaatgttcttttcttaaccttgttgattggtgtttttgttgtatgagggag

SEQ ID NO: 1358 - DNA, 1871 bp, Gossypium hirsutum
ccacaaaacagttgaaatatctctctcttcactttcttctcttttcaacgcagggtgaaaggcggggaggccgtagacaatctctcttgcgctcttctcgtagaatggatcagattcaacatccaactgtcatgcagaaggtagctggccagctcctttcttctagcatttcccgagattttcaagggtatgatgggtctttcaggaggcctgccctataccaaggacattttgcatatgggaattattccaatgctggaatgcactatcctattgttccatcaacagctaccgccatttgtgttcaagcccctttttgtgtagcgattctcagttagtcttttctttaagcttacagcttctctccagagttttataatgggtaaggagaaggttcacatcaaccttgttgtcattggccatgtcgactctggcaagtcgaccactactggtcatttgatctacaagctaggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactttatcaagaacatgattaccggtacctcacaggctgactgtgctgttctcattattgactcaaccactggtggttttgaagctggtatctctaaagatggtcagactcgtgagcatgctttgcttgcttttaccctcggtgttaggcagatgatttgctgctgcaacaagatggatgcaacaaccccaaagtactcaaaggcaaggtttgatgaaattgtcaaggaagtctcttcttatcttaagaaagttgggtacaaccctgagaagatcccgtttgttccaatctccggttttgagggtgacaacatgattgagagatctacaaacctcgattggtacaagggtcctactctccttgaggctcttgaccagatcaccgagcccaagaggccctcagataagccacttcgtcttccacttcaggatgtctacaagattggtggtattggaactgtccctgttggtcgtgttgaaactggtgtcctcaaacccggtatggttgttacttttggtcctactggtctgaccactgaagttaagtctgttgagatgcaccatgaatccctcccggaagctttccctggtgacaatgttgggttcaacgttaagaacgttgctgttaaggatcttaaacgtggttttgttgcttcaaactccaaggatgatccggccaaggaagctgccaacttcacctctcaggttatcatcatgaaccaccctggccaaattggaaatggttatgccccagtcctcgactgccacacctctcacattgctgtcaaattttccgaactgttgaccaagattgacagacgatctggcaaggaactcgagaaggaacccaagttcttgaagaacggtgatgcaggtatggtaaagatgattcccaccaaacccatggttgttgagactttctctgaatacccaccacttggacgtttttgctgtccgtgacatgcgccagactgctgccgtcggtgtcatcaagagtgttgagaagaaggacccaactggtgctaaggtcaccaaatctgctgccaagaagaaatgagagattatttgagagagaattatatcagttttcattacagctttggacaattatcttaaatttggactttagaatttacttttttgtgagacttttttgatttgctttttaaaacaaatcctagttttatatctcaaaaaaaaaaaaa

SEQ ID NO: 1359 - DNA, 2213 bp, Ceratodon purpureus
cgccgcctccacctcgccctcttcctgcttcgccaggaactccagattattcaagatgggtaaggagaaggttcatatcaacatcgtggtcattggccatgtcgactccggaaagtcgacaaccaccggacacttgatctataagttgggtggtatcgacaagcgtgtgatcgagcgtttcgagaaggaggcggctgagatgaacaagcgttccttcaagtacgcgtgggtgttggacaagctgaaggctgagcgtgagcgtggtattaccatcgatatcgccttgtggaagttcgagacggtgaagtactactgcaccgttatcgatgcccctggacatcgtgattttatcaagaacatgattacgggaacttcgataacggtgcagtagtactgcaccgttatcgatgcccctggacatcgtgattttatcaagaacatgattacgggaacttctcaggccgattgcgctgtgctgatcatcgactcgacgaccggaggtttcgaggccggtatctcgaaggatgggcagacccgtgagcacgctttgttggctttcactttgggagtgaagcagatgatttgctgctgcaacaagatggacgcgaccacccccgaagtacagcaaggctcgtttcgaggagatcacgaaggaggtgtcctcctacctgaagaaggtgggatacaaccccgacaagatcccgtttgtgcccatctctgggttcgagggtgacaacatgattgagaggtcgtcgaacctggactggtacaagggccctactctgttggaggccttggacgccgttacggagcccaagaggccgtccgacaagcccctgcggttgccccttcaggacgtttacaagattggaggcattggaactgtgccggtgggacgtgtggagactggtgtaatcaagcccggtatgttggtgtgcttcgcccccactggactgaccactgaggtgaagtccgtggagatgcaccacgagtctatgccggaggccaccccggtgacaacgtgggattcaatgttaagaacgtggcggtgaaggacctgaagagagggttcgttgcttctgactctaagaacgaccccgcgaaggaggccgccaacttcaccgctcaggttattatcatgaaccaccccggacagatcggtaacgggtagccccggtgctggattgccacacttctcacatcgctgtgaagtttgccgagatcttgaccaaggttgacaggcgatctggtaaggagctcgagaaggagcccaagttcttgaagaacggtgacgctggtttcgtgaagatgattcccaccaagccgatgacggtggagactttcgctgagtacccacctttgggtcgtttcgccgtgcgcgacatgaggcagacggtcgctgtgggagttatcaaggctgtggagaagaaggacgcgactggtgccaaggtgaccaaggccgctgccaagaagaagtaaaaaggttgtaagaattttggggagcagttggtttggctttggttatgcccgttctgtcttcgcacttcggacctgcctgctgtgtctggattggaatttgtaatagacaagatgcatcacacatgcatgtgaattttcatcgaataaatacatttccgatctacgatttctttaatttcgaaggataactttacacactaccgaagagaacagtcgatgaaatatcattctccgacttttcaatctttatgtaggaggttttcagatccttggaggatgctcatttgaaatgtgatattttttcctagtaagccagacagaatatcagatgtatcggacttctagtggagtgatttctaactacttagaaggttttgtagtgaatgtcttgcacaaagttcttacggatttgctgtctggcctgtaaaggggggttgtttacttacaaatctctctccacacccactcactgttggcgaaaacagcggaagatcgttgatgttatactatgtgtgatcaggttatcgtcctctattcaagccttaatattttcacctcttcaaaaagttgtaagtcgattataatgtgtataggtggccgacgtatctcgcgagtgttcagtgatcatgatggagtaagaataaatgaattttttcacagtatgcgcagtcagatgggagaatgagcactgacaatttttgtcagcagcaaatgacaacttcgagggctggatg

SEQ ID NO: 1360 - DNA, 3770 bp, Pinus taeda
cgagatcggacggcgatccgaaactgcaagcgtcggccgtcggattcagcatcggacggcaaagaaggaaccctaaaacgcattgcaacgtgcttggtgggtggagggtctatggccagtatatgttgataacaagggagaggaagtagtcctcttcatctagtgcgagtctctctgcttttctacgccgctgcgaagctgttctgtggtgcttctgattctccagactcaggcagtcgtttttgtaagagaatttagtaggagaaaacccatatcaacattgtggttattggccatgtcgactccggcaagtcaacaaccactgggcatttgatctacaagcttggaggaattgacaagcgtgtgattgaacgttttgagaaggaagctgctgagatgaacaagaggtcattcaagtatgcttgggttcttgacaagctcaaggctgaacgtgaacgtggtatcacaattgatattgcactctggaagtttgagacaactaaatactactgcactgtgattgatgcccctggccatcgtgattttatcaagaacatgattactggaacatctcaggctgactgtgcagttttgatcatcgactccaccactggaggttttgaagctggtatctctgccctattggcgttcaccttgggagtgaggcaaatgatttgctgctgtaacaagatggatgccactactccgaagtactctaaggctcgttatgatgaaattgttaaggaagtatcttcttatttgaagagggttggatataacccggacaagattccttttgtgcccatctctggttttgagggtgacaatatgattgagcgttctaccaaccttgattggtacaagggtccaacactcttggaagctcttgacaacctttcagagcccaaacgtccttcagacaagcctctgaggttgcctcttcaggatgtttacaagattggtggtattgggactgtgcctgttggtcgtgtcattaaaccaggtatgattgttacctttggtcccactggtctgacaactgaagttaagtctgttgagatgcatcatgaagctcttctggaggcattgcctggtgacaatgtggggttcaacgttaagaatgttgctgttaatccaagaatgatccagcaaaggaagctgccaactttaccgcacaggttattattatgaatcatccaggacagattggaaatggttatgcccctgtgttggattgccacacttgccacattgctgtcaagtttgctgagattcagaccaaggttgacaggcgttccggcaaggagctggagaaggagcccaagttccttaagaatggagatgctggatttgttaagatgattccaaccaaacccatggttgtggaaacctttgctgagtatcctccattgggtcgttttgcagtcagggacatgcgtcagacagttgctgtaggagtcatcaaagctgttgaaaagaaggaaccaagtgcaaggcagcagccaaaaagaagtgaatgtttcagcaaagtgattgggagtggaggattgcgtgctgcatttcgtgtgcttccatgcttatctattttccagatattatgttagtagagttagttgaattgggttcttgatcggcggtggcataagttacattgttttctagtaaatactttttaatggttacattagggtaaagttgatttaagatttcgtagttgcggggaaatcatcagtttgtctgcactgctaggaaatctatgcagttggattgagagaggatgggcattaataatttctattactggtttatttaatgtttgtattcccgtccgtacatgacatttttctccggattgagaagacttggaatttatattaaagcgcagttttgagaaaattcatctcatccaataatggataagaaattggttatagtagtttgccacaactctgataagatctttcagtaccagccatttcgaggaagtaaaattaatatcaagccttctcatattatagactactgattcaaccctaatacatagaatggaacacagactatacatcaaaattttcggttctttcgaaaatggaatctaaatttaccatagtgaacacagaaggaaaatgatccatctctagcataggggaatcagttacagaagtgtgagttgaacaacctctgtgatgtcggattctgaagcttgcgatctttgtcgacaaggatccatggcttgcatcagtggagtaggtggaggcaggtaattagactcagaagtggatggcgagcaaaaaaatggagcaaagtttgggaattcaagctctcccccgaggaatgttgatgggtattcgttctgttgatgatgacgaatgaaatcagctgaaaactctttctcactgccttgtattctgtatattggatctgcaggatggcttgtgaatggaattgcactgtgtgctgatgaatccacattgggtgaataggaggggctcttcccaaagctaacttttcactgggcagacaccaccatcatttgctgctgcaaaccaaggtgcagacgagcttggaagaaagtgggtagaagggaatatagcaatattgcctggaatctgagaaatcggaaaagggagctgaagaaggcgggcatcgttttggcagctgtgtaccccactgtaagttacttcaaagacagaaggattgtcatctggtctttgcactttcttggtcgcctggcagcctaagtcatgtttgtgggtacatctgtaatagctccgaggatgctgagctccaagaatgtctttctggccatatttgcgccaagtgtacccgtcctctggtgggacatcgttgcctggttcggaactattagcaggcataattttagtccatttgggtagtgatttccttttcctggagactcctcgcttgtccttgctgcttgcgcgttcgttctctgtggtgtctgcggggtcattgcgcttgaacttacccggagtagccaaacttcggacaggggatccatcagacatgtcgctaggtggactgccactcaaggaggatctacctccagaccgaggtgaagagtttctgttatctttaacagatttcttctgagaatgccccacttccagacctccaagctgcttctccagaagaacttcaactctcttgccaattatcaagacaactgggactggaatttgacctgagcatttccaaggcatggccgaaggtgctcactatctcaaccgaggaagcccagagaagctcatacaaatcaggaccttgggcagaattgagtttggtctccaactctctggccatttgacatccatggttcacttccttgagacactcgtccaaatcctgcgcatccctcgagtctgccattttctatccgttagtcctaattcccgctgtaacagagatttgggcttttcgaattggcaaattggggaaattcgttctctacattctccagttgcagacagttggaggaattcagcttgggagtgggatgagaggttacaaattgttgtgatagggcaaagaaagggaatgcatatatatacaagagtggaatttaaaagcagccttgactggatcaaacaatcaaggagggccacaagacagaatactcggcgaagctttgaccgccattgattcataggaatgggaactcgggaggaggtccaacggtccaaccgaggactgaccgagcaaggggtgggagcttccaagctttgaaaagtcagagcccccggccgttg

SEQ ID NO: 1361 - DNA, 1794 bp, Pinus taeda
ggagggtctatggccagtatatgttgataacaagggagaggaagtagtcctcttcatctagtgcgagtctctctgcttttctacgccgctgcgaagctgttctgtggtgcttctgattctccagactcaggcagtcgtttttgtaagagaatttagtaggagaaaacccatatcaacattgtggttattggccatgtcgactccggcaagtcaacaaccactgggcatttgatctacaagcttggaggaattgacaagcgtgtgattgaacgttttgagaaggaagctgctgagatgaacaagaggtcattcaagtatgcttgggttcttgacaagctcaaggctgaacgtgaacgtggtatcacaattgatattgcactctggaagtttgagacaactaaatactactgcactgtgattgatgcccctggccatcgtgattttatcaagaacatgattactggaacatctcaggctgactgtgcagttttgatcatcgactccaccactggaggttttgaagctggtatctctgccctattggcgttcaccttgggagtgaggcaaatgatttgctgctgtaacaagatggatgccactactccgaagtactctaaggctcgttatgatgaaattgttaaggaagtatcttcttatttgaagagggttggatataacccggacaagattccttttgtgcccatctctggttttgagggtgacaatatgattgagcgttctaccaaccttgattggtacaagggtccaacactcttggaagctcttgacaacctttcagagcccaaacgtccttcagacaagcctctgaggttgcctcttcaggatgtttacaagattggtggtattgggactgtgcctgttggtcgtgttattaaaccaggtatgattgttacctttggtcctactggtctgacaactgaagttaagtctgttgagatgcatcatgaagctcttcttgaggcattgcctggtgacaatgtggggttcaacgttaagaatgttgctgttaatccaagaatgatccagcaaaggaagctgccaactttaccgcacaggttattattatgaatcatccaggacagattggaaatggttatgcccctgtgttggattgccacacttgccacattgctgtcaagtttgctgagattcagaccaaggttgacaggcgttccggcaaggagctggagaaggagcccaagttccttaagaatggagatgctggatttgttaagatgattccaaccaaacccatggttgtggaaacctttgctgagtatcctccattgggtcgttttgcagtcagggacatgcgtcagacagttgctgtaggagtcatcaaagctgttgaaaagaaggaaccaagtgcaaggcagcagccaaaaagaagtgaatgtttcagcaaagtgattgggagtggaggattgcgtgctgcatttcgtgtgcttccatgcttatctattttccagatattatgttagtagagttagttgaattgggttcttgatcggcggtggcataagttacattgttttctagtaaatactttttaatggttacattagggtaaagttgatttaagatttcgtagttgcggggaaatcatcagtttgtctgcactgctaggaaatctatgcagttggattgagagaggatgggcattaataatttctattactggtttatttaatgtttgtattcccgtccgtacatgacatttttctccggattgagaagacttggaatttatattaaagcgcagttttgagaaaa

SEQ ID NO: 1362 - DNA, 1179 bp, Secale cereale
ggtaaggagaagactcacatcaacatcgtggtcattggccatgtcgactctggcaagtcgaccaccactggccatctgatctacaagcttggaggtatcgacaagcgtgtgatcgagaggttcgagaaggaagccgctgagatgaacaagaggtcgttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcccaagtactcgaaggcccgttatgaggaaattgtcaaggaagtctcttcgtacctgaagaaggtcggctacaaccctgacaaggtccccttcgtccccatctctgggtttgagggtgacaacatgattgagaggtccaccaaccttgactggtacaagggccctaccctgcttgaggcgcttgaccagatcaacgagcccaagaggccctcagacaagcccctgcgtcttccccttcaggacgtttacaagattggtggcattggaactgtgcctgttggccgtgttgagactggtgtcatcaagcctggtatggttgttacctttggtcccactggtctgacaactgaggtcaagtctgttgagatgcaccacgagtccctcctggaggcgcttcctggtgacaacgttggcttcaacgtcaagaatgttgctgtgaaggatctgaagcgtgggtttgttgcatccaactccaaggatgaccctgccaaggaggcagccaacttcacctcccaggtcatcatcatgaaccaccctggtcagatcggcaacggctacgccccagtgctggactgccacacctcccacattgctgtcaagtttgctgagctggtgaccaagatcgacaggcggtctggtaaggagctggaggccctgcccaagttcctgaagaacggtgacgctggtatcgtgaagatgattccc

SEQ ID NO: 1363 - DNA, 1338 bp, Quercus alba
aactctgtattcctctctctcactctttcacactccgattctctctccctctctcgcggctagggttttagcgcagctctttcttcagttcattaagaatgggtaaggaaaaggttcacatcaacattgtggtcattggccatgtcgactctggaaagtcgaccacaactggtcacttgatatacaagcttggaggtatcgacaagcgtgttattgaaaggttcgagaaggaagctgctgagatgaacaagaggtcattcaagtatgcctgggtgcttgacaagctcaaggctgagcgtgagcgtggtatcaccattgatattgccttgtggaagtttgaaaccaccaagtactactgcacagtcattgatgctcctggacatcgtgatttcatcaagaacatgattactggaacctcccaggctgattgtgctgtccttattatcgactccaccactggtggttttgaagctggtatttccaaggatggacagacccgtgagcatgctctccttgctttcacccttggtgtcaggcaaatgatttgctgctgcaacaagatggatgccactacccccaagtactcaaaggccaggtacgatgaaatcgtgaaggaagtctcttcctacttgaagaaggttgggtacaaccctgacaagattccttttgtccccatctctggatttgagggtgacaatatgattgagaggtccaccaaccttgactggtacaagggtccaacccttcttgaggcacttgaccagatcaatgagccaaagaggccctcagacaagcccctccgtctcccacttcaggatgtttacaagattggaggcattggaactgtccctgtgggtcgtgttgagaccggtctcatcaagcctggtatggttgtgacttttggccccactggactgaccactgaagtaaagtctgttgaaatgcatcatgaggctctcctagaggctcttcctggtgacaatgttggcttcaacgttaagaatgttgctgtgaaggatctcaagcgtgggtttgttgcctccaactccaaggatgatcctgccaaggaggcagccaacttcagctcccaagttatcatcatgaaccaccctggccagattggaaatggttacgcccctgtcctcgattgccacacctcccacattgctgtcaaatttgctgagctcttgaccaagattgacaggcggtctggtaaggagcttgagaaggagcccaaattcttgaagaatggtgatgctggaatggttaagatgcttcccaccaagcccatggttgtggaaacctttccgagtatccccacttggtcgtagagacacg

SEQ ID NO: 1364 - DNA, 1392 bp, Triticum aestivum
cagcattgtggtcattggccatgttgactctggcaagtcaaccacgactggccacctcatctacaagcttggaggcattgacaagcgtgtgatcgagaggttcgagaaggaagccgctgagatgaacaagaggtctttcaagtacgcctgggtgcttgacaagctcaaggctgagcgtgagaggggtatcaccattgatattgctctgtggaagtttgagaccaccaagtactcctgcactgtcattgatgctcctggtcaccgtgacttcatcaagaacatgatcactgggacctcccaggctgattgtgctgtgcttatcattgactccaccactggtggttttgaggctggtatctccaaggatggccagacccgtgagcacgctctccttgcgttcactcttggtgtgaagcagatgatctgctgctgcaacaagatggatgccaccactcctaagtactcgaaggcccgttatgaagaaattgtcaaggaagtctcttcatacctgaagaaggtcggttacaaccctgacaaggttcccgttccgtttcccactcttcctggggtttcggagggtggacaacatgattgagaggtccacccaacctttgactgggttaccgaaagggcccccgaccccttcttgaggcccctggaccagatcaatgagcccagagccctccgaccaagcccctcgcgtcttccccttcaggacgtctacaagattggtggcattggaactgtgccagtggggcgtgttgagactggagtcatcaagccaggcatggttgtcacctttggtcctactggcctgacaactgaggtgaagtctgttgagatgcaccatgagtctctcctggaggcgcttcctggtgacaacgtcggcttcaacgtcaagaacgtggccgtcaaggatactcaagcgtgggtacgtggcctctaactccaaggacgaccccgccaaggaggctgccaacttcaccgcccaggtcatcatcatgaaccaccccggccagatcagcaacggctacgccccggtgctggactgccacacgtcccacatcgctgtcaattcgctgagatccaaaccaagattgaccggcgatctagcaagggcgattgaggcggcgcccaagttcctgaagaacggtgatgccgggttcgtcaagatgatccccaccaagcccatggtggtggaaacttcgcccagtacctcccctcggccggcttgtctgtgcgtgacatgaggcagacggttgccgtgggcggttatcaaggctgtggagaagaaggatccgacccggcgccaaggtgaccaaaggacgtgcgggcccgaagaagaaatgagatggtgtcgggccgggtggcgtcggttcgtggtactttacc

SEQ ID NO: 1365 - DNA, 1281 bp, Triticum aestivum
cctccacctcccacctcatcgccgccgcaggctttgactccatcgcctcctccctcctcctcttcgtctccggcaggccaggtagttaacagctccagcagccatgggaaaggagaagatccacatcagcattgtggtcattggccatgttgactctggcaagtcaaccacgactggccacctcatctacaagcttggaggcattgacaagcgtgtgatcgagaggttcgagaaggaagccgctgagatgaacaagaggtctttcaagtatgcctgggtgcttgacaagctcaaggctgagcgtgagaggggtatcaccattgatattgctctctggaagttcgagaccaccaagtactcctgcactgtcattgatgctcctggtcaccgtgatttcatcaagaacatgatcactgggacctcccaggctgattgtgctgtgcttatcattgactccaccactggtggttttgaggctggtatctccaaggatggccagacccgtgagcacgctctccttgcgttcactcttggtgtgaagcagatgatctgctgctgcaacaagatggatgccaccactcctaagtactcgaaggcccgttatgaagaaattgtcaaggaagtctcttcatacctgaagaaggtcggctacaaccctgacaaggttcccttcgtccccatctctgggttcgagggtgacaacatgattgagaggtccaccaaccttgactggtacaagggcccaaccctgcttgaggcacttgaccagatcaacgagcccaagaggccctcagacaagcccctccgtcttcccctacaggatgtttacaagattggtggcattggaactgtgcctgttggccgtgttgagactggtgtcatcaagcctggtatggttgttacctttggtcccactggtctgacaactgaggtcaagtccgttgagatgcaccatgagtctctcctggaggcgcttcctggtgacaacgttggcttcaatgtcaagaatgttgccgtgaaggatctgaagcgtggttttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtgaccaagatcgacaggcgatctggtaaggagctggaggccctgcccaagttcctcaagaatggtgatgctggcatagtgaagatgat

SEQ ID NO: 1366 - DNA, 1527 bp, Papaver somniferum
cgacgtactgggaaatccgaccgtaccaccggttcactttcgatctacctaaaggcttaggaggtattgactaagcgtgtattgaaagattacgagaagaggctgctagagatgaacaagaggtcaattcaagtatgcatgggtcttgacagctaaggcttgtaacgtgagcgtggtattaccattgatattgccttgaaggaagtttagagaccaccaagtactactgcacagttattgatgctcctggacatcgtgactttatcaaaaacatgattactggtacttctcaggctgattgtgccgtcctcattatcgattctaccactggaggttttgaggctggtatctcaaaggatggtcagactcgtgagcacgctcttcttgctttcacccttggtgtcaagcagatgatctgttgttgtaacaagatggatgccaccacccccaagtactcaaaggctaggtatgatgaaattgtaaaggaggtctcatcttacttgaagaaggttggatacaacccagacaaaattgcctttgttcctatctctggattcgagggagacaacatgattgagaggtccaccaaccttgactggtacaagggaccaactcttctcgatgctcttgacaatatctctgagccaaagagaccctcagacaagccccttcgtcttccccttcaggatgtttacaagattggaggtattggaactgtgccagtgggacgtgttgaaactggattcatcaagcctggtatggttgttacctttcggacccactgggttgaccactgaaagttaagtctgtggagatgcaccacgaagcccttcaagaagctcttccaggagacaatgttgggttcaatgtcaagaatgttgcagtgaaggatctcaagcgtggtttcgtcgcctccaactccaaggacgaccctgccagggaagctgctaacttcacctcccaggtcatcatcatgaaccatcctggtcagatcggtaacggttatgctccagtcctcgactgtcacacatctcacattgctgttaagtttgctgagatcctcaccaagattgataggcgatctggaaaggagcttgagaaggagcccaagttcttgaagaatggtgatgctggtattattaagatgcttccaacaaagcccatggttgtagagaccttctctcagtacccacctcttggtcgttttgctgttagggacatgaggcagacagttgctgttggtgttatcaaggaagttgagaagaaggacccaacaggggccaaggttaccaagtctgctgtcaagaagaaatgaagtgtgctgccaaggttaactagagggagagggatggtactaagaggatctacaggagggacttatttctttactattagtcagttttgttttttgttttcgtgcattaggtatcagtgtggtcttttgttttgtttcaccttcgttttgttgcgcattcagttgcaaacctgggtgcttgacaggcggtggcaacaaggtgttgggctgtt

SEQ ID NO: 1367 - DNA, 1256 bp, Brassica napus
agtttcacatcaacattgtggtcattggccaatgtcgactctggaaaatacgactacaactaggtcacttgtatctacaagcttggtggtattgtacaagcgtgtcaatcgagaggttcgagaaggagggctgctgagatgaacaagaggtccttcaagtacgcatgggtgttggacaaacttaaggctgagcgtgagcgtggtatcaccattgatattgctctctggaagttcgagaccaccaagtactactgcactgtcattgatgcccctggacatcgtgatttcatcaagaacatgattactggtacttcccaggctgattgtgctgttctcatcattgactctaccactggtggttttgaagctggtatctccaaggatggtcagacccgtgagcatgctcttcttgccttcacccttcggtgtcaagcaaatgatttgctgctgtaacaagatggatgccactaccccaacgtactccaggctaggtacgatgagatcatcaaggaggtgtcttcctacttgaagaagtcgggtacaaccctgacaaaatcccattgtccccatctctggattcgagggtgacaacatgattgagaggtccaccaaccttgactggtacaagggaccaactctccttgaggctcttgaccagatcaacgagccaaagaggccttcagacaagcccctgcgtctaccacttcaggatgtctacaagatcggtggtattggaacggtgccagtgggtcgtgtggagactggtatgctcaagcccggtatggttgtgacattcgctccttcagggttgaccactgaggtcaagtccgttgagatgcaccacgagtctcttgtggaggcgcttccgggtgacaacgttgggttcaatgttaagaacgttgctgtcaaggatcttaagcgtgggtacgttgcgtccaactccaaggatgatcctgctaaaggcgctgctaacttcacctcccaggtcatcatcatgaaccaccctggtcagattggtaatggttacgccccggttcttgattgccacacctcccacattgctgtcaagttctctgaaatcttgaccaagattgatagacgttctggtaaggagattgagaaggaacctaagttttgaagaatggtgatgctggtatggtgaagatgactcccaccaagcctatggttgttgagactttctctgagtacccaccgcttggacgtttcgctgttagggacatgaggcagactgttgc

SEQ ID NO: 1368 - DNA, 3239 bp, Arabidopsis lyrata
gattcaccactataaataatctcgaatcccccatcatagcttattccttacttcattcttcgtcaccctagccgcttaacttgcctgcgatatctctgagatttacttgacaagtaaccatgggtaaagagaagtttcacatcaacattgtggtcattggccacgtcgattctggtaaatcgaccaccactggacacttgatctacaagttgggaggtattgacaagcgtgtcattgagaggttcgagaaggaggctgctgagatgaacaagaggtctttcaagtacgcatgggttttggacaaacttaaggctgagagagagcgtggtatcaccattgacattgctctctggaagttcgagaccaccaagtactactgcactgtcattgatgctcctggccatcgtgatttcatcaagaacatgatcactggtacctctcaggccgattgtgctgtccttatcattgactccaccactggtggttttgaggctggtatctccaaggatggtcagacccgtgagcatgctctccttgctttcacccttggtgtcaagcaaatgatctgctgttgtaacaagatggatgccaccacccccaggtactccaaggccaggtacgatgaaatcatcaaggaggtgtcttcctacttgaagaaggttggttacaaccccgacaaaatcccgtttgtgcccatctctggattcgagggagacaacatgattgagaggtccaccaaccttgactggtacaagggaccaactctccttgaggctcttgaccagatcaacgagcccaagaggccatcagacaagccccttcgtctcccacttcaggatgtctacaagattggtggtattggaacggtgccagtgggacgtgttgagactggtatgatcaagcctggtatggtcgtgacctttgctcccacagggttgaccactgaggtcaagtctgttgagatgcaccacgagtctcttcttgaggcacttcccggtgacaatgttgggttcaatgttaagaatgttgccgtgaaggatcttaagagagggtacgtcgcctccaactcaaaggatgaccctgccaagggagcagccaacttcacctcccaggtcatcatcatgaaccaccctggtcagattggtaacggttacgccccagtcctcgattgccacacctcacacattgcagtcaagttctctgagatcttgaccaagattgacaggcgttctggtaaggagattgagaaggagcccaaattcttgaagaatggtgatgctggtatggtgaagatgactccgaccaagcccatggttgtggagaccttctctgagtacccaccccttggacgttttgccgtgagggacatgaggcagactgttgcagtcggtgtcatcaagagcgtggacaagaaggacccaaccggagccaaggttaccaaggctgccgtcaagaagggtgaatcaaaggacaatgttagtttttttacactagtttggtatctggtcgcttgtctgtgttcctgtttcgttatttccccatcagagcgttgttctcgtaattgggttcttgatcggaggtggcggagctaagcaaacatgcttccttgtttttgctttttatttgttttctcattatttacttgacaagtaaccatgggtaaagagaagtttcacatcaacattgtggtcattggccacgtcgattctggtaaatcgaccaccactggacacttgatctacaagttgggaggtattgacaagcgtgtcattgagaggttcgagaaggaggctgctgagatgaacaagaggtctttcaagtacgcatgggttttggacaaacttaaggctgagagagagcgtggtatcaccattgacattgctctctggaagttcgagaccaccaagtactactgcactgtcattgatgctcctggccatcgtgatttcatcaagaacatgatcactggtacctctcaggccgattgtgctgtccttatcattgactccaccactggtggttttgaggctggtatctccaaggatggtcagacccgtgagcatgctctccttgctttcacccttggtgtcaagcaaatgatctgctgttgtaacaagatggatgccaccacccccaagtactccaaggccaggtacgatgaaatcatcaaggaggtgtcttcctacttgaagaaggttggttacaaccccgacaaaatcccgtttgtgcccatctctggattcgagggagacaacatgattgagaggtccaccaaccttgactggtacaagggaccaactctccttgaggctcttgaccagatcaacgagcccaagaggccatcagacaagccccttcgtctcccacttcaggatgtctacaagattggtggtattggaacggtgccagtgggacgtgttgagactggtatgatcaagcctggtatggtcgtgacctttgctcccacagggttgaccactgaggtcaagtctgttgagatgcaccacgagtctcttcttgaggcacttcccggtgacaatgttgggttcaatgttaagaatgttgccgtgaaggatcttaagagagggtacgtcgcctccaactcaaaggatgaccctgccaagggagcagccaacttcacctcccaggtcatcatcatgaaccaccctggtcagattggtaacggttacgcccctgtcctcgattgccacacctctcacattgcagtcaagttctctgagatcttgaccaagattgacaggcgttctggtaaggagattgagaaggagcccaagtttttgaagaatggggatgccggtatggttaagatgactccgaccaagcccatggttgtggagaccttctctgagtacccaccactaggacgttttgccgtgagggacatgaggcagactgttgctgttggtgtcatcaagagtgttgacaagaaggacccaactggagccaaggttaccaaggctgccgtcaagaagggtgcgaagtgaactcccatcctcaaaactctatccgcagatgaatcaaacgactgttttagggttttcactttagttttgtatttggtcgcttgtatgtgttacagcttcgtttcttctccgtcagagctcaattcccggaactgggttcttgatcggaggtggcggggccacttggcactcaagctgtctgttttttgctttttgaattgttttcgattttgaacctttttggagattcgttat

SEQ ID NO: 1369 - DNA, 1586 bp, Flaveria ramosissima
taccgactactcttatactacagacgttggtggtagttgacgaagcgtgtgatacgaaggtacgagaaggagctgctgagatagaacaagaggtctacaatacgcttgggtgctcgacaagctcaaggcagagcgtgaaagaggtattaccattgatattgccttgtggaagttcgagaccaccaagtactactgcactgtcattgatgctcccggacatcgtgatttcattaagaacatgattactggtacctcccaagctgactgtgctgtcctcatcatcgactcgaccactggtggttttgaggctggtatttccaaggatggtcagactcgtgagcacgctcttcttgctttcactcttggtgtcaagcaaatgatttgctgctgtaacaagatggatgccaccaccccgaaatactccaaggcgaggtatgatgaaattgtgaaggaagtttcttcatacttgaagaaggtcggatacaaccccgacaaaatcccatttgtgccaatctctggtttcgaaggagacaacatgattgaaaggtccaccaacctcgactggtacaagggtcccacccttcttgaagctcttgaccagatcaacgagcccaagagaccctcagacaagccactccgtctcccacttcaggacgtgtacaagatcggtggtattggaactgtcccagttggacgtgttgagactggtgtgatcaagcctggtatggttgtcaccttcggaccatctgggttgaccactgaagttaagtctgttgagatgcaccatgaagctctaaccgaggcactccctggtgacaatgttggcttcaacgtcaagaacgttgctgtcaaggatctcaagcgtggttacgttgcctcaaactccaaggatgatcctgccaagggtgcagccagcttcacctctcaggtcatcatcatgaaccaccctggtcagatcggtaacggatacgcccccgttcttgattgccacacctctcacattgccgtcaagttctctgagcttttgaccaagattgacagacgatctggtaaggagcttgagaaggagcctaagttcttgaagaacggtgatgctggtatggttaagatgcttcccaccaagcccatggttgtcgagacctttgctgaatacccaccacttggaaggtttgccgtgagagacatgcgtcagacggttgcagtcggtgttatcaagagtgtcgagaagaaggacccgaccggagccaaggtgaccaaggctgcagtgaagaagggagccaagtgaggtgaggtggtttgtggtttggtttatggagtattttatgttttgtcatttgatttactagttttgaacttattttgttgaggagttttgttgtttttcgatctttgaagctttcattattattgtgggagttttatgggttgcagacttttgttgtgggttaatttatagtggtctacttcaatgagtttgtagttggtgttgaaaacttatatttatgatatccaaattcttttttataataactaaaaaaaaaaaaaaaaaataaaaagtactactgtgtagactaccaacaacgtat

SEQ ID NO: 1370 - DNA, 1617 bp, Fraxinus spp
ctctcggcagtcggcgggcgagagatctctctaaactacattcaaagttttctatttaaaagttcaacatgggtaaggaaaagtttcacattaacatcgtggtcattggccacgtcgactctggaaagtcaactaccactggccatttgatctacaagcttggtggtattgacaagcgtgtcatcgaaaggtttgagaaggaggctgctgagatgaacaaaaggtcattcaagtatgcctgggtgcttgacaagctcaaggctgagcgtgaacgtggtatcaccattgatattgccttgtggaaattcgagacaaccaaatattattgcacggttattgatgctccaggacatcgtgactttatcaaaaacatgattactggtacttcacaggctgactgcgccgtccttatcattgactctaccactggtggtttcgaagctggtatttccaaggacggtcagacccgtgagcatgctttgcttgccttcacccttggtgtcaagcaaatgatttgctgctgcaacaagatggatgccaccacacctaaatactcaaagcccaggtatgatgaaattgtgaaggaagtgtcatcctacatcaggaaggttggatacaaccctgacaagatcccatttgttcccatatctggttttgagggtgacaacatgattgagaggtccaccaaccttgattggtacaagggcccaaccctccttgaagctcttgaccagattcaggagccaaagaggccctcagacaagccctccgtctcccacttcaggacgtctacaagattggtggtattggaactgtacctgttggccgtgtggagactggtgttatcaagcctggtatggttgtcaccttttggcccaactggtctgacaactgaagtcaagtctgttgagatgcaccacgaggccctccaggaggctctccctggtgacaatgttggcttcaacgtcaagaatgttgccgtgaaggatctcaagcgtggttacgttgcctccaactccaaggatgaccctgccaagggtgctgccagcttcacttcccaggtcatcatcatgaatcaccctggtcagattggaaatggatatgcaccagtgctcgactgccacacatcccacattgctgttaagtttgccgagctccagaccaagattgacaggcgttctggtaaggagctggagaaggagcccaagttcttgaagaacggtgatgctggtcttgttaagatgattcccaccaagcccatggttgtggagactttctccgagtacccacctcttggtcgttttgctgtcagagatatgcgccagacagttgctgtcggtgtcatcaagagtgtggacaagaaggatccatctggtgccaaggtcaccaaagctgctgctaagaagggtgccaagtgaagaaaattccggttggatgatatggtttttgttaatcaaattagttattttcaagacatcttttgcagttttgattattatggtttaaacaggtgctctatctgtattgcctattttttttctttttttctttttaattattgcttgagatgagttgtaggcctatatgttccaacgaatattttattctgttttactt

SEQ ID NO: 1371 - DNA, 1278 bp, Brassica napus
aacctagccgctacacttatcttccccctaccacatcactgagattagccatgggtaaagagaagttccacatcaacatcgtggtcatcggccacgtcgactccggaaaatccacaaccaccggtcacttgatctacaagctcggcggtatcgacaagcgtgtcatcgagaggttcgagaaggaagcagccgagatgaacaagagatctttcaagtacgcgtgggtcctggacaagctcaaggccgagcgcgagcgtggtatcaccatcgacattgctctctggaagttcgagaccaccaagtactactgcaccgtcatcgacgctcctggccatcgcgatttcatcaagaacatgatcactggtacctcccaggctgattgtgctgttctcattatcgattccaccaccggggggtttgaggctgggatctctaaggatggtcagactcgtgagcatgctcttctcgctttcacgcttggtgttaagcagatgatttgttgttgtaacaagatggatgctactactcctaagtactctaaggctaggtacgatgagattatcaaggaggtttcttcttacttgaagaaggttggttacaaccctgacaagatccttttgttcccatctctggtttcgagggtgacaacatgattgagaggtcaaccaaccttgactggtacaaggggccgactctcctcgaggctcttgaccagatcaacgagcccaagaggccctctgacaagcccctccgtcttcccctccaggatgtctacaagattggtgggattggaacggtgccggtgggacgtgttgagaccggtatgctcaagcccggtatggttgtgacattcgctccttcgggtttgaccactgaggttaagtctgttgagatgcaccacgagtctcttgttgaggcgcttccgggtgacaacgttgggttcaatgttaagaacgttgctgtcaaggatcttaagcgtgggtacgttgcgtccaactccaaggatgaccctgctaaaggtgctgctaacttcacctcacaggttatcattatgaaccaccctggtcagattggtaacggttacgctccggttcttgattgccacacgtcccacattgctgttaagttctctgagattttgaccaagattgataggcgttctggtaaggagattgagaaggagcccaagtttttgaagaatggtgatgctggtatggttaagatgactccgaccaagccaatggttgttgagactttctctgagtacccgcatcacca

SEQ ID NO: 1372 - DNA, 1282 bp, Triticum aestivum
cgaccgccgccgccgcctcctcctctcggttccctctccttccttcgagtttgcttcagccatgggtaagggagaagactcacatcaacatcgtggtcattggccacgtcgactctggcaagtcgacgaccactggccacctgatctacaagcttggaggcattgacaagcgtgtcatcgagaggttcgagaaagaagccgctgaaatgaacaagaggtctttcaagtacgcctgggtgcttgacaagctcaaggccgagcgtgagagaggtatcaccatcgatattgccctctggaagtttgagacaaccaagtactactgcaccgtcattgatgcccctggtcaccgtgacttcatcaagaacatgatcaccggtacctcccaggctgactgtgctgttctcatcatcgactccaccactggtggttttgaggctggtatctccaaggatggccagacacgtgagcacgccctccttgctttcactcttggagtgaagcagatgatctgctgctgcaacaagatggacgccaccactcccaagtactcgaaggctcgttacgaagaaattgttaaggaggtctcttcgtacctgaagaaggtcggctacaaccctgacaaggttcccttcgtccccatctctgggttcgagggtgacaacatgattgagaggtccaccaaccttgactggtacaagggcccaacccttcttgaggcgcttgaccagatcaacgagcccaagaggccctcagacaagcccctccgtcttcccctccaggacgtttacaagattggtggcattggaactgtgcctgttggccgtgttgagactggtgtcatcaagcctggtatggttgtcacctttggtcccactggtctgacaactgaggtcaagtccgttgagatgcaccatgagtctctcctggaggcgcttcctggtgacaacgttggcttcaatgtcaagaatgttgccgtgaaggatctgaagcgtggttttgttgcatccaactccaaggatgaccctgccaaggaggcagccaacttcacctcccaggtcatcatcatgaaccaccctggtcagatcggtaacggctatgccccagtgctggactgccacacctcccacattgctgtcaagtttgctgagctggtgaccaagatcgacaggcgatctggtaaggagctggaggcgctgcccaagttcctcaagaatggtgacgccggtatcgtgaagatgattcccaccaagcccatggttgtggagaccttcgccacctaccc

SEQ ID NO: 1373 - DNA, 1489 bp, Ceratodon purpureus
ccggaaagtcgacgaccaccggacacttgatctataagttgggtggtatcgacaagcgtgtgatcgagcgtttcgagaaggaggcggctgagatgaacagcgttctcaagtcgcgtgggtgttggacagctgaaggcgagcgtgagcgtggtattaccatcgatatcgcgttgtggaagttcgagacggtgaagtactactgcaccgtgatcgacgccccccgggcatcgcgattttattaagaatatgattacgggaacgtcgcaggctgattgtgcggtgttgatcatcgactcgacgactggagggttcgaggctggtatttcgaaggacgggcagacgcgtgagcatgctctgtttggcgttttacgctaggagtgaggcagatgatctgctgctgcaacaagatggacgcgaccaccccgaagtatagtaaggctcgttatgaggagattacgaaggaagtgtcggcgtatctgaagaaggtgggatataaccccgagaaggtcccatttgtgccgatttccgggttcgagggagataacatgatcgagaggtcgtcgaacctggagtggtacaaggggccgaccctgttggaggctttggacaacgtgtctgagccgaagaggccgtccgacaagccactgcgtctgcctctccaggatgtgtacaagattggaggcattggaactgtgccggtgggacgtgtggagaccggagtgatcaagcccggtatgttggtgtgcttcgcgcctaccggattggtgactgaggtgaagtcggtggagatgcaccacgagtcgatggcggaggcccacccgggagacaacgtgggattcaacgtgaagaacgtggcggtgaaggatctgaagagaggatacgtggcttctgactcgaagaacgaccccgcgaaggaggccgccaacttcacggcgcaggtgatcatcatgaaccaccccgggcagatcggcaacgggtacgccccggtgctggattgccacacttctcacatcgcggtgaagttctcggagatcctgacgaaggtggacaggcgatcgggtaaggagctggagaaggagcccaagtttctgaagaatggtgacgcgggggtcgtgaagatggttccgacgaagccgatgacggtggagactttcgctgagtacccacctttgggtcgtttcgccgtgcgcgacatgaggcagacggtggcggtgggagtgatcaaggctgtggagaagaaggagccgagtggggccaagataacgaagtccgctaagacgaagaagtgaatagtgtgggaggagtcgccagggcagttttgtttgtggggtggaattctgtgggcggctttggacttgttcactctatgtgcgtgttcgatatacctactgcaagcgcggcagaggcaaacttgggtacttgaccggagatggcagggcttgccgtgtctgtgattattagaacctaaatcttttataatataataagc

SEQ ID NO: 1374 - DNA, 1387 bp, Setaria italica
cttctcctctagccatgggcaaggagaaggtccacatcaacatcgtggtcatcggccatgtcgactccggcaagtccacgaccaccggccacctcatctacaagctcggaggcatcgacaagcgcgtcatcgagaggttcgagaaggaggctgccgagatgaacaagaggtccttcaagtacgcctgggtcctcgacaagctcaaggccgagcgcgagaggggcatcaccattgacattgccctctggaagttcgagaccaccaagtactactgcaccgtgatcgacgctcccggacaccgcgacttcatcaagaacatgatcaccggcacctcccaggctgactgtgccgtgctcatcatcgactccaccaccggtggctttgaggccggtatctccaaggatggccaaacccgtgagcacgccctccttgccttcactcttggtgtcaggcagatgatctgctgctgcaacaaggtaacaatatactgcttgttcttggtttgatgatctttggtgctaatgctaatgaaagtttttgttcgtgcccatctctgggttcgagggtgacaacatgatcgagaggtcgacgaacctggactggtacaagggccccaccctcctcgaggcgctggaccagatcaacgagccgaagcggccgtcggacaagcccctccgccttcccctgcaggacgtttacaagatcggcggcatcggcaccgtcccggtgggccgcgtggagaccggcgtcctgaagcccggcatggtggtcaccttcgcgcccaccggcctgacgacggaggtgaagtcggtggagatgcaccacgagtcgatgcaggaggcgctgccaggcgacaacgtcgggttcaacgtgaagaacgtggcggtgaaggacctgaagcgcggctacgtggcgtccaactccaaggacgaccccgccagggaggccgccggcttcacggcgcaggtgatcatcatgaaccacccggggcagatcgccggcggctacgcgccggtgctggactgccacacgtcccacgtcgccgtgaggttctcggagctgctgaccaagatcgacaggcgctccggcaaggagctcgagagcggccccaagttcctcaagaacggcgacgctgggctcgtcaagatggtcccgaccaagcccatggtggtggagacgttctccgagtacccgccgctggggaggttcgccgtgcgcgacatgaggcagacggtggccgtgggcgtgatcaagagcgtggagaagaaggacccgacgggagccaaggtcaccaaggctgcggcgaagaagaaataaatggtcgatccgtggatgatatttacatcatatagatagtattttggctagaaagtttacattactgcta

SEQ ID NO: 1375 - DNA, 1281 bp, Brassica juncea
ggagctcgatctttctcttcaacctagccgcaacactttgccgagatttactaagtagccatgggtaaagagaagtttcacatcaacattgtggtcattggccacgtcgactctgggaagtctaccaccactggtcacttgatctacaagcttggtggtattgacaagcgtgtgattgagaggttcgagaaggaggctgctgagatgaacaagaggtccttcaagtacgcgtgggtgttggacaaacttaaggctgagcgtgagcgtggtatcaccattgacattgctctctggaagttcgagaccaccaagtactactgcacggtcattgatgctcctggacatcgtgatttcatcaagaacatgattactggtacctcccaggctgattgtgctgtccttatcattgactctaccactggtggttttgaagctggtatctccaaggatggtcagacacgtgagcatgctcttcttgctttcacccttggtgtcaagcagatgatttgctgctgtaacaagatggatgctacaacccccaagtactccaaagctaggtacgatgagattatcaaggaggtgtcttcctacttgaagaaggttgggtacaaccctgacaaaatcccattcgtccccatctctggtttcgagggtgacaacatgattgagaggtccaccaaccttgactggtacaagggtccaactctccttgaggctcttgaccagatcaacgagcccaagaggccctcagacaagcccctccgtcttccacttcaggatgtctacaagattggtggtattggaacggtgccagtgggtcgtgttgaaaccggtatgctcaagcctggtatggttgtgacctttgctccttcagggttgaccactgaggtgaagtcagttgagatgcaccacgagtctcttgtggaagcacttcctggtgacaacgttggattcaatgtcaagaacgttgctgtcaaggatcttaagcgtgggtatgttgcatccaactccaaggatgaccctgccaagggagctgccaacttcacttcccaggtcatcatcatgaaccaccctggccagatcggaaatggatacgccccagttcttgattgccacacctcccacattgcagtcaagttctctgagatcctcaccaagattgacaggcgttctggtaaggagattgagaaggagcccaagtttttgaagaatggtgatgctggtatggtgaagatgacttcgaccaagcccatggttgttgagaccttctctgagtaccca

SEQ ID NO: 1376 - DNA, 1588 bp, Gossypium hirsutum
agacatctcactctctcttctctgccgatttctccgttcttcaaaatttaagttttttctgctaaaaagttgctatgggtaaggagaaggttcacatcaacattgttgtcattggccatgtcgactctggaaagtcaacaacaactggtcacttgatctacaagcttggaggtattgacaagcgtgtgatcgagaggttcgagaaggaagctgctgagatgaacaaaaggtcattcaagtatgcctgggtgctcgataagttgaaggctgagcgtgagcgtggtatcaccattgatattgccttgtggaagtttgagacaaccaagtactactgcactgtcattgatgctcctggacatcgtgacttcattaagaatatgattacgggtacttctcaagctgactgtgctgtccttatcattgactccacaactggaggttttgaagctggtatttccaaggatgggcagacccgtgagcatgctctccttgccttcactcttggtgtcaagcaaatgatttgctgctgcaacaagatggatgccacaacccccaagtactcaaaggcaaggtatgatgaaattgttaaggaagtttcttcctacctgaagaaggttggttacaaccctgagaagattccattcgtccccatatctggttttgagggtgacaacatgattgagaggtccaccaacctcgattggtacaagggtccaaccctccttgaggctcttgaccagatcaatgagcccaagagaccctctgacaagcccctccgtctcccacttcaggatgtctacaagatcggtggtattggaactgtcccggtgggtcgtgttgaaaccggtacccttaagcctggaatggttgttacattcggaccttctggattgaccactgaagttaagtctgttgagatgcatcatgaagctcttcaagaggctcttcctggtgacaatgttgggttcaacgtgaagaatgttgctgtcaaggatctcaagcgtggatatgttgcctccaactccaaggatgatcctgccaaggaggcagccaacttcacctcccaagttatcatcatgaaccacccaggacagattggaaatggctatgcaccggtcctcgattgccacacctcccatattgctgtcaagtttgcagagctcttgaccaagattgacaggcgatctggtaaggagcttgagaaggagcctaagttcttgaagaatggtgatgctggtatgattaagatggttccgaccaagcccatggttgtggaaccttctccgcgtaccctccacttggacgttttgccgttagggacatgagacagactgttgctgttggtgtgatcaagagtgtggagaagaaggacccatctggagccaaggtgaccaagtctgccgccaagaagggtggcaagtgaactttggtttagtctagtttgtttgtgagatccgtaattaatccttgagtattggtttgctttagacgatgaggtttcagacaacatggttgtgtgttgaagtttacttgagagttaacttgcaactgatcttcactactgataagaaatgagtggacttcaagc

SEQ ID NO: 1377 - DNA, 1417 bp, Pennisetum glaucum
cccggggacggggtgggggccgcggaaatgaacaagaggtccttcaagtacgcgtgggtgcttgacaagctgaaggctgagcgtgagagaggtatcaccatcgacattgccctgtggaagttcgagaccaccaagtactactgcacggtcatcgatgcccctggtcaccgtgacttcatcaagaacatgattaccggcacctcccaggccgactgtgctgtcctcatcattgactctaccactggtggttttgaggctggtatctctaaggatggccagacccgtgagcatgctctccttgctttcactcttggagtgaagcagatgatctgctgctgcaacaagatggatgccaccactcccaagtactccaaggcccgttatgatgagattgttaaggaagtctcctcgtacctcaagaaggtgggttacaacccagacaagattgccttcgtccccatctctggtttcgagggtgacaacatgattgagaggtccaccaaccttgactggtacaagggcccaaccctgcttgaggctcttgaccagatcaacgagcccaagaggccttccgacaagcccctgcgtctcccccttcaggacgtgtacaagatcggtggtattggaactgtccctgttggccgtgttgagactggtgtgatcaagcctggtatggttgtcacctttggtccaactggcctgactactgaggttaagtctgttgagatgcaccacgaggctctccaggaggcccttcctggtgacaatgttggtttcaatgtgaagaacgttgctgtgaaggatctcaagcgtggttatgtggcctccaactccaaggatgaccctgccaaggaggctgccagcttcacctcccaggtcatcatcatgaaccaccctgggcagattggcaacgggtatgccccagtgctggactgccacacctcccacatcgctgtcaagtttgctgagcttgtcaccaagatcgacagacgatctggtaaggagctcgagaaggagcccaagttcctgaagaacggtgatgctggtatggtgaagatgattcccacgaagcccatggttgttgagacattctctgagtaccctcctcttggtcgctttgctgttcgggacatgaggcagacggttgctgttggtgtcatcaagagcgtcgagaagaaggaccccactggtgccaaggttaccaaggctgctgccaagaagaaatgagagggttgacattgtctgctgtgtttcatctatcttagtactcttgctgttttaagctttgttatgctattgttcttgcagcagggccttgcagttgcgtgcaactgtaatatctgctggcaatgcgccctattgtctggtgttgctgtaaacggtactcttatttttggatactgtgagttacgaatgg

SEQ ID NO: 1378 - DNA, 1236 bp, Triticum aestivum
tcctcttcgtctccggtaggccaggtagttaacagctccagcagccatgggaaaggagaagatccacatcagcattgtggtcattggccatgtcgactctggcaagtcaaccacgactggccacctcatctacaagcttggaggcattgacaagcgtgtgattgagaggtttgagaaggaagccgctgagatgaacaagaggtctttcaagtatgcctgggtgcttgacaagctcaaggctgagcgtgagaggggtatcaccattgatattgctctgtggaaattcgagaccaccaagtactcctgcactgtcattgatgctcctggtcaccgtgatttcatcaagaacatgatcaccgggacctcccaggctgattgtgctgtgcttatcattgactccaccactggtggttttgaggctggtatctccaaggatggccagacccgtgagcacgctctccttgcgttcactcttggtgtgaagcagatgatctgctgctgcaacaagatggatgccaccactcctaagtactcgaaggcccgttatgaagaaattgtcaaggaagtctcttcatacctgaagaaggtcggttacaaccctgacaaggttcccttcgttcccatctctgggttcgagggtgacaacatgattgagaggtccaccaaccttgactggtacaagggccccacccttcttgaggccctggaccagatcaatgagcccaagaggccctccgacaagcccctgcgtcttccccttcaggacgtgtacaagattggtggcattggaactgtgccagtggggcgtgttgagactggagtcatcaagccaggcatggttgtcacctttggtcctactggcctgaccactgaggtgaagtctgttgagatgcaccatgagtctctcctggaggcgcttcctggtgacaacgtcggcttcaacgtcaagaacgtggccgtcaaggatctcaagcgtgggtatgtcgcttccaactccaaggacgaccctgccaaggaggctgccaacttcaccgcccaggtcatcatcatgaaccaccctggccagatcagcaatggctacgccccggtgctggactgccacacgtcccacatcgccgtcaagttcgctgagatccagaccaagattgaccggcggtctggcaaggagattgaggcggcgcccaagttcctgaagaacggtgatgccgggttcgtcaagatgatccccaccaagcc

SEQ ID NO: 1379 - DNA, 1712 bp, Zea mays
atccttttttttgtgaatacagctttctagtcagctgctcccgttgccatggggaaggagaaggttcacatcaacattgtggtcattggccatgtcgactccggcaagtccacaaccaccggccacctcatctacaagcttggaggcattgacaagcgtgtcatcgagaggtttgagaaggaggctgccgagatgaacaagaggtccttcaagtacgcctgggtccttgacaagctcaaggccgagcgcgagaggggcatcaccattgacattgccctgtggaagtttgagacaaccaagtactactgcaccgtgattgatgcccctgggcaccgtgacttcatcaagaacatgatcaccggcacctcccaggctgattgtgcggtgctcatcattgactccaccactggtggcttcgaggctggtatctccaaggacggccagacccgtgagcatgcgctccttgctttcactcttggtgtgaggcagatgatctgctgctgcaacaaggtacttttgaaagttcgattgatgctctatgttccagtacgcaatgaaagctaatgactactatctgtttgtctgtactgcattatactgcaattttatctgtatatactgcaaactaaacgaactattgctaaatcagatggatgccactacccccaagtactccaaggctcggtacgacgagatcgtcaaggaagtgggttcctacctgaagaaggtggggtacaacccggacaagatccccttcgtgcccatctctgggttcgagggtgacaacatgatcgagaggtcgacgaacctggactggtacaagggccccaccctccttgaggcgctggaccagatcaacgagcccaagcggccctcggacaagcccctgcggcttcctctgcaggacgtgtacaagatcggcggcatcggcaccgtcccggtgggccgcgtggaaactgggctcctgaagcccggcatggtggtcacctttgcgcccacgggcctgacgacggaggtcaagtcggtggagatgcaccacgagacgatgcaggaggcactgcccggcgacaacgtcggcttcaacgtcaagaacgtggcggtcaaggacctgaagcgcggctacgtggcctccaactccaaggacgaccccgccaaggaggctgccagcttcaccgcgcaggtgatcatcatgaaccacccggggcagatcggcaacggctacgccccggtgctggactgccacacgtcccacatcgccgtgaagttctcggagctgctcaccaagattgaccggcggtcgggcaaggagctggagagcgcccccaagttcctcaagaacggtgacgccggcttcgtcaagatgatccccacgaagcccatggtggtggagactttctccgagtatcctccactggggcgcttcgcggttcgcgacatgaggcagacggttgcggtcggcgtgataaagagcgtggagaagaaggacccaacgggagccaaggtgaccaaggcggctgccaagaagaaatgatgatgattctgcatgtaatccatggttcctggtttctttgctggtcggagtattttgttgggtggtgctagtagtagttaacaaaagaataattttcatgggttcattgtgtaggtttggactgttgtgttcgtgattgcgtaccacactatatatattgggttttgcttctatagtaata

SEQ ID NO: 1380 - DNA, 1230 bp, Pennisetum glaucum
atcgagaggttcgagaaggaggctgctgagatgaacaagcggtccttcaagtacgcgtgggtgcttgacaagctcaaggctgagcgtgagagaggtatcaccattgatatcgccctgtggaagttcgagaccaccaagtactactgcactgtcattgacgcccctggacaccgtgacttcatcaagaatatgatcaccggtacctcacaggctgactgtgctgtccttatcattgactccaccactggtggttttgaggctggtatctccaaggatggccagacccgtgagcatgctctccttgctttcactcttggagtcaagcagatgatctgctgctgcaacaagatggatgccaccactcccaagtactccaaggcccgttatgatgagattgttaaggaagtttcctcatacctcaagaaggttggttacaaccctgacaagattgcctttgtccctatctctggttttgagggtgacaacatgattgagaggtccaccaaccttgactggtacaagggcccacccctgcttgaggctcttgaccagatcaacgagcccaagaggccttccgacaagcccctgcgtctcccccttcaggacgtgtacaagatcggtggtattggaactgtccctgttggccgtgttgagactggtgtgatcaagcctggtatggttgtcacctttggtccaactggcctgactactgaggttaagtctgttgagatgcaccacgaggctctccaggaggcccttcccggtgacaatgttgggttcaacgtgaagaacgttgctgtgaaggatctcaagcgtgggtacgtggcttccaactccaaggacgaccctgccaaggaggctgccagcttcacctcccaggttatcatcatgaaccaccctgggcagattggcaacgggtatgcgccagtgctggactgccacacctcccacatcgctgtcaagtttgctgagcttgtcaccaagatcgacagacgatctggtaaggagcttgagaaggagcccaagttcctgaagaacggtgatgctggtatggtgaagatgattcccacgaagcccatggttgttgagacattctctgagtaccctcctcttggtcgctttgctgttcgtgacatgaggcagacggttgctgttggcgtcatcaagagcgtggagaagaaggaccccaccggtgccaaggttaccaaggctgctgccaagaagaaatga

SEQ ID NO: 1381 - DNA, 1209 bp, Papaver somniferum
ttgtcgtcattggacatgttgactctggtaaatcgaccactactggtcacttgatctacaagcttggaggtattgacaagcgtgttattgaaagattcgagaaggaggctgctgagatgaacaagaggtcattcaagtatgcatgggttcttgacaagcttaaggctgaacgtgagcgtggtattaccattgatattgccttgtggaagtttgagaccaccaagtactactgcacagttattgatgctcctggacatcgtgactttatcaaaaacatgattactggtacttctcaggctgattgtgccgttctcattatcgattccaccactggaggttttgaggctggtatctcaaaggatggtcagactcgtgagcacgctcttcttgctttcactcttggtgtcaagcagatgatctgttgttgtaacaagatggatgccaccacccctaagtactcaaaggccaggtacgatgaaattgtcaaggaagtctcatcttacttgaagaaggttggatacaacccagacaaaattgcctttgttcctatctctggattcgagggagacaacatgattgagaggtccaccaaccttgactggtacaagggaccaactcttcttgatgctcttgacaatatctctgagccaaagagaccctcagacaagccccttcgtcttccccttcaggatgtttacaagattggaggtattggaactgtgccagtgggacgtgttgaaactggattcatcaagcctggtatggttgttacctttggacccactgggttgaccactgaagttaagtctgtggagatgcaccacgaagcccttcaagaagctcttccaggagacaatgttgggttcaatgtcaagaatgttgcagtgaaggatctcaagcgtggttttgtcgcctccaactccaaggacgaccctgccagggaagctgccaacttcacttcccaggttatcatcatgaaccatcctggtcagatcggtaacggttatgctccagtcctcgactgtcacacatctcacatcgctgttaagttcgctgagatcctcaccaagattgataggcgatctggaaaggagcttgagaaggagcccaagttcttgaagaatggtgatgctggtattatcaagatgcttccaaccaagcccatggttgtggagaccttctctcagtaccctcctcttggacgttttg

SEQ ID NO: 1382 - DNA, 1651 bp, Eschscholzia californica
ctcgcattggctaagggttttagacgaggcgctctagaagtatcttagcatctggtcaacatgggtaaagagaagattcatatcagtattgtcgtcattggacatgtcgactccggaaagtcgaccaccactggtcacttgatctacaagttgggaggtattgacaagcgtgttatcgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcactgttattgatgccccaggacatcgtgatttcatcaagaacatgattactggtacctctcaggctgattgtgctgtcctcatcattgactccaccactggaggttttgaagctggtatctctaaggatggacagacccgtgagcacgctcttcttgctttcacccttggtgtcaagcagatgatctgttgttgtaacagatggatgccatacccccagtactcgaaggcaaggtatgaagaaatcgtgaaggaagtctcatcttacttgaagaaggttggatacaacccagacaaaatcgcctttgttcccatctctgggtttgaaggtgacaacatgattgagagatccaccaaccttgactggtacaagggaccaacccttcttgaggcacttgaccagatcaatgagccaaagagaccctcagacaagccactccgtcttccacttcaggatgtttacaagattggtggtattggaactgtgccagtgggacgtgttgagactggagtcatcaagcccggtatggtcgtcacttttggccccactgggttgaccactgaggtcaagtccgtggagatgcaccacgaggctctccaggaagctcttccaggtgacaatgtcggattcaatgtgaagaatgttgctgtcaaggatctcaagcgtggtttcgttgcctccaactcaaaggatgacccagctagggaagctgctaacttcacctcccaggtcatcatcatgaaccaccccggtcaaattggtaacggatacgctccagttcttgactgccacacctcccacattgctgtgaagttcggtgagatcctcaccaagattgacagacgatctggaaaggagctcgagaaggagcccaagtttttgaagaatggtgatgctggtatggttaagatgcttccgaccaagcccatggttgtggagacctttgctgaatacccacccttggtcgttttgctgttagggatatgcgacagacagttgctgtggagtcatcaagagtgttgagagaaggatccatcaggtgccaaggtcactaagtcagctgccaagaagaagtgaaccgtgcaggtcaaccgcacagtagatttcttcgaacttcattcctccttttatcataaagacctattactttttagttgtttcgtcaaactattatgttttgtttgttgtcgatgtagctctctgccgtcaccttctatctccagcctctatgagaactgggtgttagacaggcggtggcagttgttacattgaacaaattctgtcgttaatttcgtcttttgtttttcaagtcaagagtgtggaactatac

SEQ ID NO: 1383 - DNA, 1479 bp, Secale cereale
gccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcccaagtactcgaaggcccgttatgaggaaattgtcaaggaagtctcttcgtacctgaagaaggtcggctacaaccctgacaaggttcccttcgtccccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggacgtttacaagattggtggcattggaactgtgcctgttggccgtgttgagactggtgtcatcaagcctggtatggttgttacctttggtcccactggtctgacaactgaggtcaagtctgttgagatgcaccacgagtccctcctggaggcgcttcctggtgacaacgttggcttcaacgtcaagaatgttgctgtgaaggatctgaagcgtgggtttgttgcatccaactccaaggatgaccctgccaaggaggccgccaacttcacctcccaggtcatcatcatgaaccaccctggtcagatcggcaacggctacgccccagtgctggactgccacacctcccacattgctgtcaagtttgctgagctggtgaccaagatcgacaggcggtctggtaaggagcttgaggcgctgcccaagttcctcaagaacggtgacgctggtatcgtgaagatgattcccaccaagccaatggttgtggagaccttcgccacctaccctcctcttggccgcttcgctgtgcgtgacatgagacaaacggttgctgttggtgtcatcaagggcgtggagaagaaggaccccaccggtgccaaggttaccaaggccgccatcaagaagaaatgagtgctctggtctcagccatcgagttatctagcagaagttttagtgtcaagtcttttggagaatcttagtgtatgttaagtgttgttcctgggcgttgttgcactttgactcctgcacttgtgtgcgagctatgatgtgtcgtttgaatactctattccgattccattattgtgctcttatcccatttgtgattttgtctgcttgtgttgaatgccagtagcgctagatggttatgattacctgcttccccactggggttctttgttgatgagcttgtttcctgtatgtgttgctttgtaattttgtctaggaacatcatgaacactt

SEQ ID NO: 1384 - DNA, 1688 bp, Trigonella foenum-graecum
ctcatctctacgctcattctcttccttgctgctagggttttagcgcatccttcaaaagaactttttgtggttttaagcttttaaggacaaatgggtaaggaaaaggttcacattaacattgttgtcattggccatgtcgactctgggaagtcaactaccaccggtcacttgatctacaagcttggaggtattgacaagcgtgttatcgagaggtttgagaaagaagctgctgagatgaacaagcgttcattcaagtatgcctgggtgctcgacaagctcaaggctgaacgtgaaagaggtatcacaattgacattgctctctggaagtttgagacaactaagtactactgcactgtcattgacgctcccggacacagggatttcattaagaacatgatcactgggacttcccaagctgattgtgctgttcttatcattgattccactaccggtggttttgaagccggtatttccaaggacggtcagacccgtgaacatgctctccttgctttcactcttggtgtgaagcaaatgatctgttgctgcaacaagatggatgcgaccacacccaagtactccaagggtaggtatgatgaaattgtgaaggaagtttcatcctatttgaagaaggttggttataacccagataaaattccgtttgttcccatctctggttttgagggagataacatgatcaaacgctctacaaaccttgactggtacaagggtccaacccttcttgaggcccttgaccaaatcaacgagccgaagagaccatcagacaagcctctccgactaccacttcaggatgtctacaagattggaggaattggaactgtgcctgtaggacgtgttgagactggtgtcttgaaacctggaatggtggtgacttttgctccaagtggactgacaactgaagttaagtctgtggagatgcaccatgaagctctcacggaggcccttcccggtgacaatgtgggatttaatgttaagaatgttgccgttaaggatctcaagcgtggttatgttgcctcaaactccaaggatgatccagcgaaggaggccgctaactttacatctcaagtgatcatcatgaatcaccctggccagattggaaatggctatgcacctgttcttgactgccacacctcccacattgctgtcaaatttgctgagcttgttaccaagattgacaggcgttctggaaaggagattgagaaggagcctaaattcttgaagaatggtgatgctggtattattaagatgattccaccaagcctatggtggttgagactttctccgaatatcctccacttggccgtttcgctgtgagggacatgcgtcaaactgtggctgttggggtcatcaaggctgtggagaagaaggatcctagtggaggacttaagccaactaagtcagcactgaagaaaaagtgaactgtgcaggatttctactgtcctgattacaataaatggtcaaggaatgtttatggtatgccgaagaaagaagtttcttttgacacttgtctgagttgtctaacacacgtcgtacgagtgtcatgtggatgttggacaccgatccatggagtgtcgaatattcctaaatagtaatcgtgaagttgaacaaataagtgtacatagccacacaaatttttgttctaggtctatatttattttatccttttattt

SEQ ID NO: 1385 - DNA, 1721 bp, Quercus alba
ctacaagcttggaggtattgacaagcgtgttattgagaggttcgagaaggaagctgccgagatgaacaagaggtcattcaagtacgcctgggtgcttgacaagctcaaggctgagcgtgagcgtggtatcaccattgatattgccttgtggaagttcgagaccaccaggtactactgcacggtcattgatgcccctggacatcgtgatttcatcaagaacatgattactggaacctcccaggctgattgtgccgtcctcattattgactccaccactggtggttttgaagctggtatttccaaggatggacagacccgtgagcatgctctccttgctttcaccctcggtgtcaagcaaatgatttgctgctgcaacaagatggatgccactacccccaagtactcaaaggctaggtacgatgaaatcgtgaaggaagtctcttcctacttgaagaaggttgggtacaaccctgacaagattccttttgtccccatctctggatttgagggtgacaatatgattgagaggtccaccaaccttgactggtacaagggtccaacccttcttgatgcacttgaccagatcaatgagccaaagaggccctcagacaagcccctccgtctcccacttcaggatgtttacaagattggaggcattggaactgtccctgtgggtcgtgttgagaccggtatcatcaagcctggtatggttgtgactttcggccccactggactgaccactgaagtaaagtctgttgaaatgcatcatgaggctctcctagaggctcttcctggtgacaatgttggcttcaacgttaagaatgttgctgtgaaggatctcaagcgtgggtttgttgcctccaactccaaggatgatcctgccaaggaggcagccaacttcacctcccaagttatcatcatgaaccaccctggccagattggaaatggttacgcccctgtcctcgattgccacacctcccacattgctgtcaaatttgctgagctcttgaccaagattgacaggcggtctggtaaggagcttgagaaggagcccaaattcttgaagaatggtgatgctggaatggttaagatgcttcccaccaagcccatggttgtggaaaccttttccgagtatcccccacttggtcgttttgccgtcagggacatgcgtcaaactgtggctgttggtgtcatcaagagtgtggagaagaaggatccatctggagccaaggtgaccaagtctgctgccaagaagaagtgaattgtgctgcacccagtttctgcaagtgctgggtatcgtagtccttacagtaaggactgggttcttgctattaatctatccatagaaggtctaagtgtttgttttgttggtaatagcttcaagtctctgccatcgtcatgtagcttcaattcccagaattgggtgcttgaccgacggtggcggggccatggagtatcctagtgttttttgatttgcttaaggtgtcatgtgagactatttattttcataagcagctatggagttttaggtctgttttcatgctgcccggatttttgctatttacatttatagttatctagtctgtgtgttttcaattgaacaatttttacttgctgcatctctactgatatgatttttaaggttcgctacttttattctttattatagatctttactggttgaattgttttcggaagaatagaccttattactggttgaa

SEQ ID NO: 1386 - DNA, 2015 bp, Nicotiana benthamiana
aatactctcattcatttttgcttctccttctgctgtgcggcaacagatctatatttgcttttaagtctttttttcaatcaacatgggtaaagagaaatttcacatcaacattgtggtcattggccacgtcgactctggtaagtcgactaccactggtcacttgatctacaaacttggtggtattgacaagcgtgtcattgagaggtttgagaaagaagctgctgagatgaacaagaggtcattcaagtatgcctgggtgcttgacaagctcaaggctgagcgtgagcgtggtatcaccattgatattgccttgtggaagtttgagaccaccaagtactactgcactgtgattgatgctcctggacacagggacttcatcaagaatatgattactggtacctcccaagccgactgtgctgtcctgattattgactccaccactggtggttttgaagctggtatctctaaggatggacagacccgtgaacatgcattgcttgctttcacccttggtgtcaagcaaatgatttgctgctgtaacaagatggatgctaccacccccaagtactccaaggctaggtacgatgaaatcgtaaaggaggtttcttcctacctcaagaaggtaggatacaaccctgacaaaatcccctttgtccccatctctggtttcgagggtgataacatgatcgaaagatcaaccaaccttgactggtacaagggcccaactcttcttgaggctcttgaccagattaatgagcccaagaggccctcagacaagcccctcaggctcccacttcaggatgtctacaagattggtggtattggtactgtccctgttggtcgtgtggaaaccggtatcctcaagcctggtatggttgtgaccttgaggctcttgaccagatcaatgagcccaagaggccctcagacaagcccctcaggctcccacttcaggatgtgtacaagattggtggtattggtactgtccctgttggtcgtgtggaaaccggtatcctcaagcctggtatggttgtgacttttggtcccactggtttgaccactgaagttaaatctgttgagatgcaccacgaagctcttcaggaggcacttcctggtgataatgttggattcaacgtcaagaacgttgcagtgaaggatctcaagcgtgggtttgttgcttccaactccaaggatgacccagctaagggtgctgccagctttacctcccaagtcatcatcatgaaccatccaggacagattggaaatggatatgctccagtgcttgactgccacacctcccacattgctgtcaagtttgcagaaattttgaccaagattgacaggcgttctggtaaggaaattgagaaggagcccaagttcttgaagaatggtgatgctggtatggttaggatgcttcccaccaagcccatggttgttgagaccttctctgagtacccaccattgggacgttttgctgtgagggacatgcgtcaaactgttgctgttggtgttatcaagaacgttgacaagaaggacccaactggtgccaaggtcaccaaggctgctcagaagaagaaatgaacgttgcagttcaattctggtggtattcgtgatatctactacaataaagtgtgttatggagacattgttttctctgcttgtgatgtttttgttctgtccttaatgtggttcttaggttgtagttttctgctttgtatgactggtatccgctcccagagttgggtgcttgacaggcggtggcgggaataactttgttgagtctgtctgcattttcttttgaggtaccttggttttccaaggtggcttggaagttttgtttgttatgttgcttaagatacttaattcggaacttatttatttttgtgttgaatatgttttcttatttctattctctggtagttttatatctttagctttttactggtacttgcttcctctttgatcttggtttaacttgttaccttctttagagtattcttgttatttcaacctgtgct

SEQ ID NO: 1387 - DNA, 1595 bp, Panicum virgatum
tatcgacaagcgtgtgatcgagaggttcgagaaggaagccgctgagatgaacaagcggtccttcaagtacgcgtgggtgcttgacaagctgaaggctgagcgtgagaggggtatcacaatcgatatcgccctgtggaagttcgagaccaccaagtactactgcactgtcattgatgcccccggacaccgtgacttcattaagaacatgatcacgggtacctcccaggctgactgtgctgtacttatcatcgactccaccactggtggttttgaggctggtatctccaaggatggccagacccgtgagcatgctctccttgccttcactcttggagtgaagcagatgatctgctgctgcaacaagatggatgccaccactcccaagtactccaaggcccgttatgatgagattgtgaaggaagtctcctcctacctgaagaaggtcggatacaatcctgataagattgccttcgtccccatctctggttttgagggtgacaacatgattgagaggtccacgaaccttgactggtacaagggaccaaccctgcttgaggctcttgaccagatcaacgagcctaagaggccttcagacaagcccctgcgtctcccccttcaggatgtgtacaagattggtggtattggaaccgtccctgttgggcgtgttgagactggtatcatcaagcctggtatggttgtgaccttcggtcccagcggcctgactactgaggtcaagtctgttgagatgcaccacgaggctctccaggaggcccttcctggtgacaatgttggcttcaacgtgaagaacgttgctgtgaaggatctgaagcgtgggtatgtggcctccaactccaaggatgaccctgccaaggaggctgccagcttcacctcccaggtcatcatcatgaaccaccctgggcagattggcaacggttatgccccagtgctggactgccacacctcccacattgctgtcaagttcgctgagcttattaccaagattgacaggcggtctggcaaggagcttgagaaggagcccaagttcctcaagaatggcgacgctggtatggtgaagatggttcccacaaagcccatggtggtggagacgttctctgagtaccctcctcttggtcgctttgctgtccgtgacatgaggcaaacggttgctgttggagtcatcaagagcgtggagaagaaggacccaaccggcgccaaggttaccaaggctgctgccaagaagaaatgatgcgcctggtgctttatcctgcgtctgcttttgctatacctagatgctattttattattataccagttttgtttgcatgtcatcgctgttatcgttgaacatttaaggtctgctggtggtgtgacatttgtatgtttaggtactgtcttcttatttcagcttaggcaaaacttgaatgctctgagacctatgtgtgtccattttggtggtggttggaatcgtctagttatatctttttgcatattgttcctgttttttcttctgggttaattggaatggtactattataatttttcaaggttggagatataccactacaattcttcatattgaaaatatgttactagaa

SEQ ID NO: 1388 - DNA, 1609 bp, Eschscholzia californica
ctttttctcgcattggctaagggttttagacgaggcgctctagaagtatcttagcatctgctcatcatgggtaaagagtaagattcatatcagtattgtcgtcattggacatgtcgactctggaaagtcgaccaccactggtcacttgatctacaagttgggaggtattgacaagcgtgttatcgaaagattcgagaaggaggctgctgagatgaacaagaggtctttcaagtacgcatgggttcttgacaagcttaaggctgaacgtgagcgtggtattaccattgatattgccttgtggaaatttgagaccaccaagtactactgcactgttattgatgccccaggacatcgtgatttcatcaagaacatgattactggtacctctcaggctgattgtgccgtcctcatcattgactccaccactggaggttttgaagccggtatctctaaggatggacagacccgtgagcacgctcttcttgctttcacccttggtgtcaagcagatgatctgttgttgtaacaagatggatgctaccacccccaagtactcaaaggcaaggtacgaggaaatcgttaaggaagtctcatcttacttgaagaaggttggatacaacccagacaaaatcgcctttgttcccatctctgggtttgagggtgacaacatgattgagagatccaccaaccttgactggtacaagggaccaacccttcttgatgcccttgaccaaatcaatgagccaaagagaccctcagacaagccactccgtcttccacttcaagatgtttacaagattggtggtattggaactgtgccagtgggacgtgttgagactggagtcatcaagcccggtatggttgtcacttttggccccactgggttgaccactgaggttaagtctgtggagatgcaccacgaggctctccaggaagcacttccaggtgacaatgtcggattcaatgttaagaatgttgctgtcaaggatctgaagcgtggtttcgttgcctccaactccaaggacgacccagccagggaagctgctaacttcacctcccaggttatcatcatgaaccatcctggtcagatcggtaacggatacgctccagttcttgattgtcacacctcccacattgctgtgaagttcggtgagatcctcaccaagattgacagacgatctggaaaggagctcgagaaggagcccaagtttttgaagaatggtgatgccggtatggttaagatgcttccaaccaagcccatggttgtggagacgtttgccgaatacccaccccttggtcgtttcgctgttagggatatgcgacagacagttgctgtgggagtcatcaagagtgtggagaagaaggatccatcaggtgccaaggtcaccaagtcagctgccaagaagaaatgagcaatgggaattggtttggcagtagaagcaacagggtcagagaggtagtagagagaaattttgttgggtaatggtttttatgatttgaatcagtctatgttttgtggtgttttaagttttctcgagaaccaaatttgtttggatattgaacttgttttaattttgaaattaatagaactgaggggacctctgtttgct

SEQ ID NO: 1389 - DNA, 1678 bp, Quercus alba
gagaggtttgagaaggaagctgctgagatgaacaagaggtcattcaagtatgcctgggtgcttgacaagctcaaggctgagcgtgagcgtggtatcaccattgatattgctttgtggaagtttgaaaccaccaagtactactgcacggtcattgatgctcctggacatcgtgatttcatcaagaacatgattactggaacctcccaggctgattgtgctgtccttattatcgactccaccactggtggttttgaagctggtatttccaaggatggacagacccgtgagcatgctctccttgctttcacccttggtgtcaggcaaatgatttgctgctgcaacaagatggatgccactacccccaagtactcaaaggccaggtacgatgaaatcgtgaaggaagtctcttcctacttgaagaaggttgggtacaaccctgacaagattccttttgtccccatctctggatttgagggtgacaatatgattgagaggtccaccaaccttgactggtacaagggtccaacccttcttgaggcacttgaccagatcaatgagccaaagaggccctcagacaagcccctccgtctcccacttcaggatgtttacaagattggaggcattggaactgtccctgtgggtcgtgttgagaccggtctcatcaagcctggtatggttgtgacttttggccccactggactgaccactgaagttaagtctgttgaaatgcatcatgaggctctcctagaggctcttcctggtgacaatgttggcttcaacgttaagaatgttgctgtgaaggatctcaagcgtgggtatgttgcctccaactccaaggatgatcctgccaaggaggcagccaacttcagctcccaagttatcatcatgaaccaccctggccagattggaaatggttacgcccctgtcctcgattgccacacctcccacattgctgtcaaatttgctgagctcttgaccaagattgacaggcgatctggtaaggagcttgagaaggagcccaaattcttgaagaatggtgattctggaatggttaagatgattcccaccaagcccatggttgttgaaactttctccgagtatcccccacttggtcgttttgccgtcagggacatgcgtcaaactgtggctgtcggagtcatcaagagcgtggaaaagaaggatccatctggagccaaggttaccaagtctgctgccaagaagaagtgaatcgtgctgcaccgggtttctgcaagtgatggctatcctaggtgttataataaggaatgggttcttgctagtaagctatcaatagtgtgtttaaggttttgtttagttggttattgcttcaagtctccaccttcatcacgcaggtgctgttctcagaactgggtgcttgaccggcggtggcgaggcagctgtgtttttgagtcctaagtatttattctgcttttttttttttttttaatgttgtcctgtgagacttatatttattttcataagcagctatggagttttaggtctgttcctaagctgccgggatgattactatttacatttataattaagtaagttattgtgtgtttttatttaaatctctctcgtcgaatgagtttggaacaggattatctccatttcgtccaatggaataaatttaaaatggagatgaactagctgcaac

SEQ ID NO: 1390 - DNA, 1285 bp, Secale cereale
gaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcccaagtactcgaaggcccgttatgaggaaattgtcaaggaagtctcttcgtacctgaagaaggtcggctacaaccctgaccaaggttcccttccttccccatctctgggtttgagggtgacaacatgattgacaggtccaccaaccttgactggtacaagggccctaccctcttgaggctcttgaccagatcaacgagcccagaggccctcagacaagcccctgcgtcttccccttcaggacgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaatgttggcttcaacgtcaagaatgttgctgtgaaggatctgaagcgtgggtttgttgcatccaactccaaggatgaccctgccaaggaggccgccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgacgctggtatcgtgaagatgattcccaccaagcccatggttgtggagacctttgccacctaccctcctcttggccgcttcgctgtgcgtgacatgagacaaacggttgctgttggtgtcatcaagggtgtggagaagaaggaccccaccggtgccaaggttaccaaggccgccatcaagaagaaatgagtgctctggtctcagccatggagttatctagcagtaagtttagtgtcaagttcttttggagtatcttagtgtatgttaagtgttgttcgtggtcgttgttgctactttgactcctgctacttgtgtgcg

SEQ ID NO: 1391 - DNA, 1613 bp, Gossypium hirsutum
cttcttctgcttctagtcaagccaatctcaaaagactccccttttagctcacagctcctctcttgagtactataatgggtaaaggagaaggttcacatcaacattgtggtcatcggccatgtcgactctgggaagtctacaaccactggtcatttgatctacaagcttggtggtattgacaagcgtgtgattgagaggtttgagaaggaggctgctgagatgaacaaaaggtcatttaagtatgcatgggtgcttgacaagcttaaggccgaacgtgaacgtggtattaccatcgatattgccctctggaagtttgagactaccaaatactactgcacagtcattgatgcccctggacaccgtgacttcatcaagaacatgattactggtacctcacaggctgactgtgctgttctcattatcgactcgaccactggtggtttcgaagctggtatctcaaaggatggtcagacacgtgagcatgctttgcttgcgtttacccttggtgtcaagcagatgatttgctgctgcaacaagatggatgcaacaactccaaaatactccaaggcaaggtatgatgaaattgtgaaggaagtctcctcatatcttaagaaagttggttacaaccctgacaagatcccatttgtcccaatctctggatttgagggtgataacatgattgagaggtctaccaaccttgactggtacaagggtcccactctccttgaggctcttgaccagatcaatgagcccaagaggccttcagacaagccactccggctcccacttcaggatgtctacaagattggtggcattggaactgtccctgttggtcgtgttgagactggtgtccttaagcctggtatggtagtgacctttggcccctctggtctgaccactgaagttaagtctgttgagatgcaccatgaagctctctctgaggctctccctggtgacaatgttggattcaacgtcaagaacgttgctgttaaggatctcaagcgtggtttcgttgcttcaaactctaaggatgatcctgcaaaggaggctgccagcttcacctctcaggtcatcatcatgaaccaccctgggcagattggaaacggatatgccccagtccttgactgccatacctcccacattgctgtgaaattttccgaattgctgaccaagatcgacaggcgatctggaaaggagcttgagaaggagcccaagttcttgaagaatggtgatgcagggatgataaagatggttcccaccaagcctatggttgtggagactttctctgagtacccaccccttggtcggtttgctgtcagggacatgcgtcagactgtggctgttggtgtcatcaagagcgttgagaagaaggatccaaccggtgctaaggtcaccaaatctgctgccaagaagaaatgagattgcatttgagatgccaggatagtttctaagttttggtcttattttttgtctggtagtaattgtatggaaatattttgaccattttttatatgctttatcgtgtattgttttggttccgaaatttatcaagaattgttcaattgtcttgtttaacttttcctggttaattttagattaaggtaccgtgtttt

SEQ ID NO: 1392 - DNA, 1434 bp, Eschscholzia californica
aaagattcgagaaggaggctgctgagatgaacaagaggtcattcaagtatgcatgggttcttgacaagcttaaggctgaacgtgagcgtggtattaccattgatattgccttgtggaagttggagaccaccaagtactactgcactgttattgatgccccgggacatcgtgatttcatcaagaacatgattactggtacctctcaggccgattgtgctgtcctcatcattgactccaccactggagggtttgaagctggtatctctaaggatggacagacccgtgagcacgctcttcttgctttcacccttggtgtcaagcagatgatctgttgttgtaacaagatggatgctactactcccaagtactccaaggcaaggtatgaggaaatcgttaaggaagtctcatcatacttgaagaaggttggatacaacccagacaaaatcgcctttgttcccatctctgggtttgagggtgacaacatgattgagagatccaccaacctcgactggtacaagggaccaacccttctagacgcccttgaccagatcaatgagccaaagagaccctcagacaagccactccgtcttccacttcaggatgtttacaagattggtggtattggaactgtgccagtgggacgtgttgagactggagtcatcaagcccggtatggttgtcacttttggccccactgggttgaccactgaggttaagtctgtggagatgcaccacgaggctctccaggaagctcttccaggtgacaatgtcggattcaatgtgaagaatgttgctgtcaaggatctcaagcgtggtttcgttgcctccaactccaaggatgacccagccagggaagctgctaacttcacctcccaggtcatcatcatgaaccaccctggtcagatcggtaacggatacgctccagttcttgattgtcacacctcccacattgctgtgaagttcggtgagatcctcaccaagattgacagacgatctggaaaggagctcgagaaggagcccaagtttttgaagaatggtgatgccggtatggttaagatgcttccaaccaagcccatggttgtggagacctttgctgaatacccaccccttggtcgtttcgctgttagggatatgcgacagacagttgctgtgggagtcatcaagagtgtggagaagaaggatccatcaggtgccaaggtcaccaagtcagctgccaagaagaaatgagcaatgagaattggtttggcagtagaagcaacagggtcagagaagtagtagagagaaattttgttgggtaatggtttttatgatttgaatcagtctgttttgtggttgttttagtttttatctaagtaacctaaatttatttggattattgaactattgttttacttttagtaaattaatagtaactgaggggtacctcgtgtttacg

SEQ ID NO: 1393 - DNA, 1380 bp, Setaria italica
cctctagccatgggcaaggagaaggtccacatcaacatcgtggtcatcggccatgtcgactccggcaagtccacgaccaccggccacctcatctacaagctcggaggcatcgacaagcgcgtcatcgagaggttcgagaaggaggctgccgagatgaacaagaggtccttcaagtacgcctgggtcctcgacaagctcaaggccgagcgcgagaggggcatcaccattgacattgccctctggaagttcgagaccaccaagtactactgcaccgtgatcgacgctcccggacaccgcgacttcatcaagaacatgatcaccggcacctcccaggctgactgtgccgtgctcatcatcgactccaccaccggtggctttgaggccggtatctccaaggatggccaaacccgtgagcacgccctccttgccttcactcttggtgtcaggcagatgatctgctgctgcaacaagggtgacaacatgatcgagaggtcgacgaacctggactggtacaagggccccaccctcctcgaggcgctggaccagatcaacgagccgaagcggccgtcggacaagcccctccgccttcccctgcaggacgtttacaagatcggcggcatcggcaccgtcccggtgggccgcgtggagaccggcgtcctgaagcccggcatggtggtcaccttcgcgcccaccggcctgacgacggaggtgaagtcggtggagatgcaccacgagtcgatgcaggaggcgctgccaggcgacaacgtcgggttcaacgtgaagaacgtggcggtgaaggacctgaagcgcggctacgtggcgtccaactccaaggacgaccccgccagggaggccgccggcttcacggcgcaggtgatcatcatgaaccacccggggcagatcgccggcggctacgcgccggtgctggactgccacacgtcccacgtcgccgtgaggttctcggagctgctgaccaagatcgacaggcgctccggcaaggagctcgagagcggccccaagttcctcaagaacggcgacgctgggctcgtcaagatggtcccgaccaagcccatggtggtggagacgttctccgagtacccgccgctggggaggttcgccgtgcgcgacatgaggcagacggtggccgtgggcgtgatcaagagcgtggagaagaaggacccgacgggagccaaggtcaccaaggctgcggcgaagaagaaataaatggtcgatccgtggatgatatttacatcatatagatagtattttggctagaaagtttacattactgctactattggttgtttgggtctctcgcagtgttttttaaagtatgtgtcggttctagaatcaatacaacctgtccagcatacaacctgc

SEQ ID NO: 1394 - DNA, 1486 bp, Flaveria ramosissima
ttattgagagattcgagaaagaagctgctgaaatgaacaagaggtcattcaaatacgcatgggttcttgacaaactaaaggctgagcgtgaacgtggtatcactattgatattgctctgtggaagtttgagaccaccaagtactactgtactgttattgatgctcctggacatcgtgatttcatcaagaacatgatcactggtacctctcaggctgattgtgctgttctgatcattgactcaaccactggtggttttgaagctggtatttctaaagatggtcagacccgtgaacatgctttgcttgccttcacccttggtgtgaagcaaatgatctgctgctgtaacaagatggatgccactacccccaagtactctaaatcaaggtatgaggaaattgtcaaggaagtctcatcttacctgaagaaggttggctacaaccctgacaaaattccatttgtacccatctctggatttgagggtgacaacatgattgagaggtcaacaaacctcgactggtacaagggtccaactcttctagaagctcttgaccagatcaacgagcctaaaagaccatctgacaaaccacttcgtctaccacttcaagacgtgtacaagattggtggtattggaactgtgcctgttggacgtgttgaaactggtgtcatcaaacctggtatggttgtcacttttggtccatctgggttgaccactgaagttaagtctgttgagatgcaccatgaggcactaaccgaagctctccctggtgacaacgttgggttcaatgtcaagaacgttgctgtcaaggatctgaaacgtggttatgttgcatccaactcaaaggatgaccctgctaagggtgcagccagtttcacctcgcaggtcatcatcatgaaccaccctggtcagattggaaacggctatgcccctgttctggattgccacacctctcacattgcagtcaagttttctgagcttttgaccaaaatcgacagacggtctggtaaagagctggaaaaggagcccaagtttttgaaaaatggtgatgccgggatggttaagatgcttcccactaagcctatggttgttgagacttttgccgagtacccaccacttggtcgatttgctgttcgtgacatgcgtcagacggttgctgttggtgtgatcaagagtgtggagaagaaagacccaactggagctaaggtgaccaaggctgcagtcaagaagggagctaaatgatggggttggagtgttttgttatcgaacgacgatggagcttttatcgtattttggaactacctttattatgtttatttttggttaagaatttttggtgtttggtcttcttggtgcttgcatttctgtactctagcctcactttgtgaggatggtggaggtattgagcaacttgttgcttgatgacggtggtgcaagttaccagaggacaacttttgtttgaatggttatgttgaacttctatgctttaa

SEQ ID NO: 1395 - DNA, 1377 bp, Flaveria ramosissima
tgttattgagagatttgagaaagaagctgctgaaatgaacaagaggtcattcaaatacgcatgggttcttgacaaactaaaggctgagcgtgaacgtggtatcaccattgatattgctttgtggaagtttgagaccaccaagtactactgtactgttattgatgctcctggacatcgtgatttcattaagaacatgattactggtacctctcaggctgattgtgctgttctgatcattgactcaaccactggtggttttgaagctggtatttccaaagatggtcagacacgtgaacatgctttgcttgccttcacccttggtgtgaagcaaatgatctgctgctgtaacaagatggatgccactacccccaagtactctaaggcaaggtatgatgaaattgtcaaggaagtctcatcctacctgaagaaggttggctacaaccctgacaaaattccatttgtacccatttctggatttgagggtgacaacatgattgagaggtcaacaaaccttgactggtacaagggtccaactcttctggaagctcttgaccagattaacgaacctaaaagaccatctgacaagccacttcgtctaccactacaagatgtgtacaagattggtggtattggaactgtgcctgttggacgtgttgaaactggtgtcatcaaacctggtatggttgtcacttttggtccatctgggttgaccactgaagttaagtcagttgagatgcaccacgaggcactgactgaagctctccctggtgacaatgttgggttcaacgtcaagaacgttgctgtcaaggatctgaagcgtggttatgttgcatccaactcaaaggatgaccctgctaagggtgcagccagtttcacctcacaggtcatcatcatgaaccaccctggtcagattggaaacggttatgccccagttctggattgccacacctctcacattgcagtcaagttttctgagcttttgaccaaaatcgacagacggtctggtaaagagctggaaaaggagcccaaatttttgaagaatggtgatgccgggatggttaagatgcttcccactaagcccatggttgttgagacttttgctgagtacccaccacttggtcggtttgctgttcgtgacatgcgtcagactgttgctgttggtgtgatcaagagcgtggagaagaaggacccaactggagctaaggtgaccaaggctgcagtcaagaagggagctaaatgatgggattggagcggtttgttatcgaatgatgatggagcttttatcgtattttggaactatctttattatgtttatttttggttaagaatttttggtgtttggtcttcttggtgcttgcatttctgtactctagcctc

SEQ ID NO: 1396 - DNA, 1548 bp, Musa acuminata
agcaatgggaaaggagaaggttcacattaacattgtggtcattggccatgtcgattctggaaaatctacaacaactggacatctcatctacaaacttggtgagcgtggcatcaccattgatattgctttgtggaaatttgagaccacaaagtactattgcacagtcattgatgctcctggccatcgtgatttcattaagaacatgattacaggaacttctcaggctgattgtgctgttctcatcatcgactccacaactggtggatttgaagcaggtatatcaaaggatggtcagacccgtgagcatgctcttcttgctttcactcttggtgtcaaacagatgatatgctgctgcaacaagatggatgccacaactcccaaatactaaaggcacgatatgatgaaattgtcaaggtggtctcatcctacttgaagaaagttggctacaaccctgagaagattccttttgtccccttatctggttttgaaggtgataatatgattgagaggtccaccaaccttgactggtacaagggcccgactctccttgatgcccttgatatgattcaagagcccaagcgtccaacgtacaaagccccttcgtcttcccctgcaggatgtctacaagattggaggcatcggaaccgtgcctgttggtcgtgttgaaactggaatcctgaagccaggtatggtcgtcacctttggtcccacgggactcacaactgaagtcaagtctgtggagatgcaccatgaggcactccaagaagcgttacctggcgacaacgttggcttcaatgtcaagaatgttgctgtgaaggatttgatttgaaacgtggttatgttgcctcaaactcgaaggaagacccaacaaaggaggctgccagcttcacctcacaagttatcatcatgaaccatccaggtcaaattgggaatggttatgctcctgtattggattgccacacctctcacattgcagtcaaatttgctgagttgctaaccaagatcgacaggtgatctggcaaggcgctggaaaaggagcccaagtttcttaagaatggtgatgcaggttttgtaaagatgattcccactaagccgatggtggtggagaccttctccgagtaccctcctctgggtaggttcgctgtaagagacatgagacagactgttgctgtaggtgtcatcaagagtgtggagaagaaggatccaacaggagccaaggttacaaaagcagcacagaaaaagaaatgaaagtggaattgtggatcattgcagtctggagtcattattggtcgtggtgttgtgtgttcatgcccttctcttgaggactctgcaggtgtggtatctggacccagaactgggttctcgacaggcagcggcggggttgaagatccggcgtctattttgttgtttaatgtcaactaacgagttttcggaaatctactaaatgtaaggactgtattgcagtgacttgtgttattgtctggtactctgtttcctaaatttacttgctgactatgctgctataacatatggatttccagtatttag

SEQ ID NO: 1397 - DNA, 1522 bp, Amorphophallus konjac
aagaggtcattcaagtatgcttgggtgcttgacaagctgaaggctgagcgtgagcgtggtattacgattgatattgctctctggaaattcgagaccacaaaatactactgcaccgtgatcgatgcgccggggcacagagatttcatcaagaacatgatcacaggaacttctcaagcagactgtgcagttctcattatcgattccactactggtggttttgaagctggcatttccaaggacggtcagactcgcgagcatgcgctgcttgctttcacacttggagtgaagcagatgatttgttgttgcaacaagatggatgccaccactcccaagtattcaaaggcaaggtatgatgaaatcgtgaaggaggtgtcatcttacctcaagaaggtggggtacaaccctgataagatcccattcgtcccgatctccggatttgagggcgacaacatgattgagaggtccaccaacctcgactggtacaaggggcccactctactcgaagccttggacttgatccaggagccaaagcgccctacggacaagccccttcgccttcccctccaggatgtctacaagattggaggcatcgggacggtgcccgtgggccgtgttgaaactggagtcctcaagcctggtatggtcgttacctttggcccgactggcctgaccactgaagtcaagtctgttgagatgcatcatgaagccctcccggaggccctccccggtgacaacgtgggcttcaacgtcaagaacgttgctgtgaaggatctgaagcgtggtttcgtggcatccaactccaaggatgaccccgctaaggaggccgcgaacttcacctcccaggtcatcatcatgaaccacccgggccagatcggcaatggctacgccccggtccttgactgccacacctcacacattgccgtcaagtttgcggagatcctgacaaagatcgataggcgttctggtaaggagctggagaaggagcccaagttcctgaagaatggcgatgctgggtttgtgaagatgatccccaccaagcccatggtggtggagactttctccgagtaccccccacttggtaggtttgccgtgagggacatgaggcagacggtcgcggtcggtgtcatcaaggccgtggagaagaaggatccaagcggcgccaaggtgaccaaggctgcccagaagaagaagtgaaccgaaaccgtattgctgctctctgcacctacggtggtggtggttgttgagcctacttccattttatgtcgtcgtcgtcgtcgtcgcagtgtcaagtgtgctagttttgctttttgtgtgttgtccgtggatttcctgtccagcatttggatgcagaactgggttctagactggcggtggcaggggtaaaagaagagggctttgattgcttgcccctgcggcgttcagcccttacgctttggccaccacctcttctctttcattcgagtcatttttctgttgtgcttttattgttgatgcggtctgcagactttttacatccatcaat

SEQ ID NO: 1398 - DNA, 1252 bp, Flaveria ramosissima
tcatcactctccacaaatcggctagcagattattccccaagctgtgccagcttttttgatatctcagaatgggtaaggaaaagactcacatcagcattgtggtcattggacatgtcgactccggcaagtcaacgaccactggccatttgatttacaagcttggaggaattgacaagcgtgttatcgagaggtttgagaaagaagcggctgaaatgaacaagaggtcattcaagtacgcctgggttcttgacaaactgaaagctgaacgagaacgtggaattaccattgatattgctttgtggaagttcgagactaccaagtactattgcactgttattgatgcacccgggcacagagatttcatcaagaatatgattactggtacatctcaggcagattgtgctgtcttgattatcgactcgactactggtggttttgaagctggtatctctaaagatggtcagacccgagagcatgctctgcttgcttttactcttggtgtgaagcaaatgatctgctgttgtaacaagatggatgccaccactcctaaatactccaaatcaagatatgaagaaattgttaaggaagtttcttcatacttgaagaaggttggttacaacccagacaaaatcccatttgtacccatctccggtttcgagggtgacaacatgattgagaggtctacaaaccttgactggtacaagggtccaacacttcttgaagctcttgaccagatcaacgagccaaaaagaccctctgacaaaccacttcgtctaccccttcaagacgtgtacaagattggaggtattggaactgtgcccgtcggtcgtgtcgaaaccggtgtaatcaaacccggtatggttgtcacttttggtccatctgggttgaccactgaagtcaagtcagtcgaaatgcaccacgaggccctaaccgaagctctccctggtgacaacgtcgggttcaacgtcaaaaacgttgcagtcaaggatctgaaacgtggttacgttgcttccaactccaaggatgaccccgccaagggtgcagccagtttcacctcacaggtcatcatcatgaaccaccctggtcagatcggaaacggatatgccccagtcctggattgccacacttctcacattgcagtcaagttctccgagcttttgaccaagattgaccgtcggtccggtaaagaacttgagaaagagcccaagtttttgaagaacggtgatgctggtatggttaagatgcttccaac

SEQ ID NO: 1399 - DNA, 1184 bp, Pennisetum glaucum
caagtacgcgtgggtgctcgacaagctgaaggctgagcgtgagagaggtatcaccatcgacattgccctgtggaagtttgagaccaccaagtactactgcacggtcatcgatgcccctggtcaccgtgacttcatcaagaacatgattaccggtacctcccaggccgactgtgctgtcctcatcattgactccaccactggtggttttgaggctggtatctctaaggatggccagacccgtgagcatgctctccttgctttcactcttggagtgaagcaaatgatctgctgctgtaacaagatggatgccaccactcccaagtactccaaggcccgttatgatgagattgttaaggaagtctcctcgtacctcaagaaggtgggttacaacccagacaagattgccttcgtccccatctccggtttcgagggtgacaacatgattgagaggtccaccaaccttgactggtacaagggcccaaccctgcttgaggctctggaccagatcaacgagcccaagaggccctccgacaagcccctgcgtctcccccttcaggatgtgtacaagatcggtggtattggaactgtccctgttggccgtgttgagactggtgtgatcaagcctggtatggttgtcacctttggtccaactggcctgactactgaggttaagtctgttgagatgcaccacgaggctctccaggaggcccttcccggtgacaatgttgggttcaacgtgaagaacgttgctgtgaaggatctcaagcgtgggtacgtggcctccaactccaaggacgaccctgccaaggaggctgccagcttcacctcccaggttatcatcatgaaccaccctgggcagattggcaacgggtatgccccagtgctggactgccacacctcccacatcgctgtcaagtttgctgagcttgtcaccaagatcgacagacgatctggtaaggagcttgagaaggagcccaaattcctgaagaatggtgatgctggtatggtgaagatgattcccacgaagcccatggttgttgagacattctctgagtaccctcctcttggtcgctttgctgttcgggacatgaggcagacggttgctgttggtgtcatcaagagcgtcgagaagaaggaccccactggtgccaaggttaccaaggctgctgccaagaagaaatgag

SEQ ID NO: 1400 - DNA, 1380 bp, Papaver somniferum
ctaagcttggaggtattgacaagcgtgttattgagagattcgagaaggaagctgctgagatgaacaagaggtctttcaagtacgcctgggtgcttgacaagcttaaggctgaacgtgagcgtggtatcaccatcgatattgctctatggaagtttgagaccaccagatactactgcacagtcattgatgctcctggacatcgtgactttatcaagaacatgattactggtacctctcaggctgactgtgctgtccttattattgattccaccactggtggttttgaagccggtatctccaaggatggacagacccgtgagcatgctcttcttgctttcacccttggtgtcaagcagatgatctgttgttgtaacaagatggatgccaccacccccaagtactccaaggctaggtacgatgaaattgttaaggaagtctcatcctacctgaagaaggttgggtacaacccagacaaaattgcctttgtccccatctctggtttcgagggagacaacatgattgagaggtctaccaaccttgactggtacaagggaccaaccctccttgaggcccttgaccagatcaatgagcccaagagacccacagataagcccctccgtcttccacttcaggatgtttacaagattggtggtattggaactgtgccagtgggacgtgttgaaactggtttgatcaagcctggtatggttgtcacttttggccctactggtttgaccactgaagttaagtctgtggagatgcatcatgaggctctcctggaagctcttccaggtgacaatgttgggttcaacgtcaagaatgttgctgtgaaggatctcaagcgtgggtttgttgcctccaactccaaggatgaccctgccagggaagcggccaacttcacctcccaggtcatcatcatgaaccaccctggtcagatcggtaacggttatgccccagtgctcgactgccacacttcccacattgctgtgaagttcggtgagatcctcaccaagattgacaggcgatctggaaaggagcttgagaaggagcccaagttcttgaagaatggagatgctggtattattaagatgcttcccaccaagcctatggttgtggagaccttcgctgaatacccaccacttggacgttttgctgtgagggacatgagacagacagttgctgttggagttatcaagagtgttgagaagaaggatccatctggtgccaaggttaccaagtctgctgccaagaagaagtagacgttggatgttgagcagcaggtaagagtagcctcatcagcagcagggttatcttttgccattcatctatattttctcaattttgttttggtaatgattttgtgactggtatcggtttatt

SEQ ID NO: 1401 - DNA, 1614 bp, Thalictrum flavum
atttgagaagaggctgctgagatgaacaaaaggtcattcaagtatgcctgggttctggacaagcttaaggctgaacgggaacgtggtatcaccattgacattgctctatggaagtttgagaccaacaagtactactgcactgtcattgatgctcctggccatcgtgatttcatcaagaacatgattactggtacctcccaggcagattgtgctgtcctcattattgactctaccactgggggttttgaagctggtatttccaaagatggtcagacccgtgagcatgctcttcttgccttcacacttggagtcaagcagatgatttgctgctgtaacaagatggatgccacaactccaaagtattcaaaggctaggtatgaggaaattatcaaggaagtatcttcatacctgaagaaggttggctacaaccctgacaaattccctttgttcccatctctgggtttgagggtgacaacatgattgagagatctaccaaccttgactggtacaagggaccaaccctccttgaggcacttgacttgatatcagaacccaagagacccacagacaagcctcttcgtctcccacttcaggatgtttacaagatcggtggaattggaactgtaccagtcggtcgtgttgagactggtttgctgaaacccggtatggtgatcacctttggccctactggattgaccactgaagttaagtcggttgagatgcaccacgaggctctccaggaggccctgccaggtgacaatgttggttttaatgtgaagaatgttgctgtcaaggatcttaaacgtggatttgttgcatccaactcaaaggatgatcctgctaaggaagccgccaactttacctcccaggttatcatcatgaatcaccctggtcagataggaaacggatatgcccctgttcttgactgccacacttcccacattgctgtcaagttcggtgagattcttaccaagattgacaggcgatcaggaaaggagattgaaaaggagccgaaatttctcaagaatggtgatgcagggtttgttaagatgattccatctaagcctatggttgttgagactttctctgagtacccaccacttggacgttttgctgtgagggacatgcgtcagactgttgctgttggagtcatcaagagtgtggagaagaaagacccaactggagccaaggtcacaaagtctgcagtcaagaagaaatgatccaagcatttcagtggtgaggttgttttgttggcttttgctgccattattttaaaaacttggtacttggtagtgtagttttgttgaatgtttagattgatgttggtactggctcttgccatttgcctttaccttttttgagcagtcattcccagaattgggtgctcgataggcggtggtatagctattacatctcatattttgtgttgttgtaagaattttgtttccttggtttaatcttgttgaaggtgaaattcaagagttgataaacacttgatatcctgccctggtagttctggagcacgttagcgatcttacttatctagttaattttcttattgtctgttttcagtcatctactatttggtttgcttgtttaaaattctgaaacagt

SEQ ID NO: 1402 - DNA, 1583 bp, Ambrosia trifida
caggatgggtaagaaaagattcacatcagcattgtcgtcattggacatgtcgactctggcaagtcaaccactacaggccacttaatctataagttgggaggaatcgataagagagttatcgagaggtttgagaaagaagctgctgaaatgaacaaaaggtctttcaagtacgcctgggttcttgacaaactcaaggccgagcgagaacgtggaatcacaatcgatattgcattgtggaaatttgagaccaccaagtactactgtaccgtcattgatgctcctggacatcgtgatttcattaagaacatgattactggtacatctcaagctgattgtgctgtcttgattattgactctaccactggtgggtttgaagctggtatctctaaggatggtcagacccgagaacatgctctgcttgctttcactcttggtgtgaagcaaatgatctgctgttgtaacaagatggatgcaaccactcctaagtactccaaggcaaggtacgacgaaattgtgaaggaagtctcttcttacctaaagaaggttggttacaatcccgacaaaatcccatttgttcccatctctggttttgagggtgacaacatgattgagaggtcgacaaacctcgactggtacaagggcccaacccttcttgaagctcttgaccagatcaacgagcccaagagaccctcagacaagccacttcgtctcccacttcaggatgtgtacaagatcggtggtattggaactgtgccagtgggacgtgttgagactggtgtgatcaagcctggtatggttgttacctttggaccatctgggttgacaactgaagttaagtctgtagagatgcaccatgaagctctgcaagaggctcttcctggtgacaacgttgggttcaatgtcaagaacgttgcagtcaaggatctgaaacgtgggtatgttgcttccaactccaaggatgacccagctaagggtgcagccagtttcacctcacaggtcatcatcatgaaccaccctggtcagattggaaacggttatgctccagttctcgattgccacacttctcacatcgctgtcaagttctccgagcttttgaccaagatcgacagacgatccggaaaagagcttgagaaagagcccaagtttttgaagaacggagatgcaggtatggttaagatgcttccaaccaagcccatggttgttgagactttcgcagagtacccacctcttggtaggtttgctgttcgtgacatgaggcagacggttgccgttggtgtgatcaagagtgttgacaagaaggacccgactggagctaaggtgaccaaggctgcagtcaagaagggtgccaagtgaatctgctggaccgatgaagctgttttaagtgcgtatttgaacaattttaattatgtttattttgtgtcaaggatttttggtattatgtgttgtggcttgcattcctgtactctagcctcgcttgcggggatggggtggaggtattgagcaacctgttgcttgatggacggtagtgctaagtttacaaacatcagattttgacttattgtgacttaaaaactaaataatta

SEQ ID NO: 1403 - DNA, 1553 bp, Ambrosia trifida
actcttcgtgttcccccatctatcacacaaatcatctgagtcatcttttgtttaaggatggtaggaaaagattcatatcagtattgttgtcattggacatgtcgactccggcaagtcgacaacaaccggtcacttgatctataagctcggcggtatcgataaaagagttatcgagcggttcgaaaaggaagccgctgaaatgaacaagaggtcattcaaatacgcttgggttcttgacaaacttaaggctgagcgtgaaagaggtatcacaattgacattgcattgtggaagttcgagaccacgaagtattactgtacggttatcgatgctccggggcatcgggatttcattaagaacatgattactggtacctcacaggctgattgtgctgtgcttattattgattcgactactggtgggtttgaagctggtatttctaaagatgggcagacgcgtgaacacgcgcttcttgctttcactcttggtgtcaagcaaatgatttgttgctgtaataagatggatgctaccacacctaagtactcgaaggcaaggtacgatgaaatcgttaaggaagtgtcatcgtacttgaagaaggtcggatacaacccggacaaaatcccatttgttccaatctctggatttgaaggagataatatgattgagaggtctactaaccttgactggtacaagggaccaacgcttcttgaagcgcttgaccagattaatgagcccaagagaccgtcggacaagcctttacgtcttccgcttcaggatgtgtacaagattggtggtattggaactgtgccggtgggacgtgttgagaccggtgttatcaagcctggtatggttgttactttcggaccgtctgggttgactactgaagttaagtcagttgagatgcatcacgaagcgttgcaagaggctcttcccggtgacaatgttgggtttaatgttaagaacgttgcggttaaggatctcaagcgtggttatgtcgcatcgaactctaaggatgaccccgccaagggagctgctagcttcacctcacaagtcatcatcatgaaccaccctggacagattggaaacggttacgcgccggttcttgattgccacacttcccacattgctgtcaagttctccgagcttttgaccaagatcgacagacgatctggaaaggagcttgagaaggagccgaaattcttgaagaatggtgacgccgggatggtaaagatgcttcccaccaagccgatggttgttgagactttcgccgagtacccaccacttggaaggtttgccgtgagagacatgcgtcaaacggttgctgttggtgtgatcaagagcgtcgacaagaaggacccgactggagccaaggtgaccaaggctgcagtgaagaagggagccaagtgaggtggcttgtgtttggattattttattttcagttgtttggttttactagttttgaacaattgaggttttggtattcaaatctttgaatctttcatcttcgtgaaaggtttatgggttgcagacttttgtttggttaattttatagttg

SEQ ID NO: 1404 - DNA, 1586 bp, Ananas comosus
attcgagaaggaagccgctgagatgaacaagaggtcgttcaagtatgcttgggtgctcgacaagcttaaggctgagcgtgagcgtggtatcactattgatattgctctctggaaattcgagaccaccaaatactattgcacagtcattgatgcccccggacaccgtgactctatcaagaacatgatcacggggacctcccaggcggactgtgctgtcctcatcattgattccaccactggtggttttgaggctggtatctccaaggacggccagactcgtgagcatgctcttcttgcgttcactcttggcgtgaagcagatgatctgttgttgtaacaagatggatgccacgacccccaagtactcgaaggcgagatatgatgaaattgttaaggaagtctcctcctaccttaagaaggttgggtacaaccccgataagattccctttgtgcccatctctggtttcgagggtgacaacatgattgagcgctccaccaacctggactggtacaagggtcccacccttcttgaggccctggacttgatccaggagcccaagcgccccacagacaagcccctccgccttccgctgcaggacgtctacaagattggtggtattggcaccgtccctgtgggccgtgtcgaaactggtgtcctcaagcccggtatggttgtcacctttggacctactggcctaacgactgaagttaagtcggtcgagatgcaccacgaggccctccaggaggctctccccggtgacaatgttggcttcaacgtgaagaacgttgccgtgaaggacttgaagcgtggctttgttgcctccaactccaaggatgaccctgccaaggaggctgccaactttacctctcaggtcatcatcatgaaccaccctggtcagatcggcaatggctatgctcctgttcttgactgccacacttcccacattgccgtcaagtttgccgagatcttgaccaagatcgaccgtcgctccggtaaggagcttgagaaggagcccaagttcttgaagaatggagatgctggattcgtcaagatggttcctactaagccaatggtgatggagacgttctctgagtacccgcccttgggtaggtttgctgtgagggacatgaggcagacggtggccgttggtgttatcaagagtgtcgagaagaaggatcccagtggagccaaggtcacgaaggctgctcagaaaaagaaatgaaccgcggaggagatcggggtgtcagttttggttgcagtcgtcgttgttagtagttgtagtgtggtgtctttattttcgtgtcgttgggatgagttgtccggtttggtatctggtgtctggatgcagaactgggtgcttgaccgtcggtggcgttcttgaatcgtcggtgttgatctatgcgatgtttgttgtcaagtatttgagactgcttgcaggtgtcagccttttcttttctaatgttttctattgagtcttatgtcatgaatgagatgttgagatgtttgctgttttatcgccgacctgtcatattgtggtacttttaagcatgaatttagagtattttaaaataaattagtgtttcggt

SEQ ID NO: 1405 - DNA, 1436 bp, Papaver somniferum
ttattgaaagattcgagaaggaggctgctgagatgaacaagaggtcattcaagtatgcatgggttcttgacaagcttaaggctgaacgtgagcgtggtattaccattgatatcgccttgtggaagtttgagaccaccaagtactactgcacagttattgatgctcctggacatcgtgactttatcaaaaacatgattactggtacatctcaagctgattgtgccgtcctcattatcgattctaccactggaggttttgaggctggtatctcgaaggatggtcagactcgtgagcacgctcttcttgctttcacccttggtgtcaagcagatgatctgttgttgtaacaagatggatgccaccacccccaagtactcaaaggctaggtacgatgaaattgtaaaggaggtctcatcttacttgaagaaggttggatacaacccagacaaaattgcctttgttcctatctctggatttgagggagacaacatgattgagaggtccaccaaccttgactggtacaagggaccaactcttctcgatgctcttgacaatatctctgagccaaagagaccctcagacaagccccttcgtcttccccttcaggatgtttacaagattggaggtattggaactgtgccagtgggacgtgttgaaactggattcatcaagcctggtatggttgttacctttggacccactgggttgaccactgaagttaagtctgtggagatgcaccacgaagcccttcaagaagctcttccaggagacaatgttgggttcaatgtcaagaatgttgcagtgaaggatctcaagcgtggttttgtcgcctccaactccaaggacgaccctgccagggaagctgccaacttcacttcccaggttatcatcatgaaccatcctggtcagatcggtaacggttatgctccagtcctcgactgtcacacatctcacattgctgttaagtttgctgagatcctcaccaagattgataggcgatctggaaaggagcttgagaaggagcccaagttcttgaagaatggtgatgctggtatcattaagatgcttccaacaaagcccatggttgtagagaccttctctcagtacccacctcttggtcgttttgctgttagggacatgaggcagacagttgctgttggtgttatcaaggaagttgagaagaaggacccaacaggagccaaggttaccaagtctgctgtcaagaagaaatgaagtgtgctgccaaggttaactagagggagagggatggtgctaagaggatctacaggagggacttgtttctttactattagtcagttttgttttttgttttcgtgcatttggtatcagtgttgtcttttgttttgtttcaccttcgttttgttgcgcattcagttgcaaacctgggtgcttgacaggcggtggcaacaaggtgtt

SEQ ID NO: 1406 - DNA, 1449 bp, Trigonella foenum-graecum
gcatgggttcttgacaaacttaaggcagagcgtgaaagaggaattaccatcgatattgctttgtggaaattcgagaccaccaagtactactgcacagtcattgatgctcccggccatcgtgatttcatcaagaacatgattaccggaacctcccaggctgattgtgctgttctcatcattgattccaccactggtggttttgaagctggtatctcaaaggatggacagacccgtgagcatgctcttctcgctttcacccttggagtgaagcagatgatctgttgttgtaacaagatggatgctaccacccctaagtactcaaaggctaggtacgatgaaatcattaaggaagtttcttcctacttgaagaaggttggttacaacccagacaaaattccctttgttcccatctccggttttgaaggtgacaacatgattgaaaggtccaccaacctagactggtacaagggaccaactctccttgaggcacttgaccagatcaacgagcccaagagaccctcagacaagcccctcagacttccattgcaagatgtttacaagattggtggtattggaactgtgccagtcggacgtgttgagaccggtgttgtgaagcccggtatggtggtgacttttggaccaactggtttgacaactgaagttaagtctgttgagatgcaccacgaggctctcactgaagctcttccaggagacaatgtcggattcaatgttaagaatgttgccgtgaaggatctcaagcgtggttttgttgcatccaactccaaggatgaccctgccaaggaagctgccaacttcacttcccaagtcatcatcatgaaccaccctggacagattggaaatggatatgcaccagtgctcgattgtcacacctctcacattgctgtgaagtttgctgaacttgtcaccaagatcgacaggcgatctggtaaggagattgagaaggagcccaagtttttgaagaatggagatgctggtatcattaagatgattccaaccaagcccatggttgttgagactttctctgaatatcctccattgggacgtttcgctgtcagggacatgcgtcaaactgttgctgttggtgtcatcaagggtgtggagaagaaggatcctaccggagccaaagtcaccaaagctgctgccaagaagaagtgatctcacaccatggttattgcataagttgttcctttttactagtttattatctcttcagagtactttgttattccagttttatttttccagttttagaaacttacagaactgggttcttgatcggcgatggtactgtttttggttttatttgttaagagtctggagaacttgattttcgaaaggcagctaaaaggttttacatcttaattttgctgctgaaggatgttgtaatttcatttgatttacaaacagttttgtgatgtcaaacctttt

SEQ ID NO: 1407 - DNA, 1407 bp, Salvia sclarea
tgaacaagaggtcattcaagtacgcctgggttcttgacaagctcaaagctgaacgtgaacgtggtatcactattgatattgccctctggaagtttgagaccaccaagtactactgcactgttattgatgctcctggacatcgtgacttcatcaagaacatgattactggtacatctcaggctgattgtgctgtacttatcattgattccactactggtggatttgaggctggtatctctaaggatggtcagacccgtgagcatgctcttctggctttcactcttggtgtgaagcaaatgatctgctgctgtaacaagatggatgctaccactcccaaatactccaaggcgaggtatgatgaaatcattaaggaggtgtcttcctacctgaagaaggttggttacaatcctgagaagatcccgtttgtgcctatttctggatttgagggtgacaatatgattgagaggtcgaccaaccttgactggtacaagggtcctactctccttgaggctcttgatgctgtctctgagcccaagaggccctcggacaaaccccttcgtctcccgcttcaggatgtctacaagattggaggtattggaactgtgccagttggaagggttgaaactggtgtcatcaagcctggtatggttgtcacctttggtccaactgggctgacaactgaagttaaatctgttgaaatgcatcatgaggcactccaagaagccctccctggtgacaatgttggcttcaatgtcaagaatgttgctgttaaggatctcaagcgtggttttgttgcatcaaactcaaaagacgaccctgccaaagaagctgcaaacttcacttcccaggtcatcatcatgaaccaccctggtcagattggaaacggttacgcccccgtcctcgactgccacacttcacacattgcagtcaagtttgctgagctcatgaccaagattgatagacgttcgggcaaggagctggagaaggagcccaagtttttgaagaatggtgatgccggtatggtgaagatgattccgaccaagccgatggtggtggagactttctcgcagtacccaccgctgggaaggtttgcagtgagggacatgcgccagactgttgctgttggtgtgatcaagagtgtggagaagaaggatccatcaggagccaaggtgaccaaggcagcagccaagaagggtgccaagtgaactgtgttctctacacatactatctctcgctttatttactacaagatactcttatttaatgttggtcttgcaactttttgtcgttttctttgtgtctgttggtatttgtcgtgcgattttggctcccagaattgggtgctggatcgccgatggcgtcagttaatatgactctgtttctattgttacttttatgatattgagt

SEQ ID NO: 1408 - DNA, 1229 bp, Flaveria ramosissima
cttcctccatccaccacacaagtcgtctgcagatcaatcgttaaggatgggtaaagaaaagactcacattagtattgttgtcattggacatgtcgactccggcaagtccacaacaactggacacttgatctacaagcttggaggaattgacaagagagtcatcgaaagattcgagaaggaggctgctgagatgaacaaaagatccttcaaatacgcctgggttcttgacaaacttaaggccgagcgtgaaagaggtatcaccattgatattgccttgtggaagtttgagacaaccaagtactactgcactgtcattgatgctcctggacatcgtgattttatcaagaacatgattactggtacttctcaggccgactgtgcggtgcttatcattgactccaccactggtggttttgaagctggtatctccaaggatggtcagacccgtgagcatgctcttcttgctttcacccttggtgtcaagcaaatgatttgctgctgtaacaagatggatgccacaacaccaaagtactccaaggcaaggtatgacgaaattgtgaaggaagtgtcatcttacttgaagaaggtgggatacaaccctgacaaaatcccatttgttccaatctctgggtttgaaggagacaacatgattgagaggtcgacgaaccttgactggtacaagggtccaacccttcttgaagctcttgaccagatcaatgagcccaagagaccatcagacaagcccctccgtcttccacttcaggatgtgtacaagattggtggtattggaactgtgccagtgggacgtgttgagactggtgtgatcaagcctggtatggttgtcacttttggaccatctggattgaccactgaagttaaatctgttgagatgcaccatgaagctcttactgaggctcttcctggtgacaatgttgggtttcaacgttaagaatgtttgctgtcaaggatctcaagcgtggttatgttgcatcaaactccaaggatgacccggctaagggtgctgctagcttcacctcccaggttatcatcatgaaccaccctggtcagatcggtaacggttatgcacctgttcttgattgccacacctcccacattgccgtcaagttctctgagcttcttaccaagatcgacagacgatctggtaaggaacttgagaaggagcctaaattcttgaagagtggtgatgctggtatggtaaagatgcttcc

SEQ ID NO: 1409 - DNA, 1460 bp, Helianthus annuus
gggcaagttgggtggtattgacaagcgtgtgatcgaaagattcgagaaggaagccgctgagatgaacaagaggtccttcaaatacgcatgggtgctcgacaaacttaaggccgagcgtgaaagaggtatcaccatcgatatcgccctgtggaagttcgagaccaccaagtactactgcactgtcatcgatgcccccggacatcgtgatttcattaagaacatgattaccggtacatcccaagctgactgtgccgttcttatcattgactccaccactggtggttttgaggctggtatttccaaggatggtcagacccgtgagcacgctcttcttgctttcaccctcggtgtcaagcaaatgatctgctgctgtaacaagatggatgccaccacaccaaagtactcgaaggcgaggtacgatgagattgttaaggaagtttcatcctacttgaaaaaggtcggatacaaccctgacaaaatcccattcgtgccaatctctgggggggagggagacaacatgattgagaggtccaccaaacttgactggtacaagggtccaacccttcttgaggctcttgaccaaatcaatgagcccaagagaccctcagacaagccccttcgtctcccacttcaggatgtgtacaagatcggtggtattggaactgtgccagtgggacgtgttgagaccggtgtgatcaagcccggtatggttgtaaccttcggaccatcagggttgaccactgaagtcaagtccgttgagatgcaccacgaagctcttcaagaggctctccccggtgacaacgttgggttcaacgtcaagaacgttgcagttaaggatctcaagcgtggttacgttgcatcaaactccaaggatgatcctgctaagggtgccgccagtttcacttcccaggttatcatcatgaaccaccctggccagatcggtaacggttacgccccggttctcgattgccacacctcccacattgccgtcaagttctctgaactcttgaccaagatcgacagacgatctggtaaggagctcgagaaggagcctaagttcttgaagaacggagatgccggtatggttaagatgcttcccaccaagcccatggttgtcgagacctttgctgagtacccaccacttggtcggtttgctgtgagggacatgcgtcagacggttgctgtcggtgttatcaagagtgttgacaagaaggacccaactggagctaaggtgaccaaggctgcagccaagaagggagccaagtgagagggtggtttgtgtttggtttatggagtatttatggtttctgtcgtttgtttactagtttgaactttattttgttgaagagttttgttatttgatccttgaagctttcattattgtgcaagttttatgggttacagacttttgttgtgggttaaattatagtaatcatgagttgctagttggtggtttaaaa

SEQ ID NO: 1410 - DNA, 1262 bp, Eschscholzia californica
ctcatttcttcttctccatcagcctagggtttaggcagccgttctatccacttcagaagtaacgtagcatctactcgtcatgggtaaagagaagattcatatcagtattgtcgtcattggacatgtcgactctggaaagtcgaccaccactggtcacttgatctacaagttgggaggtattgacaagcgtgttatcgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcactgttattgatgccccaggacatcgtgatttcatcaagaacatgattactggtacctctcaggctgattgtgctgtcctcatcattgactccaccactggaggttttgaagctggtatctctaaggatggacagacccgtgagcacgctcttcttgctttcacccttggtgtcaagcagatgatctgttgttggaacaagatggatgccactactcccaagtactccaaggcaaggtatgaggaaatcgttaaggaagtctcatcatacttgaagaaggttggatacaacccagacaaaatcgcctttgttcccatctctgggtttgagggtgacaacatgattgagaggtccaccaacctcgactggtacaagggaccaaccttctgaggcacttgaccagatcaatgagccaaagagaccctcagacaagccactccgtcttccacttcaggatgttacaacgattggtggtattggaactgtgccagtgggacgtgttgagactggagtcatcaagcccggtatggttgtcacttttggtcccactgggttgaccactgaggttaagtccgtggagatgcaccacgaggctctccaggaagcacttccaggtgacaatgtcggattcaatgttaagaatgttgctgtcaaggatctcaagcgtggtttcgttgcctccaactccaaggatgacccagccagggaagctgccaacttcacctcccaggtcatcatcatgaaccatcctggtcagatcggtaacggatacgctccagttcttgactgccacacctcccacattgctgttaagttcggtgagatcctcaccaagattgacagacgatctggaaaggagctcgagaaggagcccaagtttttgaagaatggtgatgctggtatggttaagatgcttccgacc

SEQ ID NO: 1411 - DNA, 1384 bp, Primula obconica
gaaaacttctattcaattgctcgtttctttgctgcggctaggtctcctttctctctctaatcgaattacctggtaaaagttcagtatgggtaaggaaaagattcatatcagtattgtcgtcattggtcatgtcgactcgggcaagtcgaccaccactggtcaccttatctataagcttggaggtattgacaagcgtgttatcgagaggtttgagaaggaggctgccgagatgaacaagaggtcattcaagtatgcgtgggtgttggacaagctcaaggctgagcgtgagcgtggtattaccattgatattgctctgtggaagtttgagaccaccaagtattattgcactgtcatcgatgcccctggacatcgtgatttcatcaagaacatgattacgggaacttcccaggctgattgtgctgttctcattatcgattccaccactggtggttttgaagctggtatctccaaggacggtcagacccgtgagcatgctttgcttgctttcacccttggtgttaagcagatgatttgctgttgtaacaagatggatgctaccacccccaagtattccaagtcaaggtacgaagaaattgtgaaggaagtgtcttcttacctgaagaaggttggttacaaccctgacaaaatcccattcgtgcccatctctggatttgaaggtgacaacatgattgagaggtccaccaacctagactggtacaagggcccaacccttcttgatgctcttgaccaagtctcagagcccaagaggccctcagacaagcccctccgtctcccacttcaggacgtctacaagatcggtggcattggaacggtgccagttggacgtgtggagacaggtgttatcaagcccggtatggtcgtcaccttcggcccatctggtttgacaactgaagtcaagtccgttgagatgcaccacgagtctctccttgaagctcacccaggtgacaatgttgggttcaatgtgaagaatgttgctgtgaaggatctcaagcgggggtatgttgcatcaaattccaaggatgatcctgccaagggtgctgctagcttcacctcccaggtcatcatcatgaaccaccctggtcaggtcggtaatggctatgctccagtgctcgattgccacaccctcccacattgctgtgaaattctctgagattctgaccaagattgataggcgttctggtaaggagctcggaagaaggacgtccttaagtttttagaagaatggagatgctggtatggtagaagatgtacttcccggaccaacgcctagttggttgtcgagtactttctctgacgtacccgtcggttgggttcggtttgcgtgtggaggacagtgacggcagacgtagttcgcgttggttgg

SEQ ID NO: 1412 - DNA, 1335 bp, Panicum virgatum
aaccccaccccaccccacaggcacagcagccgccggcgccgccgccgcagaccgacccgaggcgagcacggaagcggcgattcgccgacgctccttcagatcttcggcgagccgtgactgagacctctgctgccgtccgccgagcagtttaatcttcacctgcagccatgggtaaggagaagtcccacatcaacatcgtggtcattggccacgtcgactccggcaagtcgaccaccaccggccacctgatctacaagcttggaggcatcgacaagcgtgtgatcgagaggttcgagaaggaggctgcggagatgaacaagaggtccttcaagtacgcgtgggtgcttgacaagctcaaggcggagcgcgagagaggtatcaccattgatatcgccctgtggaagttcgagaccaccaagtactactgcacggtcattgatgcccctggacaccgtgacttcatcaagaacatgatcacgggtacctcccaggctgattgtgctgtccttatcattgactccaccactggtggttttgaggccggtatctccaaggatggccagacccgtgagcatgctctccttgctttcactcttggagtcaagcagatgatctgctgctgcaacaagatggatgccaccactcccaagtactccaaggcccgttatgatgagattgttaaggaagtctcctcctacctgaagaaggtgggctacaaccctgacaagattgccttcgttcccatctctggttttgagggtgacaacatgatagagaggtccaccaaccttgactggtacaagggcccaaccctgcttgaggctcttgaccagatcaacgagcccaagaggccttcggacaagcccctgcgtctcccccttcaggatgtgtacaagattggtggtattggaactgtccctgttggccgtgttgagacaggtatcatcaagcctggtatggttgttacctttggccccagtggcctgactactgaggtgaagtcagttgagatgcaccacgaggctctccaggaggcccttcctggtgacaatgttggcttcaacgtgaagaacgttgctgtgaaggatctgaagcgtgggtatgtggcctccaactccaaggatgaccctgccaaggaggctgccagcttcacctcccaggtcatcatcatgaaccaccctggacagatcggcaacggctatgccccagtgctggactgccacacctcccacattgctgtcaagtttgctgagctcattaccaagatcgacaggcgatctggtaaggagcttgagaaggagcccaagttcctcaagaatggtgatgctggtatgg

SEQ ID NO: 1413 - DNA, 1317 bp, Ambrosia trifida
gggtaagaaaagattcacatcagcattgtcgtcattggacatgtcgactctggcaagtcaaccactacaggtcacttaatctataagttgggaggaatcgataagagagttatcgagaggtttgagaagaagctgctgaaatgaacaaaaggtctttcaagtacgcctgggttcttgacaaactcaaggccgagcgagaacgtggaatcacaatcgatattgcattgtggaaatttgagaccaccaagtactactgtaccgtcattgatgctcctggacatcgtgatttcattaagaacatgattactggtacatcccaggctgactgtgctgtcttgattattgactcgaccactggtgggtttgaagctggtatctctaaggatggtcagacccgagaacatgctctgcttgctttcactcttggtgtgaagcaaatgatctgctgttgtaacaagatggatgcaaccactcctaagtactccaaggcaaggtatgacgaaattgtgaaggaagtctcttcttacctgaagaaggttggttacaaccccgataaaatcccatttgttcccatctctggttttgagggtgacaacatgattgagaggtcgacaaacctcgactggtacaagggcccaacccttcttgaagctcttgaccagatcaacgagcccaagagaccctcagacaagccacttcgtctcccacttcaggatgtgtacaagatcggtggtattggaactgtgccagtgggacgtgttgagactggtgtgatcaagcctggtatggttgttacctttggaccatctgggttgaccactgaagttaagtctgttgagatgcaccacgaagccctccaagaggctctccccggtgacaatgttgggttcaacgtcaagaacgttgctgttaaggatctcaagcgtgggtacgtcgcatccaactccaaggatgatcctgccaagggtgctgccagtttcacatcccaggttatcatcatgaaccaccctggccagatcggtaatggttacgccccggttcttgattgccacacctcccacattgctgtcaagttctctgaacttttgactaagatcgacagacgatccggtaaggagcttgagaaggagcctaagttcttgaagaacggagatgccggtatggttaagatgcttccaaccaagcccatggttgtcgagacctttgctgaatacccaccacttggtcggtttgctgtgagagacatgcgtcagacagttgcagtcggagtcatcaagagcgtggataagaaggacccaaccggagccaaggtgacaa

SEQ ID NO: 1414 - DNA, 1279 bp, Brassica juncea
ttagctgctgagatgaacaagaggtccttcaagtacgcctgtgttgttggacaaacttaaggctgagcgtgagcgtggtatcaccattgacattgctctctggaagtttgagaccaccaagtactactgcacagtcattgacgctcctggacatcgtgatttcatcaagaacatgattactggtacctcccaggctgattgtgctgttttgatcattgactccaccactggtgggcttgaagctggtatctctaaggatggtcagacccgtgagcatgctcttcttgctttcacccttggtgtcaagcagatgatttgctgctgtaacaagatggatgcgactacccccaagtactccaaggctaggtacgatgagatcatcaaggaggtgtcttcctacttgaagaaggttgggtacaaccctgacaaaatcccattcgtccccatctctggttttgagggtgacaacatgattgagaggtccaccaaccttgactggtacaagggaccaaccctccttgaggcacttgaccagatcaacgagccaaagaggccctccgacaagcccctccgtctcccacttcaggatgtctacaagatcggtggtattggaacggtgccagtgggtcgtgttgagactggtatgctcaagcctggtatggttgtgacctttgctccttcaggtttgaccactgaggttaagtctgttgagatgcaccacgagtcacttgttgaggcgcttccaggtgacaatgtcgggttcaacgtgaagaatgttgctgtcaaggatctcaagcgtgggtatgttgcatccaactccaaggatgatcctgccaagggtgctgctaacttcacctcccaggtcatcatcatgaaccaccctgggcagatcggtaacggttacgccccggttcttgactgccacacgtcccacattgccgtgaagttctctgagatcctcaccaagatcgacaggcgttctggtaaagagatcgagaaggagcctaagttcttgaagaatggagacgctggtatggtgaagatgactccaaccaagcccatggttgtgagaccttctctgagtacccaccccttggacgttttgccgtgagggacatgaggcagactgttgcagtcggtgttatcaagagcgttgacaagaaggacccaaccggagccaaggtcaccaaggctgccgtcaagaagggtgccaaataaagtaccttgagcaaaactctatcatccgcagttgaatcaaaagacggttttagttttttac

SEQ ID NO: 1415 - DNA, 1418 bp, Pennisetum glaucum
tgctcgacaagctgaaggctgagcgtgagagaggtatcaccatcgacattgccctgtggaagtttgagaccaccaagtactactgcacggtcatcgatgcccctggtcaccgtgacttcatcaagaacatgattaccggcacctcccaggctgactgtgctgtcctcatcattgactctaccactggtggttttgaggctggtatctctaaggatggccagacccgtgagcatgctctccttgctttcactcttggagtgaagcaaatgatctgctgctgtaacaagatggatgccaccactcccaagtactccaaggcccgttatgatgagattgttaaggaagtctcctcgtacctcaagaaggtgggttacaacccagacaagattgcctttgtccccatctctggtttcgagggtgacaacatgattgagaggtccaccaaccttgactggtacaagggcccaaccctgcttgaggctctggaccagatcaacgagcccaagaggccctccgacaagcccctgcgtctcccccttcaggatgtgtacaagatcggtggtattggaactgtccctgttggccgtgttgagactggtgtgatcaagcctggtatggttgtcacctttggtccaactggcctgactactgaggttaagtctgttgagatgcaccacgaggctctccaggaggcccttcccggtgacaatgttgggttcaacgtgaagaatgttgctgtgaaggatctcaagcgtggttatgtggcctccaactccaaggatgaccctgccaaggaggctgccagcttcacctcccaggtcatcatcatgaaccaccctgggcagatcggcaatggctatgccccagtgctcgactgccacacctcccacattgctgtcaagtttgctgagcttgtcaccaagatcgacagacgatctggtaaggagcttgagaaggagcccaaattcctgaagaatggtgatgctggtatggtgaagatgattcccacgaagcccatggttgttgagacattctctgagtaccctcctcttggccgctttgctgttcgtgacatgaggcagactgttgctgttggtgtcatcaagagtgtggagaagaaggatcccaccggtgccaaggttaccaaggctgctgccaagaagaaatgagaggtctgagggttgttatcgtctgctggttttcatctatcttagcagtcttagtgctgttttaagctttgttaggccattgtttttgcagttggtagcaactgtaatttctgctggcaatgtgccctagtctgctgtcctgtaaacgctactgttattttggttgtggttaaacctggctactttgagtgagttaaacgctctgtagtaacaatcttgctgttctgcacctaaaaagggtgttttcgt

SEQ ID NO: 1416 - DNA, 1600 bp, Papaver somniferum
tgggttcttgacaagcttaaggctgaacgtgagcgtggtattaccattgatattgcactgtggaagtttgagaccaccaagtactactgcacagttattgatgctcctggacatcgtgactttatcaaaaacatgattactggtacttctcaggctgattgtgccgtcctcattatcgattccaccactggaggttttgaggctggtatctcaaaggatggtcagactcgtgagcatgctcttcttgctttcacccttggtgtcaagcagatgatctgttgttgtaacaagatggatgccaccacccccaagtactcaaaggctaggtacgatgaaattgtcaaggaggtctcatcttacttgaagaaggttggatacaacccagaaaaaattgcctttgttcctatctctggattcgagggagacaacatgattgaaaggtccaccaaccttgactggtacaagggaccaactctccttgaggctcttgacaacatctctgagccaaagagaccctcagacaagccccttcgtcttccccttcaggatgtttacaagattggaggtattggaactgtgccagtgggacgtgttgaaactggagtcatcaagcctggtatggttgttacttttggacccaccggtttgaccactgaagttaagtctgtggagatgcaccacgaagcccttctagaagctcttccaggagacaatgttgggttcaatgtcaagaatgttgcagtgaaggatctcaagcgtggtttcgtcgcctccaactcaaaggatgaccctgccagggaagctgccaacttcacctcccaggtcatcatcatgaaccatcctggtcagattggtaatggttatgctccagttcttgactgtcacacatctcacattgctgtcaagtttgctgagatccaaaccaagatcgataggcgatctggaaaggagcttgagaaggagcccaagttcttgaagaacggtgatgctggtattattaagatgattccaaccaagcccatggttgtagagacctttgctcagtacccacctcttggacgttttgctgttagggacatgaggcagacagttgctgttggtgtcatcaagggagttgagaagaaggacccaacaggagccaaggttaccaagtctgctgtcaagaagaaatgaagtgtgctgccaaggttaactacaggagggacttatttctttactattagtcagttttgttttttgttgtggtgcattaggtaccagtgtggtcttttgttttgtttcaccttcgttcagttgcgcattcagttgcaaacctgggtgcttgacaggcggtggcaacaaggtgttgggctgttttgttgaatttcctttaaaaacttatgttggattttgggttttcaagtttctgttcacaactttacttaaaaccctctgcctttaattgaaaaccatatttgctagttattgtcttcagagttacttcagattgctttcatgtgcatctttattcttggagaactgcatattctagcacttggttcactttggtgaacactggcagttctcaaccagttgtgtataattgatatcttgctgtgac

SEQ ID NO: 1417 - DNA, 1222 bp, Secale cereale
ccccgtccccgccgcaggctctcactcctcttcgtccccggacagccaggtagttatcagccatgggtaaggagaagatccacatcagcattgtggtcattggccatgtcgactctggcaagtcaaccacgactggccacctcatctacaagcttggaggcattgacaagcgtgtgatcgagaggttcgagaaggaagccgctgagatgaacaagaggtcgttcaagtacgcctgggtgcttgacaagctcaaggctgagcgtgagagaggtatcaccattgatattgctctgtggaagttcgagaccaccaagtactcctgcaccgtcattgatgctcctggtcaccgtgatttcatcaagaacatgatcactggtacctcccaggctgattgtgctgtgcttatcattgactccaccactggtggttttgaggctggtatctccaaagatggccagacacgtgagcatgctctccttgctttcactcttggtgtgaagcagatgatctgctgctgcaacaagatggacgccaccactcccaagtactcgaaggcccgttatgatgaaattgtgaaggaagtctcttcatacctgaagaaggtcggttacaaccctgacaaggttccctttgtccctatctctgggtttgagggtgacaacatgatcgagaggtcctccaaccttgactggtacaagggcccaaccctgcttgaggcgcttgaccagatcaatgagcccaagaggccctccgacaagcccctgcgtcttccccttcaggatgtgtacaagattggcggcattggaactgtgccagtgggacgtgttgagactggagtaatcaagccaggcatggttgtcacctttgggcctactggcctgaccactgaggtgaagtccgttgagatgcaccacgagtcccttttggaggcgcttcctggtgacaacgtcggcttcaacgtcaagaacgtggctgtcaaggatctcaagcgtgggtatgtcgcttctaactccaaagacgaccctgccaaggaggctgccaacttcacggcgcaggtcatcatcatgaaccaccctggccagatcagcaatggctatgccccagcgctggactgccacacgtcccacatcgccgtcaaattcgctgagatccagaccaagatcgaccggcggtctggcaaggagctggaggcggcgcccaagttcctcaagaatggtgatgc

SEQ ID NO: 1418 - DNA, 1334 bp, Nicotiana tabacum
ctaacgcttcgcttcatttgttctgcgcagccagggttttagcgaagctctctcgtcttttcttttcgtcttctaaagtttctaaggaatcatgggtaaagagaaggttcacatcaacattgtggtcattggccacgtcgactctggaaagtcgaccaccactggtcacttgatctacaagcttggtggtattgacaagcgtgttattgagaggttcgagaaggaagctgctgagatgaacaagaggtcattcaagtatgcctgggtgcttgacaagcttaaggctgaacgcgagcgtggtatcaccattgatattgccttgtggaagtttgagaccactaagtactactgcactgtgattgatgcccccggacacagggactttatcaagaacatgatcactggtacttcccaggctgattgtgctgttcttattattgactccaccactggtggttttgaagctggtatttccaaggatggtcagacccgtgagcatgcattgcttgctttcacccttggtgttaagcaaatgatttgctgctgcaacaagatggatgctaccaccccaaagtactccaaggctaggtatgatgaaattgtgaaggaagtttcttcctacctcaagaaggttggttacaaccctgacaagattccctttgtccccatctctggtttcgagggggacaatatgattgagaggtctaccaaccttgactggtacaaggggccaaccctccttgaggctcttgaccagattaatgagcccaagaggcccacagacaaacccctacgtcttccacttcaggacgtttacaagattggtggtattggtactgtccctgttggtcgtgttgaaacaggtgtcctcaagcctggtatgcttgtgacctttgggcctactggtctgacaactgaagtcaagtctgtagagatgcaccatgaagctctccaggaggcactccccggtgacaatgttgggttcaatgttaagaatgttgctgttaaggatctcaagcgtggttatgttgcctcaaactccaaggatgacccagccaaaggggctgccagtttcacctcccaggtcatcatcatgaaccatcctggtcagatcggaaatggatatgcaccagtgctggactgccacacttctcacattgcggtcaagtttgctgagatcttgaccaagattgacaggcgttctggtaaggaacttgagaaggagcctaagttcttgaagaatggtgatgctggtatggtttaagatgaatcccctacaagcctatggttgtttgagaaccttctctgaatatcatctattgtggtcgttttgc

SEQ ID NO: 1419 - DNA, 1233 bp, Ambrosia trifida
ctgctgaaatagacaaaaggactttcaagtacgcctgggttcttgtacaaactcaaggccgagcgagaacgtggaatcacaatcgatattgtcattgtggaaatttgagaccaccaagtactactgtaccgtcattgatgctcctggacatcgtgatttcattaagaacatgattactggtacatctcaagctgattgtgctgtcttgattattgactctaccactggtgggtttgaagctggtatctctaaggatggtcagacccgagaacatgctctgcttgctttcactcttggtgtgaagcaaatgatctgctgttgtaacaagatggatgcaaccactcctaagtactccaaggcaaggtatgacgaaattgtgaaggaagtctcttcttacctgaagaaggttggttacaaccccgacaaaatcccatttgttcccatctctggttttgagggtgacaacatgattgagaggtcgacaaacctcgactggtacaagggcccaacccttcttgaagctcttgaccagatcaacgagcccaagagaccctcagacaagccacttcgtctcccactccaggatgtgtacaagatcggtggtattggaactgtgccagtgggacgtgtcgagactggtgtgatcaagcctggtatggttgttacctttggaccatccgggttgacaactgaagttaagtctgttgagatgcaccatgaagccctacaagaggctctacctggtgacaacgttgggttcaacgtcaagaacgttgctgtcaaggatctgaaacgtgggtatgttgcatccaactccaaggatgacccagctaagggcacagcaagtttcacctcacaggtcatcatcatgaaccaccctggtcagattggaaacggttatgctccagttctcgattgccacacttctcacatcgctgtcaagttctccgagcttttgaccaagatcgacagacgatccggaaaagagcttgagaaagaacccaagtttttaaagaatggagatgcaggtatggttaagatgcttccaaccaagcctatggtggtcgagactttcgcagagtacccacctcttggtaggttcgctgttcgtgacatgaggcagactgttgctgttggtgtgatcaagagtgttgagaagaggacccgatggagctaaggtgaccaaggctgcagtgaagaagggtgccaagtgaattttctggaccaatgaag

SEQ ID NO: 1420 - DNA, 1258 bp, Phalaenopsis aphrodite
cctgagcagctgccagagagacgaaattcttcagctgttgttcaactctgcaatcgcgtttaagaagataagctatgggaaaggagaaggttcacatcagcattgtggtcattggtcatgttgattccggaaaatcaaccaccactggtcacctcatatacaagcttggtggtattgataagcgagttatcgagcggttcgagaaggaagcggctgagatgaacaagaggtcattcaagtatgcatgggtgcttgacaaactcaaggccgagcgcgagcgtggtatcactattgacatcgccttgtggaagtttgagaccacaaaatactattgtaccgtcattgatgctcccggccatcgtgattttatcaagaatatgatcactggaacttctcaggcagattgtgctgtgctgatcattgattccaccactggaggttttgaagccggtatttccaaggatggccagacacgtgagcatgcccttcttgctttcacccttggtgtgaagcagatgatttgctgttgcaacaagatggatgccaccacgccaaagtactctaaggcgaggtatgatgaaattgtgaaggaggtttcgtcctacttgaagaaggtgggttacaatcctgagaaaattccctttgtgccaatatctggatttgaaggcgacaatatgattgagagatctagcaaccttgactggtacaagggtccaactctgcttgaagccctggacttgattcaggaaccaagcgtccttcggacaagccccttcgtcttccgctccaggatgtctacaagattggaggcattggaactgttcctgtgggaagagttgagacaggagtcctcaaacccggaattgtggtgacgtttggacctactggcctcacaactgaagtcaagtctgttgagatgcaccacgaggctcttcaggaagcccttcctggggacaatgttggctttaatgtcaagaatgttgctgttaaggacttgaagcgtggatttgtggcctcaaactccaaggatgatccagcaaaggaagctgcaaattttacttcgcaggtcatcattatgaatcatccaggccagattggcaatggctacgcccctgttctagactgtcacacctcccacattgctgttaagttttctgagatattgaccaagattgacaggcgctctggtaaggagcttgagaaggagcctaagttcctgaagaatggggatgctggattgtgagatgattcctacaaa

SEQ ID NO: 1421 - DNA, 1259 bp, Brassica napus
actctggcaaatcgactacaactggcacttgatctacaagcttggtggtattgacaagcgtgtcatcgagaggttcgagaaggaggctgctgagatgaacaagaggtccttcaagtaacgcggtgggtgttggacaactaaggctgagcgtgagcgtggtatcaccattgatattgctctctggaagttcgagaccaccaagtactactgcacggtcattgatgctcctggacatcgtgatttcatcaagaacatgattactggtacctcccaggctgattgtgctgtcctcatcattgactccaccactggtggttttgaagcaggtatctccaaggatggtcagacccgtgagcatgctcttcttgctttcacccttggtgtcaagcaaatgatttgctgctgtaacagatggatgccactacccccaagtactccaaggctaggtacgatgagatcatcaaggaggtgtcttcctacttgaagaaggttgggtacaaccctgacaaaatcccattcgtccccatctctggattcgagggtgacaacatgattgagaggtccacaaccttgactggtacaagggaccaactctccttgaggctcttgaccagatcaacgagccaaagaggccctctgacaagcccctccgtctgccacttcaggatgtctacaagatcggtggtattggaacggtgccagtgggacgtgttgagactggtatgctcaagcccggtatggttgtgaccttcgctccttcagggttgaccactgaggttaagtccgttgagatgcaccacgagtctcttgtggaggcgcttccaggtgacaacgtcgggttcaatgttaagaatgttgccgtcaaggatcttaagagagggtatgttgcatccaactccaaggatgatcctgccaagggtgctgctaacttcacctcccaggttatcatcatgaaccaccctgggcagattggtaacggttacgccccggttcttgattgccacacctcccacattgcggtgaagttctctgagatcctcaccaagattgacaggcgttctggtaaggagattgagaaggagcccaagtttttgaagaatggtgatgctggtatggtgaagatgactccgaccaagcccatggttgttgacgacccttctctgaggtaccccaccacttgggacgtttcgctgtgaggggacatgaggcagctgttgacggtcggtgcatcaagggcgttgacagaagcccaacggtgc

SEQ ID NO: 1422 - DNA, 1905 bp, Populus trichocarpa
cttgctctcaacgttgctccctgtagctgcgagagagctccttcgtttttcaattccctttctttaagcttctctcccaaattttatcatgggtaaggagaagacacacattaacattgcggtcatcggccatgttgactctggcaagtcaaccaccactggtcatttgaccttcaagcttggaggtattgacaaacgtgtcattgagaggtttgagaaggaagctgctgggatgaacaaaaggtcatttaagttgcctgggttttggacaagcttaaggctgagcgtgagcgcggtatcaccattgatattgctctctggaagtttgagaccaccaagtactactgcactgtcattgatgctccttgtcatcgtgactttattaagaatatgatcactggtacctcacaggctgactgtgctgtcctcattattgattccaccactggtggttttgaagctggtatctccaaggatggccagacccgtgagcatgccctacttgcttttacccttggtgtcaagcagatgatttgctgttgcaccaagatggatgctaccacccccaagtactccaaggccaggtacgaagaaatcgtgaaggaagtttcctcttacttgaagaaggttggttacaaccctgagaagatcccctttgtccctatctctggttttgagggcgataacatgattgagaggtctaccaaccttgactggtacaagggccctaccctccttgaatctcttgaccagatcaatgagcccaagagaccatcagacaagcccctccgtcttctacttcaggatgtctacaagattggaggtattggaactgtacctgttggacgagttgcgactggtatcctgaagcctggaatggttgtgacctttggcccctctgggctgaccactgaagttaaatctgttgagatgcaccatgaagctctccaggaggcccttccaggtgacaatgttggtttcaatgttaaaaatgttgctgtcaaggatctcaagcgtggttttgttgcttctaactctaaggatgctcctgccagggaggctgctaacttcacctctcaggtcatcatcatgaaccacccaggaggcccttccaggtgacaatgttggtttcaatgttaaaaatgttgctgtcaaggatctcaagcgtggttttgttgcttctaactctaaggatgatcctgccaaggaggctgctaacttcacctctcaggtcatcatcatgaaccacccaggtcagattggaaacggatatgctcctgtccttgattgtcacacctcacacattgctgtcaagttttcagagattttgaccaagattgacaggcgatccgggaaagagcttgagaaggagccaaagttcttgaagaatggtgatgctgggtttgtgaagatgattcccaccaagcctatggttgttgagaccttttctacctatcctcctcttggtcgttttgctgtgagggacatgcgccagaccgtggctgttggtgtcatcaagagtgctaagaagaaagatgcatctggtgccaaggtcacaaagtctgcagtaaagaaaggtggaaagtgaagtgtgttttgttaggctagtctatatgtctctgtttcagctgttttgattctccaagttttgaggacggattaccattttggttttcaagttatccctacccaaacgagcatgtagtttttcttttattatttaattgaatatttagagtcatctaggacttccatacattcccatctttctacgagatcccaaggaatggacttttttcgttccagttgtctgacgtgaaccatgcttgaaccacactcttagcttcgtctgtttagcttggaaatcagaaaacctaatgggccctaccctggccattcaaagat

SEQ ID NO: 1423 - DNA, 1570 bp, Utricularia gibba
attcaagtatgcgtgggtgctcgacaagctgaaggctgagcgcgagcgtggtatcaccatcgatattgctctatggaagtttgagaccacaaagtactactgcaccgtcattgatgctcctgggcatcgtgatttcatcaagaatatgattactggtacctcacaagccgattgtgctgtgctcatcatcgattcgaccactggtggtttcgaagctggtatctccaaggatgggcagacccgagagcatgctctgcttgctttcacccttggcgtgaagcaaatgatctgttgctgcaacaagatggatgccaccacaccaaaatactccaaggccaggtacgatgaaattgtgaaggaggtgtcctcctacctgaagaaggtcggttacaatcctgaaaagatccccttcgtgccaatttctggtttcgagggagacaacatgatcgagaggtccaccaacctggactggtacaaggggccaactctactggaggctcttgatctgatcaacgagccaaagaggccctcggacaagcccctccgcctcccgcttcaggacgtgtacaagatcggtggtatcggcactgtgcctgtggggcgtgttgagacgggtgtcctgaagccgggtatggtggtcaccttcgggccgtctggtttgacgactgaagtaaagtcggtggagatgcaccacgaagcgctgcaggaggctctgccgggtgacaacgtgggtttcaacgtgaagaacgtggcggtgaaggacctgaagcgtgggtatgtggcgtccaactccaaggatgaccccgccaaggaagccgccaacttcacctcccaggtgatcatcatgaaccatcccgggcagatcgggaacggatacgcccccgtgctggattgccacacctcccacattgccgtgaagttcgccgaaatcctgacgaagatcgacagacggtctggaaaggagctggagaaggagcccaagttcctgaagaacggcgacgccggcttcgtgaagatgattcccaccaagcccatggtcgtggagacgttctccgagtaccctcctctggggcgtttcgcagtgcgtgacatgcgtcaaacggtggcggtgggtgtcatcaagagcgtggagaagaaggacccaaccggcgccaaggtgaccaaggcggccgccaagaaaggggcgaagtgaatggtgcatactcgcagttctggtgttttatcttcttgcctcaggtttttttcgtttccatttttccatccatgttgtctgtttgcatgttttgactctatgtccctgagctgggttctggacaggcgattgcgcagtcctctgcggctgcgttgaaactgccgcccatattatgtaacgttatcttttgtagccctatatccaacgcgtccacttttgctatttatgtgccctcttttatatggaaaaaaaaaaaaaacaaactacatggaacaactaggagagatcacttaagttgaacagttgaatggataaaagcatgaagtacttggttcaatgtttggtctctttcatcattgaaacttcgtccacgtttcc

SEQ ID NO: 1424 - DNA, 1388 bp, Euonymus alatus
gatgaacaagagatcattcaagtatgcctgggtgttggacaaactcaaggctgagcgtgaacgtggtattaccattgatattgctctatggaagtttgagactacaaagtattactgtactgtcattgatgctcctggacatcgtgactttatcaagaatatgattactggtacttcacaggctgactgtgctgtcctcattattgactccaccactggtggatttgaagctggtatttccaaggatggccagacccgtgagcatgcgttgcttgcttttactcttggtgtgaggcaaatgatttgttgttgcaacaagatggacgccactacccccaagtactcgaaggctaggtatgaggaaattgtgaaggaagtttcttcctacttgaagaaggttggttacaaccctgacaagatcccatttgttcccatctctggttttgagggtgacaacatgatcgagagatctaccaaccttgactggtacaagggcccaaccctccttgaagctcttgaccagatctcggaacccaagaggccctcagacaagcccctccgtctcccccttcaggatgtttacaagattggtggtattggaactgtcccagtcggacgtgttgagactggtgtcctgaagcctggtacagttgtgacctttggtcctactggactgaccactgaagttaagtctgttgagatgcaccacgaggctctccaggaggccctgccaggtgacaatgttggcttcaatgtcaagaacgttgctgtgaaggatctgaagcgtggttttgttgcttccgactctaaaaatgatcctgccaaggaggcggccagcttcacctctcaggtcattatcatgaaccaccctgggcagattggaaatggctatgccccagtccttgattgtcacacatcccacattgctgtgaagtttgctgagatcttgacaaagattgacaggcgatctggtaaggagattgagaaggaaccaaaatttttgaagaatggtgatgcaggaatggtgaagatgattccaaccaagcctatggtggtggagaccttctctgcgtaccctcctcttggtcgttttgctgtgagggacatgcgccagactgtggctgtgggtgtcatcaagagtgttgataagaaggaagcatctgccgccaaggtcaccaagtctgctgctaagaagaagtgagagtcagatgtgttttagttgatttctattatctagtgtagttttgttttgttatattttccgtggaagttttgtcatttgtggacatcttcggtctttgtttcttggttgtattatcagtcattaatctcgtacgatgatgcgttatgaacattgctgagttttgtggtaaaatttcatttttcag

SEQ ID NO: 1425 - DNA, 1413 bp, Flaveria ramosissima
ttcaagtacgcctgggtgttagacaaactgaaagccgagcgtgaacgtggtatcaccattgacattgcattgtggaagtttgagactaacaaatattactgcactgtcattgatgcacccgggcatcgtgattttatcaagaatatgatcacggggacctctcaggccgactgtgctgtgctcatcatcgactccaccactggtggttttgaagctggtatttctaaggatggtcaaacccgcgaacatgctttgcttgcttttacccttggtgtcaagcaaatgatctgttgttgtaacaagatggatgctactacacccaagtactctaaagctcgatatgatgaaatcgtgaaggaagtgtcgtcgtacctcaagaaggttggatacaaccctgataaaattccgtttgtaccaatctctggttttgagggagataacatgattgagagatcaaccaatctcgactggtacaagggtccaacacttctagaagctcttgaccagatcaacgagccaaagagaccctcggacaaaccactgcgtctaccacttcaggacgtctacaagattggtggcattgggactgtgcccgtgggtcgtgttgagactggtgtgatcaaaccaggcatggttgtcacttttggcccaactggtctaaccactgaagtcaaatccgttgagatgcaccatgaggcgctccaagaggcgctacctggagacaatgtcgggttcaatgttaagaatgtcgcggttaaggatcttaaacgtggttatgtggcttcaaactccaaagacgaccctgcaaagggtgcatcgagttttacttctcaggtcatcatcatgaaccaccctggtcaaattggcaacgggtatgcacctgtgctcgactgccacacttctcacattgcagtcaagttttccgagatcttgaccaagattgaccgaaggtccggaaaagagcttgagaaggaacccaagtttctcaagaacggtgatgctggaatggttaagatggttccaaccaaacctatggtggttgaaacattttctgagtatcctcctttgggtcggtttgcggttagggacatgcgccagaccgttgcggttggtgtcatcaagagcgtggacaagaaggacccgactggtgctaaagtcaccaaggcggctcagaagaagaaatgaaggttacttgtctgtttaatgaacctttttatcgttatgttttccagttttcgtgtgttgcatgtttgtgtttgttacttttgtcgccttcgtctagcctcgttcttgggtatggtggttgtgttacgctttcgggttcacacctgggtgcttgaccggcggtggcggccttatttgctttcttgttatcagaacttgtgattttggattgaaataagcttggttgag

SEQ ID NO: 1426 - DNA, 1483 bp, Brassica juncea
ggcgtccacatttacttctctcactcagtttcgtagccgcatctcgcattcttacttgcagctatgggtaaagagaagtttcacatcaatatcgtggtcattggccatgtcgattctggaaaatcgaccacgctggtcacttgatctacaagctcggtggtattgacaagcgtgtcatcgagaggttcgagaaggaggctgctgagatgaacaagaggtccttcaagtacgcgtgggtgttggacaaacttaaggctgagcgtgagcgtggtatcaccattgacattgctctctggaagttcgagaccaccaagtattactgcactgtcattgatgctcctggtcatcgtgatttcatcaagaacatgattactggtacctcccaggctgattgtgctgttcttatcattgactctaccactggtggttttgaggctggtatctccaaggatggtcagacccgtgagcatgctcttcttgctttcacccctggtgtcaagcaaatgatttgctgctgtaacaagatggatgccactacccccaagtactccaaggctaggtacgatgagatcatcaaggaggtgtcttcctacttgaagaaggttgggtacaacccagacaaaatccccttcgtccccatctctggtttcgagggtgacaacatgattgagaggtccaccaaccttgactggtacaagggaccaactctccttgaggctcttgaccagatcaacgagccaaagaggccctcagacaaacccctccgtctcccacttcaggatgtctacaagatcggtggtattggaacggtgccagtgggacgtgttgagaccggtatgctcaagcccggtatggttgtgacctttgctccttcagggttgaccactgaggttaagtctgttgagatgcaccacgagtctcttgttgaggcacttccaggtgacaacgttggattcaatgtcaagaatgttgctgtgaaggatcttaagcgtgggtatgttgcatccaactccaaggatgaccctgccaagggtgctgccaacttcacttcccaagtcatcatcatgaaccaccctggtcagattggtaatggttacgccccagttcttgattgccacacatcccacattgcagtcaagttctctgagatcctcaccaagattgacaggcgatctggtaaggagattgagaaggagcccaagttcttgaagaatggtgatgctggtatggttaagatgactccaaccaagccaatggttgttgagactttctctgagtacccaccattgggtcgtttcgctgttagggacatgagacagaccgttgctgttggtgttatcaagagcgtcgacaagaaggacccaaccggtgctaaggtcaccaaggctgcagttaagaagggagctaaatgatgagactactctcgtctttgtttttttctttgcattacaaaaactttgatggcgtttgagcctttttaata

SEQ ID NO: 1427 - DNA, 1669 bp, Musa acuminata
atgtctttaaaagaagcggagggcgtcgctcatctccgcaactcacttcgctacctctcggccgcctctgtattagttttttttgctttaagctacagtcgccatggggaaagagaaggttcacatcagcattgtggtcattggtcacgtcgattctggcaagtcaaccaccactgggcatcttatctacaagctgggtggtattgacaagcgtgtcattgagaggtttgaaaaggaggctgctgagatgaacaagaggtcattcaagtatgcctgggttcttgacaagcttaaggctgagcgtgagagagggattaccattgatattgcactttggaagtttgaaacaaccaagtattattgtactgtcattgatgctcctggacaccgtgacttcattaaaaatatgatcactggaacatcccaggctgactgtgctgttcttatcattgactcaactactggtggttttgaagctggtatctctaaggatggccagactcgtgagcatgctctgcttgcttttacccttggagttaaacagatgatttgctgctgcaacaagatggatgcaaccacaccaaagtattccaaggccaggtatgatgaaatcgtcaaggaggtctaccaacctggattggtacaagggcccaacccttctcgaggctcttgacatgatccaggaaccaaagaggccatcagacaagccccttcgtcttcctcttcaggacgtgtacaagattggtggtattggtactgtcccggttggacgtgttgagactggtgtcctcaagcctggcatggttgttacttttggtccaacaggtttgacaaccgaagttaagtcagttgagatgcaccatgaagctctccaagaagccttccctggtgacaatgttggctttaacgtgaagaatgttgctgtgaaggatcttaagagaggtttcgtcgcatccaattctaaagaagatcctgcaaaggaggctgctaacttcacttctcaggtcatcatcatgaaccacccaggccaaattagcaatggttatgcccctgtgctcgactgccacacgtcccatattgcaaatggcgatgcaggcttcgtgaagatgattccgtccaagcccatggttgtggaaacgttctcccagtatcctccacttggtcgttttgctgtgagggatatgcgtcagactgtggccgtgggtgtcatcaagagtgtcgagaagaaggatcctaccggtgctaaggtcaccaaggctgctgccaagaagaaatgagatgattcagctctgcagcagtgtaatgttatacatgtaggtgcttagtggctgaggtgacgaaagccttcgatggttttcccccatcaaccccttttggtgtttctttcttgcgtatgtttgcttatgtgagtctaagtgcagctgtcttgggagattttaggttctctactccctggcagttcggaatatttatgtgaaatttagtggccctcagaagagttgtgaacattctgctttaaaataaaaattctatgtttttgggtcctttttagtgtaaattggatcaggtctagttttcttgtgattggcagctagtctctaaatcctttcggttcaatcttttagccatgtttgctggtttctgcctcggattgagaggcgttccacgg

SEQ ID NO: 1428 - DNA, 1391 bp, Triticum aestivum
acaagctcaaggctgagcgtgagagggtatcaccattgatattgctctctggaagttcgagaccaccaagtactcctgcactgtcattgatgctcctggtcaccgtgatttcatcaagaacatgatcactgggacctcccaggctgattgtgctgtgcttatcattgactccaccactggtggttttgaggctggtatctccaaggatggccagacccgtgagcacgctctccttgcgttcactcttggtgtgaagcagatgatctgctgctgcaacaagatggatgccaccactcctaagtactcgaaggcccgttatgaagaaattgtcaaggaagtctcttcatacctgaagaaggtcggttacaaccctgacaaggttcccttcgttcccatctctgggttcgagggtgacaacatgattgagaggtccaccaaccttgactggtacaagggccccaccctcttgaggccctggaccagatcaatgagcccaagaggccctccgacaagcccctgcgtcttccccttcaggacgtctacaagattggtggcattggaactgtgccagtggggcgtgttgagactggagtcatcaagccaggcatggttgtcacctttggtcctactggcctgaccactgaggtgaagtctgtggagatgcaccacgagtctctcctggaggcgcttcctggtgacaatgtcggcttcaacgtcaagaacgtggccgtcaaggatctcaagcgtggatacgtcgcttccaactccaaggacgaccctgccaaggaggctgccaacttcaccgcccaggtcatcatcatgaaccaccctggccagatcagcaacggctatgccccggtgctggactgccacacgtcccacattgctgtcaagttcgctgagatccagaccaagattgaccggcggtctggcaaggagattgaggcggcgcccaagttcctgaagaacggtgatgccgggttcgtcaagatgatccccaccaagcccatggtggtggaaacctttgcccagtaccctcccctgggccggtttgctgtgcgcgacatgaggcagacggttgccgtgggcgttatcaaggccgtggagaagaaggatccgaccggcgccaaggtgaccaaggctgcgccaagaagaaatgagatggtgtcaggttctttactgcatcatgatggtggttggcggtgacggctattggtaggtggtgatagttgttctagtcgtttgtaaacttgttaagcttcggttatttgtgtcgagctagtgttggaactgcttatgctctggtcattgtattcgttcggttgttgttggtggaactttgtcagttaatgttgctactatatatagtacatacatgtttggagtacgtt

SEQ ID NO: 1429 - DNA, 1361 bp, Cicer arietinum
gtctctctctgcggctgaggattccgaacgagtcttagatttcatttcttctttgctaagatatcatgggtaaagaaaagtttcatatcaacattgtcgtcattggacatgtcgattctggtaaatcaaccaccactggtcacttgatctacaagcttggaggtattgacaagcgtgtcattgagaggttcgagaaggaggctgctgagatgaacaaacgttcattcaagtacgcctgggtgctcgacaagcttaaggctgagcgtgaaagaggtattaccatcgatattgccttgtggaaattcgagaccaccaagtactactgcacagtcatcgatgcccccggacatcgtgatttcattaagaacatgattactggtacctcccaagctgattgtgctgtccttatcattgactccaccactggtggttttgaggctggtatctctaaggatggacagacccgtgagcacgctcttcttgctttcactcttggagtgaaacagatgatctgttgttgtaacaagatggatgccactacccccaagtactccaaggccaggtacgatgaaatcgtgaaggaagtttcttcatacttgaagaaggttggttacaaccctgacaaaatccccttcgtgccaatctctggatttgagggagacaacatgattgagaggtccaccaaccttgactggtacaagggaccaactctccttgaggctcttgaccagatcaacgagcccaagagaccctcagacaagcccctcaggcttccattgcaagatgtttacaagatcggtggtattggaactgtgccagtcggacgtgttgagactggagtcatcaagcctggtgtgatcgttacctttggccctaccggtctgacaactgaagttaagtctgttgagatgcaccacgaggctctcaccgaagctctccctggagacaatgttggattcaatgttaagaatgttgcagtgaaggatctcaagcgtggtttcgttgcatccaactccaaggatgaccctgctaaggaagctgccaacttcacttcccaagtcatcatcatgaaccatccaggacagattggaaacggttatgccccagtcctcgactgtcacacctcccacattgctgttaagttcgctgagcttctcaccaagattgacagacgatctggtaaggaactcgagaaggagcctaagttttgaagaatggtgatgctggtcttgttaagatgattccaacaaagcctatggttgtggtaaactttctccgagtatccaccacttggtcgttttgctgtgagggacatgcgtcaaactgttgctgtcggtgtcattaagagtgttgagaagaag

SEQ ID NO: 1430 - DNA, 1372 bp, Secale cereale
tcaaggctgagcgtgagaggggtatcaccattgatattgctctgtggaaattcgagaccaccaagtactcctgcactgtcattgatgctcctggtcaccgtgatttcatcaagaacatgatcaccgggacctcccaggctgattgtgctgtgcttatcattgactccaccactggtggttttgaggctggtatctccaaggatggccagacccgtgagcacgctctccttgctttcactcttggtgtgaagcagatgatctgctgctgcaacaagatggacgctaccactcccaagtactcgaaggcccgttatgatgaaattgtcaaggaagtctcttcatacctgaagaaggtcggttacaaccctgacaaggttcccttcgtgcccatctctgggtttgagggtgacaacatgatcgagaggtcctccaaccttgactggtacaagggcccgaccctgcttgaggcgcttgaccagatcaatgagcccaagaggccctcagacaagcccctccgtcttccccttcaggacgtgtacaagattggcggcattggaactgtgccagtggggcgtgttgagactggagtcatcaagccaggcatggttgtcacctttggccctactggcctgaccactgaggtgaagtctgtggagatgcaccatgagtctctcctggaggcgcttcctggtgacaatgtcggcttcaacgtcaagaatgtggctgtcaaggatctcaagcgtgggtacgtggcctctaactccaaggatgaccccgccaaggaggctgccaacttcacggcccaagtcatcatcatgaaccaccctggccagatcagcaacggctacgccccggtgctggactgccacacgtcccacatcgccgtcaagttcgctgagatccagaccaagatcgaccggcggtctggtaaggagctggaggcagcacccaagttcctcaagaacggcgacgctgggttcgtgaagatgatccccaccaagcccatggtggtcgagaccttcgcccagtaccctcccctgggccgctttgccgtgcgtgacatgaggcagacggttgctgtgggtgtgatcaagagcgtggagaagaaggagccgacgggcgccaaggtgaccaaggctgcgatcaagaagaaatgagatggtgttgggcagtggcgttgttggtggttctttgttccatctatggtggtggcggtggtatatgttggtggtgatagtcgtgttagtgggtttgaaaacttgttaagcttcgtgtatttgcgtcgtgcagtgtttgaacttcttactattctgttcatgttatggttcggttgtgttggtgaaacttcgtcggttaaagttgttactacatc

SEQ ID NO: 1431 - DNA, 1225 bp, Secale cereale
ttctccttcattcgagtttcagccatgggtaaggagaagactcacatcaacatcgtggtcattggccatgtcgactctggcaagtcgaccaccactggccatctgatctacaagcttggaggtatcgacaagcgtgtgatcgagaggttcgagaaggaagctgctgagatgaacaagaggtcgttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcccaagtactcgaaggcccgttatgaggaaattgtcaaggaagtctcttcgtacctgaagaaggtcggctacaaccctgacaaggttcccttcgtccccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggacgtttacaagattggtggcattggaactgtgcctgttggccgtgttgagactggtgtcatcaagcctggtatggttgttacctttggtcccactggtctgacaactgaggtcaagtctgttgagatgcaccacgagtccctcctggaggcgcttcctggtgacaacgttggcttcaacgtcaagaatgttgctgtgaaggatctgaagcgtgggtttgttgcatccaactccaaggatgaccctgccaaggaggccgccaacttcacctcccaggtcatcatcatgaaccaccctggtcagatcggcaacggctacgccccagtgctggactgccacacctcccacattgctgtcaagtttgctgagctggtgaccaagatcgacaggcgatcgtaggtaaggagcgtgggaggcgctcgaccctaagttcctacaagacggtgacgctggtatcgtgaagatgtacttcccaccaacgccc

SEQ ID NO: 1432 - DNA, 1145 bp, Secale cereale
cgttcgttcttcttcgagtttatacatcagccatgggtaaggagaagactcacatcaacatcgtggtcattggccatgtcgactctggcaagtcgacgaccactggccatctgatctacaagcttggaggcattgacaagcgtgtgatcgagaggttcgagaaggaagccgcggagatgaacaagaggtctttcaagtacgcctgggtgcttgacaagctcaaggctgagcgtgagagaggtatcaccatcgatattgctctctggaagttcgagaccaccaagtactactgcaccgtcattgatgcccctggtcaccgtgacttcatcaagaacatgatcaccggtacctcccaggctgactgtgctgttctcatcattgactccaccactggtggttttgaggctggtatctccaaggatggccagacacgtgagcacgctctccttgctttcactcttggagtgaagcagatgatttgctgctgcaacaagatggacgccaccactcccaagtactcaaaggctcgttacgaagaaattgttaaggaggtgtcttcctacctgaagaaggttggctacaaccctgacaaggttccctttgtccccatctctgggttcgagggtgacaacatgatcgagaggtccaccaaccttgactggtacaagggccccaccctgcttgaggcgcttgaccagatcaacgagcccaagaggccctcagacaagcccctccgacttcccctccaggatgtttacaagattggtggcattggaactgtgcctgttggccgtgttgagactggtgtcatcaagcctggtatggttgtcacctttggtcccactggtctgacaactgaggtcaagtccgttgagatgcaccacgagtctctgctggaggcgcttcctggtgacaatgttggcttcaacgtgaagaacgttgctgtgaaggatctgaagcgtgggtttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtcaccaagattgacaggcgatct

SEQ ID NO: 1433 - DNA, 1235 bp, Eschscholzia californica
ttctctcatttcttcttctccatcagcctagggtttaggtagccgttctatccgcttcagaagtaacgtagcatctactcgtcatgggtaaagagaagattcatatcagtattgtcgtcattggacatgtcgactctggaaagtcgaccaccactggtcacttgatctacaagttgggaggtatcgacaagcgtgtgatcgaaagattcgagaaggaggctgctgagatgaacaagaggtctttcaagtacgcatgggttcttgacaagcttaaggctgaacgtgagcgtggtattaccattgatattgccttgtggaagtttgagaccaccaagtactactgcactgttattgatgccccaggacatcgtgatttcatcaagaacatgattactggtacctctcaggctgattgtgctgtcctcatcattgactccaccactggaggttttgaagctggtatctctaaggatggacagacccgtgagcacgctcttcttgctttcacccttggtgtcaagcagatgatctgttgttgtaacaagatggatgccactactcccaagtactcaaaggcaaggtacgaggaaatcgttaaggaagtctcatcttacttgaagaaggttggatacaacccagacaaaatcgcctttgttcccatctctgggtttgagggtgacaacatgattgagagatccaccaacctcgactggtacaagggaccaacccttcttgaggctcttgaccaaatcaatgagccaaagagaccctcagacaagccactccgtcttccacttcaagatgtttacaagattggtggtattggaactgtgccagttggacgtgttgagactggagtcatcaagcccggtatggttgtcacttttggtcccactgggttgaccactgaggttaagtccgtggagatgcaccacgaggctctccaggaagcacttccaggtgacaatgtcggattcaacgttaagaatgttgctgtcaaggatctcaagcgtggtttcgttgcctccaactccaaagatgacccagccagggaagcagccaacttcacctcccaggttatcatcatgaaccaccctgggcagatcggtaacggatacgctccagttcttgactgtcacacctcccacattgctgtgaagttcggtgagatcctcaccaagatcgacaggcgatcaggaaaggagctcgagaaggagcccaagtttttagaagaa

SEQ ID NO: 1434 - DNA, 1384 bp, Primula obconica
cctctagtccattacggccgaaaacttcttttcaattgctcgtttctttggttcggctaggtcttttctctctctaattgaattacctggtaaaagttaagtatgggtaaggaaaagattcatatcagcattgtcgtcattggtcatgtcgactcgggcaagtcgaccaccactggtcaccttatctataagcttggaggtattgacaagcgtgttatcgagaggtttgagaaggaggctgctgagatgaacaagaggtcattcaagtatgcgtgggtgttggacaagctcaaggctgagcgtgaacgtggtattaccattgatattgctctgtggaagtttgagaccaccaagtattattgcactgtcatcgatgcccctggacatcgtgatttcatcaagaacatgattacgggaacttcccaggctgattgtgctgttctcattatcgattccaccactggtggttttgaagctggtatctccaaggacggtcagacccgtgagcatgctttgcttgctttcacccttggtgttaagcagatgatttgctgttgtaacaagatggatgctaccacccccaagtattccaagtcaaggtacgaagaaattgtgaaggaagtgtcttcttacctgaagaaggttggttacaaccctgacaaaatcccattcgtgcccatctctggatttgaaggtgacaacatgattgagaggtccaccaacctagactggtacaagggcccaacccttcttgatgctcttgaccaagtctcagagcccaagaggccctcagacaagcccctccgtctcccacttcaggacgtctacaagatcggtggcatcggaacggtgcccgtcggacgtgtcgagactggtgtcatcaagcccggaatggttgtcaccttcggcccatctggtctgacaactgaggttaagtccgtcgaaatgcaccacgagtctcttctagaagcccacccaggtgacaacgttgggttcaacgttaagaatgttgctgtgaaggatctcaagcgtgggtacgttgcctctaactccaaggatgaccctgccaagggagctgctagcttcacctcgcaggtcatcatcatgaaccacccaggccagatcggtaacggatacgccccagtgctcgattgccacacctcccacattgctgtgaaattctccgagattctgaccaagatcgataggcgatctggtaaggagctcgagaaggagcccaagttcttgaagaatggagatggcgggtatggtagaagatgactcccgaccaagcctatggttgtcgagactatttccgacgtacccaccgcgtgggtctttgcgtgtaggaggatagtggaggcagactaggttgcgttggttg

SEQ ID NO: 1435 - DNA, 1433 bp, Ambrosia trifida
ctgctgagatgacaagaggccttcaagtacgcttgggtcttgacaactaaaggactgagcgtgaacgtggtatcaccattgatatcgctctgtggaagtttgagaccaccaagtattactgcactgttattgatgctcctggacatcgtgatttcattaagaacatgattactggtacttcccaggctgattgtgctgttttgattattgactccactactggtggttttgaagctggtatttccaaggatggtcagacccgtgaacacgctctgcttgcttttactcttggtgtgaagcaaatgatctgctgttgtaacaagatggatgcaaccactcccaagtactcaaaggcaagatatgatgaaattgtgaaggaagtgtcatcctacttgaagaaggttggttacaacccagacaaaattccatttgtgcccatctctggatttgagggtgacaacatgattgagaggtctaccaaccttgactggtacaagggtccaacccttcttgaagctcttgatcagatcaatgagcccaagagaccatcagacaagcctcttcgtctcccacttcaggacgtgtacaagatcggtggtattggaactgtgccagtgggacgtgttgagactggtgtgatcaagcctggtatggttgttacctttggaccatctgggttgaccactgaagttaagtctgttgagatgcaccatgaagctctccaagaggctctccctggtgacaatgttgggttcaacgtcaagaatgttgcagtcaaggatctgaaacgtggttacgttgcatccaactcaaaggatgaccctgctaagggtgctgccagtttcacctcccaagtcatcaacatgaatcaccctggtcaaattggaaacggttatgctccggttttggattgccacacatctcacattgctgtcaagttttctgagcttttgaccaagattgacagacggtctggaaaagagctggagaaggagcccaaatttttgaagaacggagatgcgggtatggttaagatgcttccaactaagcccatggttgttgagaccttcgctgagtacccaccacttggtcggtttgctgttcgtgacatgcgtcagactgttgctgttggtgtgatcaagagtgttgacaagaaggacccaactggagctaaggtgaccaaggctgcagccaagaagggagctaaatgaaacggttttatattttatgaagtttttatcgtgttttggaactattttcatatctggttaagaatttttggtaattggtctttttggagcttgcacttctgtactctagcctcacttgtgaggatgggtggaggtattgagcaactttgtagttgcttgatgacggcggtgcaagttatccaggggccagcttttgttggttgattatgttgaacttctatg

SEQ ID NO: 1436 - DNA, 1724 bp, Cephalotaxus harringtonia
gaagggaataggcaggtctcttaaagggagccttcgatcttcttcatttctttctgtcgccgatctcaggaaaatctagttcgatcagccagtttttgatctcaagcaatcatgggaaaagaaaaacccacattaacattgttgtcattggccatgttgactctggaaagtcaactaccactggccatctgatctataagttgggtggtattgacaagcgtgtgattgaacgatttgagaaggaagctgctgagatgaacaaaaggtcattcaagtatgcttgggtgcttgacaagctcaaggctgagcgcgaacgtggtatcactattgatattgcgctttggaagtttgagactactaggtactattgcactgtgattgatgcccctggacatcgtgattttattaagaacatgattactggaacctctcaggctgattgtgcagtgctgattattgattcaacaactggaggttttgaggctggtatatccaaggatggtcagacccgagagcatgcccttctggcatttacattgggagtaaagcaaatgatttgctgttgtaacaagatggatgctaccacacccaaatactccaaggctcgttacgaggagattgttaaggaagtgtcttcttacctgaagaaggttggatacaacccagacaaaattccatttgtgcctatctctggttttgagggtgataacatgattgagagatcaagcaaccttgattggtacaagggtccaacactgttggatgcccttgatcaggtttcagaacccaagcgtcctacagacaaacctctcaggttgccacttcaggatgtttacaagattggtggtattggaactgtacctgtgggacgagttgagactggtgtgttgaagccaggtatgcttgtcacctttggcccatctgggttgactactgaagttaagtctgttgaaatgcaccatgaagctctgcaagaggcattgcctggtgacaatgtgggattcaatgttaagaatgttgctgtgaaggatcttaagagagggtacgtggcctctgattcaaagaatgacccagcaaaggaggcagcaaacttcacttcccaggttatcatcatgaatcatccaggacagattggaaatggttatgcccccgtgctggattgccacacatgccacattgctgttaagtttgctgagatcttgaccaaagttgataggcgatctggcaaggagcttgagaaggaaccaaaatttatcaagaatggggatgctggatttgtcaagatggttccaaccaagccaatggttgtggaaacattctctgattaccctccattgggtcgttttgctgtgagggacatgcgtcagacagttgctgttggagtcatcaaggctgttgagaagaaggaaccttctggtgctaaggttaccaaggcagctgctaagaagaagtgaaggtttgtgcaatgtgtgcaggaattgagtcatgcaagaagcattttgcatgcatgtatgcaggatttctgcacatatggtacagtggtaggaatcttattagcttctcatatgcatatgcaaaattgggttcttgatagacggtggcattgttcatttatttccattccaagcactttaatagtttaggaaatatacttgtgatttctcagttgcggggaaatttttgatttgtctgcactgctaggaaatctatgcagtctgagcaga

SEQ ID NO: 1437 - DNA, 1536 bp, Euonymus alatus
ggttatcatttcaagtatgcatgggtgttggacaaactcaaggctgagcgcgaacgtggtataaccattgatattgctctatggaagtttgagaccacaaagtattattgcactgtaattgatgctcctggacatcgtgactttattaagaatatgatcactggtacctcacaagctgactgtgctgtcctcatcattgactcaactactggtggttttgaagctggtatttccaaggatggccagacccgtgagcatgcactgcttgcttttactcttggtgtgaaacaaatgatttgttgctgcaacaagatggacgccactacacccaaatactctaaggctaggtatgaggaaattgtgaaggaagtttcttcctacttgaagaaggttggttacaaccctgacaagatcccatttgttcccatctctggttttgagggtgacaacatgatcgagagatctaccaaccttgactggtacaagggcccaaccctccttgatgctcttgaccagatctcagaacccaagaggccctcagacaagcccctccgtctcccccttcaggatgtttacaagattggtggtattggaactgtcccagtcggacgtgttgagactggtgtcctgaagcctggtacagttgtgacctttggtcctactggactgaccactgaagttaagtctgttgagatgcaccacgaggctctccaggaggccctgccaggtgacaatgttggcttcaatgtcaagaacgttgctgtgaaggatctgaagcgtggttttgttgcttccgactctaaaaatgatcctgctaaggaggctgccagcttcacctctcaggtcattatcatgaaccaccctgggcagattggaaatggctatgctccggtcctcgattgtcacacatctcatattgctgttaagtttgctgagatcttgactaagattgacaggcgatctggtaaggagctcgagaaggagccaaagtttttgaagaatggtgatgctggaatggtaaagatgattccaaccaagcctatggtagtggagaccttctctgcataccctcctcttggtcgtttcgctgttcgggacatgcgccagactgtggctgtgggagtcataaagagtgttgataagaaggaagcatctgcggccaaggtcaccaagtctgctgctaagaagaaatgaatcacgggagttcgcagtggattgcattcagctgaagtctactttcatatgaataattgtctttcttacacatttgatgttggtactgtcatctttggtttattttgttttatatgttatagttttgtgccgtcgttgggttgccagtctgagaaccgggtacttgacaggcggtggcagcacagtttatagcatagagccctcttgtttttggaggtttcagtgtcaattttctgtcgagattactgtgtctgagggttggttttctacttttcttccaaacggctcagaagttttgtcgttgtggttatcaagtaatgcaaattgtcgtatctttagttt

SEQ ID NO: 1438 - DNA, 1532 bp, Ananas comosus
tccttgacaagctcaaggctgagagggagcgtggtatcaccattgacattgctctgtggaagttcgagaccacaaagtactactgcacagtcattgatgcgcctgggcatcgggacttcatcaagaacatgatcacggggacatcccaggctgactgtgctgttcttatcattgattccaccactggtggttttgaagctggtatctcgaaggatggacagacccgtgagcacgccttgctcgctttcactcttggtgtcaagcagatgatctgctgctgcaacaagatggatgccaccactccaaagtactccaaggccaggtacgacgaaattgttaaggaagtttcatcctacctcaagaaggttggatacaaccccgataagatccccttcgtccccatctccggcttcgaaggtgacaacatgattgagaggtcaaccaacctcgactggtacaagggcccaacccttcttgaggccctcgacttgattcaggagccaaagaggcccaccgacaagcctctccgccttccccttcaggacgtctacaagattggtggtatcggcaccgtcccggtgggtcgtgttgaaaccggtgtcctcaagcccggtatggtggtcacttttgggcccactgggctgaccactgaggtcaagtctgtggagatgcaccacgaggcccttcaggaggccttacctggtgataacgttggcttcaacgttaagaacgtcgccgtcaaggatctcaaacgtggtttcgtcgcctccaactcgaaggaagatcctgcaaaggaggccgctagcttcacttctcaggttatcatcatgaaccaccccggacagattggcaatggctatgctcccgtactcgactgccacacctcccacatcgctgttaagtttgctgagatcctcaccaagattgatcgccgctctggcaaggagctcgagaaggagcccaagttcttgaagaacggtgatgcgggctttgttaagatgattccgaccaagcccatggttgttgagaccttctccgagtacccgccccttggccgttttgccgtccgtgacatgaggcagaccgttgctgtcggagtgatcaagagtgtcgagaagaaggatcccactggcgccaaggtcaccaaggccgccgcgaagaagaagtgaaagattaattattttaaatggttgagtcctaaattattcatggatctggtagctagtgttcattttgtctttctagtcgttttctatatgttttcgtcaaagccattggtactgtttggcccgagttgcagagtagggtgcttgataggtgtggcgcagttcgaaggttcggatttgtatttctagttaagtttgttttcttttattgctgttgagttgagagttaccattttgttgtcagggagttttaggtttttactccttggcagctcggttagttttctcatgtcggcatattgacattttcttttgtaatggtgatgcaatttaggttttaataatcttctgatctttttttttttc

SEQ ID NO: 1439 - DNA, 1339 bp, Panicum virgatum
atgggtaagaagaagagtcacatcaacattgtggtcattggccacatcagctctggcaagtcgaccaccactggccacctgatctacaagcttggaggtattgacaagcatatgatgcagaagcttcagaaagaggctgccattatgaacaagaagtccgtcaagtacgcatgggtgctcgacaagctcaaggctgagcgtgagaggggtatcaccatcgatatcaccttgtcgaagttcgagaccagcaagtactactgcactgtcattgatgcgcctggacaccgtgacttcatcaagaacatgatcaccggtacctcccaggctgactgtgccatccttatccttgattccactactggtggttatgaagctggtatctccaaggatggccagacctgcgagcatgctctcattgctttcactcttggagtgaagcagatgatttgctgctgtaacaagatggatgccacagcaccgcggtactcgaaggcccgttatgatgaaattgtgaaggacatctctcacttcctcaagaaggttggctacaaccctgacaaaattccttttgttcccatctctggtattgagggtgacaacttgactgagaggtccaccaaacttgactggtacaagggggccaaccctgcttgaggctgttgaccagatcaatgagcccaataggccctcggacaagcccttgcgtctcccccttcaggatgtgtacaagattggtggtattggtactgtgcctgttggttgcgtccaagctggtgtccttaagcctggcatggttgttacctttggtcctagcggcctgactactgaggtcaagtctattgagatgcacaacgaggctctccaggaagcccttcctggtgacattgtgggcttccatgtgaagaacgttgctgtgaatgatctcaagcgtggttatgtggcctccgactccaaggatgaccctgccaaggaggctgccagcttcacctcccatgtcatcattatgaaccaccctacacaaatttacaagggctatgcgccagtgctggactgtcacacctcccacgttgctgtcaagtttgctgagctcctcaccaagattgacagacgttctggcaaggagctcgagaaggagcccaagttcttaaagaacggtgatgctggtctggtgaaaatggttcccatcaagcccatggtggtggagaccatctccgagtaccctccccttggtcgttttgttgtccgtgacaagaatcagataattgctgttggagtcatcaggactgttgagaagtacccgactggttccaaggtggccaaggctgctaccaagaagtga

SEQ ID NO: 1440 - DNA, 1200 bp, Chelidonium majus
ttctctgctctacaagtgtcttaaacatgggtaaggagaaggttcacatcaatattgtcgttattggacatgtcgactctgggaagtcgaccaccactggtcacttgatttacaagcttggaggtattgacaagcgtgtgattgagagattcgagaaggaagctgctgagatgaacaagaggtcattcaagtacgcctgggtgcttgacaagctgaaggctgagcgtgagcgtggtatcaccattgacattgctctatggaagtttgagaccaccaagtactactgcaccgtcattgatgcccctggacatcgtgactttatcaagaacatgattacgggtacttctcaggctgactgtgctgtccttattatcgattccaccactggtggttttgaagctggtatctctaaggatggacagacccgtgagcatgctcttcttgctttcacccttggtgtgaagcagatgatctgttgttgtaacaagatggatgccaccacccccaagtactccaaggctaggtacgatgaaattgttaaggaagtctcatcctacctgaagaaggttgggtacaacccagacaaaattgcctttgtccccatctctggtttcgaaggagacaacatgattgagaggtctaccaaccttgactggtacaagggtccaaccctccttgaggcccttgaccagatcaatgagcccaagagacccacagacaagcccctccgtcttccacttcaggatgtttacaagattggtggtattggaactgtgccagtgggacgtgttgaaactggtttgatcaagcctggtatggttgtgacttttggccctactggtttgaccactgaagttaagtctgtggagatgcaccacgaggctctccaggaagctcttccaggtgacaatgttgggttcaatgtcaagaatgttgctgtgaaggatctcaagcgtgggtttgtgcgtccaactccaaggatgaccctgccagggaagccgctaacttcacctccaggtcatcatcatgaaccaccctggtcagatcggtaacggttatgctccagtgcttgattgccacacttctcacatcgctgtgaagtttggtgagatcctcaccaagattgacaggcgatctggaaaggggcttgagaaggagccttaagttttagaagtaatggtgatgcgtggtataggttaa

SEQ ID NO: 1441 - DNA, 1319 bp, Curcuma longa
gcacgcggtacaagctcaaggctgagcgagaacgcggtatcaccatcgatattgctctttggaagtttgagaccacaaagtactactgcaccgtcattgatgcacccggacaccgtgactttatcaagaacatgatcactggaacctctcaggctgattgtgctgtcctcattatcgactcaaccactggtgggtttgaggcaggtatttcaaaggatggccagacacgagaacacgctctccttgctttcactcttggtgttaaacagatgatttgctgctgcaacaagatggatgccactactccaaagtactccaaggctcgatatgacgaaattgttaaggaagtctcttcttacctcaagaaagttggttacaatccagacaagatcccattcgttcccatttctggttttgaaggtgataacatgattgagaggtcgactaacttggactggtacaagggtccgacccttctggatgccctcgacttgattcaggagccaaagaggcccacagacaagccccttcgccttccacttcaggacgtctacaagatcggaggcatcgggactgtcccagtcggtcgtgtggagactggcgtcctcaagcctggtatggttgtcacttttggcccgaccggtctcaccaccgaagtcaagtctgtggaaatgcaccatgaggctctacaagaggctctccccggcgacaatgtcgggttcaatgttaagaatgttgcagtcaaggatctcaagcgaggtttcgtcgcttccaactccaaggatgatcctgcaaaggaggcagctaattttacatctcaggtcatcatcatgaaccacccgggccagattggcaatggatacgcccccgtgcttgattgccacacctcccatatcgccgtcaagtttgctgaaattctcaccaagatcgataggcgctccggcaaggaacttgagaaggagcccaagttcctcaagaatggtgatgctggattcgtcaagatgattcccaccaagcaaatggtggttgagaccttctccgagtacccgcctctcggtcgtttcgccgtgagagacatgagacaaaccgtggccgtcggcgtcatcaagagcgtcgagaagaaggatccaaccggtgccaaggtcacaaaggccgcagccaagaagaaatgagctgcttcgtttaactgtccttcattatattctgaaagtctctttgctagtctggtagtgagtgtcgatcgagcatttgcatggcgttctgaaaggattgaacttaatttgtattgtagcgacaagattttaatcaccattattaat

SEQ ID NO: 1442 - DNA, 1292 bp, Secale cereale
actcctcttcgtccccggacagccaggtagttatcagccatgggtaaggagaagatccacatcagcattgtggtcattggccatgtcgactctggcaagtcaaccacgactggccacctcatctacaagcttggaggcattgacaagcgtgtgatcgagaggttcgagaaggaagccgctgagatgaacaagaggtcgttcaagtacgcctgggtgcttgacaagctcaaggctgagcgtgagagaggtatcaccattgatattgctctgtggaagttcgagaccaccaagtactcctgcaccgtcattgatgctcctggtcaccgtgatttcatcaagaacatgatcactggtacctcccaggctgattgtgctgtgcttatcattgactccaccactggtggttttgaggctggtatctccaaggatggccagacccgtgagcatgctctccttgctttcactcttggtgtgaagcagatgatctgctgctgcaacaagatggacgccaccactcccaagtactcaaagtcccgttatgaagaaattgttaaggaagtctcttcatacctgaagaaggtcggttacaaccctgacaaggttcccttcgtccccatctctgggttcgagggtgacaacatgattgagaggtccaccaaccttgactggtacaagggccccacccttcttgaggcccttgaccagatcaatgagcccaagaggccctcagacaagcccctccgccttccccttcaggatgtctacaagattggtggcattggaactgtgccagtggggcgtgttgagactggtgtcatcaagccaggtatggttgtcacctttggccctactggcctgaccactgaggtgaagtctgtggagatgcaccacgagtctctcctggaggcgcttcctggtgacaatgtcggcttcaacgtcaagaacgtggccgtcaaggatctcaagcgtgggtatgttgcctccaactctaaggacgaccccgccaaggaggctgccaacttcactgcccaggtcatcatcatgaaccaccccggccagatcagcaatggctacgccccagtgctggactgccacacgtgccacatcgccgtcaagtttgctgagatccagaccaagatcgacaggcggtccggcaaggagctggaggctgccgcccaagttcctcaagaacggtgacggccgggttcgtaaagatgacttcccaccaacgcccagtggtggtggagtacctttcgccctacgtacccctcccgtcgggccgtctttgctgt

SEQ ID NO: 1443 - DNA, 1681 bp, Vinca minor
ggtctcataccgcagccgctggattttcctctgcttcctaagctttctgaaagttcagcggtatgggtaaggaaaagattcacatcagcattgtggtcattggccatgtcgactctggcaaatcgaccaccactggtcacttgatctacaagcttggaggtattgacaagcgtgtgattgaaaggttcgagaaggaggctgctgaaatgaacaagaggtcattcaagtacgcatgggtgctcgacaagctcaaggctgagcgtgagcgtggtatcaccatagatattgccttgtggaaatttgaaaccaccaagtactactgcacagtcattgatgccccgggacatcgtgatttcatcaagaacatgattactggtacctcacaggctgactgtgctgtccttatcatcgactccaccactggtggttttgaagctggtatctccaaggatggtcaaactcgtgagcacgccttgcttgccttcactctcggtgtcaagcagatgatctgctgctgtaacaagatggatgctaccacccctaagtactccaaggctaggtacgaagaaatcattaaggaagtgtcatcttacctcaagaaggtcggatacaacccagacaaaattccctttgtccccatctctggttttgaaggagacaacatgattgagaggtctaccaaccttgactggtacaagggaccaaccctccttgaagctcttgaccagatctcagagcctaagaggccctcagacaaaccactccgtctcccacttcaggacgtctacaagattggtggtattggtactgtcccggtgggtcgtgtggaaacaggtgtcatcaaacctggtatggttgtgacctttggcccaactggtttgactactgaagttaagtcagttgagatgcaccacgaggccctccaggaggcacttcccggtgacaatgtcggtttcaatgtgaagaatgttgctgttaaggatatcaagcgtggttatgttgcatccaactccaaggatgacccagccaagggggccgccagcttcacctcccaggtcatcatcatgaaccaccctgggcagattggtaatggatatgcacctgtgctggattgccacacctctcacattgcagtcaagtttgctgagcttctgaccaagattgacagacgatctggtaaagagctcgagaaggagcccaagttttgaagaatggtgatgcaggtatggttaagatgattcctaccaagcccatggttgtggagacctttgctcagtaccctccccttggccgttttgctgtgagagacatgcgtcaaactgtcgctgttggtgttattaagagcgtggacaagaaggacccaactggtgccaaggtcaccaaggctgctgccaagaagggtgccaaatgaaccgtgatggttggttctggtactgctgctgatgttcactatttcaataaagctttttatgaaatctggaaattttatagaactgctatcgtagtttcgtctttgtttcatttgttgtgttgctgtaggtttctgccttgtaagttcagtatcctttctcagaattgggtacttgataggcggtggcagttcctacaattttagtctttgttatgttttgttggagtcttcatacatttggggtgcttaggtttttcctggctgctcaag

SEQ ID NO: 1444 - DNA, 1319 bp, Cicer arietinum
acacgtagtattgaggattccgaacgagtcttagatttcatttcttctttgctaagatatcatgggtaaagaaaagtttcatatcaacattgtcgtcattggacatgtcgattctggtaaatcaaccaccactggtcacttgatctacaagcttgtaggtattgacaagcgtgtcattgagaggttcgagaaggaggctgctgagatgaacaaacgttcattcaagtacgcctgggtgctcgacaagcttaaggctgagcgtgaaagaggtattaccatcgatattgccttgtggaaattcgagaccaccaagtactactgcacagtcatcgatgcccccggacatcgtgatttcattaagaacatgattactggtacctccaagctgattgtgctgtccttatcattgactccaccactggtggtttttgaggctggtatctctaaggatggacagacccgtgagcacgctcttcttgtctttcactcttggagtgaaacagatgatctgttgttgtacaagatggatgccactacacccaagtactcaaaggccaggtacgatgaaatcgtgaaggaagtttcttcatacttgaagaaggttggttacaaccctgacaaaatccccttcgttccaatctctggatttgagggagacaacatgattgagaggtccaccaaccttgactggtacaagggaccaactctccttgaagctcttgaccagatcaacgagcccaagagaccctcagacaagcccctcaggcttccattgcaagatgtttacaagatcggtggtattggaactgtgccagtcggacgtgttgagactggagtcatcaagcctggtgtgattgttacctttggccctaccggtctgacaactgaagttaagtctgttgagatgcaccacgaggctctcaccgaagctctccccggagacaatgttggattcaatgttaagaatgttgcagtgaaggatctcaagcgtggtttcgttgcatccaactccaaggatgaccctgctaaggaagctgccaacttcacttcccaagtcatcatcatgaaccatccaggacagatcggaaacggttatgccccagtcctcgactgtcacacctcccacattgctgttaagttcgctgagcttctcaccaagatcgacaggcgatctggtaaggaacttgagaaggagcctaagtttttgtagaatagtggatgctggtcgttgtttaagtaatgattcctaacccaaacgacctactggttggttggaacgtttacttccgacgtatccacccaccttggttcggtttcgt

SEQ ID NO: 1445 - DNA, 1578 bp, Cicer arietinum
ggccctatccccctcgtgtgccttgagagacgccgaccacgccacgtatgtctctctctgcggctgaggattccgaacgagtcttagttttctattcttctttgtctaagatatcatgggtaaagaaaagttttcatatcaacattgtcgtcattggacatgtcgactctggaaaatacaaccaccactggtcacttgatctacaagcttggaggtattgacaagcgtgtcattgagaggttcgagaaggaggctgctgagatgacaaacgttcattcaagtacgcctgggtgctcgacaagcttaaggctgagcgtgaaagaggtattaccatcgatattgccttgtggaaattcgagaccaccaagtactactgcacagtcatcgatgcccccggacatcgtgatttcattaagaacatgattactggtacctcccaagctgattgtgctgtccttatcattgactccaccactggtggttttgaggctggtatctctaaggatggacagacccgtgagcacgcccttcttgctttcactcttggagtgaaacagatgatctgttgttgtaacaagatggatgccactacacccaagtactcaaaggccaggtacgatgaaatcgtgaaggaagtttcttcatacttgaagaaggttggttacaaccctgacaaaatcccttcgttccaatctctggatttgagggagacaacatgattgagaggtccaccgaaccttgactggtacaaggggaccaactctccttgaggctctttgaccaggatcgaacgggccccaagggacccctgagacaagcccctcaggcttccattgcaagatgtttacaagatcggtggtattggaactgtgccagtcggacgtgttgagactggagtcatcaagcctggtgtgatcgtcacctttggccctactggtctgacaactgaagttaagtctgttgagatgcacccacgagggctctcacccgaaagctctcccccggagacaaatgttgggattcaatgttaaggaatgttgcagtgaaggatctccaagcgtggtttcgttgcatccaactccaaggatgaccctgctaaggaagctgccaacttcacttcccaagtcatcatcatgaaccatccaggacagattggaaacggttatgccccacgtctcgactgtcacacctcccaccattgtctgtttaagtttacgtctgagcttcttcaccaacgaattgtacagacgatctggtaagggaaacgtcgagaaggaaggcctaacgtttttagttaagaaataggttggatgctggtcgtttgtttaagtaatgattcctaaccaaaagacctactggttggttggaaactttacttccgacgtatccaccacttggtcgtttgtcggtgagggacgatgcgtcaaactagttgtctgtcggtggtcattaagtagtgttgagaagaaggatccaactaggaggccaacgaattcaccaaacggcgtgcagtcaagaagaagtagaggtacgtggcggggtcggcggtctctcaggacgacacagggagtagggggg

SEQ ID NO: 1446 - DNA, 1234 bp, Eschscholzia californica
ggcaattattttcggcgagagcttctaccgaggaggcgctcccatttcttcatcttctgctaagagagattcttgctggtaattcttcgatttcaacatgggtaaagagaagattcatatcagtattgtcgtcatcggacatgtcgactctggaaagtcgaccaccactggtcacttgatttacaagttgggaggtattgacaagcgtgttattgaaagattcgagaaagaggctgctgagatgaacaagaggtcattcaagtacgcatgggttcttgacaagcttaaggctgaacgtgagcgtggtattaccattgatattgccttgtggaagtttgagaccaccaagtactactgcactgttattgatgccccaggacatcgtgatttcatcaagaacatgattactggtacctctcaggctgattgtgccgtcctcatcattgactccaccactggagggtttgaagctggtatctctaaggatggacagacccgtgagcacgctcttcttgctttcacccttggtgtcaagcagatgatctgttgttgtaacaagatggatgccactactcccaagtactccaaggcaaggtatgaggaaatcgttaaggaagtctcatcatacttgaagaaggttggatacaacccagacaaaatcgcctttgttcccatctctgggtttgaaggtgacaacatgattgagagatccaccaaccttgactggtacaagggaccaaccgttcttgaggcacttgaccagatcaatgagccaaagagaccctcagacaagccactccgtcttccacttcaggatgtttacaagattggtggtattggaactgtgccagtgggacgtgttgagactggagtcatcaagcccggtatggttgtcacttttggtcccactgggttgaccactgaggttaagtccgtggagatgcaccacgaggctctccaggaagcacttccaggtgacaatgtcggattcaacgttaagaatgttgctgtcaaggatctcaagcgtggtttcgttgcctccaactccaaagatgacccagccagggaagcagccaacttcacctcccaggttatcatcatgaaccaccctgggcagatcggtaacggatacgctccagttcttgactgtcacacctcccacattgctgtgaagttcggtgagatcctcaccaagatcgacaggcgatcaggaaaggagctcgagaaggagccc

SEQ ID NO: 1447 - DNA, 1425 bp, Utricularia gibba
gaacaagaggtccttcaagtacgcatgggtgctggacaaactcaaggccgagcgtgagcgtggtatcaccatcgatatcgctctctggaagttcgagaccaacaagtactactgcaccgtcattgatgcccctggccatcgtgatttcatcaagaacatgatcacaggaacatcacaggctgattgcgctgtgctcattattgactccaccacaggaggtttcgaagccggtatttccaaggatggtcagacccgtgagcacgctcttctcgctttcacccttggtgtgaagcagatgatttgctgcctcaacaagatggatgccaccacccccaagtactccaaggctcgttacgaggaaatccaaaaggaagtgtcatcttacctgaagaaggtcggatacaaccccgagaaggttcctttcgtgcccatctccggattcgagggagacaacatgattgagaggtcaaccaacctcgactggtacaagggccccacccttctggaagctctcgacaacgtcactgagccaaagagaccctccgacaagcccctcagacttcccctccaggacgtgtacaagattggaggtatcggcacagtgcctgtgggacgtgttgagaccggtgttatcaagcccggtatggtgatcaccttcgcccccactggactcaccactgaagttaagtctgtcgagatgcaccacgagtctctccccgaggctaaccccggagacaatgttggctttaacgtcaagaacgtgtcagtcaaggagttgaagcgtggtttcgtcgcctctgactctaagaatgaccccgcaaaggaggctgctaacttcactgctcaggtcatcatcatgaaccaccctggacagatcggaaacggatacgctcccgtcctcgattgccacacttctcacattgctgtgaagtttgccgagatcctcgtcaagattgacaggcgttccggtaaggaaattgaaaaggaacccaagtttgtgaagaatggtgacgcttgcttcgtgaagatgattccctccaagcctatgtgtgtcgagactttctccacctacccaccactcggaagatttgctgtcagagacatgaggcagaccgtcgccgtcggtgttatcaaggccgttgagaagaaggatgccaccagcgccaaggtgaccaaggctgcagtcaagaagaagtgaatagttttgtcattttgggctcgagtagggaaccaaaaatacacgaagattagacattgcttgcttgatctgttgaagaggagtttgatttggttagctgagtcccgtcgacttcagacctgggtgctggataggcggtggcatgcttaactggaatggatttctctttaatgacatttttctgaaacaaaaaaaaaacaaaacggccatcaaaatacaactacaaa

SEQ ID NO: 1448 - DNA, 1610 bp, Secale cereale
ctgaaggccgagcgtgagagggtactcaccattgatattgcctgtgaagttcgagaccaccaagtactactgcaccgtcattgatgcccctggtcaccgtgacttcatcaagaacatgattactggtacctcccaggctgactgtgctgtgctcatcattgatccaccacttggggtttttgaggctggtatctccaaggatggccagacccgtgagcagccctcctttgctttcactcttggagtgaagcagatgatctgctgctgcaacaagatggatgccaccactcccaagtactcgaaggcccgttatgaggaaattgtcaaggaagtgtcttcgtacctgaagaaggtcggctacaaccctgacaaggtccccttcgtccccatctctgggtttgagggtgacaacatgattgacaggtcccaaccttgactggtacaagggcctaccctgcttcgagcgcttgaccagatcaacgagcccaagaggccctcagacaagcccctcgcgtcttccccttcaggatgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgttggcttcaacgtcaagaatgttgctgtgaaggatctgaagcgtgggtttgttgcatccaactccaaggatgaccctgccaaggaggccgccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgatgctggtatcgtgaagatgattcccacccaagcccactggttgtggagaccttcgccacctaccctcctcttggccgcttcgctgtgcgtgacatgagacaaacagttgctgttggtgtcatcaagggcgtggagaagaaggacccaccggtgccaaggttaccaaggccgccatcaagaagaaataggcttctatctagcagaaggtttttgttcatggtcattgctttcgttgcttcagactcttatcccgggcgagcaatgatcctgtctgtcgtttaattactgtatttctattcctgcgtaaactcctgtgccctgagactgatttgttgtgaaatgcaagctatttagattggcaacttatgtacaaaaaaaaaaaaaaaaaaaacaaaaaaaaaaaaaaacaaaaaaaagaaaaagaaagaataagatatacagactacatacactacaacactacaactacgacacggaggacggacgagtacgagtacacgctagtagacgagcgacagcagagtacagacagaacgtggacgcacctatcgcaggaagagtagacagagtagaggtagatactagagagcgagtgtatgtgtacagacacacatacagagaggaggagacgacacgagagaga

SEQ ID NO: 1449 - DNA, 1147 bp, Triticum aestivum
gcttgacaagctgaaagccgagcgcgagaggggtatcaccattgatattgccctgtggaagtttgagaccaccaagtactactgcaccgtcattgatgcccctggtcaccgtgacttcatcaagaacatgatcaccggtacctcccaggctgactgtgctgttctcatcatcgactccaccactggtggttttgaggctggtatctccaaggatggccagacacgtgagcacgccctccttgctttcactcttggagtgaagcagatgatctgctgctgcaacaagatggacgccaccactcccaagtactcaaaggcgcgttatgaagaaattgtcaaggaggtctcttctacctgaagaaggtcggctacacccgacaaggttcccttcgtcccatctctggtttgaggtgacaacatgattgagaggtccaccaaccttgactggtacaagggcccaaccctacttgaggctctggacttgatcaatgagccaaagaggccttcagacaagcccctgcgtctcccccttcaggatgtgtacaagattggtggtattggaactgtccctgttggacgtgttgagactggtgtcattaagcctggtatggttgttacttttgggcctactggtcttactactgaggttaagtccgttgagatgcaccatgaggctctccaggaggcccttcccggtgacaatgttggcttcaacgtgaagaatgttgctgtgaaggatctgaagcgtgggtatgtggcctccaactccaaggatgaccctgccaaggaggctgctagctttacctcccaggtcatcatcatgaaccaccctggccagattggcaatggctatgccccagtgctggactgccacacctcacacattgctgtcaagtttgctgagctcgttaccaagattgataggcgatctggcaaggagctggagaaggagcccaaattcctcaagaacggtgatgctggtatggtgaagatggttcccaccaagcccatggtggtggagaccttctctgagtatcctcctcttggtcgctttgctgtccgtgacatgaggcaaacggtggctgtcggagtcatcaagagtgtggagaagaaggacccaactggagccaaggtgaccaaggctgcc

SEQ ID NO: 1450 - DNA, 1530 bp, Brassica napus
ggctctcatttcagtttcgtagccgcaagtcctcctctcagattcttacttgcagctatgggtaaagagaagtttcacatcaacatcgtggtcattggccatgtcgactctgggaaatcgaccaccactggtcacttgatctacaagcttggtggtattgacaagcgtgtcattgagaggttcgagaaggaagctgctgagatgaacaagaggtctttcaagtacgcgtgggtgttggacaaacttaaggccgagcgtgagcgtggtatcaccattgatattgctctctggaagttcgagaccaccaagtactactgcacggtcattgatgcccctggtcatcgtgatttcatcaagaacatgattactggtacctcccaggctgattgtgctgtcctcatcattgactccaccactggtggttttgaagctggtatctccaaggatggtcagacccgtgagcatgctcttcttgctttcacccttggtgtcaagcaaatgatttgctgctgtaacaagatggatgccactacccccaagtactccaaggctaggtacgatgagatcatcaaggaggtgtcttcctacttgaagaaggttgggtacaaccctgacaaaatcccattcgtccccatctctggattcgagggtgacaacatgattgagaggtccaccaaccttgactggtacaagggaccaactctccttgaggctcttgaccagatcaacgagcccaagaggccctcggacaagcccctccgtctcccacttcaggatgtctacaagatcggtggtattggaacggtgccagtgggacgtgttgagaccggtatgctcaagcccggtatggttgtgacctttgctccttcagggttgaccactgaggttaagtctgttgagatgcaccacgagtctcttgtggaggcacttccaggtgacaacgttggattcaatgttaagaacgttgctgtgaaggatcttaagcgtgggtatgttgcatctaactccaaggatgacccagctaagggagctgccaacttcacatcccaggtcatcatcatgaaccaccctggtcagatcggtaacggatacgccccagtcctcgattgccacacgtcccacattgcagtcaagttctctgagatcttgaccaagattgacaggcgatctggtaaggagatcgagaaggagcccaagttttgaagaatggtgatgctggtatggttaagatgactccaaccaagcccatggttgtcgagtactttctcagagtacccaccgttgggacgtttcgctgtcgagggacatgaggcagaccgttgctgtgtgtcatcagagtgttgacagaaggccaacggtgccaaggtgaccaaggccgcagtcgaagaacggagccaaatggatgagacttcgtctcgtctttgtcgttttactttgacttttaaaaacgttgattggcgtttagagtccttgttactttatttcgtgttgactttctctatctcttactcttttttacatactctactt

SEQ ID NO: 1451 - DNA, 1617 bp, Papaver somniferum
agctctgtgctgcggagcttttctaatcgccgtttcagttaatttctaagaattcaatatgggtaaagagaaggttcacatcaacattgtcgtcattggacatgtcgactctggtaaatcgaccactactggtcacttgatctacaagcttggaggtattgacaagcgtgttattgaaagatttgagaaggaggctgctgagatgaacaagaggtcattcaagtatgcatgggttcttgacaagcttaaggctgaacgtgagcgtggtattaccattgatattgccttgtggaagtttgagaccaccaagtactactgcacagttattgatgctcctggacatcgtgactttatcaaaaacatgattactggtacttctcaggctgattgtgccgttctcattatcgattccaccactggaggttttgaggctggtatctcaaaggatggtcagactcgtgagcacgctcttcttgctttcactcttggtgtcaagcagatgatctgttgttgtaacaagatggatgccaccactcctaagtactcaaaggccaggtacgatgaaattgtcaaggaagtctcatcttacttgaagaaggttggatacaacccagacaaaattgcctttgttcctatctctggattcgagggagacaacatgattgagaggtccaccaaccttgactggtacaagggaccaactcttctcgatgctcttgacaatatctctgagccaaagagaccctcagacaagccccttcgtcttccccttcaggatgtttacaagattggaggtattggaactgtgccagtgggacgtgttgaaactggattcatcaagcctggtatggttgttacctttggacccactgggttgaccactgaagttaagtctgtggagatgcaccacgaagcccttcaagaagctcttccaggagacaatgttgggttcaatgtcaagaatgttgcagtgaaggatctcaagcgtggttttgtcgcctccaactccaaggacgaccctgccagggaagctgccaacttcacctcccaggtcatcatcatgaaccatcctggtcagattggaaacggttatgccccagtcctcgactgtcacacatctcacattgctgttaagtttgctgagatcctcaccaagattgataggcgatctggaaaggagcttgagaaggacgcccaagttcttgaagaatggtgatgctggtatcattaagatgcttccaacaaagcccatggtcgtaagagaccttctctcagtacccacctcttggtcgttttgctgttagggacatgaggcagacagttgctgttggtgttatcaaggaagttgagaagaaggacccaacaggagccaaggttaccaagtctgctgtcaagaagaaatgaagtgtgctgccaaggttaactagagggagagggatggtgctaagaggatctacaggagggacttatttctttactattagtcagttttgttttttgttttcggggcattaggtatcagtgtggtcttttgttttgtttcacctttgttttgttgcgcattcagttgcaaacctgggtgcttgacaggcggtggcaacaaggtgttgggctgtt

SEQ ID NO: 1452 - DNA, 1223 bp, Triticum aestivum
gtgaacaacgaaggcgtttcccaagtatgcctgggtgctgcaagctcgaggctgaggcgtgacacgggggtatacacccattgatattgctctcgtggaaattccgagaccaccaagtaccctggcactagtcgattgatgctccctggtcaccgtgatttcatcagaacatgatcaccgggactcccagggctgattgtgctgtgcttatcattgactccaccactggtggttttgaggctggtatctccaaggatggccagacccgtgagcacgctccccttgctttcactcttggtgtgaagcagatgatctgctgctgcaacaagatggatgccaccactcccaagtactcgaaggcccgttatgaagaaattgtcaaggaagtctcttcatacctgaagaaggttggttacaaccctgacaaggttccctttgttcccatctctgggttcgagggtgacaacatgattgagaggtccaccaaccttgactggtacaagggccccacccttctcgaggccctggaccagatcaatgagcccaagaggccctcaagaacaagcccctccgtcttccccttcaggacgtgtacaagattggcggcattggaactgtgccagtgggccgtgttgagactggagtcatcaagccaggcatggttgtcaccttttggtcctactggcctgaccactgaggtgaagtccgttgagatgcaccatgagtctctcctggaggcgcttcctggtgacaacgtcggcttcaacgtcaagaacgtggctgtcaaggatctcaagcgtgggtacgtcgcttccaactccaaggacgaccctgccaaggaggctgccaacttcaccgcccaggtcatcatcatgaaccaccccggccagatcagcaacggctatgccccggtgctggactgccatacgtcccacattgctgtcaagtttgctgagatccagaccaagatcgaccggcggtctggcaaggagattgaggcggcgcccaagttcctcaagaacggtgatgctgggttcgtcaagatgatccccaccaagcccatggtggtggagacctttgcccagtaccctcccctgggccgctttgctgtgcgtgacatgaggcagacggttgccgtgggcgttatcaaggccgtggagaagaaggatccgaccggcgccaaggtgaccaaggctgcggccaagaagaaatgagatggtgtc

SEQ ID NO: 1453 - DNA, 1244 bp, Gossypium hirsutum
tcaagcttggtggtattgacaagcgtgtgattgagaggtttgagaaggaggctgctgagatgaacaaaaggtcatttaagtatgcatgggtgcttgacaagcttaaggccgaacgtgaacgtggtattaccatcgatattgccctctggaagtttgagactaccaaatactactgcacagtcattgatgcccctggacaccgtgacttcatcaagaacatgattactggtacctcacaggctgactgtgctgttctcattatcgactcgaccactggtggttttgaagctggtatctcaaaggatggtcagacacgtgagcatgctttgcttgcgtttacccttggtgtcaagcagatgatttgctgctgcaacaagatggatgcaacaactccaaaatactccaaggcaaggtatgatgaaattgtgaaggaagtctcctcatatcttaagaaagttggttacaaccctgacaagatcccatttgtcccaatctctggatttgagggtgataacatgattgagaggtctaccaaccttgactggtacaagggtcccactctccttgaggctcttgaccagatcaatgagcccaagaggccttcagacaagccacttcggctacccaacttacaaggatgtctacaagattggtggcattggaactgtacctgttggtcgtgttgagactggtgtccttaagcctggtatggttgtgacctttggcccctctggtctgaccactgaagttaagtctgttgagatgcaccatgaagccctctctgaggctctccccggtgacaatgttggattcaacgtcaagaacgttgctgttacggatctcaaggatggtttcgttgcttcaaactcttaaggatgatcctgccaaggaggctgccagcttcacctctcaggtcatcatcatgaaccaccctgggcagattggaaacggatatgccccagtccttgattgccatacctcccacattgctgtgaaattttctgaattgctgaccaagatcgacaggcgatctggaaaggagcttgacaaggaacccaactccttgaagaatggtgatgcacggatgataacaatggttcccaccaaccccatgggtgcggtagacttcctgtcagtaccctccccttgtaaagctctgcggcaaggtcctgcagtccacatgtggctgccggtggtctccccgaccgttgaataaaacgaccccaccggtcgctaagtccccc

SEQ ID NO: 1454 - DNA, 1292 bp, Eragrostis curvula
agaagaacgcagccctcgtcaactgatgaagcagcgaagtcgccggcgcaccgtcccggccccccagatccgccgagcagttaactcttcccttcagccatgggtaaggagaagagccacatcaacattgtggtcattggccatgtcgactccggcaagtcgaccaccactggccacttgatctacaagcttggaggtattgacaagcgtgtgatcgagaggttcgagaaggaagccgctgagatgaacaagcggtccttcaagtacgcgtgggtgcttgacaagctcaaggccgagcgtgagagaggtatcaccatcgatatcgcgctgtggaagttcgagaccaccaagtactactgcactgtcattgatgcccctggacaccgtgacttcatcaagaacatgattaccggtacctcccaggctgactgtgctgtccctatcattgactccaccactggtggttttgaggctggtatctccaaggatggccagacccgtgagcatgctcttcttgctttcactcttggagtgaagcagatgatttgctgctgcaacaagatggatgccaccactcccaagtactcgaaggcccgttacgatgagattgtgaaggaagtctcttcctacctcaagaaggtcggctacaaccctgacaagatcccctttgttcccatctctggttttgagggtgacaacatgattgagaggtccaccaatcttgactggtacaagggccccactctgctggaggctcttgaccagatcaacgagcccaagaggccctcagacaagcccctgcgtctcccccttcaggatgtgtacaagattggtggtattggaactgtccctgtgggccgtgtggagactggagtcctcaagcctggtatggttgttacgtttggtcccagtggcctaacaactgaggttaagtctgttgagatgcaccacgaggctcttcaggaggctcttcctgggtgacaatgtgggcttcaatgtgaagaatgttgctgtgaaggatatcaagcgtggtaatggttgcctcaaactccaagaatgaccctgccaaggaggccgcaagcttcacctcccaggtcatcatcatgaaccaccctgggcaaatcggcaacggctatgccccagagctggactgccacactcccacattggctgttaagtttgctgacctccaaaccaaaatggaaaaacgatctggcaagaaacttgaaaaggagcccaatttctgaagaaccgtggatgcgggttatggttaaaagattcccccaaagcca

SEQ ID NO: 1455 - DNA, 1375 bp, Brassica juncea
agatttatttagccatgggtaaagagaagtttcacatcaacattgtggtcatcggccacgtcgactccgggaagtcaaccaccaccggtcacttgatctacaagctcggtggtatcgacaagcgtgtcatcgagaggttcgagaaggaggctgctgagatgaacaagaggtctttcaagtacgcttgggtgttggacaagcttaaggccgagcgtgagcgtggtatcaccatcgacattgctctttggaagtttgagaccaccaagtactactgcactgtgatcgacgctcctggtcatcgtgatttcatcaagaacatgatcaccggtacctcccaggcggattgtgctgttttgattattgactccaccaccggtgggttcgaggctggtatctcaaaggatggtcagacccgtgagcatgctcttcttgctttcacacttggtgtcaagcagatgatttgctgctgtaacaagatggatgctactacccccaagtactccaaggctaggtacgatgagattatcaaggaggtgtcttcctacttgaagaaggttgggtacaaccctgacaaaatcccattcgtccccatctctggtttcgagggtgacaacatgattgagaggtccaccaaccttgactggtacaagggaccaactctccttgaggctcttgaccagatcaacgagcccaagaggccctcggacaagccccttcgtctcccacttcaggacgtctacaagattggtggtattggaacggtgccagtgggtcgtgttgagaccggtatgctcaagcccggtatggttgtgaccttcgctccttcagggttgaccactgaggtcaagtctgttgagatgcaccacgagtctcttgtggaggcgcttccaggtgacaacgtgggattcaacgttaagaatgttgctgtcaaggatctcaagcgtgggtacgttgcatccaactccaaggatgaccctgccaagggtgccgctaacttcacctcccaggtcatcatcatgaaccacccgggccagatcggtaacggttatgccccggttcttgattgccacacctcccacattgcggtgaagttctctgagatcctcactaatattgacaggcgttctggtaaggagattgagaaggagcccaagttttgaagaatggtgatgctggtatggtgaagatgactccgaccaagcccatggttgttgagaccttctctgagtacccaccccttggacgttttgctgtgagggacatgaggcagactgttgctagtcggtgtcatcaagagcgtttgacaagaaggacccgaccggagccaaggttaccaaggactagaccgtcaagagggtgccaagtgaactaccta

SEQ ID NO: 1456 - DNA, 1327 bp, Parthenium argentatum
cgacagcaacggtccaaacatagaatccacatctgattccctcacaaccgtcagatcacataatccaacggctcacacaaaaaccctaatttcataccttctttacttcacttataaaacctctctttgcacctcacttcacacattcttcatcttcctccatctactcaacacctcgtctgcattattattcgttaaggatgggtaaggaaaagattcacatcagtatcgtcgtcattggacatgtcgactccggcaagtccacaaccacaggacaccttatctacaagttgggaggaattgacaagcgtgtgatcgaaagattcgagaaggaagccgctgagatgaacaaaaggtccttcaaatacgcctgggtgcttgacaagcttaaggctgagcgtgaaagaggtattaccatcgatatcgccttgtggaagtttgagaccaccaagtactactgcactgtcattgatgctcccggacatcgtgatttcattaagaacatgattactggtacttcacaagctgattgcgctgttcttatcattgactccactactggtggtttcgaggctggtatttccaaggacggtcagacccgtgagcacgctcttcttgctttcacccttggtgtcaagcaaatgatttgctgctgtaacaagatggatgccaccacaccgaagtactccaaggcaaggtacgatgaaatcgtcaaggaagtttcatcttacttgaagaaggtcggatacaaccccgacaaaatcccatttgtgccaatctctggattcgaaggagacaacatgattgagaggtcgaccaaccttgactggtacaagggaccaacccttcttgaagctcttgaccagatcaacgagcccaagagaccctcagacaagccccttcgtctcccacttcaggacgtgtacaagatcggtggtattggaactgtgccagtgggacgtgttgagactggtgtgatcaagcctggtatggttgttactttcggaccatctgggttgaccactgaagttaagtctgttgagatgcaccatgaagctctacaagaggctcttcctggtgacaatgttgggttcaacgtcaagaacgttgctgttaaggatctcaagcgtggttacgttgcatcaaactccaaggatgacccagctaagggtgctgccagtttcacctcccaggttatcatcatgaaccaccctggccagattggtaacggttacgccccggttcttgattgccacacctcccacattgctgttaagttctctgaacttttgaccaaaatcgacagacgatccggtaaggagcttga

SEQ ID NO: 1457 - DNA, 1478 bp, Orobanche aegyptiaca
aaggctgagcgtgaacgtggtattaccattgatattgccttgtggaaatttgagaccaccaagtactattgtaccgtgattgatgcacctggtcaccgtgactttatcaagaacatgatcactggcacctcacaggcagactgtgctgtcctcatcattgactcaaccactggtggttttgaagctggtatttctaaggatggtcagacccgtgagcatgccttgcttgctttcactcttggtgtcaagcaaatgatctgttgctgcaacaagatggatgctaccacaccaaaatactccaaggccagatacgatgaaattgttaaggaagtgtcttcctacctcaagaaggtcggatacaatcctgacaagatcaactttgtgccaatttctggtttcgagggagacaacatgattgagcggtccactaaccttgactggtacaagggcccaactctcctggaggcacttgatatgattcaggagcccaagaggccctcggacaagccccttcgactcccgcttcaggatgtttacaagatcggtggcattggtactgtccctgttggtcgtgtcgagactggtatcatcaagcccggcatgcttgtcacctttggcccgactggtctgaccactgaagttaagtctgttgagatgcaccatgaatccatgccagaggcacttcctggtgacaatgttgggtttaatgtgaagaatgttgctgtcaaggatctcaagcgtggtttcgttgcttccaactccaaggatgaccccgcgaaggaagctgctaactttacgtctcaggttatcatcatgaaccatcctggacagattggacaaggatatgccccagtgcttgattgtcacacgtcacacattgctgttaagtttgctgagcttgtgaccaagattgacaggagatctggtaaggagattgagaaggagcccaagttcttgaagaatggtgatgctggtatggttaagatgattcccaccaagcccatggttgtggagactttctctgagtacccaccactaggacgatttgctgtaagagacatgcgccagacggttgctgtcggtgtgatcaagagtgttgagaagaaagacccatctggagccaaggtcaccaaggctgctgccaagaagggtgccaagtgaactgtgcgggtgaaggggtctgtttatgatgcccgtgaagtttatgttacgaatttattgcctatgaagtgtgtgtttgtttttactgctttgtcatgtttgttttattggttgtgttttaatatcttgtcttgtgtgttgggtagccattcacagaattgggtgcttgacaggcggtggcagattaggttgtttttgtgtcgattttagcgtgtttttgatatgagatgccttgtctttacttggttaatgaaacatttgtgttgaaattctatttagtaaacatctagttctcgttttgctttacagtaaaaaaa

SEQ ID NO: 1458 - DNA, 1318 bp, Papaver somniferum
ttgtcgtcattggacatgtcgactctggtaaatcgacaccactggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatattgcactgtggaagtttgagaccaccaagtactactgcacagttattgatgctcctggacatcgtgactttatcaaaaacatgattactggtacttctcaggctgattgtgccgtcctcattatcgattccaccactggaggttttcgaggctggtatctcaaaggatggtcagactcgtgagcatgctcttcttgctttcaccttggtgtcaagcagatgatctgttgttgtaacagatggatgccaccaccccaaagtactcaaaggctaggtacgatgaaattgtcaaggaggtctcatcttacttgaagaaggttggatacaacccagaaaaaattgcatttgttcctatctccggattcgagggagacaacatgattgaaaggtccaccaaccttgactggtacaagggaccaactctccttgaggctcttgacaacatctctgagccaaagagaccctcagacaagccccttcgtcttccccttcaggatgtttacaagattggaggtatcggaactgtgccagttggacgtgttgaaaccggagtcatcaagcctggtatggttgttaccttttggacccaccgggttgaccactgaagttaagtctgtggagatgcaccacgaagcccttcaagaagctcttccaggagacaatgttgggttcaatgtcaagaatgtcgcagtgaaggatctcaagcgtggtttcgtcgcctcgaactccaaggatgaccctgcaagggaagcttccaacttcacctcccaggtcatcatcatgaaccatcctggtcagatcggtaacggttatgccccagttcttgactgtcacacatctcgcatttctgtgaagtttgctgagatcctcaccaagattgatagacgatccggaaaggagcttgagaaggagcccaagttctctacgttttcagttgcagcgtatctaagttgcaaatcagaatactcacacaaaaataatatatcttgatatattaaactgtaagagaaagtaaaggaacactaactgcagagaggattaaaaatttaaaaagatgattgagatgtcatctattactgctgcttcagagaataaaagaaatataattgaaaaagaatcttgggg

SEQ ID NO: 1459 - DNA, 1159 bp, Flaveria ramosissima
atccaccacacaagtcgtctgcagatcaatcgttaaggatgggtaaagaaaagactcacatcagtattgttgtcattggacatgtcgactccggcaagtccacaactactggacacttgatctacaagcttggaggaattgacaagagagtcatcgaaagattcgagaaggaggctgctgagatgaacaaaagatccttcaaatacgcctgggttctcgacaaacttaaggccgagcgtgaaagaggtatcaccattgatattgccttgtggaagtttgagacaaccaagtactactgcactgtcattgatgctcctggacatcgtgactttatcaagaacatgattactggtacttctcaggccgactgtgcggtgcttatcattgattccaccactggtggttttgaagctggtatttccaaggatggtcagacccgtgagcacgctcttcttgctttcacccttggtgtcaagcaaatgatttgctgctgtaacaagatggatgccacaacaccaaagtactccaaggcaaggtatgacgaaattgtgaaggaagtgtcatcttacttgaagaaggtgggatacaaccctgacaaaatcccattcgttccaatctctgggttcgaaggagacaacatgattgagaggtcgacgaaccttgactggtacaagggtcctacccttcttgaagctcttgaccagatcaatgagcccaagagaccatcagacaagcccctccgtcttccacttcaggacgtgtacaagatcggtggtattggaactgtgccagtgggacgtgtcgagactggtgtgatcaagcctggtatggttgtcacttttggaccatctggattgaccactgaagttaagtctgttgagatgcaccatgaagctttgactgaggctcttcctggtgacaatgttgggttcaacgttaagaatgttgctgtcaaggatctcaagcgtggttatgttgcatccaactccaaggatgacccagctaagggtgctgctagcttcacctcccaggttatcatcatgaaccaccctggtcaaattggtaacggttatgcacctgttcttgattgccacacctctcacattgctgtcaagttctctgaactgttgaccaagatcgacagacgatctggtaagga

SEQ ID NO: 1460 - DNA, 1627 bp, Marchantia polymorpha
ccctgctctcttctgttctgctcttgcaagaaaccactttgctggtgtatcttgagacttagcagctcttcagctgagcctgagcattttccagaagcaagctagcagaatggcttccgagaaggttcacatcaacatcgtggttatcggccatgtcgattcagggaagtccaccaccaccggtcacatgatttacaagctgggaggaatcgaccagagtgtcatcgaccgtttcgaggaggaggccaccgagatgaacaagcagtctttcaagtacgcgtgggtgctcgacaagctcaaggctgagcgcgagcgaggtatcaccatcgacatcgccttgatgaaattcgagacctccaaatactcgtgcactgtgatcgatgctcccggccacagggacttcatcaagaacatgatcacgggaacatctcaggccgattgtgctctgctcatgatcgactccaccacaggaggttttgaggctggtttctccaaagatggccagaccagagagcacgctctgttggctttcactctgggagtagagcaaatgatctgctgctgcaacaagatggacgccacgtctccaccttactcccaggagagatacgaggagattaagcaggaagtgtcgggatacttggaaatggtcggatacaatccagagaacatcccgttcgtccccatctcgggattccagggcgacaacatgatcgagaagtctgaaaacctcgaatggtatgagggaccgactcttctggaggccctggacaacgtaaccgagccgaagagaccatctgacaagcctctgaggctgccccttcaggatgtatacaagatcggaggcatcggaactgtccccgttggtcgtgtcgagactggtgtgatcaagcctggtatgatggtgtgctttgctcctaccggactgaccgccgaggtcatgtccgtggagatgcatcacgaagctttgagcgaagcattgcccggcgacaatgtgggattcaacgtgaaggatgtatcagctaaagagttgaagcgtggattcgtggcttcggactcggagaacgaccctgcgagggaggcagcgagcttcacgtcgcaggtgatcatcatgaaccacccgggacaaatcgccaatggctacgcaccggtgctcgactgccacacatcgcatgttgctgtgaagttcgcagaggttctgtcgaaaatcgaccggcattcgggagaggagctggagcaagagcccaagtttttgaagagtggagaggccggaatggtgaaaatgattccttcgaggcccttgacggtcgaggcctttgcagaatacccacctctgggtcgcttcgcagttcgggatagtcgacaaaccgtggcagtcggtgtcatcaaggcagtggagaagaaggacccggcctgtgaaaagtgagcaagtcagcatgctcgagaagcaagaagtgacctgaacacgcgcatgaaagttttgatgtgtacatgagagtttcaagattcacttcggcaactccctctgttgcgtgcaacaaccaaattccgcctttcaaggaatgatcgggaacagaagggagtgaaggaataggtgcggccttcaatcggcacatgccctgtgaat

SEQ ID NO: 1461 - DNA, 1774 bp, Podocarpus macrophillus
tttgtgtttctcgcggcgctgcgcttgcaattctcttcttctcttctgcaagtctctgccgctatttttttgagctcaattaatcatgggtaaggagaagactcatattaacattgtcgtcattggtcatgtcgactctggcaaatcgaccaccactggccacttgatctacaagttgggaggcattgacaagcgtgtcattgaacgttttgagaaggaggccgctgaaatgaacaagaggtcattcaaatatgcttgggttcttgacaagcttaaagctgagcgtgaacgtggtatcaccattgatattgcattgtggaaatttgagaccacaaggtattattgcactgtgattgatgctcccggccatcgcgatttcattaagaacatgattaccgggacctcacaggctgattgtgcggtgctgattattgattcaacaaccggaggttttgaagctggtatttctaaagatggtcagacccgagagcatgctttgttggcatttacattgggagtaaagcaaatgatttgctgctgtaacaagatggatgctactactcccaaatactccaaagctcgatatgatgaaatagttaaagaagtgtcttcttacttgaagaaagtgggatacaatcctgataaaattccttttgtgccgatctctgggtttgagggtgataacatgattgagaggtcaaccaaccttgattggtacaagggtccaacactgttggatgctcttgaccaggtgtcagagcctaagcgtccttcagacaagcctctaaggttgccacttcaggacgtttacaagattggtggtattggaacagtgcctgtgggacgagttgagactggagttctgaagccaggtacagttgttacttttggtccaactgggttgaccactgaagttaaatctgttgagatgcatcatgaagctttggtagaggcattacctggtgacaatgtgggtttcaatgttaagaacgttgctgtgaaggatctcaagagaggatatgtggcctctgattccaagaatgaccctgcgaaggaggctgctaacttcacctcacaggtcattataatgaaccaccctggacagattggaaacggttatgctcctgttctggattgccacacctgtcacattgctgtcaagttttctgagatcttgaccaaggttgataggcggtctggtaaggaacttgagaaagagcctaagttcttaagaatggagatgctggatttgtgaagatgattcccaccaaacccatggttgtggaaacattctctgagtatcctcctttgggtcgatttgctgtaagagatatgcgtcagactgttgctgttggagtcatcaaagctgttgagaagaaggaacctactggtgccaaggttaccaaggctgctgctaagaagaagtgaaaggccatgcaacttgtgcggaagtcaaggtgtgcaggcggcatcttgcatgtttgcatgcttgatttttgcaaaaatagtatgatagtaggattgttttttgtttgtcatagtagtttgcaaaattgggttcttgataggcggtggcatggttaatttatatttctgtgaagatacttttggaatttctgatttgcggagaaattttgatttgtctgctttggaaatctatgcagtctgagctgaggaaggattaagtaattttaagtactgtgatttattgtttagacgcttttcttgtatttgaaatttttatggattttaatgaaatacatagagaatttcc

SEQ ID NO: 1462 - DNA, 1221 bp, Brassica napus
ctgagatgaacaagaggtccgttcaagtacgcgtgggtacttggacaaactaaggccgagcgtgagcgtggtatcaccattgacattgctctctggaagttcgagaccaccaagtactactgcactgtcattgactgcccctggacatcgtgatttcatcaagaacatgattacctggtacctcccaggctgattgtgctgtctatcattgactctaccactggtggttttgaagctggtatctccaagggatggtcagacccgtgagcatgctctcttgccttcacccttggtgtcaagcaaatgatttgctgctgtaacaagatggatgccactacccccaagtactccaaggctaggtacgatgagatcatcaaggaggtgtcttcctacttgaagaaggtcgggtacaaccctgacaaaatcccattcgtccccatctctggattcgagggtgacaacatgattgagaggtccaccaaccttgactggtacaaagggaccaactctccttgaggctcttgaccagatcaacgagccaaagaggccttcagacaagcccctgcgtctaccacttcaggatgtctacaagatcggtggtattggaacggtgccagtgggtcgtgtggagactggtatgctcaagcccggtatggttgtcacctttgcttcatcagggttgaccactgaggttaagtctgtcgagatgcatctcgagtctcttgttgaggcacttgcaggtgacaacgtcggattcaatgtcaagaatgttgccgtcaaggatctcaagcgtgggtatgttgcatccaactccaaggatgatcctgccaagggagctgcgaactttgcttcgcaggtcatcatcatgaaccacactggtcagatcggtaacggttacaaccctgtccttgattgccacacctcccacattgcagtgaagttctatgagatccttaccaagattgacagacggtctggtaaagagatcgagaaggagcctaagtttttgaagaatggagattctggtatggtgaagatgactccaacagagcccatggttgttgagactttctcagagtaccccccgctgggacgattcgctgttagggatatgaggcagcccgtggctgttggtgtcatcaagagtgttgacaagaaggacccaaccggtgccaaggtcaccaaggctgcagtcaagaagggtgccaaatgatgagactt

SEQ ID NO: 1463 - DNA, 1182 bp, Flaveria ramosissima
gaaagaggtatcaccattgatattgccttgtggaagttcgagacaaccaagtactactgtactgtcattgatgctcctggacatcgtgactttatcaagaacatgattacgggtacctcccaagctgactgtgccgtgcttatcattgattccaccacgggtggttttgaagctggtatttccaaggatggtcagacccgtgagcacgctcttcttgctttcactcttggtgtcaagcaaatgatttgctgctgtaacaagatggatgccacaacaccaaagtactccaagtcaaggtatgaggaaattgtgaaggagtgtcatcttacttgaagaaggtgggatacaaccctgacaaaatcccattcgttccaatctctgggtttgaaggagacaacatgattgagaggtcgaccaaccttgactggtacaagggtccaacccttcttgaagctcttgaccagatcaatgagcccaagagaccatcagacaagccccttcgtcttccacttcaggacgtgtacaagattggtggtattggaactgtgccagtgggacgtgttgagactggtgtgatcaagcctggtatggttgtcactttcggaccatctggattgaccactgaagttaagtctgttgagatgcaccatgaagctcttactgaggctcttcctggtgacaacgttgggttcaacgttaagaatgttgctgtcaaggatctcaagcgtggttatgttgcatccaactccaaggatgacccagctaagggtgctgctagcttcacctcccaggttatcatcatgaaccaccctggtcaaatcggtaacggttatgcacctgttcttgattgccacacctcccacattgctgtcaagttctctgaacttttgaccaagatcgacagacgatctggtaaggaacttgagaaggagcctaaattcttaaagaatggtgatgctggtatggttaagatgcttcccaccaagcctatggttgtcgagactttcgcagagtatccaccacttggtaggtttgccgtcagagacatgcgtcaaacggttgctgtgggtgtgatcaagagcgttgagaagaaggacccaacaggagccaaggttaccaaggctgcagtgaagaagggagccaagtgaggtggttttgtgttttggctttatggtgtatttt

SEQ ID NO: 1464 - DNA, 1665 bp, Fagus grandifolia
gttctgctccaactccagcgccgctatcgggttagtcaattttagttttcacaaggtcattttcgtaaaatcacttcaagaaaaagaatccgaaatgaagccctagttgtgagcttgtgactccccctctcgtctataagtactacgcaaagccttcgccaccccagactcctctctttctatcgtatagctctctcttgctatacttttcattgcggctagggtttcagcagaagctctcgttcaagttttttaagagttcataatgggtaaggaaaaggttcacattaacattgtggtcattggccatgtcgactctggaaagtcgaccaccactggacacttgatctacaagcttggaggaattgacaagcgtgtgatcgagaggttcgagaaggaggcagctgagatgaacaagaggtcattcaagtatgcctgggtgttggacaagcttaaggcagagcgtgagcgtggtattaccattgatattgccttgtggaaatttgagaccaccaggtactattgcactgtcattgatgctcccggacatcgtgactttattaagaacatgattactggaacgtcacaggctgactgtgccgtcctgattattgactccaccactggaggttttgaggctggtatttctaaggatggtcagacccgtgagcatgctttgcttgctttcacccttggtgtcaagcagatgatttgctgttgtaacaagatggatgccacaaccccaaagtactccaaggctaggtacgatgaaattgttaaggaagtctcatcctatttgaagaaggttggatacaacctgacaaatccccttgtccccatttctggttttgagggtgacaatatgattgagaggtctaccaacctcgactggtacaagggtcccaccctccttgatgctcttgaccagatctcagagcccaagagaccctcggacaagccccttcgtcttcctcttcaggatgtgtacaagatcggtggtattggaactgtgcctgttggacgtgttgagactggtgtcgtcaagcctggtatggttgtgacatttggccccactgggttgacaactgaagttaagtctgtggagatgcaccacgaagctctcctggaggcccttcccggtgacaatgttggcttcaacgtcaagaatgttgctgtgaaggatctcaagcgtggttttgttgcttccaactccaaggatgatcctgccagggaagctgccaacttcacctcccaggtcatcatcatgaaccaccctggtcagattggaaatggctatgctccagttcttgattgccacacctgccacattgctgttaagttcagtgagatcttgaccaagattgacaggcgatccggaaaggagcttgagaaggagaccctaaatttttgaagaacggtgatgctggtatggttaagatgattcccaccaagcccatggttgttgagactttctctgagtatccacctcttggtcgttttgctgtgagggacatgcgtcagaccgttgctgttggtgtcatcaagagtgttgagaagaaggatccatctggtgccaaggtcaccaagtctgcagcaaagaagaagtgaaatatgcttctgagatctatcctagttagactagttttgtctattgtcggtgtcact

SEQ ID NO: 1465 - DNA, 1359 bp, Brassica napus
aacttaaggctgagcgtgagcgtggtatcaccattgacattgctctctggaagttcgagaccaccaagtactactgcactgtcattgatgcccctggacatcgtgatttcatcaagaacatgattactggtacctcccaggctgattgtgctgttcttatcattgactctaccactggtggttttgaagctggtatctccaaggatggtcagacccgtgagcatgctcttcttgccttcacccttggtgtcaagcaaatgatttgctgctgtaacaagatggatgccactacccccaagtactccaaggctaggtacgatgagatcatcaaggaggtgtcttcctacttgaagaaggtcgggtacaaccctgacaaaatcccattcgtccccatctctggattcgagggtgacaacatgattgagaggtccaccaaccttgactggtacaagggaccaactctccttgaggctcttgaccagatcaacgagccaaagaggccttcagacaagcccctgcgtctaccacttcaggatgtctacaagatcggtggtattggaacggtgccagtgggtcgtgttgagactggtatgctcaagcccggcatggttgtcacattcgctccttcagggttgaccactgaggtcaagtccgttgagatgcaccacgagtctcttgtggaggcacttccaggtgacaacgtcggattcaatgttaagaacgttgccgtcaaggatcttaagcgtgggtatgttgcatccaactctaaggatgaccctgccaagggtgctgctaacttcacttcccaggtcatcatcatgaaccaccctggtcagatcggtaacggttacgccccagtgcttgattgccacacctcccacattgcagtcaagttttctgagatcctcaccaagattgacaggcgatctggtaaagagatcgagaaggagcctaaatttttgaagaatggagatgctggtatggtgaagatgactccaaccaagcccatggttgttgagactttctcagagtacccaccattggggcgttttgctgttagggacatgaggcagaccgtggctgttggtgtcatcaagagtgttgacaagaaggatccaaccggtgccaaggtcaccaaggctgcagtcaagaagggtgccaaatgataagacttctctattacttttaaaaaaactttgatggtgtttgagccttttttttaatatattttctgcgacatggtttcagttatgcagtttgtggatggttttggctaatgatttttagtgctttgttcttgaatgtccttgttagttgcttttactcatctagagtttttagaccagtctgttcaagatt

SEQ ID NO: 1466 - DNA, 1204 bp, Cicer arietinum
caaggctgagcgtgaaagaggtatcacaattgacattgctctgtggaagtttgagacaactaagtattactgcaccgtcattgatgcccccggacacagagatttcattaagaacatgattactggaacatcccaagctgattgtgctgtccttatcattgattccactactggtggttttgaagctggtatttctaaggacggtcagacccgtgaacatgctctccttgctttcactcttggtgtgaagcaaatgatttgctgctgtaacaagatggatgccactactcccaagtactctaaggctaggtatgatgaaattgtgaaggaagtttcatcctatttgaagaaggttggctacaacccagacaaaattccatttgttcccatctctggttttgagggagataacatgattgagcgctctacaaaccttgactggtacaagggtccaacccttcttgaggcccttgaccaaatcaatgagcctaagaggccatcagacaagcccctccgattaccacttcaggatgtctacaagattggaggaattggtactgtgcctgtggggcgtgtcgagactggtgtcttgaaacctggatttgtcgtgacttttgcgcccactggactgtcaactgaagtcaagtctgttgagatgcatcatgaagctctcactgaggcccttcctggtgacaatgttggatttaatgttaagaatgttgctgtcaaggatctcaagcgtggttacgttgcctcaaactccaaggatgaccctgccaaggaggctggtaactttacatcccaagttatcatcatgaatcaccctggccagattggtaatggttatgcccctgttcttgactgccacacctcccacattgctgtcaagtttgctgagcttattaccaagattgacaggcgttctggtaaggagattgagaaggagcctaaattcctgaagaatggtgatgctggtcttgttaagatgattccaacaaagcccatggtggttgagacttttgctgagtatcctcctcttgggcgttttgctgtgagagacatgcgtcaaactgtggctgtgggagttatcaagagtgtggagaagaaggaaccaagtggtggaggtaagaaaactatctcagcagtgaagaagaaatgaattgtgcacgatcatctatatagggaaatctattggtgtgacatc

SEQ ID NO: 1467 - DNA, 1357 bp, Brassica napus
tgaacaagaggtctttcaagtacgcgtgggtgttggacaaacttaaggccgagcgtgagcgtggtatcaccattgatattgctctctggaagttcgagaccaccaagtactactgcacggtcattgatgctcctggacatcgtgatttcatcaagaacatgattactggtacctcccaggctgattgtgctgtcctcatcattgactccaccactggtggttttgaagcaggtatctccaaggatggtcagacccgtgagcatgctcttcttgctttcacccttggtgtcaagcaaatgatttgctgctgtaacagatggatgccactacccccaagtactccaaggctaggtacgatgagatcatcaaggagtgtcttcctacttgaagaggtggtacacctgacaaaatccatcgtcccatctctggattcgagggtgacacatgattgagaggtccaccaccttgactggtacaagggaccaactctccttgaggctcttgaccagatcaacgagccaaaagaggccctctgacaagcccctccgtctgccgacttcaggatgtctacaagagtcggtggtattggaacggtgccagtgggacgtgttgagaccggtatgctcaagcccggtatggttgtgaccttcgctccttcagggttgaccactgaggttaagtccgttgagatgcaccacgagtctcctgtggaggcgcttccaggtgacaacgtcgggttcaatgttaagaatgttgccgtcaaggatcttaagagagggtatgttgcatccaactccaaggatgaccctgccaagggtgccgccaacttcacctcccaggtcatcatcatgaaccaccctggtcagatcggtaacggttacgccccggttttcgattgccacacatcccacattgcagtcaagttctctgagatcctcaccaagattgacaggcgatctggaaaagagattgagaaggagcccaagttcttgaagaatggtgatgctggtatggttaaaatgactccgaccaagcccatggttgttgagactttctctgagtaccccccattgggtcgtttcgctgttagggacatgaggcagacggtggctgttggtgttatcaagagcgttgacaagaaggacccaaccggtgctaaggtcaccaaggctgcagttaagaagggagctaaatgatgagacttgctctcgtctttggtttttcttttcattacaaaaaactttgatggcgtttgaggctttttcttattttctgcgactttcttttaccttgtttgtggatctctgagactattgtggttttcgattatgcagcttctggataattttgcctaatg

SEQ ID NO: 1468 - DNA, 1283 bp, Brassica napus
ggacaacttaaggccgagcgtgagcgtggtatcaccattgatatcgctctctggaagttcgagaccaccaagtactactgcacggtcattgacgctcctggacatcgtgatttcatcaagaacatgattactggtacctcccaggctgattgtgctgtttgatcattgactctaccactggtggttttgaggctggtatctccaaggatggtcagacccgtgagcatgctcttcttgctttcacccttggtgtcaagcagatgatttgctgctgtaacaagatggatgctactacccctaagtactccaaggctaggtacgatgagatcatcaaggaggtgtcttcctacttgaagaaggttggggtacaaccctgacaaaatccccattcgttccaatctctggggttcgaggggtgacaacatgattgagaggtccaccaaccttgactggtacaagggaccaactctccttgaggctcttgaccagatcaacgagccaaagaggccctcagacaagcccctgcgtctaccacttcaggatgtctacaagatcggtggtattggaacggtgccagtgggtcgtgtggagactggtatgctcaagcccggtactggttgtgacattcgctccttcagggttgaccactgaggtcaagtccgttgagatgcaccacgagtctcttgtggaggcacttccaggtgacaacgtcggattcaatgttaagaatgttgccgtcaaggatcttaagcgtgggtatgttgcatccaactccaaggatgaccctgccaagggtgctgctaacttcacttcccaggtcatcatcatgaaccaccctggtcagatcggtaacggttacgcccctgtgcttgattgccacacctcccacattgcagtcaagttctctgagatcctcaccaagattgacaggcgatctggtaaagagatcgagaaggagcctaagtttttgaagaatggagatgctggtatggtgaagatgactccaaccaagcccatggttgttgagactttctcagagtacccaccattgggacgttttgctgttagggacatgaggcagacggttgctgttggagttatcaagagtgttgacaagaaggacccaaccggtgctaaggtcaccaaggctgcagtcaagaagggtgccaaatgatgagccttctctatttctattacttttaaaaaaactttgatggcgtttgagccttttttttatatattttctgcgacatggtttcagttatgcagtttgtggatggttt

SEQ ID NO: 1469 - DNA, 916 bp, Leymus cinereus x Leymus triticoides
  misc_feature (5)..(6): n is a, c, g, or t
  misc_feature (8)..(9): n is a, c, g, or t
cccgnncnngccgccgccgcgtaacccaataacaccggggcaggagaaacagtagctacccgagcttacagtcaggaggcgagtgatgtcggcggcgacggcagcgcctatcggcctgtcgtgggcgccccagctgccttccctggcggcggccggcggcagcaagaagggctcagcgccgaccccgagcattgacgcgcaggagtctctctggaagcccagcaacgacctcgtggacggcctctacgtgcccccgagggaccccaggaaggtcaacaagatggcgaggaagaacgtcaaggacaccaccggcatgggctggttcgacatgccggcgccgagcatcactcccgagttgaagaaagaccttgagattttgcagctgaggcatgtaatggaccctaaaaggcatttcaagaggtctggtaaatccaaggctcttccgaagtatttccaagttggaacggttgttgagcctgcatctgagtactactcaagtaggctgacaaagcacgaacggaagcagactttggttgatgagctgttatctgaccaaaaactcaagaactacaggatgcgtaaggtaagggaaattcaggtggcccgtacgccgggaggcaaccagaaatggaagaacaagggcaagcaaacctttaaaagggccaaggacaggcggaaataggatccatgcggttaattgtatctgttttgcaccaaggaagagcagaggaacggagccaaagagaaatgggcgagcacattcattcatatcatactagtatttccgccggttttgcattataggttgtggctctagtgtaatgtggtggattcatgtaacagaacttacggaacgttttcttgccttgcttcgggtgatgagatcagagttccagggggaagatcaaaaaaaaaa

SEQ ID NO: 1470 - DNA, 1192 bp, Triticum aestivum
cttcctcctaccccgccgcctcattgattttcctcctcttcccctccaccgcccgcccttgccgccgccgcgtaacccaacaacgccggggcaagagaaggagcagctatccaagcttacaagggctcggagagccatgtcgtcgtcgtcggcggcgccgatcggcctgtcgtgggcgccccagctgccttccctggcggcggccggcggcagcaagaagggctcggcgccgaccccgagcattgacgcgcaggagtccctctggaagcccagcaacgagctcgtggacgggctctacgtgcccccgagggaccccaggaaggtcaacaagatggcgaggaagaacgtcaaggacaccaccggcaagggctggttcgacatgccggcgccgagcatcactcccgagttgaagaaagaccttgagattttgcagctgaggcatgtaatggaccctaaaaggcatttcaagaggtctggtaaatccaaggctcttccgaagtatttccaagttggaacggttattgagcctgcatctgagttctactcaagtaggttgacaaagcatgaacggaagcagaccttggttgatgagctgttatctgaccaaaaactcaagaactacaggatgcgtaaggtaagggaaattcaggtggcccggacacccggaggcaaccagaagtggaagaacaagggcaagcaaacgttcaaaagggccaaggacaggcggaaataggatcaatgtaaaacaaggaagaacagaagaacggagccaaagagaaatgggcgagcacggctataggttgtgcactccagtgtaatgtggtgaattcatgtaactgaacgtatggaacttttctccccgcacttagagagatgagatcagtgtttgaggggatgatggtcaaagcattgtagtatctgaacttgagtttggcaggatgcttttgcgcaaaaagaaaaactgatcttgtgaatgttcatctactgatctgcaacaaaagagcaggggaagtgtgtaacatttgcaaacattctgaatcctggtatagttccattgcgaggaacgttatgtgcctgtttggttgcttgtatcaaaatttgtgctcttgcatctatggcctgacttagcttggctgaataaacaacctctgggccatgttgtgcaatttatttcgtttggtcccttgcatcg

SEQ ID NO: 1471 - DNA, 1094 bp, Secale cereale
gactttctctagctctagccccctccctctcccccgtcgcagtcctcctcctaccccgcgccgcctaattggtttcctcctcttcccctccaccgcccgccccctccgccgccgcgtaacccaacaacgccggggcaagagaagcagcagctatccaaacttacaagggctcggggagcgatgtcgtcgtcgcggcagcgccgatcggcctctcgtgggcgccccagctgccttccctggcggcggccggcggcagcaagaagggctcggcgccgtccccgagcattgacgcgcaggagtctctctggaagcccagcaacgagctcgtggacgggctctacgtgcccccgagggaccccaggaaggtcaacaagatggcgaggaagagcgtcaaggacaccgccggcaagggctggttcgacatgccggcgccgagcatcactcccgagttgaagaaagaccttgagattttgcagctgaggcatgtaatggaccctaaaaggcatttcaagaggtctggtaaatccaaggcccttccaaagtatttccaagttggaacggttattgagcctgcatctgagtactactcaagtaggctgacaaagcacgaacggaagcagaccttggctgatgagttgttgtctgaccaaaaactcaagaactataggatgcgtaaggtcagagaaattcaggtggcccgtacgccgggaggcaaccagaagtggaagaacaagggcaggcaaacatttaaaagggccaaggacaggcggaagtagaatccatgctgttaattgcatctgttttgcaccaaggaagagcagagaaacggagccacagagaaatgggcgagcacactcattcatatatcgtactaatgtgatttctgccggttttgcattataggctgtggctgtggtgtaatgtgtggtggattcatgtagtaactgaaatacggaacattttcttgccttgacttagtgatgagatcagggttccagggaggagatcaaagcattgtggtacctgaacttgagtttggcaggattctttcctgattaatcgtgatattgtggacattaatctactttttgttt

SEQ ID NO: 1472 - DNA, 974 bp, Avena sativa
gcctctttcctcctctccccctccaccgccgcccctcacgcgcgagccgcccctgacgccgccgcatccaacaacattgggacggtagaaacgatggcagaagcgccaatcggcctgtcttgggcgcccaagcttccttccctaccgtcggccggcggcagcagcagcaagaagggctcggcgccgacccagagcatcgacgccaaggactccctatggaggccgagcagcgagctcgtagacgggctcttcgtgccgccgagggacccgaggaagctcaacaagatggcgaggaagaacgtcaaggacaccaccggcaagggctggttcgacatgccggcgccgaccatcactcccgagttgaagaaagaccttgagattttgcagctgaggcacgtaatggaccctaaaaggcatttcaagaggtctggtaaatccaaggcacttccaaagtatttccaagtcggaacagtcattgcgcctgcatctgagttctactcaagtaggctgacaaagcaggaacagaagacaaccttggttgatgagctgttatctgacccaaaactcaagaactaccggatgcgtaaggtaagggaaattcaggagactcggactccgggtggcaaccagaagtggaagaacaagggcaggcaaacattcaagagggccaaggataggcggaaatgagatccacgcggtctattgtccctccttttgtgcaccaaagaagaagcgaggaatggagccaaacaggaaatacctgagcacatccacacattgtagctactagtgctttcctcagttttgcgttgtaggttgcggttccagtgtaatgcggtgaactaatgtaatatgaagacagcatttgcagtcctatgtgtatcaggttagctgaacgcgagaaacatttcttccctcagttccttgtaatgagatctgagcctgggagattatccaaaatcatatttcccgac

SEQ ID NO: 1473 - DNA, 932 bp, Brachypodium distachyon
tcctcctgcccgcgccgccgccgagtcgggttcctctccagctcttctccactccaccgtccccagccccgtcgctgccgcttgacgcaacgatccctgggcgcgagacgcgagagctctatctgagttttagaggcgggagcggtagcgatgtcggaggcggcggcagcgccgatcggcctgtcgtgggcgcccaagctgccctccctgccggcggccgggggcggtaagaagggcttggggacagaccttagcgcgcacgggtcgtcgctctggaagcccgggaacgagctcgtggacgggctcttcgtggccccgagggacccgaggaaggtcaacaagctggcaaggaagaacgtcaaggacaccaccggcaagggctggtttgacatgccggcgccgagcatcacacccgagttgaagaaagacctgcatattttgcagctgaggcatgtaatggaccctaaaaggcatttcaagaggtctggtaaatccaaggtccttccgaagtatttccaaatcggtacagttattgagcctgcacatgagttctggtcaagtaggctgacaaagagggagcggaagacaacattggttgacgagctcttgtcagaccaaaaactcaagaactacaggatgggtaaggtaagggaaattcaggagacccgaaagccaggcggcaacgaaaagtggaagaacaagggcaggcaaacatttaaaagggccaaggataggcggaaataatatcatgctgtaaatcttgtttgcagtatggaagaacagaggaatggaggcaaacagaaaagactgagcacattcatattgtacttgccctcagtgcgttatagatttcaatttctgtaacgtgctcaatttctgatgtaatatgacgacagcacttccagttctatgtctgaattttgagcaggatg

SEQ ID NO: 1474 - DNA, 1983 bp, Panicum virgatum
gcgggtccttgcgcgcgaacgcccacatctccgcggacgcctcgcgcaccgccccggccgccacccgcagccggcccgcgacgcccctcgcggccccgtcatccaccccccacgccgcgtactccccgccgccgcggccaccggcggggacgccccagtcgaacccgagcagcggctcccgcgccgcgcgctggtccagcgtcgaccgcagcgtccccagctgcggcggcagcggcggcaggccagccggcggcggccccattgcctcgacaagcgatcgctccggcgcggcgtttctctggcctcgctgcgtacgcggcgcgcggttaggcccggtacgacacgatgcgcgcgcgtcggcggaggaggaggaggagtcccgggcgctctcgggggcaggcggggctcctcttttgtcggagttcgtttcgctcctggcagttcggttcggggctcctggtgtggtcggtgtcgtgctcgtctcctccgaatcccagccgcacgaagattggacggtggtggcggttgcgtcgtcctactcgcctggcagcggggcaccaccgagcgatggcgaggcgccgccacgccacggagcgactgagcaacaagcgaatgtggcgtgacgcggaggccggcgtctttgttctttgtgaagcgacgccggagtaacggagtccatgcggccgccggcggcggcgacacgggatcacctccacgcggaagtcacatacggcccacttgaagtagcccgttacggcccatgaaatattttttgggcctccaaaacctctgatatgacggcccatattgcccgatccttccctagaatactctcctttcccctctctccccccatcggcatcagcgtcgcagccctcagcctgccttcaccgtccccacggccgccgcgccgcctcgccgctttcctcgttcccgcccgacgcccacccctgccgccgggtggcttgatccagcaccgaggcgggagaagtgataagcatcccaactcgcagcggtagggcggtgatgccggaagcggcggcgccgatcggcctgtcatgggcgcccaatctgccttccctagcgacgacgagcgggggcagcaagagcgacccggcgccgaaaccgagcaccgcgcaggggtcgatctggaagcccgcgagcgagctcgtggacgggctgttcgtgccaccgacggaccccaggaaggttaacaagctcgccaggaagagtgtcaaggacaccaccggcaagggctggttcgacatgccggcgccgagcatcactcccgagttgaagaaagatctcgagattttgcagctgaggcatgtaatggacccaaaaaggcacttcaagagggcaggaaaatccaaggcccttcccaggtacttccaagttggtacagttgttgagcctgcatctgagttctactcaggtaggctgacgaagagggagcggaaaacaacattggttgatgagctgttatcggatcaatctcttaagagctacaggaagcgcaaggtacgggaaatccaggagagtcgtacaccaggaggcaaccaaaagtggaagaacaaggggaagcaaacacttaagagggccaaggataggcgaaaatgagtttgctgcgtctgactgcttcggtcgtgagaaagaagagagtggagaagggtctccttcaagtcacactatactctctctcgattttacagtataaattgtgattcaactgtaatgtggtgaacttcagcatgttgactgttgaatacattttcaggtctaaatatttttaaagtagtagtgtagcatcggaattcagaaatgctggttggtggactcgtttcctcggtcaagcagccccggatgttgcataatgttttctttttttgaaagaaacataatgttttctttcgttgttggttgatgctagcatagctagttgtgggccaacactatcttttcagctcagctagcttgctttcg

SEQ ID NO: 1475 - DNA, 972 bp, Panicum virgatum
agcctgccttcaccgtccccacggccgcctcgccgcctcgccgctttcctcgttcccgcccgacgcccacccctgccgccgggtggcttgatccagcaccgaggcgggagaagtgataagcatcccaactcgcagcggtagggcggtgatgccggaagcggcggcgccgatcggcctgtcatgggcgcccaatctgccttccctagcgacgatgagcgggggcagcaagagcgacccggcgccgaaaccgagcaccgcgcaggggtcgatctggaagcccgcgagcgagctcgtggacgggctgttcgtgccaccgacggaccccaggaaggttaacaagctcgccaggaagagtgtcaaggacaccaccggcaagggctggtttgacatgccggcgccgagcatcactcccgagttgaagaaagatctcgagattttgcagctgaggcatgtaatggacccaaaaaggcacttcaagagggcaggaaaatccaaggcccttcccaggtacttccaagttggtacagttgttgagcctgcatctgagttctactcaggtaggctgacgaagagggagcggaaaacaacattggttgatgagctgttatcggatcaatctcttaagagctacaggaagcgcaaggtacgggaaatccaggagagtcgtacaccaggaggcaaccaaaagtggaagaacaaggggaagcaaacacttaagagggccaaggataggcgaaaatgagtttgctgcgtctgactgcttcggtcgtgagaaagaagagagtggagaagggtctccttcaagtcacactatactctctctcgattttacagtataaattgtgattcaactgtaatgtggtgaacttcagcagcatgttgactgttgaatacattttcaggtctaaatatttttaaagtagtagtgtagcatcggaattcagaaatgttggttggtggactcgtttcctc

SEQ ID NO: 1476 - DNA, 1067 bp, Panicum virgatum
gtgtcacttaggccagtgatgtccgagacggcggcgccaatcggcctgtcatgggcgcccaagctgccttccctagcgatgacgagcggtggcagcaagagcgatccggcgccgaaaacgagcaccgtgcaggggtcgatctggaagcctgcgagcgagcttgtggatgggctgttcgtgccaccgacggaccccaggaaggttaacaagcttgccaggaagaatatcaaggacaccaccggcaaaggctggttcgacatgccggcgccgagcatcactcccgagttgaagaaagatctcgagattttgcagctgaggcatgtaatggacccaaaaaggcacttcaagagggcagggaagtccaaggcccttcccaggtacttccaagttggtacagttgttgagcctccatctgagttctactcaggtaggctgacgaagagggagcgaaaaacaacattggttgatgagctgttatcggatcaatctcttaagaactacaggaagcgcaaggtacgggaaatccaggagaatcgtacaccaggaggcaaccaaaagtggaagaacaaggggaagcaaacacttaagagggccaaggataggcgaaaatgagattggtgtgtcacctgcttcggtcgtgagaaagaagagagtggagaattggacgaaggttcaccttcaggtctctctctctctctctctctctccctccctccctccctctccctctccttccctccctctccctccccccctctctctccccctcgccctcgccctctctctctagatttttacggtataaattgtgattccagtgtaatgtggtgaaccagcagcatgctgattgctgaatgcattttcagttctaaatatttttgaagtagcagtgtagcatcaaaattcagaaatgttggttggtggactcgtttcctctgtcaagtagccccggatattgcataatgttttcatttgttgtaggcgatgctagcacagctagttgtgggcctctatcttttcagcttggctagctgctttcgtgtgtagacgatcatcagcgcacggaa

SEQ ID NO: 1477 - DNA, 1110 bp, Zea mays
aaacctcctgccctagtctcctctctgtctcacagcacagcccctgctttccccccaccgtcccacggccgccacgccgccacgcttcttcttccctttcccgtccaacctccaaccctgccggctgccgcggcggcggattaacacaataccttggcgagagacgtaatagtttctgaactcaccgcgctacgcccgatgtcggagacggcggcgccgatcggcctgtcatgggctcccaagcttccttcctttgcaacgaccagcggcggcagcaagatcgaccacgcgccggatccgagcaccgcgcagggctcgctctggaagcgcacgagcgagctcgtggacgggctgttcgtgcccccgagggaccctaggcagctgaataagctggctaggaagaacgtcaaggacaccgccggcaagggctggttcgacatgcccgcgccgaccatcactcccgagttgaagaaggatctcgagattttgcagctgaggcatgtaattgacccaaaaaggcacttcaagcgggcaggaaagtccaaggcccttcccaagtacttccaagttggtacggttgttgagcctgcatctgagttctactcaagtaggctgaaaaatagggaacgcaaggcaacattggtggacgagctgctatcagatcaatctcttaagagctacaggatgcgcaaggtacgggaaattcaggagatccgtacaccaggaggcaaccaaaagtggaagaacaagggcaagaaaacactgaagagggcgaaggataggagaaaatgagactggtgcgcccagctttgtgctccagttgtgagggaaccaaggaacgccttcaagtcgctctagtgcttttctctcaactttgcagtatagattctggttccagtgtagtgttgtggacttcatgatgaattgatttgtatttctataaattttataatattgctgtaacagcggaattcagaaatatgagttggtagactctttcaagttagctagcttcatatatgggagaagcactgtctcagctcatttttcttgctgtgctgtgtctgcttatgatcatatctacagtttcatctttcttttgcttttgag

SEQ ID NO: 1478 - DNA, 1079 bp, Panicum virgatum
gtcccccatcagcgttgaagcctgccttcaccgtccccacggccgccgcgccgcctcgccgctttcctcgttcccgccccacgcccacccctgccgccgggtagcttaatccagcaccgaggcgggagaagtgataattatcacaactcgcagcggtaggccagtgatgtcggagacggcggcgccgatcggcctgtcatgggcgcccaagctgccttccctagcaacgacgagcggtggcagcaagagcgacccggcgccgaaaacgagcaccgcgcaggggtcgatctggaagcccgcgagcgagctcgtggacgggctgttcgtgccaccgatagaccccaggaaggttaacaagctcgccaggaagaatgtcaaggacaccaccggcaagggctggttcgacatgccggcgccgagcatcactcccgagttgaagaaagatctcgagattttgcagctgaggcatgtaatggacccaaaaaggcacttcaagagggcaggaaagtccaaggcccttcccaggtacttccaagttggtacagttgttgagcctccatctgagttctactcaggtaggctgactaagagggagaggaaaacaacattggttgatgagctgttatcggatcaatctcataagagctacaggaagcgcaaggtacgggaaatccaggagagtcgtacgccaggaggcaaccaaaagtggaagaacaaggggaagcaaacacttaagagggccaaggataggcgaaaatgagattggtgtgtcaactgcttcgatcctgagaaagaagagagtggagagatggataaagggtcaccttcaagtcgcactatatactctgtctcgatttgacggtataaattgtgattccagtgtaatgtggtgaacttcagcaacatgttgattgctgaatgcattttcaggtctaaatatttttaaagtagtagtgtagcatcagaattaagaaatgttggttggtggactcgtttcctctgtcaagtggccccggatattgcgtaatgttttcctttgttgttggtgatgctagttgtgggccaataaaatcttttca

SEQ ID NO: 1479 - DNA, 1168 bp, Sorghum bicolor
aacctctgaatgacggcccagaatgcccgagcctgctaaacctgctgccctagtgctcctctcctctcctctctctctctcctcccaccgtcccacagccgccgcgccgcgcggccgtgctgctccttctctttcccttcccacctccaaccctgccgcctcggaggattaatccaacacctgggcgggagacgtgataggttttctgaggtcgcagacctaggccaacgatgtcggagacggcggcgccgatcggcctgtcatgggcgcccaagcttccttcctttgcaacgaccagcggcagcagcaagagcgaccacgcgccgaatccgagcaccgcgcaggggtcgctctggaagccctcgagcgagctcgtggacgggctgttcgtgcccccgagggaccctaggcagctgaataagctggccaagaagaacgtcaaggacaccaccggcaagggctggtttgacatgccagcgccgaccatcactcctgagttgaagaaggatctcgagattttgcagctgaggcatgtaattgacccaaaaaggcacttcaagcgggcagggaagtccaaggcccttcccaagtacttccaagtcggtacggttgttgagcctgcatctgagttctactcaagtaggctgaaaaatagggaacgcaaggcaacattggttgacgagctgttatcagatcaatctcttaagagctacaggatgcgcaaggtacgtgaaattcaggagatccgtacaccaggaggcaaccaaaagtggaagaacaagggcaagcaaacactgaagagggcgaaggataggagaaaatgagattggtgtgctagcttttgtgctccggttgtgagagaagagattggaaaacagaaccaaggacaagttgctctagacctctagtactctcttaactttgcagtatagattgtggttccagtgtagtggcgaacttcagtaacatgacgaattgatttttcagttccaaatattttaaaatgttgctgcaacactggaattcagaaatgtcggttggtactctttcaagttggcttcatatatgtgagaagcacgggctctgctcatttttcttgctgtgctgtgtctgcttatgatcatatctacagtttcgcttttctcttgctctcgagagtcaatctggc

SEQ ID NO: 1480 - DNA, 1217 bp, Oryza sativa
gtccaacggcccaagctcctctacttcttcctagttccttctcggttagccctactcccttcgccattgcagactccctctcacgccgccgccgcctcgccgctttcctctctctccaccgccaccgccaccgccaccgccggcgcgtactcgagcaacgttgaggcaggagttgggataggtatctgagttgaggtgaaggacgggagcgatggcggaggcggcgccgattggcctgtcgtgggcgcccaagctgccctccctgccgacgaccagcggcgggaagaaggacacgggagccagctctagcagagcgcaggggtcgctctggaagcccgcgagcgagctcgtcgacgggctcttcgtgccaccgagggacccgaggaaggccaacaagctggccaggaagaacgtcaaggacacctccggcaagggctggttcgacatgccggctcccaccatcactcctgagttgaagaaagatcttgagattttgcagctgagacatgtaatggacccaaaaagacacttcaagagggcaggaaaatccaaggcccttccgaaatacttccaagttggtacagttattgagcctgcatctgagttcttctcaagtaggctgacaaagagggagcgcaaaacaacattggttgatgagctcttatctgatcaacatcttaagaactacaggatgcgcaaagtaagggaaattcaggagagccgcactccaggaggcagccagaagtggaggaacaagggcaagaaaacactcaaaagagccaaggataggcggaaatgagtttttactgctgctactctcactcagtttaccatgaggaagagatgactgattattgggagctaaaggttgagacaaccttcaaattgcgacaaaattagattgtgataccattgtaatgtgggaaattcatgcaatatgatggatgcattagctggtggagctgagctagattgtcggttgctgtatctccctcttttcatttatgagcccactgtttcaggtatgctgtacctggatttcagagtaaaagtaccaatgtattgcttggtctgtgagtgtgccgtgtctcctggagtcctgatcatatgcagcacagctgttatacaaatgtactccgtacgtttctttctctgtgtagaatactactagaacacatgtgcttcccggtccatatttcagtccatggagaacactt

SEQ ID NO: 1481 - DNA, 1110 bp, Setaria italica
ccgccgcgccgccccgcagctttcccccatcccgtccgacgacctccatcccagccgccgcggcggttaaacccgacacctgaactcgcagcggcaggccagcgatgtccgagacggcggcgccgatcggcttgtcatgggcgcccaagcttccttccctagcgacgacgagctgtagcagcaagagcgagccggcaccgaagccgagcaccgcgcaggggtcgctctggaagccccagagcgagctcgtggacgggctgttcgtgtctccgagggaccccaagaaggttaacaagctcaccaggaagagcgtcaaggacaccaccggcaagggctggttcgacatgccggcgccgaccatcactcccgagttgaagaaagatctcgagattttgcagctgaggcatgtaatggacccaaaaaggcacttcaagagggcaggaaagtccaaggcccttcccaagtacttccaagttggtacagttgttgagcctgcatctgagttctactcgggtaggatgacaaggagggagcgtaaaacaactttggttgatgagctgctatcggatcaatatcttaagagctacaggatgcgcaaggtacgggaaattcaggagagccgtatgccaggaggcaaccaaaagtggaagaacaaggggaagcaaacacttaagagggccaaggataggagaaaatgagattagtgcgtcaactgctttggttgtgagaaagaagggagtggagaaatggacaaaggatcgccttcaagttgcactatactttctctcgattctgtggtataaattgtgtttccagtgtcatgcagtgaacttcagcaacatgttaaatgcgtgtttgcctgggcttaggatctatggtttatctttatctaaatggatgcagtgaacttcagcaacatgttgcactagatggtccattttttcatctaggagtggagaaaccttcttgttttagccatcaacatgtgtccctacgttgtttggcaaagctgcatgacaaaaagtattttgtaggccaaaattgtttgaggacatgatttgcaatggcaaaataggtatctcggtcctgaactcgaggctcaattttcag

SEQ ID NO: 1482 - DNA, 2716 bp, Brachypodium distachyon
ctcgggcgtttctctctgggcatcgttctccgcccatttccaaaaatcgaaacagaagcgaggggaataaaagggggcgtccttcgcttcgctcaggcttcagtccgtccaaccccgcgcttctcagatctaatcattctttaatccatttacctacatacagtctcacatgagcactccccgctcctccgcctcctcccccgatccgatcccccacaaatccgtaaccctagcaccctccctcggcatgcgcgatccggaggaggactcggactcgacgccgtcgcggatgtcggaggacgacgactgctccggcgggggaggcggcggcgggtggacgccggatctgaggggcggcggcggcaggtgggcgccgccggaccaggtgctggagatcgtgctcgagagcgtgctcgagttcctcaccgctgcgcgcgatcggaacgccgcctcgctcgtctgccgctcctggtaccgcgccgaggcccagacgcgcagggagctcttcatcggcaactgctacgccgtctcgccgcgccgcgccgtcgagcggttcgggggcgtgcgggccgtcgttctcaaggggaaaccgcgcttcgcggacttcagcctcgtgccccacggctggggcgcctacgtttcgccctggttcgccgcgcttggccccgcgtatccccgcctcgagcgcatctgcctcaagcggatgaccgtctccgacgacgagctcgcgctcattcccaggtcgttcccgctcttcaaggagctgtcgctggtgtgctgcgacggatttagcacccgcggcctcgccatcatcgccgagggatgcaggcatctccgagtgctggatctgactgaagattattttcatgaggaggagaacgaggtagtggattggatctccaagtttccagagagcaacacgtcgctggagtcgcttgtatttgattgtgttagtgtaccattcaacttcgaggccctcgaggcacttgttgcacggtcaccagctctgcgtcggctgcgtgtgaatgaccatgtatcgatagagcagctgcgttgtctcatggcaagggcaccccgtctcacgcaccttggtactggttcattccgatctgaaccaggctctggcggcacatcatctgtgtctgagctcgccacctcttttgcagcatcgaggtcactagtttgtttgtcaggtttcttggatgtcaatgcagaatacctcccagcaatttacccagtttgtgccaatctcacatccctcaactttagctttgcgagcctaactgctgaggagatcataccagttattaaccactgcgtcagtcttcgcactttctgggttcttgatacagtgggtgatgaaggccttcgggctgtggctgaaacatgctcagatctccgtgagctgcgtgtttttcctctcgatgccacagaggattctgagggctcagtctcggatattggtcttcaagcaatctcagaaggctgccggaagctcgaatcgattctctacttctgccagcgtatgacaaatgcagcagtaatcgctatgtctgagaactgccctaaccttgtggtgttccgcctctgtattatgggccgtcaccgccctgatcggattacaggggagcccatggatgagggttttggggcaattgtgatgaactgcaagaagctcactagactttcagtctctggcctgctcactgataaagcgtttgcatacatcgggaagtatggaaaactaataaagactctgtctattgcctttgccgggaatagtgacatgtctcttcaacatgtctttgagggatgcactaggttgcagaagcttgaggtcagagatagccctttcggcgacaaggggttgctctctggcatgaactatttttacaacatgaggttcttttggatgaactcctgcaggctaaccgcgaagggctgtcgagatgtagctcagcaaatgccaaatttggtggtggaagtaatgaaggagcatcctgaagatgaaggggagacagataccgttgataagctgtacctgtatcgatcacttgcaggaccaaggaatgatgctccatcatttgtgaacatcttgtaggagtgcaattgaagtagtatgtgtatggacatgtttgtgctattattcctgctagcttgtattcctgatcaagcatattttagaggctcagaagcagggatggtgaagtttcccgcggatgattttgaaaatgtcatgggtaatatgcacgcatcgttcagttaagcagagcatcgcttattcttttctgggctgattccgttgagatttaacctgtatgggagcagcccatgcgatttacctgatggtgaatggaaatctgagttatgactgtccttgccagcatcagactgatggctttgtgcactataattgagtagtaggaactaattgcacagggactggctgctggcctagttaaattcggcagcatattttagatggttcatgtgccctcaatattctccggacactgatggttttgtcatctatttgttcaatttatctgctcacatgaaggaatgacaatgttccatgaacagttgccttgtaatctcagctatgataaaattttcgccttcccatgtttttagtgtcctttccacaagttaatttttgttaatcatacttgatctcaccttctgctgtcattaatccagaagagattttggtcgt

SEQ ID NO: 1483 - DNA, 3002 bp, Triticum aestivum
gcggcgggccgggagggggcgacaggtgggcgccggatctgaggggctgcagcaacggcgggaggtgggcgccgccggaccaggtgctggagaacgtgctggagagcgtgctcgagttcctcacggcggcgcgcgaccgcaacgcggcctcgctcgtctgccgctcctggtaccgcgccgaggcgcagacccgccgcgagctcttcatcggcaactgctacgccgtctcgccgcgccgcgccgtcgagcgcttcgggggcgtgcgcgccgtcgtgctcaaggggaagccccgcttcgccgacttcagcctcgtgccgcacggctggggcgccaacgtctccccctgggtcgccgcgctcggccccgcctacccgcgcctcgagcgcatctgcctcaagcggatgaccgtctccgacgacgagctcgcgctcatcccaaggtccttcccgctcttcaaggagctctcgctcgtctgctgcgacggcttcaccacgcgcggcctcgccgtcatcgccgagggctgccggcatcttcgagtactggatctgactgaagattatttccatgaggaggagagtgaagtagtggattggatctccaagtttccagagtgcaacacgtcgctggagtcgcttgtatttgattgtgttagtgtcccattcaactttgaggccctggaggcacttgttgcacgctcaccagctctgcgtcgtcttcgcgttaatgaccatgtgtcgatagagcagttgcgtcgtctcatggcaagggcaccccatctaactcaccttggcactggatcattccgatctgagccaggccctgggggtgctttgtctgtgtctgagctcgctacctctttcgcagcgtccagatcacttgtttgtttgtcaggtttcttggatgccaatgcagcatacctcccagcaatctaccaagtttgtgccaatctcacttccctcaattttagctttgcgggtctaactgctgaagagttcataccagttattcgccactgcgtcaatcttcgcactttatgggttcttgatactgtgggtgatgaaggccttagggctgtggctgaaacatgctcaaatctccgtgagctacgtgtttttcctttggatgccaccgaggattctgagggctcagtctcagatattggtctccaggcaatctcagaaggctgccgaatgcttgaatcaattctctacttttgccagcgcatgacaaatgcagcagtaattgctatgtccgagaactgccctgaccttttggtgttccgcctctgtattatgggccgccaccgccctgatcggattaccggggcgcccatggatgagggttttggggcgattgtgatgaactgcaagaagctcaccagactttcagtctctggcctgctcactgataaggcgtttgcatacattggaagacacggaaaactcataaagactctgtctgttgcctttgccgggaatagtgacatgtctcttcaacacgtgtttgaggggtgcactaggttgcagaagcttgaggtcagggatagcccttttggcgacaaaggattgctctctggcctgaactatttttacaacatgaggttcttttggatgaactcatgcaggctaactgtgaagggttgtggggatgtagctcagcaaatgcctaatctggtggttgaagtaatgaaggaaaatgaaggggaaatggataccgttgataagctgtacctgtatcgatcgttggcaggaccaagggaagatgctccatcatttgtcaacatcttgtagtactgccattgaagaagtttgttgtatggtcatgtttgttctactattcctgatcactgctgttgtattcctgttcaagtatgccagagccagagaggaagttccctgcggatgattttgcgggaaatatgaatgcatcatttaattaagcagatcatcaattattcttttctgggctgattgagtcgagacttgaacctgtacgaggtttctttgatgtatgtatcttggtgaggcatctcaccttattctcaatggaatatgagttatttttctggccagcaccagaccgatgcctttgttgtatcatagttgagttgtcggaaccgattaatgattgcacagagacttgctgaaggtcggctccaattcggcagcagattttacatggttccttttgccctcaagtctccagcctttggtgttttgccatgtactgttcaatctatctgctcagacgaaggaacggcattatctatgttggaatgttccatcaacttttttgccttgtattttagattatcccagcgacgataaattttctcttcccattttttatagtttccacaacttatttttgtagatcaatgtagaccactatcacttttcctggtcacaaccttctgctgttattaatcaagaagatattggatgatgaaattcagtcagcatcaatttgttaccacgttctactctacttcctttgttgcctgttcatttgcacccatgatcatgctgctctgattatgactgctctgttgctaccaccacagcaataaatgccctctgcctgtgtattggcacatgataaggacatgacctactaatgatttgatctcaagagtggtccttggtccttgtttcgtgtagatctgcatgacatctactgtcagatggggatttgccttttcatccttctcctgtgaacatccctggaggggccaaaagctcaaagctcccaaatgggcagagcctgcaccttccacacggcaagagaaaaaaggtaatggtttcactccctgtcatagtggcatgtactcttatgatccaaaataattggctagacaaggtgtgtgctggggatatttagatctctgccttccctgtggggctggttatcactggattctagcttgttatgactaatccaactcttgtcctggttccaaaaacacccacaacttgaatcaaaaccagatatttgtgtccaaa

SEQ ID NO: 1484 - DNA, 3130 bp, Brachypodium distachyon
ctgtccacctcgcctcgcgcttcttcagatctaatcattatttaatccatttcattcaccggctccagtctcacatgagcactccccgctcctcctcctcctcccccgatccgatccccaacccatccgtaaccctagccggctcccctggcatgcgcgatgcggaggagggcccggactcgccgccgtcgcggatgtcggaggacggcaacggcggcgcgtggacgccggatctgaggtgcgggaggtgggcgccgccggaccaggtgctggagatcgtgcttgagagcgtgctcgagttcctcacggccgcgcgcgaccggaacgccgcctcgctcgtctgccgctcctggtaccgcgccgaggcccagacgcgcagggagctcttcatcggcaactgctacgccgtctcgccgcgccgcgccgtcgagcggttcggtggggtgcgggccgtcgtgctcaaggggaagccgcgcttcgcggacttcagcctcgtgccacagggctggggcgcatacttctccacctgggtcgccgcgctcggccccgcctacccgtgcctcgagcgcatcttcctcaagcggatgaccgtctccgacgacgagctcgcgctcatccccaagtcgttcccgctcttcaaggagctgtccctggtgtgctgcgatgggtttagcacgcgcgggctcgccaccatcgccgaaggctgccggcatctccgagtgctggatctgactgaagattattttcatgaggatgagaaccaggtagtggattggatctctaagtttccagagtgcaacacgatgctggagtcgcttgtatttgattgtgttggtgtgccattcaacttcgaggccctggaagcacttgttgcacgatcaccagctctgcgtcagctgcgcgtgaatgaccatgtctctatagagcagctacgtcgtctcatggcaagggcaccccatatcacccaccttggtactggttcattccattctgagccaggctctggtggggcatcgtctgtgtctgagctcgccacctctttcgcagcaaccagatcacttgtttgtttgtcaggtttcttggattttaatgcagaatacctcccagcaatctacccagtttgtgtcaatctcacatccctcaactttagctttgcaagcctaactgctgaggagctcataccagttatttgccactgcatcagtcttcgcattttctgggttctcgatacggtgggtgatgaaggccttcaggctgtggctgaaacatgctcagatctccgtgagctgcgagtttttcctctggatgccactgaggattctgagggctctgtctcagatattggtctccaggcaatctcagaaggctgccggaagcttgaatcgattctctacttttgccagcgcatgacaaatgctgcagtaattgctatgtctgagaactgccctgaccttgtggttttccgcctctgtattatgggccgacatcgccctgatcggattaccggtgagcccatggatgagggttttggggcaattgtgatgaattgcaagaagctcactaggctttcggtctctggccttctcactgataaggcctttgcttacattgggaaatatggaaaactaataaagaccttgtctgttgcctttgctgggaatagtgacatgtctcttcagcatgtgtttgagggttgtattaggttgcagaagcttgaggtcagagatagcccttttggtgacaagggattgctctctggcatgaactatttttacaacatgaggttcttttggatgaactcctgcaggctaaccgtgaagggctgtagggatttagctcagcaaatgccaaatttggtggttgaagtaatgaaggaccatcctgatgaggaaggggagatcgataccgttgataagttgtacttgtatcgatcacttgcaggaccaaggaatgatgctccttcatttgtcaacatcttgtagtgctgctattgaagaagttttcttacggacatgttgtgttattcctgattgttgtcgtccctgatcaagcatgttagaggctctgagccatagtgggaagcttcccatggatgattttgaaaattcatgggaaacatgcacgtgtcattcagttaagcggaccatcgattgttcttttctgggctgattacattgagatttaaatcgtatgaggttcttttctgagcaggtcaccttgtgattaacccgatgccgaatgggaaatctgtttattttccttgccagcaccagactgatgcattgtactatagctgagttgttggaactgattgcacagggactggctgctagcagacaccaatacagcagattttagatggttcatgtgccctcaagtctccagccactgatggtttgccatctattgttcagtgtatctgctcacacgaagaaataccgatgcttatgttggaagcttgagtgtttcatgaatgtctctgctgcgaaattttccgttcccattttcttagcttccctaaaaaagttgtttttgtagatcaatgtagacatttatcccttttcttggtctcaccttctgctgttattaatccagaggatattggaggaactgaaattcaatcagcatgatttcgttttgctctccttccttggttgcatgtcttgccttcatcactgctgcattgccatgatcatatatttactttgactatgactgctcggttgatactgctataacaataaatggcctggtctgtgtgttgtgatgataaggctatgcccttctaatgatttgatctcagagtgggtccttatttcatgtagagctgcatgacatcgactgggtcctttatccttctcgtctttcaggatccctggataggtcacagagctcccaagaagcagagttgaatagtcacaaggaaagagaaagctcaacaggtttacttcctgacgttgtaacatgtagtatgtactactgttttccaaataataaacgggtaggtcttgacctcagttctcaccattttccctgtcaagttatttcaaagaaaagagctagtgtcagtgccaatctatgcatgtttgccttagtccaaaaaataaatattacgcatgttgtctaacaa

SEQ ID NO: 1485 - DNA, 3017 bp, Oryza sativa
gcaaatcttgatggctccatgccgagagaagaaagaaacaagccattgctatgatattgctatgctatgatactacatgaactactgctgctgctactccatgtcattttctcccatcacagtagtgtgaattgtgatggtcaatgtgcattcgtcctgttccttttctttcttcctccgggcaccatccatccattcttgctcccaacaagcccaaaactgaagcgaagaaaaggagaaaaaaaattgggagggagtgagagagagagagagagagaataaaaaggcttttttgttcgctcagtcccagtccagctcgctgctcagatctaatcattatttaatcctttttccgcagtgtcacatgagcacttccccctcctgctcctcctcctcgccgatcccccaatccctaaccctagcctccacctcctcctcctcctcatcctccgggatgcgcgatgcgggggaggggtcggactcgccgccgtcggagatgtcggaggatgggtcaggagggagcggggacggggacggggacggggacgggggagggggaggcggggacaggtggatgccggatctgaggggagggaacggcggcggcggcggaggaggcggagggggagggaggtgggcgccgccggaccaggtgctggagaacgtgctggagagcgtgctggagttcctgacggcggcgcgggaccggaacgcggcgtcgctggtgtgccggtcgtggtaccgcgccgaggcgcagacgcggcgggagctgttcatcggcaactgctacgcggtgtcgccgcgccgcgccgtggagcggttcggaggggtgcgcgccgtggtgctcaaggggaagccgcggttcgcggacttcagcctcgtgccctacggctggggcgcctacgtctccccctgggtcgccgcgctcggccccgcctacccgcacctcgagcgcatctgcctcaagcgcatgaccgtctccaacgacgacctcgcgctcatcgccaagtcattcccgctgttcaaggagctgtcgctggtgtgctgcgatgggttcagcacgctaggcctcgccgccatcgccgagcggtgccggcatctccgtgtgctggatctgattgaagactatattgacgaggaggaggatgagctagtggattggatctccaagttcccggagtccaacacgtcgctggagtcacttgtgtttgattgtgttagtgtcccattcaactttgaggccctggaggcgcttgttgcacgctcaccagctatgcgccggttgcgaatgaatcaccatgtgacagtagagcaattgcgccgtctaatggcaagggctccccagctcacacaccttggtactggtgcattccgttctgagccaggccctggtggtgctctgtctgttactgagcttgctacatcttttgcggcatctaggtctctgatttgtttgtcaggtttccgggatgtcaatccagaatacctcccagcaatccacccagtctgcgctaatctcacttcccttaattttagctttgcaaacctaactgctgaggagctcacaccgattattcgcaactgcgtccgtcttcgcactttctgggttctagatacagtgggtgatgaaggccttcgggctgtggctgagacatgctcagatcttcgtgagctgcgagtttttcctttcgatgccactgaggattctgagggatcggtttcagatgttggtcttcaggcaatctcggaagggtgccggaagcttgaatcaattctctacttttgccagcgcatgacaaatgcagcagtaattgctatgtccaagaactgttctgacctggtaacattccgtctttgtattatggggcgacaccgccctgatcggatcactggggagcccatggatgatggttttggggcaattgtgatgaactgcaagaagctcactagactttcagtctctggtctgctcactgataaggcgtttgcatacattggaaaatatgggaaactaataaagacactgtctgttgccttcgctggaaatagtgacatgtctctccaatctgtgtttgaaggatgcactaggttgcaaaagcttgaggtcagagatagtccttttagtgataagggattgctctctggcctgagctatttttacaacatgaggttcttatggatgaattcatgcaggctaaccatgaggggttgtagagatgtagctcagcaaatgcctgacttggtggttgaagtgatgaaggatcatcttgatgatgaaggggagatggagactgttgataaactgtacttgtatcgatcactggcaggagcaaggaatgatgcaccttcatttgtcaacatcttgtagtactgctacaggaagaagtttgttgtactcacaaaacaagtttgttctattaaaccttatcattgctattgtattcctgaaccctgatcagtctatcagaatcagacacagaagcttcccgcagatgattttcaaatgtcgtggggaacttcgattatgcggatctccaaattgttcttttctttgctgacaatgaggcatatgaggctcttcttgatgtatgtattgttgctgaggagaagttcgtcgagtgagctacctgatgcctgatggggatccttcttttccttgctgtgactcgactgatgcctaccattttactgttagatgaagagtaggaactgattccaatcagcagggttagattagccatcttttgatctgctcagacgaaggaatggcaatgctccaatattccatcatccgttgccttatgttttagatctcaaaactcaactatgataattgtttcctttttcatttttttggggttctctcttgagttatttttgtagtccattttaccccccttttacttggtcacgtcgctgttatgaatcaagaagctattggaggaattgaaatttaatgcattaatttgttgcctgtctctatcagccattcagcctatcactgttccattgccatg

SEQ ID NO: 1486 - DNA, 2902 bp, Setaria italica
cccaaaccgaaaccagccaaacggaggagagagaggtgagggcgagagaataaaaaggcagaggctttcgatcgccgcctgcgatgcgtcccagtccacctcgctcgctcgctcctctctcagatctaatcattatttaatccttttttccaggtctcacatgagcactccccactcgtcctccacctcctcctcccccgcaccccaccgcgcctcccctccccagatcccccaatccctaaccctagcgccgcccacggcgtcctccgcctcgccctcgtcctcctccgcgtccggcatgcgcgatgcggcggaggacgactccgactcgccgccctcgcagatgtcggaggacgaccccggcgggggaggcggcgacaggtgggagccggatctgaggggcggcaacggcggcggcgggaggtgggcgccgccggaccaggtgctggagaacgtgctcgagagcgtgctcgagttcctcaccgccgcgagggaccgcaacgccgcctcgctcgtctgccgctcctggtaccgcgccgaggcgcagacgcgccgcgagctcttcatcggcaactgctacgccgtctcgccgcggcgcgccgtcgagcgcttcggcggcctgcgctccgtcgtgctcaagggcaagccgcgcttcgcggacttcagcctcgtgccgtacggctggggcgcctacgtctccccctgggtggccgcgctgggacccgcgtacccgcgcctcgagcgcatctgcctcaagcggatgaccatctccgatgacgacctccacctcgtcgccaagtcgttcccgctcttcagggagctctcgctcgtgtgctgcgacggcttcagcacggtcggcctcgccgccatcgctaagctctgccggcatcttcgcgtgctagatctcattgaagattacgttgaggatgaggacgatgagctggtggattggatctccaagttcccagagtccaacacctctctggagtcacttgtctttgattgtgtcagcgttccgttcaactttgaggccctggaggtactggttgctcgctcaccagccctgcgccggttgcgtgtgaaccaccatgtgtcagtagagcagctgcgccgtctgatggcaagagcaccccagctcacgcactttggaactggtgcattccgatctgaagctgcccctggtgggggtttgtctgtgactgagcttgctacatcttttgctgcatccaggtcgctcatttgtctatcaggtttccgggatgttaatccagaatacctcccagcaatctacccagtttgtgccaagctcacttctctaaacttcagctttgcaagcctaactgctgaggaactcaaaccagttattcgcaactgcatcaatcttcgcactttctgggttcttgatacggtgggcgatgaaggccttcgggctgtggctgatacatgctcggaactccgtgagctgcgagtttttcctttggatgcctctgaagattctgagggctcagtctcagatgttggtcttcaggcgatctcagaaggctgccggaagctagaatcaatcctctacttctgccagcggatgacaaatgcagccgtaattgctatgtccaagaactgtcctgaccttgtggtgttccgcctctgtattatgggccgccaccggcctgatcggatcaccggggagcccatggatgatggttttggtgcaattgtgatgaattgcaagaagctcaccagactttcagtctctggcctgcttactgataaagcttttgcatacattgggaaatatgggaagctaataaagactctgtctgttgcctttgctgggaatagtgacatgtccctgcaatatatatttgagggatgcactaagttgcagaagcttgaggtcagagatagcccttttagtgacaagggattgctctcaggactgaactacttctacaatatgaggttcttatggatgaactcatgcaggctaactatgaggggctgcaaagatgtagctcagcaaatgcaaaatttggtggttgaagtaatcaaggaccaccctgatgatgaaggggaggctgagattgttgacaagttgtacctgtatcggtcactggcaggaccaaggaatgatgctccaccatttgttaccctcttgtagtactgctgttggaacctgctgtacccacgaacatgtttgttcaattattcctcatcaagtttttcagagccagcgagggaagcttcctgtggatgattttcaagttgccgcaggaatgctcctgtaaatcaagaggctgctgattattcttttctcttgatcttcattgatcgttgggctggcagggcggcattctgagttggggcagttgaggagcacgtccaaagcaagtcatcggagcgcttggcgctggtcttacagtatagcaatgatgagtagggactgattgcacagggactgactgcacactgactccagtcagctggcttcggatggttcttcggcactcaagtctcaagctacttgtatcttgccatctccctttttgtttttctgctcagaccaaggaatggcaatgctgcctatgtccgaagcttcaatgttccatcggccattatgttttagattatccaaaactcggctacgctatttttttctccctttttttctacgtttttagcactcatgagttatttttgtagacctgtagaccattatcccttttcttggtctccaccctctgctatttttaatcaagaagctattggaggaatttgaaatttcatcggcattgtttggttttgccctgcttgtcatcgtcatcactgttccattgcttgccatgatcatctatatgtaacctcgactgtgacagctctatcgctataataaacaccgtagcct

SEQ ID NO: 1487 - DNA, 2709 bp, Panicum virgatum
cccagtcatcagtacacctcacaacctcttcactctcacatctaataattatttaatccattacttcattctctcataacaaatccccactcgacctccacctcctccgcaccccacctcgcactcccctccccagatcccccaatccctaaccctagcagcgcccacggcgtcctccgcctcgccctcgtcctcctccgcgtccggcatgcgcgatgcggcggaggacgactccgactcgccgccctcgcagatgtcggaggacgaccccggcgggggagggggaggcggcgacaggtgggagccggatctgaggggcggcaacggcggcggcggcggccggtgggcgccgcccgaccaggtgctagagaacgtgctcgagagcgtgctcgagttcctcaccgccgcgcgcgaccgcaacgccgcctcgcttgtctgccgctcctggtaccgcgccgaggcgcagacgcgccgcgagctcttcatcggcaactgctacgccgtctcgccgcgccgcgccgtcgagcgcttcgggggcctgcgctccgtcgtgctcaagggcaagccgcgcttcgccgacttcagcctcgtgccctacggctggggcgcctacgtctcgccctgggtggccgcgctcggccccgcgtacccgcgactcgagcgcatctgccttaagaggatgacagtctccgacgacgacctcgcgctcgtcgccaagtccttcccgctcttcagggagctcgcgctcgtgtgctgcgacggcttcagcacgcttggcctcgccgtcatcgccgagcgctgccggcatcttagaatgctggatctcattgaagattacctcgaggatgaggacgacgagctggtggattggatctccaagttcccagagtccaacacctctctggagtcacttgtcttcgattgtgttagcgtcccattcaactttgaggccctggaggcactggttgcacggtcaccagctctgcgccggttgcgtgtcaatcaccatgtgtctgtagagcagctgcgacgtctgatggcaagagcaccccagctcacgcactttggaactggtgcattccgatctgaggctgcccctggtgcgggtttgtctgtgactgagcttgctacatcttttgctgcatccaagtctatcatttgtctatcaggcttccgggatgttaatccagaatacctctcagcaatctacccagtttgtgccaagctcacttctctgaacttcagttttgcaagcctaaccgctgaggaactcaaaccagttattcgcaactgcatcaatctgcgcactttctgggttcttgatacggtgggcgatgaaggccttcgggctgtggccgatacatgctcagatctccgtgagctacgggtttttcctctggatgcctctgaagattctgagggctcagtctcagatgttggtcttcaggcaatctcagaaggctgccagaagctagaatcgatcctctacttctgccagcggatgacaaatgcagcagtaattgctatgtccaagaattgtcctgaccttgtggtgttccgcctctgcattatgggccgccaccgccctgattggatcaccggggagcccatggatgatggttttggtgcaattgtgatgaattgcaagaagctcaccagactttcagtctctggcctgctcactgataaagcttttgcatacattgggaaatatgggaagctaataaagactctgtctgttgcctttgctgggaatagtgacatgtccctccaatatatatttgagggatgcaccaagttgcagaagcttgaggtcagagatagcccttttagtgataagggattgctctcagggatgaactacttctacaacatgaggttcttatggatgaactcatgcaggcttactatgaggggctgtaaagatgtagctcagcaaatgcaaaatttggtggttgaagtaatcaaggaccactccgatgatgaaggagaggctgagattgttgacaagttgtacttgtatcggtcactggcaggaccaaggaatgatgctccgccatttgttaccctcttgtagtaatcctattggaagaacagttctgctgtacccgcaacatgtttgttcaattattcctcatcaagtttttcagagccagcgagggaatgcggatgattttcaagttgccgcaggaaaactcgtgtaaatcaagtaagaagctgctggctattctttttacttgatcttcattgatcgttggactggcagggtggcattccaaattggggggagttggagagcgcatccagagcaaggcatcggagcgctggcgctggtcttacagtatagcaatgatgagtagggactgactgcacactgactccagtcagcgggcttcggatggttcttcggcactcaagtcttcgtgctacttgtatcttgccatcttccgtttcattttctgctcagaccaaggaatggcagcagctgcctatgtctgaagcatcaatgttccatcggccattatgttttagatgatccaaaactcagctaccctttttttttctcccttctttttccacgtctttagactcatgagttatttttgtagacctgtagaccattatcccttttcttggtctccaccatctgctatttttaatcaagaagctattggaggaatttgaaatttcattggcattgtttggttt

SEQ ID NO: 1488 - DNA, 3845 bp, Panicum virgatum
ttcgctctgctctcaatcagacgccgagccgccccgggcggagagcacggcgaccgcgctcggccggctcgtgggctgcacggacacatcacgcgtcggcgcgcgcggcacagcagtaaagcgagcaaagacccaaagacctcgccgttgtagccgaacagtgggcggcccggggccccgacgtcgtgcatgattgagcactcatcagtatcgccctgcctgcgtggcaggagcagcagccatgcctcgcagcagtgcctcacctgtcactgtagctttcaacagctcgtcgtacgagtcaaggctcgacacccagctcgaatacgtatccggtctgtaatgtattgaactacatcatgattctctgaactcccaaacggccctgaaagtcggatgctagctaagacattccttgccatttctagtgccaaaacacagtagtacatgagagaagcagatgcaggagagtccttgccaggtttgcgcgttctagatgaggtaagtgaggtggttagtgctggctaaagcgggacctaaccaaacctgtgcgtgcgtattaccattattgaggtagtagagtagcaaggaaaggctagcagtcctcctgtacgcttgctgccgagacggcgggatgggcgtagtaagtgacaagagcactggaagcctacgactccgagctttcgccgagaggagaaaggaacatggcccatgcttgctaatgctatgctcccagttccaggctcccgtgcgtagcgagtagcggaatggtgtatcgtcctgttcctttctccggcgtcgccggccgccgttggcatccgatctgattgatctcctccgttggcttggcctggcgttgggttctctctttccgaacccaaaccggaagcagccaaacggagaagggagaggggagggcgagccggcgagggagggaataaaaaggctttggcttggctctcgatcgctgccgctgcgtcgtcccagtcccagttacctcgctcgctcgctgggctctcagatctaatcattatttaatccttttttccagtctcccatgagcactccccactcgtcctccacctcctccgcaccccaccgcgcctcccctccccagatcccccaatccctaaccctagcagcgcccacggcgtcctccgcctcgccctcgtcctcctccgcgtccggcatgcgcgatgcggcggaggacgactccgactcgccgccctcgcagatgtcggaggacgaccccggcgggggagggggcggcgacaggtgggagccggatctgaggggcggcaacggcggcggcgggggccggtgggcgccgcccgaccaggtgctagagaacgtgctcgagagcgtgctcgagttcctcaccgccgcgcgcgaccgcaacgccgcctcgcttgtctgccgctcctggtaccgcgccgaggcgcagacgcgccgcgagctcttcatcggcaactgctacgccgtctcgccgcgccgcgccgtcgagcgcttcgggggcctgcgctccgtcgtgctcaagggcaagccgcgcttcgccgacttcagcctcgtgccctacggctggggcgcctacgtctcgccctgggtggccgcgctcggccccgcgtacccgcgactcgagcgcatctgccttaagaggatgacagtctccgacgacgacctcgcgctcgtcgccaagtccttcccgctcttcagggagctcgcgctcgtgtgctgcgacggcttcagcacgcttggcctcgccgtcatcgccgagcgctgccggcatcttagaatgctggatctcattgaagattacctcgaggatgaggacgacgagctggtggattggatctccaagttcccagagtccaacacctctctggagtcacttgtcttcgattgtgttagcgtcccattcaactttgaggccctggaggcactggttgcacggtcaccagctctgcgccggttgcgtgtcaatcaccatgtgtctgtagagcagctgcgacgtctgatggcaagagcaccccagctcacgcactttggaactggtgcattccgatctgaggctgcccctggtgcgggtttgtctgtgactgagcttgctacatcttttgctgcatccaagtctatcatttgtctatcaggcttccgggatgttaatccagaatacctctcagcaatctacccagtttgtgccaagctcacttctctgaacttcagttttgcaagcctaaccgctgaggaactcaaaccagttattcgcaactgcatcaatctgcgcactttctgggttcttgatacggtgggcgatgaaggccttcgggctgtgtccgatacatgctcagatctccgtgagctacgggtttttcctctggatgcctctgaagattctgagggctcagtctcagatgttggtcttcaggcaatctcagaaggctgccagaagctagaatcaatcctctacttctgccagcggatgacaaatgcagcagtaattgctatgtccaagaattgtcctgaccttgtggtgttccgcctctgcattatgggccgccaccgccctgattggatcaccggggagcccatggatgatggttttggtgcaattgtgatgaattgcaagaagctcaccagactttcagtctctggcctgctcactgataaagcttttgcatacattgggaaatatgggaagctaataaagactctgtctgttgcctttgctgggaatagtgacatgtccctccaatatatatttgagggatgcaccaagttgcagaagcttgaggtcagagatagcccttttagtgataagggattgctctcagggaagaactacttctacaacatgaggttcttatggatgaactcatgcaggcttactatgaggggctgtaaagatgtagctcagcaaatgcaaaatttggtggttgaagtaatcaaggaccactccgatgatgaaggagaggctgagattgttgacaagttgtacttgtatcggtcactggcaggaccaaggaatgatgctccgccatttgttaccctcttgtagtaatcctattggaagaacagttctgctgtacccgcaacatgtttgttcaattattcctcatcaagtttttcagagccagcgagggaatgcggatgattttcaagttgccgcaggaaaactcgtgtaaatcaagtaagaagctgctggctattctttttacttgatcttcattgatcgttggactggcagggtggcattccaaattggggggagttggagagcgcatccagagcaaggcatcggagcgctggcgctggtcttacagtatagcaatgatgagtagggactgactgcacactgactccagtcagcgggcttcggatggttcttcggcactcaagtcttcgtgctacttgtatcttgccatcttccgtttcattttctgctcagaccaaggaatggcagcagctgcctatgtctgaagcatcaatgttccatcggccattatgttttagatgatccaaaactcagctacccttttttttctcccttccttttccacgtctttagactcatgagttatttttgtagacctgtagaccattatcccttttcttggtctccaccatctgctatttttaatcaagaagctattggaggaatttgaaatttcattggcattgtttggttttgcccttacgctcgatgcctgtcgtcgtcgtcactgttccgttgcttgcgtatgttaattactttctcgaatgtgacagctctatcgctataataaacggccgtagcctgtgtattgattagtcatcataacaataggccctaccaatgatttgctctgata

SEQ ID NO: 1489 - DNA, 3919 bp, Panicum virgatum
tctgctctgctctcaatcagacgccgagccgccccgggcggagagcacggcgaggcgaccgggctcggccggctcgtgggctgcacggacacatcacacatcggtgcgcgcggcacaggagtaaagcgagcaaagacctcgccttgtagccgaacagtgggcggcccgggccccgggtgttgtgcatgattgagcactcaacagtatcgccctgcgtgacaggaggagcagccatgcctcgcagcagtgcctcacctgtcactgtagctttcaacagctcgcgtacgagtcaaggctcgagacccagctcgaatacgtagctggtccggtctgtactgtattgaactacctcatgattctctgaactccctcacaaacggccctgaaagtcgggtgctaagacattacttgccatttctagtgccgaaacacagtagtacatgagagaagcagaagcaggagtggaggtttgagtgttctagatgaggtaagtgaggtggttagtgctagttaaagcgggacctaactaaacctgtgcgtgcgtgttaccatcattgaggattcgaggtactagtagtagagtagcgaggaaaaggctagcagtcctctacggttgctgccgagacggccgcatgggcgtagtaagtgacaagagcactggaagcctacgactacgagctttcgccgagaggagaaatgaaggaacaagccccatgcttgctaatgctatgctcccggtgcgtagcgagtagcggaatggtgtatgtgtatcgccctgttgctttctccgtcgtcgccggccgccgttggcatccgatctgatctccttctccgttggcttggcttggctttccgaacccaaaccggaagcagccaaacggaggggagggcgagccggcgagggagggaataaaaaggctttggcttggctttggatcgctgcctgcgctgcgctgcgtcctcccagtcccagtccacctcgctcgctctccgctctcagatctaatcattatttaatccttttttccagtctcccatgagcactccccactcgtcctccacctcctccgcaccccaccgcgccacccctccccagatccccccaatccctaaccctagcagcgcccacggcgtcctccgcctcgccctcgtcctcctccgcgtccggcatgcgcgatgcggcggaggacgcctccgactcgccgccctcgcagatgtcggaggacgaccccggcgggggagggggaggcggcgacaggtgggagccggatctgaggggcggcaacggccggtgggcgccgccggaccaggtgctggagaacgtgctcgagagcgtgctcgagttcctcaccgccgcgcgggaccgcaacgccgcctcgctcgtctgccgctcctggtaccgcgccgaggcgcagacgcgccgcgagctcttcatcggcaactgctacgccgtctcgccgctccgcgccgtcgagcgcttcgggggcctgcgctccgtcgtgctcaagggcaagccgcgcttcgcggacttcagcctcgtgccctacggctggggcgcctacgtctcgccctgggtggctgcgctcgggcccgcgtacccgcgactcgagcgcatctgcctcaagcggatgacagtctccgacgacgacctcgcgctcgtcgccaagtccttcccgctcttcagggagctcgcgctcgtgtgctgcgacggcttcagcacgctcggcctcgccgtcatcgccgagcgctgccggcatcttcgaatgctggatctcattgaagattacgtcgaggatgaggacgacgagctggtggattggatctccaagttcccagagtccaacacctctctggagtcacttgtcttcgattgtgttagcgtcccattcaactttgaggccctggaggcactggtcgcacggtcaccagctctgcgtcggttgcgtgtgaatcaccatgtgtcagtagagcagctgcgacgtctgatggcaagagcgccccagctcacgcactttggaactggtgcattccgatctgaggctgcccctggtgggggtttgtctgtgactgagcttgctacatcttttgctgcatccaagtctatcatttgtctatcaggcttccgggatgttaatccagaatacctcccagcaatctacccagtttgtgccaagctcacttctctgaacttcagctttgcaagcctaaccactgaggaactcaaaccagttattcgcaactgcatcaatcttcgcactctctgggttcttgatacggtgggcgatgaaggccttcgggctgtggctgatacatgctcagatctccgtgagctgcgagtttttcctttggatgcctctgaagattctgagggctcagtctcagatgttggtcttcaggcaatctcagaaggctgccggaagctagaatcgatcctctacttttgccagcggatgactaatgcagcagtaattgctatgtccaagaactgtcctgatcttgtggtgttccgcctctgcattatgggccgccaccgccctgattggatcaccggggagcccatggatgatggttttggtgcaattgtgatgaattgcaagaagctcaccagactttcagtctctggcctgcttactgataaagctttcgcatacattgggaaatatgggaagctaataaagactctgtctgttgcctttgctgggaatagtgacatgtccctccaatatatatttgagggatgcaccaagttgcagaagcttgaggtcagagatagcccttttagtgacaagggattgctctcaggaatgaactacttctacaacatgaggttcttatggatgaactcatgcaggttgactatgcgtggctgtaaagatgtagctcagcaaatgcaaaatttggtggttgaagtaatcaaggaccactctgatgatgaaggagaggctgagattgttgacaagttgtacttgtatcggtcactggcaggaccgaggaatgatgctccgccatttgttaccctcctgtagtagtcctattggaagaacagttctgctgtacccacaacatgtttgttcaattattcctcatcaagtttttcagagccagcgagggaatgcggatgatcttcaagttgccgcaggaaaactcatgtaaatcaagtaagaagctgctggctgttcttttcacttgatcttcattgatcgttggactggcagggtggcattccaagctgggggcagttgaagagcacatacagagcaaggcatcggagcgctggtgctggtcttacagtatagcaatgatgagtagggactgattgcacagggactgactgcacactgactccagtcagcaggcttcggatggttcttcggcactcaagtcttcgagctacttgtatgattgtatcttgccatcttccatttcattttctgctcagaccatggaatggcactgctggctatgtccgaagcatctatatgttccatcagcccattatgttttagatgatccaaaactcggctaccctattttttctcccccttttttctacgtttttagaactcatgagttatttttgtagacctgtagaccattatcccttttcttggtctccaccatctgctatttttaatcaagaagctattggaggaatttgaaatttcattggcattgtttggtttgcctttacgctcgatgcttgtagttgtcatcactgttccattgcttgcgatgatcatgtatatattactacctcgactgtgacagctctttcgctataataaacgcccgtagcctgtgtattgaactgtcatcataacaataggccctaccaatgatttgctctgatagtcgtcgtccttgcttcatgtagagtctcatgacatcaactgccctgatggccgtctgtttttattct

SEQ ID NO: 1490 - DNA, 3252 bp, Sorghum bicolor
aagaaaggccgagacagcaccgtcgggatgggcgtaataagtgacaagagtactcgcttacgagtctgacccagagaagaaaggaacaggccagacgtcttcgtctctcccctaggccctagcgtagcgtaatggcgtatgacgcctgttcccttctcggacgtcgccggccgccgtttgcgtccgctttgatctccgttcgtctctctccggacagagagttgaggtgaggtgaggagagcccaaaccgaaagcagccaaacagaaggaggcggccgagaccgcgagagcgagagaataaaaagcagggggctttctttcgatcgctgcgctgcgtcccagcaccagcaccagcagtcccagtccaccttgctcgcgagtcgctcgctccctcgatcagatctaatcattatttaatcctttttttccagtctcacatgagcactccccactcgtcctccacctcctccgtcccccaccgcgcctcccctccccagatccccccatccctaaccctagctcccacggcgtcctctgcctcgccgtcctcctcctccgcgtccggcatgcgggacgcggcggaggacgactccgactcgccgccgtcgcagatgtcggaggacgaccccggcgggggcggggacaggtgggagccggatctgaggggcggcaacaacggcgggggcgggaggtgggcgccgccggaccaggtgctggagaacgtgctcgagaccgtgctcgagttcctcaccgccgcgcgggaccgcaacgccgcctcgctcgtctgccgttcctggtaccgcgcagaggcgcagacgcgccgcgagctcttcatcggcaactgctacgccgtctcgccgcgacgcgccgtcgagcgcttcggcggcctgcgcgccgtcgtgctcaagggcaagccccgcttcgcggacttcagcctcgtgccatacggctggggcgcctacgtctccccctgggtggcagcgctcgggcccgcgtacccgcgcctcgagcgcatctgcctcaagcggatgaccgtctccgacgacgacctcgcactcatcgccaagtccttccccttgttcagggagctctcgctagtgtgctgcgatggcttcagcacggtcgggctcgccgtcatcgtcgagcgctgccggcatcttcgcgtgctggatctgattgaagattaccttgaggatgaagaggacgagctggtggattggatctccaagttttcagagtccaacacctctctggagtcacttgtcttcgactgcgtcagtgtgcccttcaactttgaggccctcgaggcacttgttgcacgctcaccggctttgcgtcggttgcgtgtcaaccaccacgtgtcagtagagcagctgcgccgtctcatggcaagagcaccccagctcacacactttggaaccggtgcattccgatctgagggtgcccctgatgggggtctggctgtgactgagcttgctacatcttttgctgcagccaggtctctcgtttgtctatcaggttttcgggaggtcgatccacaatatctcccagcgatctaccctgtttgtgccaagctcacctcactaaacttcagctttgcaagcctaacggctgcggaactcaagccagttattcgcaactgcaccaatcttcgcactttctgggtccttgatactgtgggtgatgaaggcctacgtgctgtggctgatacatgctctgatctccgtgagctgagagtttttcctttggatgcctctgaagattctgagggttcggtctcagatgttggtcttcaggcaatatcagaaggctgccggaagctagaatcaatcctctacttttgccagcggatgacaaatgaagcagtaattgctatgtcgaagaactgtcctgagcttgtagcgttccgcctctgtattatgggccgccaccgccctgatcgagtcactggggacccaatggatgaaggttttggcgcaattgtgatgaactgcaagaaactcaccaggctttcagtctctggcctgcttactgataaagcctttgcatacattggaaaatatgggaagctaataaagactctgtctgttgccttcgctgggaatagtgacatgtccctccaatatgtatttgagggatgcactaagttgcagaagcttgaggtcagagatagcccttttactgacagggggttactctccggactgaactacttctacaatatgaggttcttatggatgaactcatgcaggctaactatgagaggatgtaaagatgtagctcagcaaatgcaaaatttggtggttgaagtaattaaggaccactctgaagatgaaggggaggctgagattgttgacaagttgtacttgtatcggtcactggcaggaccaaggaatgatgctccaccatttgttaccctcttgtaggactgctattggaagaacagccctgctgtacccacgaacatgttagttgtactattccttatcaagttctcagagccaatgagggaagctttctgcggatgattttcaagttgctgcaggagcacacagtgtaaatcaagtaagaagctgccgaatattcttttcacttgatctggcatggccagcatacagagttggggcagttgaggagcacatccagagggagacatctgatggcctcacggcgctagtcttttacagtatagcaatgatgggtagtgactgattgcacaggaactgactgcacactgactccagtcagcaggcttcggatggttcttggcactcaggtctccagctacttgtatcttgccatcttccgtttcatttttctgctcagaccaaggaatggaagtgctgctgcctatgtccgaagcttcaatgctccaccggccattacttatgttttagaatgatccaaaactcagatcctgctatttttttctctcccttctttttcattgtttttagcactcatgagttatttttgtagacgaccggtagaccattatcccttttctcattatcccttttcttcgtctccaccctctgctatttttaatcaagaagctattggaggaaatttgaaatttgttcggcattgcttggttttgcccccactctcgctgtgctccttgtcgacatcactgttccattgcttcccatgatcatactcctatatgtcctactatatatttacgacctcgactgcgacagctctatcgctataataaacgcccgtagcctgtgtgttgcaattgtcatc

SEQ ID NO: 1491 - DNA, 1075 bp, Triticum aestivum
aagggggcaggaaaacagggggcggcgcggcggaacggagagcggaggagaaagagaggaagcagtctcagttctcgatctccgaggttggtgccggtggctagggctggaagccggcggcagaggcagatctgatccgcgggtggcggtgcagaggcgagactccccggagcttcggccggaccggccatccgattccgcggcccgcctctgcgatggttcgatctccgccccccacctccacccagcagtaattttattatcctcctagggttcaaatctgggcgagatcgtcgccggatcccccgggcggttctcgtgctgggacggccaggccgggcctcgatccgtgggcgccgccagttcgagtcaaattccccatctcctctgtgcttgagttcgtcgcgccaccacgatccctctagcccacacactggactttgataaatagtctctggctgctgctgctgactggagtgatgaattcgaggccgatcgtgctcgtcttcctcctgctcgtgctcatcatatcatcgcagttcgagtggaagcagcagatcggtgaggccgaggcgagtcccgaagctacgcggcggaggcagcaaccgctggtcgtaagggaagatgccgttaaagagaaaataatactggcgcaggagaagaacatccagcagctcaccgagctcatccagagcctccaggttcagctgctgcattgtcgtggcagcaacagcactgctcatggcgcctcctcgaatcagtcttcagccagttacgccgaagcggacaggcatcagataatcgatgactgatgacccgtcaacatgcccaggtactttgcatcacagtacaaccggctcaagggcacacacctgaatgatatatgatagacaccatcgttgcggaccactatgtagtgccctggagtctagggagcttgtcttagtttcctgttgtgctgtgctattgacaacagtatgaccacccccttctaatacatgttcaccctcggcctgtacagtgttatattgtaacagtatcatgtaaatttagcccaccttcctctattgagatt

SEQ ID NO: 1492 - DNA, 1000 bp, Triticum aestivum
catcggtttttccagccagcgtttggccgactgcgccgcacgaagggagaaggaagggggcaggaaaacagggggcggcggcggaacggaaagcagaggtacgagagaggaagcagtctcagttatcgatctccgaggttggtggcggcggctagggctggcagccggcggcagaggcagatcagatccgcggctgttcggcgcggagaggagactccccggagcttttcggccggaccggccacccgattgcgcggcccgcctctgcgatggtctctggctgctgctgttgctgactgcagcgatgaattcgaggccgatcgtgctcgtcttcctcctgctcgtgctcatcatatcatcgcagttcgagtggaagcagcagatcggcgaggccgaggcgagcccggaagctacgcggcggaggcagcaaccgcaggttgtaagggaagatgccgttaaagagaaaataatactggcgcaggaaaagaacatccaacaactcaccgagctcatccagagcctccaggtgcagctactgcattgccgtggcagcaacagcactgctcatggcgcctcctcgaatcagtcttcagccagttacgccgaagcggacagacatcagataatcgatgactgatcgcccgtcgacatgcccaggtactttgcatcacagtacaagcggctcaaggacacacacctgaatgatatatgaaaggcaccatcgtcgcgcaccaccatgtagtgctctggagtccaaggagctgtcttagtgtactgatgtgttgtactattgacagcactatgaccaccccccttccaatacctcttcacccttggcttgtacagtgttatattgtaactgtatcatgtaaatttagcccaccttcctcattgagattgagaatgtactcataccgatccctgccgcgatcatcatcgattctttctatccgccaccttcctcattgcagtctgtattcggtggagcaatttctcggcg

SEQ ID NO: 1493 - DNA, 1001 bp, Triticum aestivum
tttggctggccgactgcgccgcacgaagggggaaggaagagggctacttggaaaactgggggcggcgcggcgggacggaaagccgaggtaggagagaggaagcagtctcagttctcgatctccgaggttggtggcggcggctagggctggcagccggcggcagaagcagatctgatccgcgggtgtccggcgcagagaggaggctccccggagcttcggccgggccggccatccgattccgcagcccgcctctgcgatggtctctggctgctgactgcagtgatgaattcgaggccgatcgtgctcgtcttcctcctgctcgtgctcatcatatcatcgcagttcgagtggaagcagcagatcggtgaggccgaggcgagcccggaagctacacggcggaggcagcaaccgcagatcgtaagggaagatgccgttaaagagaaaataatactggcgcaggagaagaacatccagcagctcaccgagctcatccagagcctccaggtgcagctactgcattgccgtggcagcaacagcactgctcatggcgcctcctcgaatcagtcttcagccagttactccgaagcggacagacatcagataatcgatgactgatcgcgcgtggacatgcccaggtcgtttgcgtcagagtacaaccggatcaaggacatgctctgcagtgtactgatgtgctgtactattgacagcactatgaccacccccttctaatacatcttcaccctcggcttgtacaggattatattgtaactgtatcatgtaaatttagcccaccttcctcattgagattgagaatgtactcataccgatccctgccgcgatcatcatcgattctttctatccgccaccttcctcattgcagtctgtattcggtggagcaatttctcggcgatgtggtggtctgcaagaaagaggtaaggcaggcactctacaacctacatgagcttttgcaagcatgtgttattagttactccctccgtccc

SEQ ID NO: 1494 - DNA, 979 bp, Secale cereale
gacgtacaatacggtttttcttttccagccagccagcatcatctgcccgactgcgccgcacgaagggagaaggaaaacagggggcggcgcggcgcggcgggacggaaagcggaagcagtctcagttctcgatctccgaggttggtggcggtggctagggccggcagccggcggtcgaagcagatctgatccgcgggtggcggcgcggagacgagactccccggaccttcgcccggaccggccctccgattccgcggcccgcctctgcgatggtctctggccgctgctgttgctgaccgcagcgatgaattcgaggccgatcgtgctcatcttcctcctgctcgtgctcatcatatcatcgcagttcgagtggaagcagcagatcggcgaggccgaggcgagccccgaagctacgctgcggaggcagcaaccggctgtcttaagggaagatgccgttaaagagaaaataatactggcgcaggagaagaacatccagcagctcaccgagctcatccagagcctccaggtgcagctactgcattgccggggcagcaacaacactgctcatggcggatcctcgaatcagtcttcaaccagttactccgaagcggacagacatcagataatcgatgactgatcacccgccagaatgcccaggtactttgcatcacagtacaaccggctcaaggacgcacacctgaatgatatatgaaagacaccattgccgcggaccaccatgtagtgccctggagtcttggtagctgtcttagtgtattgatgtgctgtgctattgacaacactatgacaacccccttctgatacctcttcacccttggcttgtacaggattatgttgtaactgtatcatttaaatttagcccaccttcctcattgagattgggaatttactcataccaatccctgccgcgatcatcatcgatactttctgtgattatattggcactctacaacccaaaaaaa

SEQ ID NO: 1495 - DNA, 1279 bp, Secale cereale
aggtacgatggggagtcgggtttttcgtttttccttagccacgcagcatcatctgcccgactgcgccgcacgaagggagaaggaaaacagggggcggcgcggcggaacggaaaagcggaagcagtctcagttctcgatctccgaggttggtggcggtggctagggccggcagccggcggtcgaagcagatctgatccgcgggtggcggcgcggagaccagactccccggaccttcggccggaccgcccatccgattccgcggcccgcctctgcgatggtctctggccgctgctgttgctgaccgcagcgatgaattcgaggccgatcgtgctcatcttcctcctgctcgtgctcatcatatcatcgcagttcgagtggaagcagcagatcggcgaggccgaggcgagccccgaagctacgctgcggaggcagcaaccggctgtcttaagggaagatgccgttaaagagaaaataatactggcgcaggagaagaacatccagcagctcaccgagctcatccagagcctccaggtgcagctactgcattgccggggcagcaacaacactgctcatggcggatcctcgaatcagtcttcaaccagttactccgaagcggacacacatcagataatcgatgactgatcacccgccagaatgcccaggtactttgcatcacagtacaaccggctcaaggacgcacacctgaatgatatatgaaagacaccattgccgcggaccaccatgtagtgccctggagtcttggtagctgtcttagtgtattgatgtgctgtgctattgacaacactatgacaacccccttctgatacctcttcacccttggtttgtacaggattatgttgtaactgtatcatttaaatttagcccaccttcctcattgagattgggaatttactcataccaatccctgccgcgatcatcatcgatactttctgtgattatattggcactctacaacctacatgagcttgttgcaagcatttgttagtgtttgatggtggcatcatcatcagaatacagacacatgaggattgttcagaaaagcatattaccaaagaatcaaggagaaaaaagcagcatgaagaatcaagcatctcatgcttaatgaacaaggtacgcggccacagagcacacaaatcaacagtcacagtgatgactgaactcaatgcagctaggaatccatgaaccaaaagaagtagaagaagaagaatcaaagattacattcatggacgatgatgatggattggatggatcatggatg

SEQ ID NO: 1496 - DNA, 641 bp, Lolium multiflorum
gtcgattccccaatcggcttcttcacagcccgcctggcgcctgcgatgctctctgattgctgactggagtgatgaattcgagaccaatagtcctcgtcttcctcctgctcgtgctcatcataacgtcgcagtttgagtggaaacagcagattggcgaggccgaggcgagcccggaagctacacggcggagacaacaagcgctggtcgtaagggaagatgctgtaaaagagaaaataatattggcgcaagagaagaacatccagcagctcaccgagcttatccagagcctccaggtgcagctactgcactgtcgtggcagcaacagtactactgctcatagcgcctcttcaaatcaatcgtcgaccaacgacaccgaagcagagggacatgaactaatcgatgattgatcacccgtcagcacacacatgtagtctgtctcagagtacatccagctcaagaacatgcaccaaaatcaaagtcgtctcccagggaacatcgtagaagttttatggtcatcgtcatgaccagtaggaccctagagagttaccttgatgtactaatatgatgtgctattgacactacgagcattgccttttagtttcgttttacccacagcttgtacaaactgatattgtatcatg

SEQ ID NO: 1497 - DNA, 982 bp, Avena sativa
ggaagctaacatttcgacgtcttctccttcacgcagagaagggaaaggggagaggaacttcccgagctggggaagtcaaaggctcaaaccctcatcgaaggttggtagcggattgggctagcagcggcggccagcggtagtccaccggcggacgaatcgaagcaaatccgtggcggctcggatccccctcgaggctccgccgtggatcccccaatcggcttccacagcccgcctgcggtggtctctgattgctggctggtgtgatgaattcgagaccgatagtcctcatcttcctcctgctcgtcctcatcataacgtcgcagtttgagtggaagcagcagattggtgaggctgaggcgagcccggaagctacacggaggaggcaacaagcactggttctacgggaagatgctgttaaagagaaaataatattggcgcaagagaaaaacatccagcagctcaccgagcttatccagagcctccaggtgcagctactgcactgccgtggcagtaacagtactactgctcatagcgcctcctcaaatcagtcatcgaccaacgacaccgaggcggagggacatgaaataatcgatgattgattacccgtgagcacggacatgtagtttttttcagagtacaaccagctcaagaacatgcacctgaaggcaacatggaaaatgatttatcttcacgaccagtaggaccctagagagctatcttgatgtactattgtgctgtgctattgacactacgaccatcccctttcagtttcttttctccccaggttgtacagagtgatattgtatcatgtaaatctagcccaccttcctgattgagtctacttatgccgatctctgttgcgattctatacttgctttatcagccaaaaaacatgaaagaggtctatattcggtgtagcatttgtttgtgttgtcaatggcatgctctgcaagcaaaagataaagatacatcagaggattac

SEQ ID NO: 1498 - DNA, 785 bp, Avena sativa
cttcacgcagagaagggaaggggagaggaacttcccgagctggggaagtcaaaggctcaaaccctcatcgaaggttggtagcggcttgggctagcagcagcggccagcggcggacgcatcgaagcaaatccgtggcggctcggatacccctcgaggctccggcgtggatcccccaatcggtttccacagcccgcctgcggtggtctctgattgctggctggagtgatgaattcgagaccgatagtcctcatcttcctcctgctcgtgctcatcataacgtcgcagtttgagtggaagcagcagattggcgaggctgaggccagcccggaagctacacggaggaggcaacaagcgctggttctacgggaagatgctgttaaagaaaaaatcatattggcacaagagaaaaacatccagcagctcaccgagctcatccagagcctccaggtgcagctactgcactgccgtggcagtaacagtactactgctcatagcgcctcctcaaatcagtcgtcaaccaatgacaccgaagcggagggacatgaaataatcgatgattgattacccgtcaacacggacatgtagtttttttcagagtacaaccagctcaaaaacaatgcacctgaaggcaacatggaaaatgctttatcttcgcgaccagtaggaccctagagagctatcttgatgtactattgtgctgtgttattgacactacgaccatcccctttcagtttcttttcgccccagttgtacagagtgatattgtatcatgtaatctagcccac

SEQ ID NO: 1499 - DNA, 3749 bp, Brachypodium distachyon
gagaaggtgggcagcagaaagaatagatcttgaccaaaccgctccccctctcccccacacggccgtggggcgacgccgacagcttccctacaaatcaggcaccttgccggagtcgtcggagctgagagctcctctacctccatcagggctcctccctctccagatccatttcccccaccgacacccaccaaccactgccttcttcttcgccgccggcctatcgatcgccctgccccaccgccgccgccgccatgcctcccgccgcatcatccgccgacgcaccgcctagctccaccccggctccgtccacgaccaagccgccgcgcccgcggtacccgctggggctggacgcgctggtctccccggcgcggtccctgctggcggcggggcggcggtccccggtgacgacgctggtctgcttcatcgcgctgctggcgctcatcatgtacggcgaggacgcgcgcaccgtcgccgagctctccatcgacgactacctctacccggacgccgacgtctacaacgtctccggccttccccccatcgcgctccccccgcccacctgcaacctggcccgcggccgctggctcttcgacaacgtcaccacgccgctctaccgggagcacgaatgcacgttcctcaccaagcaggtcacctgcctcgaaaatggccgccccgacgatacctggcagtactggaaatggcagcccaacgactgctccctccccacgtttgatgcgcggaggttcatggagaggatgagggggaagaggatgatgttcgtgggggactcgctgaacaggaaccagtgggagtcgatggtgtgcatggtgcagggggtgctgagcaaggggaggaagaaggtgatcaagaggggatccctcaccatcttccacgccaaggagtaccgcgccacgctcgagttctactgggcgccattcctcgtcgagtccaattccgacaaccccaggatccacagcatcgaccaccggatcatccggcccgagcggatcgaggggcacgccaagtactggcggggcgtcgactacctcatcttcaacacctacatctggtggatgaacaccgccgacatgaaagtccggaggcccgattcgaggtattggtcggagcacgacgaggtgccgaggatcgacgcgtatggccgggtgctcaagacgtggtcggactggctggaggagaatatcgatccggcgcggacatccgtcttcttcatgacaatttctcctcttcacatcagcccagataaatggggaaaccccagcgcgatcaaatgcttcaatgagacgcttccggtgctcaactacaccgagcccttcgacctcaaccacgacatgcggatgtatgacctggtagcaagcacgtccagatccatgaagaaagttccggtcacgctgatcgacatcacgaggatgtcagattacaggaaggatgcacacacatccgtgtataccattcggcgggatcgtttgctgacgcctaagcagagggccgatccggagaagttcgctgactgcatccattggtgccttccgggtgtaccagatgtctggaacacggtactcttcacgaggatcttctcgaagtcatctcctccgccactcccctctctccctccccaatgagaggcaggtgttcagttttcactcaataggaaatgtactgttgttccatcttttttttttgggatagtttgggtaaaagttagagaggaaaaaaagagtgagctgtttactaacagtgcgcaaattgttcaattgaactgtaaatttagttttgacttaaccaattgagcagatatcattgtagtaagcagttgcactggtatgaattcagaagtaggcgccatacctcaaacaggatcgtacaaaggggcattgcttattttacaaatattgtaactgctggtgcaaaagctgtctgacaactttttttttgttttgcattttcctttttcgtatactggaggagaatatataactcctagaaagaatggatgtttgcagagggaatgtaaagtggacttttactagagagaaaagaaaatgaaagagggagaaactgagatatataccatcagctattctcttgtgattttacttgtgtggcatgatcaaaatcctcaatgtgccaaatgtatgtatactactgacactaatgatgttattctgtttatcttactactacttatcattatgcttccattttgcaaattgtgttgtacctgtgcggctgtgccctgcacttgttttgcttcatgtttcctcagtttcatgtactttctccatccaacaaagaatgtctcaacaagaacagagggagtacatctctatctcattgcattggggggcgtgttacctataaatcaccttcagtgctgaaggttgctggtgctatacaggacatttggatctagttcttctaagattccaaacggaaccactgtttgcagagtgttattcttcatgtccagaacaagtacccatgtcttgcggtgccataatttgggcctggctaccaggtaaactatatatcaccatccaggctcggataaggatcggtgacaacaaggctccacaaggcttggtttattgttgcggtctcactgccctgtgatggcagcactagcaatcctttgggctgcgaaatcaagtggctttccactgtgatctcagaagctttgacccttaaggggtcccgcttgccaatcctcgtaagaattgctcatcttggtgttactccacgttctgacggaccaaccggacaccagcaaggttgataacccagtttcttcgtctatgacactgagatcaatggcgtcgaggttcagctcgacgaacttgagacagccgcccttgacaaacgctatgccgcgggagttcatcccgcggccaaaatggctgccggcgatgatttggttcatgggcaggggcatcgggatgctgcggagcgtggccggctcgcgcagcacgtcgcagaagacgatgcctcgccagagatcgacccagcccatggtgccatgctcgccgccgatgatgaccacgttggtcgtccgatggccggcgaggttggattcgtccgatggtagctcgatagggaactttttctcctcccctaccggcaacttcgcggagacactccaggcccaggcctcggagcggaaggtgaggagccggaacttgccgttggagggaatcagcgcggcgatggtgtagtcgtcgtctccacggggaaggatgccgacctcgcagtcctggaaataagtgcgggggcgaccgatgcgggggagccgcctgagcatgggccgattggggtcggcacggtagatgaagtagtcgcattggaccagcgagaggggacggttgacccagagaaggccgccggtctcgatggcgacgcggaataggatgagatcgccggcgacggcgatgacgcggggtgcctcgatgccctcagcggtggcgccggggctgtggacgcagagcttggaggggtgaggcgggggggcggggaagaaggaggccttgatgctccggcccgctctcgtggatgcagtggcggtcgcctcgttgaagtcgtcgccgaagtagccttgagaaccaaagaggacccaggcggggcggccggcggtggccatggtttcgagatctaggtttcctgtgggcggcgctggggttcggaggacggcccccggggtcgggttaggtttttgttcgagaaactcactctatgtt

SEQ ID NO: 1500 - DNA, 1915 bp, Triticum aestivum
cgccgcctccctccgccccggcggccaccaagccgcgcccgcgccaccccctggggctggactccctcgcctccaccagcaggcccctcttcgccgcggcccgccggtccccggtcgccacgctcgcctgcgccatcaccctcctcgcgctcatcatgtacggcgaggacgcgcgcaccatcgcggagctctccatcgacgactacctctacccggacgccgacatctacaacgtctccggccttccccccatcaagctgcccccgcccacctgcgacctcgcccacggccgctgggtcttcgacaacgaatccctccccctctaccgggagaaagagtgcaacttcctcaccaagcagctcacctgcctcgccaacggccgcaacgacgatttatggcagtactggcaatggcagcccaacaactgctccctccccacgttcgacgccaggaggttcatggagaggatgagggggaagcggctcatgttcgtgggggactcgctcaacaggaaccagttttactcgctggtgtgcatggtgcagtccatcttgagcaaggggaggaagaaggtggtcaaacggggatcaaacaccatcttccacgccaaggagtaccgcgccacgctcgagttctactgggcgccattccttgtcgagtccaactctgacgaccccaatatccacagcatcgagcaccggatcatacggcccgagaggatcgagggacacgcccagtattggaggggtgtggactacctcatcttcgacacctacatctggtggatgaacaccgccgacatcaaagttcggaggccagattcaaggtcttggtcggagcacgacgaggtgccgaggatcgaggcatatggccgggtgctcaaaacgtggtcggactggctgaatgagaatatcgatccggcgcggacatccgtcttcttcatgacaatttctcctattcacatcagcccagataaatggggaaacccccacgggatcaaatgcgcgaaggagacgctcccggtgctcaactacacggagcccctggacctcaaccacgacatgcggttgtacgacatggtggcgagcacggccaggtccatgaagaaagtgccggtcacgctcatcgacatcaccaggatgtcggactaccggaaggacgcccacacgtccgtctactccgtccggcggggctacctgctgaccccgaagcagaagaacgaccctgagaagtttgccgactgcatccactggtgccttcccggcgtgcccgacgtctggaacacggtgctctacacgaggatcttctcgaaatcgcccccttcttcgccgccggctctcgccctcccgcctccccagtgagagagacgcagagctcctccataggaagtgtcttcttgttcaatcttttctttctttggtggtagtccgggtaaaggctagtagaggagaagaatgtggtgggctgtttactgatggcatgtaaaatcgttcaattgaactgtaaattagttttgacctaaccagttgagcaggcttcgttatactagtaaacagctgcacttgtgttgaatccatataagaggcgtcaaacaacaaactgtgtcgtatacaaagaaagactgtaaccgctgatgcaaggggtgtccattttttgctgcttctctctgcttctatataccggagtagaatgtctgaatgtgtaacttccgtgaagaattcgtgtttgcaaagcgaatgtagtgtggcatttgttacaaaactgtttattgtaagcagaactcagatattgtctgtcgtttctcttgtgatttaattgctggcggcatgctcagttctgttttcatcagtggcgacaacaaaatgatgatattacgttttatttttacttattatatttgggtgtggctaggtct

SEQ ID NO: 1501 - DNA, 2019 bp, Secale cereale
tcgtcggacctgggcagggcagggcagggcagggcacctcccgtttctcactgcaccatcaccacccccagatcccctcttcctcgctgccgacacccacccacccaccaacgaaccagccacagccacagcccccccgcgcgtccccggcggcggtcacatcacaagctgccgccatgccgcccacatccaactcgccctccaccgccccggcggccaccaagtcgcgtccgcgccaccccctggggctggactccctcgcctccaccagccggtccctcttcgccgcgggccggcgctccccggtcaccacgctcgtctgcgccatcgccatcctcgcgctcatcatgtacggcgaggacgcgcgcaccatcgccgagctctccatcgacgactacctctacccggacgccgacatctacaacgtctccggccttccccccatcgcgctgcccccgcccacctgcgacctcgcccacggccgctgggtcttcgacaacgaatccctccccctctaccgggagaaagagtgcagcttcctcaccaagcagctcacctgcctcgccaacggccgcaacgacgatttgtggcagtactggcaatggcagcccaacaactgctccctccccacgttcgacgccaggaggttcatggagaggatgagggggaagcggctcatgttcgtgggggactcgctcaacaggaaccagttttactcgctggtgtgcatggtgcagtccgtcttgagcaaggggaggaagaaggtggtcaaacggggatcgctcaccatcttccacgccaaggagtaccgcgccacgctcgagttctactgggcgccattccttgtcgaatccaactctgacgatcccaacatccacagcatcgagcaccggatcatacggcccgagaggatcgagggacacgcccagtattggaggggtgtggactacctcatcttcgacacctacatctggtggatgaacaccgccgacatcaaagttcggaggccagattcaaggtattggtcggagcacgacgaggtgccgaggatcgaggcgtatagccgggtgctcaaaacgtggtcggactggctgaatgagaatgtcgatccggcgcggacatccgtgttcttcatgacaatttctcctattcacatcagcccagataaatgggggaacccccacgggatcaaatgcgcgaaggagacgctcccggtgctcaactacacggagcccctggacctcaaccatgacatgcggttgtacgacatggtagcaagcacggccaggtccatgaagaaagtgccggtcacgctcatcgacatcacgaggatgtcggattaccggaaggacgcccacacgtccgtctactccgtccggcggggctatctgctgaccccgaagcagaagaacgaccctgagaacttcgccgactgcatccactggtgccttcccggcgtgcccgacgtctggaacacggtgctctacacaaggatcttctcgaaatcgcctccttcttcgccgccggctctcgccctcccgcctccccagtgagagagacgcagagctcctccataggaagtgcgttcttgttcaatcttttctttctttggtggtagtccgggtaaaggttagtagaggagaagaattgggtgggctgtttactaattgcatgtaaaaccgttcaattgaactgtacattagttttgacctaaccagttgagcaggcttcgttatactagtaaacagctgcacttgtgttgaatccataagaggcgtcaaacaacaaactgtgtcgtatacaaagaaagattgtaactggtgatgcaaggggtgtccattttttgctgtttctatataccggagtagaatgtctgaatgtgtagcttccgtgaagaattcgtgtttgcaaagcgaatgtagtgtggcattcgctacagaactgagatattgtctggcgtttctcttgtgattttactgctggcggcacgctcagtgagtgatacacatgatacacaaa

SEQ ID NO: 1502 - DNA, 2092 bp, Panicum virgatum
tgcggtgaggtgtgagtgagaaattgagaatgatggccaccaaacagaccagagtagcagaccaccaccctaccataccacacgccggaccccgacgccgacacttcgccgcctgccggcccaactgctcaaggaaggaagaaccgaagaagcctgtacaaaatctgaggccgcgttccccgccgcgggatcggcggccttgcccttcttgacttgggtggcatccccttcaaattgaaggcttcaattccccagcagctccagctccagctccttcgccatggccaagccaccgcctcccacctccccctccgatcccccgcttcccaccgccgccgcccccaagccccgcactttcggcctcttctcctcctccgcgcgctccctcctcgccgcggcgcgccgctcccccgtcaccacgctcgtcgtcgccttcttcctcctcgccctcttcatgtacggcgaggacgtccgcaccatcgccgagctctccatcgacgactacctctaccccgacgccgacctctacaatgtctcggggctgcccccgctgctgctccacccgcccacctgcgacctctccgacggccgctggctcttcgacaacgtctcgctcccggcctacagggagaaggactgcaccttcctcaccaagcaggtcacctgcctcgccaacggcagacccgacgatacatggcagtactggaaatggcagcccaaccagtgctccctcccaacgttcgacgctcggagattcatggagaccatgcgcgggaagcggctcatgttcgtgggggactcgctcaaccgcaaccagtgggagtcgctcgtgtgcctggtgcagcccatcctgtccaagggcaggaagaagatcgtcaagcgaggctccctcaccatcttccacgccaaggagtaccgcgccacgctcgagttctactgggcgcccttcctcgtcgagtccaactccgacaaccccaagatccacagcatcgagcaccggatcatcaggcccgaccggatcgagggacacgccaagtactggaaggacgtcgactacctcatcttcaacacctacatctggtggatgaacactgctgacatgaaagtcaggagacctgattcaaggtattggtcacagcacgacgaggttcccaggattgaggcatatggacgagtgttcaagacgtggtctgaatggttgaataacaacattgaccctgcccacacctccgtcttcttcatgacaatttcccctcttcacatcagcccaaataactgggggaaccctgaggggatcagatgcgtgaaggagacgcttccgtatcagaactacagccaacccctggacctgtaccatgacatgcggatgtttgatctggtagtaaaggtggctagctccatggagaaggttccagtcacagtgattaacatcacgaggatgtcagattatcggaaggacgcccacacatcgttgtattctatccggcaaggtaagctgctgacaccaaagcagaaggcagacccggagaagttcgcagactgcatccattggtgccttcccggcgtgccggatgtgtggaaccagatactttacacgaggatcctttcgaaatcatcttggcactcaaattctgcggctcctcccttgcagtcactgcctcctcctgcccaatgagaatcttagcaggggcttgtggtttttaccatggcataggaaaaatgtatgattattcattcttttgtctttctttttgggtagattgagtaaaggttagagtaaaaaggaaatggatgggctgatcactgacggcatggcatggcatggcatgtaaagtgtaaatgagttttgagttagccaattgagcgaacagcagcgatcatgtagacagttgccttatgaatatatatatatatactataccagtttccagacagaaattagccatatgtaacctgtttcctgttggatgacacacaaggtgcatatgtatacgcagtgcttctaatgcttgagaagcatgtatacaggagaatcatgtaaaacaatgtttgagtttttttttctgaaggagtatacatgagcttgttttgg

SEQ ID NO: 1503 - DNA, 2795 bp, Triticum aestivum
gaggagaggagagaccgcccactctccgctagtagtattaacccctaatccagctagtaataatcccatggcgtcctccctcacgccgcgcagcccgtaccagaagaaggagaacctggggaacgtgcggcgcgggatggggtacagcgcgccgccgcgccgcaacgtgctctcggccatcaacaacggcggcggcgccaacgccgagccggcgccctccgaggccggctccgaggcgcccgccttcgagttcagcgggagggaggatgtggaccgcctgctcaacgagaagatgaaggtcaaatccaagaacgactacaaggggaggacggagcagatgagcgagtacatcaagcggctgagggcctgcatccggtggctggtggagctggaagacggctacttggccgagcaggagaagcttcgggggcagatagattcagacaatgctcgtcacgcagagtttgaggctcagctcagtggtgcgcttgaagagttgaaagcggcaaacttggaaatgacaacacggtgtgactcactggaggagagcttgaacaaggagaaggccgccaggctgcttgctgtggagtcctatgagaaggaaagagaagaaagggaatcagccgaggcttcacgggatgtactgacggtcgatcttgaaagggtcactcatgaggctaaacggtttagtgagcagctaaaaatggtccaagacaccaacaaaagacttcaggaatacaactccagcttgcagcaatacaacagtaatcttcaagctgatacatcaaagaatggagaaatcatctcgaagctgcaaagggagaagagtgcaatgatggaagccatgactaatctgaaagatcttaacaactcaatgaagaaccagttggattcttccatgtcctcccagaaagaagcaattagagtgaaagaagaacttagaaaagaagtagagtgcctcagagctgatttacagcaagttagagaagaccgtgatcagtctgttgctcaactgaataccttgaccgctgaactggccacttacagcgaacaggctaaaaagtcttcgaaagactctgaacttttgagaataaaggcggcagcctttgaggaaacatgcagttcacagcaagagcaaattgaaacattgcaaaagcagcttgcagttgcaactgagaagctgaagcatgctgatgtgactgcaattgaggcgatgacaggatatgaaacacagaaagagacaatcaaagatctggaagagcgtttggcatatgcggagtttcaaatcattgaagctgacaagctacgaaagaagctgcataataccatcttggaactaaaaggcaatatcagagtattttgtagggttcgaccctttctgtcggacgctaattctaatggtcaggaagaagccattatttcttatccatcatctgtggaaaatgctgggcgtggtattgatttaatgaatcaaggtcagaaatgttctttttcatatgacaaggttttcgatcacagcgcttcgcaagatgacgtgtttgtggaaatgtcacagctagtccaaagtgcgcttgacggatacaaggtatgcatatttgcatatggtcaaacagggtcaggtaaaacttatacaatgatgggtaagccaggccgtgatcagaaaggtatcatacctcgatctttggagcaaattttcaagaccagtcagtctctagaatctcaaggatggaagtattgtatgcaggcatcaatgctggaaatatacaatgagacaattcgtgacttgttagcaccaggccgctccagtagtgatatgcctggcggtaaacaatacacaataaagcatgattcccagggaaacacaacagtctccgatcttacaactactaatgtgttcagcactgctgatgtgacgtctcttctagagaaagcatctcatagcaggtctgtaggtaagacccaaatgaatgagcaatcttcccggagccactttgtcttcacactgaagatatttggatcaaatgagagcacaggccaacaagtacaaggtgtgctgaacttgattgatttggccgggagtgagcggcttactaaaagtggtgcaacaggcgatcgcttgaaggaaactcaggccatcaacaagagcttgtcagctctcagcgatgttatctttgcgattgccaaaaatgatgaccatgtgcccttcaggaactcgaagcttacatacctcttgcagccttgccttggcggggactcgaagacgctcatgttcgtcaacgtctcgcccgaggcatcctcggccggggagacgctatgctccctgaggttcgcgtcgagggtgaacgcttgcgagatcggggtggcgagacggcagacacagtccaagtcctcctcggataccagtaacaggctgagctacgggtgaactctgtcatgtctgttaacggccatcgtggcctgatattgatgtgatactgctacataacgagccaagctagcagccctgtgggccgacttggccacgagcgtgctggcgacgcggcgcggctggcctctggtgttagcaacatgtacagtcagtagggagagtggcagagcatgcgctgtgtggcattgagagcagcagagaacctctgcttccagccatgatgattcttcttctgtttgtagtagctgattgatttgagatttattgagtaatgttaactggcgctatattctttctgtgtgacttttagaatgaatccatgtgctgataatatgattgtgcgtccatcagtgtgtctgcgactctg

SEQ ID NO: 1504 - DNA, 2878 bp, Secale cereale
cgtcccctaccccctgccccttccatccccgaaagacccctttccccaccccacctccactccatcactcgctcggggaagtagaggagacggcgcccactccccgctagcagtattaacccctaatccagctagtaataatcccctcccatggcgtcctccctcacgccgcgcagcccataccagaagaaggagaacctggggaacgtgcggcgcgggatggggtacagcgcgccgccgcgccgcaacgtgctctcggcaatcaacaacggcggcggcgccaacgccgagccggcgccctcggaggccggctccgaggcgcccgccttcgagttcagcgggagggaggatgtggaccgcctgctcagcgagaagatgaagggcaagtccaaaaacgactacaagggccggacggagcagatgagcgagtacatcaggaggctcagggcctgcatccgctggctggtggagctggaagacggatacttggccgagcaggagaagctccgggggcagatagattcagagaatgcccgtcatgcggagtttgaggctcaactcagtggcgcgcttgaacatttaaaagctgcaaacttagaaatgactacacggtgtgactcactggaggagagcttgaacaaggagaaggccgacaggctgcttgctgtggagtcctatgagaaggaaagagaagaaagggaatcagccgaggcttcacgggatgtactcacggtcgatcttgaaagggtcactcatgaggcaaaacgctttagtgagcagctaaaaatggtccaagacaccaacaaaagacttcaggaatacaactccagcttgcagcaatacaacagtaatcttcaagctgatacatcaaagaatggagaaatcatctcgaagctgcaaagggagaagagtgcaatgatggaagccatgactaatctgaaagatcttaacaactcaatgaagaaccagttggattcatccatgtcctcccagaaagaggcaattagagtgaaggaggagctacgaaaagaagtggagtgcctcagagctgatttacaacaagttagagaagaccgtgaccagtctgttgctcaactgaataccttgaccgctgaactggccacttacagcgaacaagctaagaagtcttcaaaggactctgaacttttgagaataaaagcggcagcctttgaggaaacatgcagttcacagcaagaacaaattgaaacattgcagaagcagcttgcagttgcaaccgagaagctcaagcatgctgatgtgactgcaattgaggcgatgacaggatatgaaacacaaaaagagacaattaaagatctggaagagcgtttggcatatgcagagtttcaaatcattgaagctgacaagctacgaaagaagctgcataacaccatcttggaactaaaaggcaatatcagagtattttgtagggttcgaccctttctgtcggacgctgattctaatggccaggaagaaaccattatttcttatccatcatccgtggaaaatgctgggcgtggtattgatttaatgaatcaaggtcagaaatgttctttttcatatgacaaggttttcgatcacagcgcttcacaagatgatgtgtttgtggaaatgtcacagttagttcaaagtgcgcttgacggatacaaggtatgcatatttgcatatggtcaaacagggtcaggtaaaacttatacaatgatgggtaagccaggccgtgatcagaaaggtatcatacctcgatctttggagcaaattttcaagaccagtcagtctctagaatctcaaggatggaaatactgtatgcaggcatcaatgttggaaatatacaacgagacaattcgtgacttgttagcaccaggccgctccagcagtgagatgcctggcggtaaacaatacacaataaagcatgattcccagggaaacacaacagtctccgatcttacaactactaatgtgttcagcactggtgatgtgacgtctcttctagagaaagcatcgcatagcaggtctgtaggtaagacccaaatgaatgagcaatcttccaggagccatttcgtcttcacactaaagatatttggatcaaatgagagcacgggccaacaagtacagggtgtgctgaacttgattgatttggccgggagtgagcggcttactaaaagtggcgcaacaggcgatcgcttgaaggaaactcaggccatcaacaagagcctgtcagctctcagcgatgttatctttgcgattgcgaagaacgatgaccatgtgcccttcaggaactcgaagctcacgtacctcttgcagccttgccttggcggggactcgaagacgctcatgttcgtcaacgtctcgccggaggcgtcctcgtccggggagacgctctgctccctgaggttcgcgtcgagggtgaacgcgtgcgagatcggggtggcgagacggcagacgcagtccaagtcctcctcggatagcagtaacaggctgagctacgggtgaagaaccataaatgtcttgtctgttaacggccatcgtggcctgatgtgataaagggctaagctagcaagcctgtgggccgacttggccacgagcgtgtgtgctggcgacgcggcgcggctggcctctggtattagtaacatgtacagtcagtagggagagtggcagagcatgcgctgtgacttggcattgagagcaggagagaacctctgcttcctgccaccatgattcgtcttgtgtttgtagtagctgattgatttgagatttgttgaagtaatgttaactggcgctatattctttctgtgtgacttcgtgctgcagcgtatcttttgacccgctgatgcgtcaatatgaatccatggtgctagaaaat

SEQ ID NO: 1505 - DNA, 2826 bp, Secale cereale
agagaggagaggccgcccactccccgctagcagtattaacccctaatccagctagtaataatcccctcccatggcgtcctccctcacgccgcgcagcccataccagaagaaggagaacctggggaacgtgcggcgcgggatggggtacagcgcgccgccgcgccgcaacgtgctctcggcaatcaacaacggcggcggcgccaacgccgagccggcgccctcggaggccggctccgaggcgcccgccttcgagttcggcgggagggaggatgtggaccgcctgctcagcgagaagatgaagggcaagtccaaaaacgactacaagggccggacggagcagatgagcgagtacatcaggcggctcagggcctgcatccgctggctggtggagctggaagacggatacttggccgagcaggagaagctccgggggcagatagattcagagaacgcccgtcatgcggagtttgaggctcaactcagtggcgcgcttgaacatttaaaagctgcaaacttagaaatgactacacggtgtgactcactggaggagagcttgaacaaggagaaggccgacaggctgcttgctgtggagtcctatgagaaggaaagagaagaaagggaatcagccgaggcttcacgggatgtactgacggtcgatcttgaaagggtcactcatgaggcaaaacgctttagtgagcagctaaaaatggtccaagacaccaacaaaagacttcaggaatacaactccagcttgcagcaatacaacagtaatcttcaagctgatacatcaaagaatggagaaatcatctcgaagctgcaaagggagaagagtgcaatgatggaagccatgactaatctgaaagatcttaacaattcaatgaaaaaccagttggattcatccatgtcctcccagaaagaggcaattagagtgaaagaggaactacgaaaagaagtggagtgcctcagagctgatttacaacaagttagagaagaccgtgaccagtctgttgctcaactgaataccttgaccgctgaactggccacttacagcgaacaagctaagaagtcttcaaaagactctgaacttttgagaataaaagcggcagcctttgaggaaacatgcagttcacagcaagaacaaattgaaacattgcagaagcagcttgcagttgcaaccgagaagctcaagcatgctgatgtgactgcaattgaggcgatgacaggatatgaaacacagaaagagacaattaaagatctggaagagcgtttggcatatgcagagtttcaaatcattgaagctgacaagctacgaaagaagctgcataacaccatcttggaactaaaaggcaatatcagagtattttgtagggttcgaccctttctgtcggacgctgattctaatggccaggaagaaaccattatttcttatccatcatccgtggaaaatgctgggcgtggtattgatttaatgaatcaaggtcagaaatgttctttttcatatgacaaggttttcgatcacagcgcttcgcaagatgatgtgtttgtggaaatgtcacagttagttcaaagtgcgcttgacggatacaaggtatgcatatttgcatatggtcaaacagggtcaggtaaaacttatacaatgatgggtaagccaggccgtgatcagaaaggtatcatacctcgatctttggagcaaattttcaagaccagtcagtctctagaatctcaaggatggaaatactgtatgcaggcatcaatgttggaaatatacaacgagacaattcgtgacttgttagcaccaggccgctccagcagtgagatgcctggcggtaaacaatacacaataaagcatgattcccagggaaacacaacagtctccgatcttacaactactaatgtgttcagcactggtgatgtgacgtctcttctagagaaagcatcgcatagcaggtctgtaggtaagacccaaatgaatgagcaatcttcccggagccatttcgtcttcacactaaagatatttggatcaaatgagagcacgggccaacaagtacagggtgtgctgaacttgattgatttggccgggagtgagcggcttactaaaagtggcgcaacaggcgatcgcttgaaggaaactcaggccatcaacaagagcctgtcagctctcagcgatgttatctttgcgattgcgaagaacgatgaccatgtgcccttcaggaactcgaagctcacatacctcttgcagccttgccttggcggggactcgaagacgctcatgttcgtcaacgtgtcgccggaggcgtcctcgtccggggagacgctatgctccctgaggttcgcgtcgagggtgaacgcgtgcgagatcggggtggcgagacggcagacgcagtccaagtcctcctcggataacagtaacaggctgagctacgggtgaagaactatatatgtcttgtctgttaacggccatcgtgtgggtctgatgtgataaagagctgagccagcaagcctgtgggccgacttggccacgagcgtgtgtgctggcgacgcggcgcggctggcctctggtattagtaacatgtacagtcagtagggagagtggcagagcatgcgctgtgttggcactgagagcaggagagaacagaacctctgcttcctgccaccatgattcgtcttgtgtttgtagtagctgattgatttgagatttattgagtaatgtgttaactggcgctatattctttctgtgtgacctcgtgctgcagcatatcttttgacccgctgatgcatcaataatgaatccatggtgctgataatatgattgtgcgatccaaaaaa

SEQ ID NO: 1506 - DNA, 2551 bp, Secale cereale
gctccgaggcgcccgccttcgagttcggcgggagggaggatgtggaccgcctgctcagcgagaagatgaagggcaagtccaaaaacgactacaagggccggacggagcagatgagcgagtacatcaggcggctcagggcctgcatccgctggctggtggagctggaagacggatacttggccgagcaggagaagctccgggggcagatagattcagacaatgcccgtcatgcggagtttgaggctcaactcagtggcgcgcttgaacatttaaaagctgcaaacttagaaatgactacacggtgtgactcactggaggagagcttgaacaaggagaaggccgacaggctgcttgctgtggagtcctatgagaaggaaagagaagaaagggaatcagccgaggcttcacgggatgtactcacggtcgatcttgaaagggtcactcatgaggcaaaacgctttagtgagcagctaaaaatggtccaagacaccaacaaaagacttcaggaatacaactccagcttgcagcaatacaacagtaagacttcaagctgatacatcaaagaataggggaaatcatctcgaagctgcaaagggagaagagtgcaatgatggaagccatgactaatctgaaagatcttaacaactcaatgaaaaccagttggattcatccatgtcctcccagaaagaggcaattagagtgaaagaggaactacgaaaagaagtggagtgcctcagagctgatttacaacaagttagagaagaccgtgaccagtctgttgctcaactgaataccttgaccgctgaacttgccacttacagcgaacaagctaagaagtcttcaaaggactctgaacttttgagaataaaaagcggcagcctttgaggaaacatgcagttcacagcaagaacaaattgaaacattgcagaagcagcttgcagttgcaaccgagagctcaagcatgctgatgtgactgcaattgaggcgatgacaggatatgaaacacaaaaagagacattaaagatctggaagagcgtttggcatatgcagagtttcaaatattgaagctgacaagctacgaaagaagctgcacaacaccatcttggaactaaaaggcaatatcagagtattttgtagggttcgaccctttctgtcggacgctgattctaatggccaggaagaaaccattatttcttatccatcatccgtggaaaatgctgggcgtggtattgatttaatgaatcaaggtcagaaatgttctttttcatatgacaaggttttcgatcacagcgcttcgcaagatgatgtgtttgtggaaatgtcacagttagttcaaagtgcgcttgacggatacaaggtatgcatatttgcatatggtcaaacagggtctggtaaaacttatacaatgatgggtaagccaggccgtgatcagaaaggtatcatacctcgatctttggagcaaatttcaagaccagtcagtctctagaatctcaaggatggaaatactgtatgcaggcatcaatgttggaaatatacaacgagacaattcgtgacttgttagcaccaggccgctccagcagtgagatgcctggcggtaaacaatacacaataaagcatgattcccagggaaacacaacagtctccgatcttacaactactaatgtgttcagcactggtgatgtgacgtctcttctagagaaagcatcgcatagcaggtctgtaggtaagacccaaatgaatgagcaatcttccaggagccatttcgtcttcacactaaagatatttggatcaaatgagagcacgggccaacaagtacagggtgtgctgaacttgattgatttggccgggagtgagcggcttactaaaagtggcgcaacaggcgatcgcttgaaggaaactcaggccatcaacaagagcctgtcagctctcagcgatgttatctttgcgattgcgaagaacgatgaccatgtgcccttcaggaactcgaagctcacatacctcttgcagccttgccttggcggggactcgaagacgctcatgttcgtcaacgtgtcgccggaggcgtcctcgtccggggagacgctatgctccctgaggttcgcgtcgagggtgaacgcgtgcgagatcggggtggcgagacggcagacgcagtccaagtcctcctcggatagcagtaacaggctgagctacgggtgaagaactatgtcttgtctgtcaacggccatcgtggcctgatgttgatgtgatactgcctacataacgagctaagctagcaagcctgtgggccgacttggccacgagcgtgctggcgacgcggcgcggctggcctctggtattagtaacatgtacagtcagtagggagagtggcagagcatgcgctgtgacttggcattgagagcaggagagaacctctgcttcctgccaccatgattcgtcttgtgtttgtagtagctgattgatttgagatttgttgaagtaatgttaactggcgctatattctttctgtgtgacttcgtgctgcagcgtatcttttgacccgctgatgcgtcaa

SEQ ID NO: 1507 - DNA, 1904 bp, Secale cereale
aagccaaattccccattcccctccgcttgccccaaaaccgaaaccaaaacccagagcgagcccgcggcggcgagcaccagatggagcccgcggcggcggagatggataccggcgagctggacgccctgctccttgcggcggccgacttcgcctcctacccaggaacgcatggtgaggacacagtgaggcagttcctggaacaattccctctgcctaagctgctaggtgtactgcagagtcaggcagacgtacctgagacggttgaaactgttgcagcgtgcttggacaaagtattttcctccagatatggagcatcgcttctgccaagctatggagaatttattcaagctgggttgctcacaaactcaaatagtatcagacaattggcctgcaaagcggtggtacaccttcttgacaaggctggagatattgccgttgccgtggacacatttgtacagcacaatctgtaccctcttctgatcaactgcttgattgagggagacgaagagatctcagcaattgttatggatgccataaagcgtctagcagaaattcctacagggaccgatatcatatttccaccagatggtcaaggattgcaactcaacaaagtggcagcccagtcatcctcaatggcacggattcgcattctatctttgatagctaagctctttgctgcatcaagttgtactgctactgcaattcgtgactcaaaccttctcagcttatttgaggacgagataaaagatagaaaagatatgcttaaaaccctgagtgcactagaggtcctctatgagcttgcggagcaccctcacagcaatatgttcttgttgaagaccagtttgcttcaacacataactgatgtgatcaacgatccctcagctgattctattgtacggtcaagggcatcattgatcagtgggaggcttctttcttcagctgatgcttttatgactatagaacaatcttgtgttacgaatctgctcttggccatagacaaaatattgaggacggaggaaagtcaaaatactgatgaaattgagagcgcattggagaccttaggtctaattggtacaacaactcaaggtgcatgcttgttgctctctgatccaccaaatattgccagacatgtggtagaaatgtcctttgataggcagggcagaggtaaacagctggctgctttacatgcctttggaagcatatgtggtgttgatagacaagaagaccagataaaactggatgattatcaagcagaagagtgcctgaagcgcttagtctacagtgcagcatcaaacagtccaaaattaactccttcagctcttcttctatcaattctacaacaagatccagacgttcggattgctggttatagagtactgtcaggactggttgtccgagaatggtgcctaagggaagtttgctcaaagccagagataatcggaattgttacggatccaaaaatggagacaacaaaacttggcatggaggcacggtacgcttgctgtgtggcaatcaacaaggccttgtcatcgtcgcaccttcttcatgaaccgagcctttctgagctcattggaaagctgaatgaggcggtcagaaggggtccctatctttctgagaagaggcaacgtgtggaggcacagccggtggtcggtaccatggagaggttttaaggtggcctttcgagctcttcggccgagaaaccgagcaccctctgtgcttgatgcatgtacattagatgcaactgtgtatcttcttacctgaacttgtgtgacgaggatgatgatgatgatatcagaggttcagttctgttgggttttgtgatatacaccggtggatgctggttcatgccattccatcttacaattacagttgccagtggaagttaaaacggatgacatcttcag

SEQ ID NO: 1508 - DNA, 3920 bp, Triticum aestivum
gtggagtgaagccgggatgatgatggacctgggcgccgcgcgcgcgacgccgccgtcggcgcaggaggcggccgaggccgccgtgcgcgcggtcggctgcggctacgacctcgccgacgacctccgcctcttccgcgccaaggaccgcctgctcgacctcggcggcggcggcgagcgggacctgtgcctgccgggcggggccgtggtggccggcgtgcccgcgggggtcgtcgccgacaagggcgagcgcgcgcggttccgctccgacgtgctctccttcacgcagatggcggagcacgtgaaccagtcgctgtcgctcacgggcaagatcccctcgggccccttcaacgccatgttcgactaccgcggctgctggcaccgggacgccgccgccacgcgcagcctctgcttcgacgcccgcctcgtcgagctctacgccgtcgaggccccccgcggcgcgcgcctcgccctccgcgaccacgtcgcccgcgacgtcccgacctcctgggaccccccggcgctcgccgccttcatcgacacgcacggcacccacgtcgtcgtcggcgtcaggatggggggcaaggacgtcgtctgcgtcaagcagctcaggggctccgccctcgagccgcgggacgtgcaggcccgcctcaagaagctcgccgacgccaccttctcccagtcccagcaggaccgacggcagagctccgccggcgccaagggccgcgggtcgtcgtcgcggagacctcccggccccggctccgctgcctggcgcgccttcaggtcgccggtcatccacaacaaggacgatgtcgtcggcatccacgtcaggcgaggcggcgtcgacgacgggcagggacacgacgactggcttaccaccatcgccgcctcgccggacgtcatctccatggccttcgtgcccatcacctcgctgctcaccggcgtccccggtcgcggcttcctcaaccacgccgtcaatctctacctcagatacaagccgccgatagaggagctggagcagttcctggagttccaggtgccgcggcagtgggcgccggagttcggcgagctcccgttggctctcggcccgcagaggaagaagaagaaggacagcctgccgtcgctccagttcacgctcatggggcccaagctccgggtcaacacggccaaggtggactccggggggcggccggtgacgggcatccggctgttcctggagggcaagaagaacagccggctgggcgtgcacctgcagcacctgtcggcgacgccgcgcgcggtccccatcgtcgtcggcgaggcggtcaccaccgccgtcggggacgccgtgaacgagcgcgcctacttcgagcccgtgaggtcgtcgctgctgacgcacgcgtgcacggcgccggtgcagcacgccggcgcgcgcatcgacgactgcgcggccgtggtgaccgcggcctggttcgaggtgcgcgaggcatgcctgacgaaggtgctcttcctacgtctcggcttctccggcgtggcgcggaccaagatacggcggtcggagtgggacggcccgctcgccacgacccgcaagtcgggctcgctgtcggcgatgctcagcgcggcgctgtccggcaccgccgccgtgccgccgcagggggagccgatggaggggaaggtggaggtgaactcggccgtgttccccaagggcccgccggtgccgctgcccgtgcagaagatggccaagtacatcgacacgacggaggtgacgaggggccccgacgacctgccggggtactgggtggtcaccggcgccaagctctgcgtggaaggcggcaaggtggcgctcaaggccaagtactcgctgctcatctcggcgccggaggacgacgaggtttgaatcagttgtgcatatcgtgtacagactacagagtgcgcacacacatcaagaggtggtacagactgtagattagagagtgcttgtcaattcttgtaaatcaggaccagttagctgtgagatgttgaaatttgtcaaaaatagaaaatagaaactacacattttaagcatattgccttgctgaagatggaatggcatgaagcagcatccaccgattttgtatcacaaaacccgacagaactgaagctctgatatcatcatcatcctcgtcacacaagttcaggtaagaacatacacagttgcatctaatgtacatgcataaagcacagagggtgctcgggttctcggccgaagagctcgaaaggccaccttaaaacctctccatggtaccgaccaccggctgtgcctccacacgcggcctcttctcggaaagatagggaccccttctgaccgcctcattcagctttccaatgagttcagaaaggctcggttcatgaagaaggtgcgacgatgacaaggccttgttgattgccacacagcaagcgtaccgtgcctccatgccaagttttgttgtctccatttttggatccgtaacaattccgattatctctggctttgagcaaacttcccttaggcaccattctcggacaaccagtcctgacagtactctataaccagcaatccgaacgtctggatcttgttgtagaattgatagaagaagagctgaaggagttaattttggactgtttgatgctgcactgtagactaagcgcttcaggcactcttctgcttgatgatcatccagtttcatctggtcttcttgtcgatcaacaccacatatgcttccaaaggcatgtaaagcggccagctgtttacctctgccctgcctatcaaaggacatttctaccacatgtctggcaatatttggtggatcagagagcaacaagcatgctccttgagttgttgtaccaattagtcctaaggtctccaacgcgctctcaatttcatcagtattttgactttcctccgtcctcaatattttgtctatggccaagagcagattcgtcacacaagatttttctatagtcataaaagcatcagctgaagaaagaagcctcccactgatcaatgatgcccttgaccgtacaatagaatcagctgagggatcgttgatcacatcagttatgtgttgaagcaaactggtctttaacaagaacatattgctgtgagggtgctccgcaagctcatagaggacctctagtgcactcagggttttaagcatatcttttctatcttttatctcgtcctcaaataagctgagaaggtttgagtcacgaattgcagtagcagtacaacttgatgcaccaaagagcttagctatcaaagatagaatgcgaatccgtgccattgaggatgactgggctgccactttgttgagttgcaatccttgaccatctggtggaaatatgatatcggtccctgtaggaatttctgctagacgctttatggcatccaaaacaattgctgagatctcttcgtctccctcaaccaagcagttgatcagaagagggtacagattgtgctgtacaaatgtgtccacggcaacagcaatatctccagccttgtcaagaagatgtaccaccgctttgcaggccaattgtttgatactatttgagtttgtgagcaacccagcttgaataaattcaccatagcttggtagaagcgatgctccatatctagatgaaaatactttgtccaagcacgctgcaacagtttcaaccgtctcaggtaagtctgcctggctctgcaatacacctagcagcttaggcagagggaattgttccaggaactgcctcactgtgtcctcaccatgcgttcctgggtaggaggcgaagtcggccgccgcacggagcagggcgtccagctcgcctgtatccatctccgccgcgggatccatctggtggtggtgctgctgctgctgcttctcgccgccgcggtctcgctccgggttttggtttcggttgtgggggcaagaggggcagagggaggg

SEQ ID NO: 1509 - DNA, 2613 bp, Triticum aestivum
gaggtcggcagcgccggggccccatctgccccgcaacaaggcggggcacgcggcacgcgcacggggcaggcaccccgggcacggcacacatcacttctcttctccagtccagcgctggtacggcggcgttcaacttcgttgccaagccaaatcccccaaccaaaacccagagcgagcccgcgggcggcgagaagcagcagcagcaccaccgccaccagatggatcccgcggcggagatggatgccggcgagctggacgccctgctccgcgcggcggccgacttcgcctcctacccaggaacgcatggtgaggacacagtgaggcagttcctggaacagttccctctgcctaagctgctaggtgtattgcagagccaggcagacgtacctgagacggttgaaactgttgcagcgtgcttggacaaagtattttcgtccagatatggcgcttcacttctgccgagctatggtgaatttatccaagctgggttgctcacaaactcaaatagtatcagacaattggcctgcaaagcggtggtacatcttcttgacaaggctggagatattgctgttgctgtggacacatttgtacagcacaatctgtaccctcttctgatcaactgcttgattgagggagacgaagagatctcagcaattgttttggatgccataaagcgtctagcagaaattcctacagggactgatatcatatttccaccagatggtcaaggattgcaactcaacaaagtggcagcccagtcatcctcaatggcacggattcgcattctatctttgatagctaagctctttgctgcatcaagttgtactgctactgcaattcgtgactcaaaccttctcagcttatttgaggatgagataaaagatagaaaagatatgctcaagaccctgagtgcactagaggtcctctatgagcttgcggagcaccctcacagcaatatgttcttgttaaagaccagtttgcttcaacacataactgatgtgataaacgatccctcagctgattctattgtacggtcaagggcatcattgatcagtgggaggcttctttcttcagctgatgcttttatgactatagaaaaatcttgtgttacaaatctgctcttggccatagacaaaatattgaggacggaggaaggtcaaaatactgatgaaattgagagcgcattggagaccttaggactaattggtacaacaactcaaggagcatgcttgttgctctctgatccaccaaatattgccagacatgtggtagaaatgtcctttgataggcagggcagaggtaaacatctggccgctttacatgccttgggaagcatatgtggtgttgatcgacaagaagaccagatgaaactggatgatcctcaagcagaagagttcctgaagcgcttagtctacagtgcagcatcaaacagtccaaaattaactccttcggctcttcttctatcaattctacaacaagatccagacgttcggattgctggttatagagtactgtcaggactggttgtccgagaatggtgcctaagggaagtttgctcaaagccagagataatcggaattgttacggatccgaaaatggagacaacaaaacttggcatggaggcacggtacgcttgctgtgtggcaatcaacaaggccttgtcatcatcgcaccttcttcatgaaccgagcctttctgaactcattggaaagctgaatgaggcggtcagaaggggtccctatctttctgagaagaggcagcgtgtggaggcacagccggtggtcggtaccatggagaggttttaaggtggcctttcgagctcttcggccgagaaaccgagcaccctctgtgcttgatgcatgtacattaggtgcaactgtgtatcttcttacctgaacttgtgtgacgaggatgatgatgatatcagaggttccgttctgttgggttttgtgatgtaaatcggtggatgctggttcatgccattccatcttacaattacagttaccagtaatgttaagcggatgacatcttcagcaagggaatatgcttaaaatgtgtagtttctattttctacttttggcaaatttcaacatctcacagccctaactggtcctgatttacaagaattgacaagcactctctaatctacagtctgtacgacctcttgatgtatgtgcgcactttgtacatgatatgcacaactgattcaaacctcgtcgtcctctggcgccgagatgagcagcgagtacttggccttgagcgccaccttgccgccttccacgcagagcttggcgccagtgaccacccagtaccccggcaggtcgtcggggcccctcgtcacctccgtcgtgtcgatgtacttggccatcttctgcacgggcagcggcaccggcgggcccttggggaacacggccgagttcacctccaccttcccctccatcggctccccctgcggcggcacggcggcggtgccggacagcgccgcactgagcatcgccgacagcgagcccgacttgcgggtcgtggcgagcgggccgtcccactccgaccgccgtatcttggtccgcgccacgccggagaagccgagacgtaggaagagcaccttcttcaggc

SEQ ID NO: 1510 - DNA, 3912 bp, Triticum aestivum
gcgccgcgcgcgcgacgccgccgtcggcgcaggaggcggccgaggccgccgtgcgcgcggtcggctgcggctacgacctcgccgacgacctgcgcctcttccgcgccaaggaccggctgctcgacctcggcggcgggggcggcaagcgggacctgtgcctgccgggcggggccgtggtggccggcgtgcccccgggggtcgtcgccgacaagggcgagcgcgcgcggttccgctccgacgtgctctccttcgcgcagatggcggagcacgtgaaccagtcgctgtcgctcacgggcaagatcccctcgggccccttcaacgccatgttcgactaccgcggctgctggcaccgggacgccgccgccacgcgcagcctctgcttcgacgcccgcctcgtcgagctctacgccgtcgaggccccccgcggcgcgcgcctcgccctccgcggccacgtcgcccgcgacgtcccgacctcctgggaccccccggcgctcgccgccttcatcgacacgcacggcacccacgtcgtcgtcggcgtcaggatggggggcaaggacgtcgtctgcatcaagcagctcaggggctccgccctcgagccgcgggacgtgcaggcccgcctcaagaagctcgccgacgccaccttctcccagtccctggaccgacggcagagctccgccggcgccaagagccgtgggtcgtcgtcgcggagacctcccggccccggctccgctgcctggcgcgccttcaggtcgccggtcatccacaacaaggacgacgtcgtcggcatccatgtcaggcgagggggcgtcgacgacgggcagggccacgacgagtggctcaccaccgtcgccgcctcgccggacgtcatatccatggccttcgtgcccatcacctccctgctcaccggcgtccccggccgcggcttcctcaaccacgccgtcaatctctacctcagatacaagccgccgatagaggagctggagcagttcctggagttccaggtgccgcggcagtgggcgccggagttcggcgagctcccgttggctctcggcccgcagaggaagaagaagaaggacagcctgccgtcgctccagttcacgctcatggggcccaagctccgggtcaacacggccaaggtggactctgggggccggccggtgacgggcatccggctgttcctggagggcaagaagaacagccggctgggcgtgcacctgcagcacctgtcggcgacgccgcgcgcggtcccaatcgtcgtcggcgaggcggtcaccaccgccgtcggggacgccgtgaacgagcgcgcctacttcgagcccgtgaggtcgtcgctgctgacgcacgcgtgcacggcgccggtgcagcacgccggcgcgcgcatcgacgactgcgcggccgtggtgaccgcggcctggctggaggtgcgcgaggcgtgcctgaagaaggtgctcttcctacgtctcggcttctccggcgtggcgcggaccaagatacggcggtcggagtgggacggcccgctcgccacgacccgcaagtcgggctcgctgtcggcgatgctcagcgcggcgctgtccggcaccgccgccgtgccgccgcagggggagccgatggaggggaaggtggaggtgaactcggccgtgttccccaagggcccgccggtgccgctgcccgtgcagaagatggccaagtacatcgacacgacggaggtgacgaggggccccgacgacctgccggggtactgggtggtcaccggcgccaagctctgcgtggaaggcggcaaggtggcgctcaaggccaagtactcgctgctcatctcggcgccagaggacgacgaggtttgaaccagttgtgcatatcgtgtacagactacagagtgcgcacatacatcaaagaggtagtacagactagtacagtagattagagagtgcttgtcaattcttgtaaatcaggaccagttagagctgcgactgcgagcctctgaaaagagatgttgaaatttgtcgaaagtagaaaatagaaactactacacattttaagcatatttccctgccgaagatgtcgtccgttttaacttccactggtaactgtaattgtaagatggaatggcatgaaccagcatccaccgaattatatcagaaaacccaacagaactgaacctctgatctcatcatcctcgtcacacaagttcaggtaagaagatacacagttgcacctaatgtacatgcatcgagcacagagggtgctcggtttctcggacgaagaactcgaaaggccaccttaaaacctctccatggtaccgaccaccggctgtgcctccacacgctgcctcttctcggaaagatagggaccccttctgaccgcctcattcagctttccaatgagttcagaaaggctcggttcatgaagaaggtgcgacgatgacaaggccttgttgattgccacgcagcaagcgtaccgtgcctccatgccaagttttgttgtctccatttttggatctgtaacaattccgattatctctggctttgagcaaacttcccttaggcaccattctcggacaaccagtcctgacagtactctataaccagcaatccgaacgtctggatcttgttgtagaattgatagaagaagagctgaaggagttaattttggactgtttgatgcggcactgtagactaagcgcttcaggcactcttctgcttgatgatcatccagtttcatctggtcctcttgtcgatcaacaccacatatgcttccaaaggcatgtaaagcggccagctgtttacctctgccctgcctatcaaaggacatttctaccacatgtctagcaatttttggtggatcagagagcaacaagcatgctccttgagttgttgtaccaattagtcctaaggtctccaacgcgctctcaatttcatcagtattttgactttcctccgtcctcaatattttgtctatggccaagagcagattcgtaacacaagatttttctatagtcataaaagcatcagctgaagaaagaagcctcccactgatcaatgatgcccttgaccgtacaatagaatcagctgagggatcgttgatcacatcagttatgtgttgaagcaaactggtctttaacaagaacatattgctgtgagggtgctccgcaagctcatagaggacctctaatgcactcagggttttaagcatatcttttctatcttttatctcgtcctcaaataagctgagaaggtttgagtcacgaattgcagtagcagtacaacttgatgcaccaaagagcttagctatcaaagatagaatgcgaatccgtgccattgaggatgactgggctgccactttgttgagttgcaatccttgaccatctggtggaaatatgatatcggtccctgtaggaatttctgctagacgctttatggcatccaaaacaattgctgagatctcttcgtctccctcaatcaagcagttgatcagaagagggtacagattgtgctgtacaaatgtgtccacggcaacagcaatatctccagccttgtcaagaagatgaaccactgctttgcaggccaattgtctgatactatttgagtttgtgagcaacccagcttgaataaattcaccatagcttggcagaagcgatgctccatatctggatgaaaatactttgtccaagcacgctgcaacagtttcaaccgtctcaggtacgtctgcctggctctgcaatacacctagcagcttaggcagagggaattgttccaggaactgcctcactgtgtcctcaccatgcgtccctgggtaggaggcgaagtcggccgccgcacggagcagcgcgtccagctcgccggtatccatctccgccgggggatccatctggtgctgctgctgcttctcgccgccgcgggctcgctctgggttttg

SEQ ID NO: 1511 - DNA, 2650 bp, Avena sativa
ccaaaccaacccaaaccaaaacccagagcgagcgcggcggggagcagcgcagcaggagatggaacccggcgagctggaagccatgctccgagcggcgggcgacttcggctcctacccaggggtgcatggtgatgacgcggtgaggcggttcctggagcaattccctctgcctaagctgctaggtgcattgcagagtcaggcagatgtacctgggacgattgaaactgttgcagcgtgcctggacaaagtgttctcttctagatatggagcatcgcttctgccaagctatggtgaatttattcaagctggattgctcgcgaactcgcagaatatcagacagttagcgtgcaaagctgtttttcatcttcttgacaaggctggagatagtgctgtggctgtggacacatttgtacagcataatctgtaccctcttctggtcaactgtttgattgagggtgacgaagagatctcagcacttgttttggatgccataaagcgtctagcagaaattcctaaaggacttgatatcatatttccaccagatggtcaaggatctctgcaactcgacaaagtggcagctcagtcatcctcaatggcacggattcgcattttatctttgatagctaagctctttgctgtgtcaagttctgctgctactgcaattcgtgactcaaaccttctcagcttatttgaggacgagataaaagatagaaaagatatgcttaaaaccctgagtgcactagaggtcctctatgagcttgcagaacaccctcacagcaatatcttcttgctgaagagcagtttgcttcaacacataactgatgtgatcaatgattcctcaactgattctgttgtacggtcaagggcatcattgattagtgggagacttctttcttcagctgatgcttttatgactctagatcaatcctgtgttacgaacctactattggccatagacaaaatattgagcttggaggaaagtcaaaatactgatgaaattgagagcgcgttggagaccctaggtctcattggtgcaacaactcaaggagcatgtttgttgttcaatgattcatcaaatgttgccaaacatgtggtagaattatccttcacgcgacagggccgaggtaaacagctggctgccttacatgcttttggaagcatatgtggtgttgatcgacaagaaggccagatgaaactggatgatcaagcagaagaacgtctgaagcgcttagtctatactgtagcatcaaacagtccgaaattaactccttcagctcttcttctatcagttctacagcaagatccagatgttcggatagctacttatagagtactatcaggactggttgtccgagaatggtgcctaagggaagtttgctcaaagtcagagataatcagagttgttacggatccaacaatggagacaacaaaacttgggatggaagcacggtatgcttgttgcgtggcaatcaacaaggccttgtcttcgtcacaccttgttaatgaatcaagtctttctgaagtcattgggaagttgaatgaagcagttagaaggggtccttaccttctggaaaggaagcgtgtggaggcacagccggtcgttgataccatgcagaggttttaaattcgccttctagcagccggggcaaccctgagagcaccctgtatgcttgatgcaacgctggctcaggtactaacgtatattacatgagaagcacctgtcgttagcgtggtaactggacttgcgagacgaggataatatcagagattcaggttcttctgttcggtttgaaatataaatgtgatgtaaggtatcatgtttcttgcaaaacatctctccatgatgtaaaaaacccaaactaaaatgatcctatgttttgcaacggttctcagttggctcttgtcctgctcaaaatgtacagtttctgctagtagttttctaaggctctatctgtagctcatatgtatcttctctcagactcgcagctctgtagttcatatgtatttttctatactgtacaacatatccacaacaccgtcaagcaccctagttttctaacgctgatgacctccctcaagcaccgtcgtcctctggcggcacagagatgagcagcgagtacttggccttgagcgagaccttgccgccttccacgcagagcttggcgccggtgaccacccagtaccccggcaggtcgtcggggcccctggtcacctccgtcgtgtcgacgtacttagccatcctctgcacgggcagtggcaccggaggacccttagggaacacggcggagttcacctccagcttcccctccactggctctggtggctgcacgctgccggacagcgccgcgctgaacatggcagacagcgagcccgacttgcgggccacggcgagcggcccgtcccactccgacctgcgtatcttggtccgcgccacgccggagaagccgagccgcaggtagagcaccttcttcaggcacgcctcgtgcacctccagccaggccgcggtcaccacggccgcgcagtcgtcgatgcgcgcgccgttgtgctgcaccggcgccgtgcacgcgtgcgtcagcagcggcgacctgacagcctcgaagtagcgcgctcgttcacggtagcggcgccggcaccggcggacgaccgcgtc

SEQ ID NO: 1512 - DNA, 2535 bp, Brachypodium distachyon
aagtacgcgaccgactcgctttgcccacagcacactgttcgtcgacttcttccccaaacccagccaaaagcccaaaacccgcagcgagcgcggcgggggagcagcaggggagacgatggagcccgcggcagcggagatggacgcgctgctccgagcggcggccgacttcgcctcctacccaggagtgcattgtgatgacacggtgaggcagttcctggagcaattccctctgcctaagctgctaggcgtattgcagagtcaggcagatgtacctggggtggatgaaactcttgcagcatgcttggacaaagtattttcttctagatatggagcatcacttctgccaaactatggtgaatttattcaagctgggctgctcacaaactcaaagattatcaggcagttagcctgcaaagctgtgttaaatcttcttgacaaggctggagacagtgctgtggctttggacacatttgtacagcataatctgtacccacttctgatcaactgtttgattgagggagatgaagaggtctcagcaattgttttggatgtcctaaagcgtctggcagaaatacctaaaggaactgatatcatattcccaccagatgggcaaggatctttgcaactcaacaaagtggcagctcagtcatcctccatggcacggattcgcattctatctttgatagctaagctctttgctgtgtcaagttctactgctactgcaattcgtgactcaaaccttctcagcttatttgaagacgagataaaagataggaaagatatgcttaaaaccctgagtgcactagaggtcctctatgagctcgcggaacaccctaacagcaatatcttcttgctcaaaaacagtttgcttcaacacataactgatgtgatcaacgattccacggctgattctgttatacgctcaagggcatcattgataagtgggagacttctttcttcagctgatgcatttatgactatagatcaatcttgtgttacgaacctgctcttggccatagataaaattttggggattgaagaaagtcaaaatactgatgaaattgagagcgcattggaggccttaggtctaattggtgcaacaactcaaggagcatgctttttgttcaccgattcatcaaacgttgccaaacatgtggtacaactatccttcaatagacagggtagaggtaaacagctggctgctctgcatgcctttggaagcatatgtggtgttgatcggcaagaagaccaaatgaaactgggcgatcaagcagaagagcgtctaaagcgcctagtttatactgtagcatcagacagtccaaagttaaccccttcggctcttcttctatcagtcctacaacaggatccagatattcggatagctggttatagagtaatatccagacttgttgtccgagaatggtgcctgagggaagtttgctcaaagtcagagataattagagttgttacagatccaaaaatggagacaacaaaacttggcatggaagcacgatacaattgttgcgtggcaatcaacaaggccttgtcatcatcgcatcttcttaacgaatcaagcctttctgaactcattggaaagctgaatgatgcagttagaaggggtccttatctatctgataggaagcgcatggaggcacagccagtggtggatactgcagagagattttaagttggcctaatgtcttaacccttcagctagaggaaacggtgatttacgatctgtggaaactgagcacactatacgcttgatgcgtcacttgctgtgtatggtttacctgcatttcttagtgcggcaactaaacttgtatggcgaggatgatatcagagatccagattcaggttctttgttcggtattgtaatataaatggatgaatgattgtatggatgctggttcgtgccaatccatatcagtggaaactaaaaggactccgttcttcagcaatggaatacaaaatgccagatttggaaaaacatggtagatgacttgtactgcatacgtttattgtgtgtaatttctacttttctacagttctatctgttcttttctgagacccacagctctagccgatctattgtgtgtaatttctaatttacaagaatacatcgagtgcacacactctgtacaacatatccacagctgaagagcagacagaggcggcgaatggcgggacagggctcaaacccaaacgtcctcttcctctcgcaccgagatgagcagcgagtacttggccttgagcgcgaccttgccgccttccacgcagagcttggcgccggtgaccacccagtacccgggcaaatcatcagggcccctggtcacctccgtggtatcaacatatttagccatcctctgcacgggcagcggcaccggcgggcccttggggaacacggcagagttcacctccaccttcccctccaccggcagcagctccgtagcggcagcagcagacagccgcgagctgaacaaggccgagatcgaccccgacttctgggccttgacgagcggcccatcccactcg

SEQ ID NO: 1513 - DNA, 1132 bp, Triticum aestivum
cgctctccctcgcccacgtttcccggccggcacaggctaagctaagccaggaccagcgcccagctctggtcacggggagcgtgtgtgccggtgtgcggctgcggcgggccggagtgagcgaggatggggaactgccaggcggcggaggtggcggcggcggtggtgcagcacccgggcgggcgggtggagcggctctactggtccacccccgcggcggaggtgatgcgcgccaacccgggccactacgtcgcgctcgtcacgctccgggtcgccgaggagcgccaggacgccgacggcggcggcgcgcgccgcaccgtgcgcctcacccgcgtcaagctcctcaagcccaaggagacgctgctcctcggccacgtctaccgcctcatcaccgccaacgaggtgaccaaggcggtgcaggcgaggaaggaggagaagctgaggaaggcgcggcagcagctgcagcagctggagtcgtcgacgcggcagagcaagctgcggccggcggcggacggtgacgacgtcgacgacgacgacgacgaggccagcttggatgagagtctcgatcagttggcacgccaggacggaggagatggccaccggagctccggcgcccggcaccggcaatggcggccctcgctgcacagcatcgacgaggccgcgagctgatgcccggccatacatagccctcggtggatcttctgtattttcggcgtccacccggcttcaacagattaatctagctcgtgtttatggtttgctgccacatctgtgttggatcgacaccccgatacgagcgggccgcttctgaagcgactccgtcgatcggagcgtgtcctgtgtctttgtacattttcagggtttctcgtcagggtctgttagtgagagcgagactgcctttttctttctttctcttgatacatttgcacctgattaagatgcatgaaagaagttcacaacacgagtagctaatactacatccatacaagagatgatgccattgccatgtaccaatgcacatgcacctgtgcatcgatctcgttcatgctcatggcctctcatgagtgatggcgtttctctgtgttgttgttgcaattcttggcgccgagttctcaatcataagcacggcgccggc

SEQ ID NO: 1514 - DNA, 1107 bp, Leymus cinereus x Leymus triticoides
ccgttgctgtcgccgctccgattttttttttataaaacagtggtgcaccacacgctcgccacttgctctcgctctccctcgcccacgtttccccggccggcacaggctaagccaggaccaggacccagcttgggtcacggggagcgtgtgtggctgaggcgggccggagtgagtgaggatggggaattgccaggcggtggaggtggcggcggcggtcgtccagcacccgggcgggcgggtggagcggctctactggtccaccccggcggcggaggtgatgcgcgccaacccgggccactacgtcgcgctcgtcacgctccgggtcgccgaggagcggcacgacgccgacggcggcggcgccagccgcaccgtgcgcctcacccgcgtcaagctcctcaagcccaaggagacgctcctcctcggccacgtctaccgcctcatcaccgccaacgaggtgaccaaggcggtgcaggcgaggaaggaggagaagctgaggcaggcgcggcagcagctgcagcagctggagtcgtcgacgaggcggagcaaggcgcggccggcggccgacgctgacgacgacgtcgacgacgacgacgacgaggccagcttggatgagagtctcgatcagttggcgcggcaggacggaggagacggccaccggagctccggcgtccggcaccggcagtggcggccctcgctgcacagcatcgacgaggccgcgagctgatgcccagccatacatagccctcggtggatctgtattttcggcgttcacccggcttcgacagattaatctagctcacatcgcatgggttgccgctacatctgcgttggattgacaccccgagacgagcggaccgcttctgaagcgactccgtcgatcggagtgtgtcctacagggtccgtgtacattttcagcgtttctcgtcaggatctgttagtgagagtgagactgccttttttctttctttctcttgatacatctgcacctgattaagatgcatgaaagaagttcagaacacgagtagctaaaatatatccatacaagagatgatgccatgttcatagcctctgatgagtgatggcattcctctgtattctgttgctgca

SEQ ID NO: 1515 - DNA, 954 bp, Panicum virgatum
ccccgccccgcccccactcgctccgcctcgccaccggcgctctcgcagagcagagtcgccggcgcagccactcccaagtcttcctcacgcgtgggcggggatcgccccagcagctagctagcgctcggcgggggcgggatggggaactgccaggcggcggaggcggcggcggtgctgctccagcacccgggcgggcgggtggagcggctctgctggtccaccagcgcggccgaggtgatgcgcgccaacccgggccactacgtcgcgctcgtcacgctccgcgtcgccgaggagcggcaggacgcccccggcggcgagcgccgcaccgtgcgcctcacacgcgtcaagctgctcaagcccaaggagacactgcttctcggccacgtctaccgcctcatcaccacccaggaggtgacaaaggcggtgcaggcgaggaaggaggagaagcagaggaaagcgcagcagcagctgctggagtcgaggcagagcaaggcgaggggcgccgccgaggacgacgacgaggacgaggcggcgctggacgccagccttgatcagttggcgcgtcaggacaatggcaaccggagctccagcgcgcggcaccgccaatggcggccgtcgctgcaaagcatcgacgaggccaccagctgatatgtcaactcacttactcacacacacccataccacacaaatcgtagggccgtaatcattgaccggtgggcctgtattttcggtgatcacctggcctcagtcagctaaccgtgttggtcaccggctccggcctccagtcctacagtatttctctctcacattgctccagcactagcctccagccaccagccagttaaccgtatttttctctcacaccactccagctccagcctccagctccagcctgccgaacacggtgaaggactgctacatttgcttgtgtactgtgactctatgagctcgaca

SEQ ID NO: 1516 - DNA, 2120 bp, Panicum virgatum
cggtaggtggagtggatccaaattaaaccacaacctgttaatattcacctctatggctctatgcatggaatcggacagggacttcggaatgaaaacgccgaagcgccaccaatcgatgatctttcctgaaaagaaaaataatgaatacagacaagcttttgctgtcagctgatctatgctctcgcgacttgagaagaatcccctctactggccaggccgtgtgcaggtggaaacttgtgcacatcggtaggctgcggcagctgctgccgatcgccatggactctgctgctagtgctactgctagctaggccatggttttccagcgtacgttcacggtggccggcggtggacaagacgtacgcggcagggagagagccgagacccacccaatggccgatcccgccaggccgccctggtccgcacgccgccggcgaaaacgaccaattgatgacggcgcatgcaagggcttcctttccccctccccgctgtcgccgcactgcaaacttcccgacgagtacaaacaactccccgaacacgaccgcggcgatcaccggcaccggtcgctagatcttttcgccgaggagggaggcagcgcgcgcgcgccggggcacgacgccgtggcgagcaccaaccaccagtaaccagttcaccgcttcgcccctcggaaaccgctgttaccgcgccagccgcgggcatccgagcacgcacgcacgtcgcgtatacgtggcgtggtggggttcggtccgggacagacagaaaaaaggagcagtgggtaggctggcccgtcggcatatataccacctcggtcctcggcactcgagcggttgctctcgcctcgaccccgccccactcgctccgcctcgccaccggcgctctcctcccagagcagagtcgccgccgcagccgctcccaagtctccctcacgcgtgcgcggggatcgctgcccccagcaggagaagcagcggcgggatggggaactgccaggcggcggaggcggcggcggtggtgctccagcacccgggcgggcgggtggagcggctctgctggtccaccagcgcggccgaggtgatgcgcgccaacccgggccactacgtcgcgctcgtcacgctccgcgtcgccgaggagcggcaggacgcccccggcggcgagcgccgcaccgtgcgcctcacgcgcgtcaagctgctcaagcccaaggagaccctgctcctcggccacgtctatcgcctcatcacaacccaggaggtgacaaaggcggtgcaggcgaggaaggaggagaagcagaggaaagcgcagcagcagctgctggagacgaggcagggcaaggcgaggggcgccgccgaggacgacgacgaggaccaggcggcgctggacgccagccttgatcagttggcgcgtcaggacaatggcaaccggagctccagcgcgcggcaccggcaatggcggccgtcgctgcaaagcatcgacgaggccaccagctgatatgtcaactcatacaccccgtaccacacaaaatcgtagggccgtaatcattgaccggtagacctgtattttcggtgatcacctggcctcagttagctcatcgcaagggctgctacatttgcttgcatactgtgactctgtgagtggaatctgacaccccaggatgagaggactgcctgcttggactggagtgatatgcagcagcctcgaatcagtgtaaattttcaggtcttcgtcaggcgcttgttagtgagactccttgctttctccatacggtttgcacatggaatcagaacaagttaaagtagcatagatctagagccagagatgtcctgtactgtacttgctacactctcttgctcttcagatgggaatcaaagcgcatagcttttgaggatatctcagcgtttctttaatagtgtttaagaatgtaagttgttgtcgatgccaaataggcaatcataaactcagtgccaatgatgccggcagcagttggtggaatcatcggagccttttgggttggaagctcatcatgcgtgttcgcgtcggcggatgcttagagtagaggctcacgcaccgtttgtttaagccgctgctgatgttgtgcaagaacaggacaaaaggcaaagggatttcgaaac

SEQ ID NO: 1517 - DNA, 919 bp, Panicum virgatum
gcagcggcgggatggggaactgccaggcggcggaggcggcggcggtggtgctccagcacccgggcgggcgggtggagcggctctgctggtccaccaacgcggccgaggtgatgcgcgccaacccgggccactacgtcgcgctcgtcacgctccgcgtcgccgaggagcggcaggacgcccccggcggcgagcgccgcaccgtgcgcctcacgcgcgtcaagctgctcaagcccaaggagaccctgctcctcggccacgtctatcgcctcatcacaacccaggaggtgacaaaggcggtgcaggcgaggaaggaggagaagcagaggaaagcgcagcagcagctgctggagacgaggcagggcaaggcgaggggcgccgccgaggacgacgacgaggaccaggcggcgctggacgccagccttgatcagttggcgcgtcaggacaatggcaaccggagctccagcgcgcggcaccggcaatggcggccgtcgctgcaaagcatcgacgaggccaccagctgatatgtcaactcatacaccccgtaccacacaaaatcgtagggccgtaatcattgaccggtagacctgtattttcggtgatcacctggcctcagttagcacatcgcaagggctgctacatttgcttgcatactgtgactctgtgagtggaatctgacaccccaggatgagaggactgcctgcttggactggagtgatatgcagcagcctcgaatcagtgtaaattttcaggtcttcgtcaggcgcttgttagtgagactccttgctttctccatacggtttgcacatggaatcagaacaagttaaagtagcatagatctagagccagagatgtcctgtactgtacttgctacactctcttgctcttcagatgggaatcaaagcgcatagcttttgaggat

SEQ ID NO: 1518 - DNA, 900 bp, Triticum aestivum
ctcgctcgtcgcccaccccaccctctctcatcctccctccccccggaccgaatttgacgactcctttgacctctcgcgctgtccctccccgccccgccccgcctgcgtcgccgcaccaagctccaggcgccccccggtcggattccatggccaacagcaacctcccccgccggatcatcaaggagacgcagcggctgctcagcgagccagcgccggggatcagcgcctcaccgtcggaggagaacatgcgctacttcaatgtcatggtccttggccccgcgcagtctccctacgaaggtggagtcttcaagcttgaacttttcttacccgaggaatatccgatggctgctcctaaagttaggtttctcacaaaaatataccatcccaacattgacaagcttggtagaatatgcctcgacatcctaaaggacaagtggagtccagctcttcagatacgcactgttcttctgagcattcaggcactgctgagcgccccaaacccagatgatcctctctcagaaaacgtcgcaaaacactggaaatccaatgaagctgaagctgttgagacagcgaaggaatggactcgtatgtatgccagtggcgcatgacaagctaacgctgttatggatgtaataacactgtgtcatagttgggcctaatcgaaaaccatttgcttgataaaaacacacttgaaatgatttgcgatggacgaatgtatccagagcggcatcatttcttgttggtggttgtatttgtggtgcgtgttctggcacgcttcataacttgctgcttatagaacacgctctgtttctcgttcatcctcaattgtttctccaattaaaaatatctgttgtgatccggtatgtaatctctccaaatgaaatagtggctctctgtatt

SEQ ID NO: 1519 - DNA, 1305 bp, Triticum aestivum
ccggggaaaatatctcaggagcgagcgagccaccgtcacctggtgggctgcagcgtggggccgctgccaccaacgagttgttgcgttatatataagcggaggggaacagtagcagcaccaccatcgaccatctccggttcgctcgtcgccccatcccatcctccctccccccgaccgattttgacgactcctttgacctctcgcgctgtccctccccgccccgcctgcgtcgccgcgccgagctccaggcgccccccctccggtcggattccatggccaacagcaacctcccccgccggatcatcaaggagacgcagcggctgctcagcgagccagcgcccgggatcagcgcctcgccgtcggaggagaacatgcgctacttcaatgtcatggtccttggccccgcgcagtcgccctacgaaggtggagtcttcaagcttgaacttttcttacccgaggaatatccgatggctgctcctaaagttaggtttctcacaaaaatataccatcccaacattgacaagcttggtagaatatgcctcgacatcctaaaggacaagtggagtccagctcttcagatacgcactgttcttttgagcattcaggcactgctgagcgccccaaacccagatgatcctctctcagaaaacgtcgcaaaacactggaaatccaatgaagctgaagctgttgagacagcgaaggaatggactcgtatgtatgccagtggcgcatgacaagctaacgctgttatggatgtaataacaccgtgtcatagttgggcctaatcgaaaaccatttgcttgataaaaacacacttgaaatgatttgcgatggacgaatgtatccagagcggcatcatttctagttggtggttgtatttgtggtgcgtgttctggcacgcttcataacttgctgcttatagaacacgctctgtttctcgttcatcttcaattgtttctccaattaaaagtatctgttgtgatccgagtatgtaagctctccaaatgataatagtggctctctgtatttctcccccaaacacctctgatgatttggttttcttttggatttttttagtaatgttcatttttttttcaatctccagttgctttggttacttctttttcctttttcgtgagttgaactgcacatacttatgattttccaaatcaaatggttaatgtatgaatctcgatgagtaagattggttctgagtgatgtaaggtggggagtgctgtcactgttatactttttgcattgttcttatgaagattgtagattaaacccaggtaagacatcatatgc

SEQ ID NO: 1520 - DNA, 1176 bp, Brachypodium distachyon
tagcgtggagtttataaatacgtggtacacagtatcggaccctgacccatttctgttcgttcgtcgcctcctcccccggctcgccctccccgacagatcgacgactcctttgacctctctcgcgctgtcttctcctccgtcgccgcgcgaagctcgaggcggtccctccccccctcccctctaggctctcgctccagccccggccggactccatggccaacagcaacctcccgcgccggatcatcaaggagacgcagcggctgctcagcgaaccagcgccggggattagcgcgtcgccgtcggaggagaacatgcgctacttcaatgtcatggtccttggtccggcgcagtctccttatgaaggtggagttttcaagcttgaacttttcttacctgaggaatatccgatggctgctccaaaagttaggtttctcacaaaaatataccatcccaacattgacaagcttggtaggatatgcctcgatatcctgaaggacaaatggagcccagctcttcagatacgtactgttcttttgagcattcaggcactgctgagcgctccgaatccagatgatccgctctcagaaaacgtggcaaaacactggaaatccaatgaagctgaagctgtcgagacagcgaaggagtggactcgcctgtatgccagtggtgcttgacaagccagcgctgttatgcatgtaataacaccatgtcatatctgggcctaatcgaaaaccatttgcttgataagaacaaactcgaagtgttttgcgatggaagaaagtgtccaaagctataaacagttcgagttcctgattgtatttgaggtgcatgttccagcacctgccactgctgtgccactctagcaaaatctgttgccgcttatgtaacttgctgtgtcctttcttcatcttcaattatttcccagttaactcgcccgcagcattctgagcatgtaagatatccaaacatagtcaccggtagtccgataccctgtctgtgttcttccttgaagaacacttctgatgaattgcatttgcgtcggtacatgttttatgggttcgttggctgaattagtaattgacaatgagacactcctcggttcctgtttctctttccttttgccttggtggagccaaacagagcactctttctgtggtgcaaagtgaaacgataaca

SEQ ID NO: 1521 - DNA, 810 bp, Festuca arundinacea
ggcacgaggccggctctcatctcatcctccctcctctccccgaccgattgacgactcctttgacctctcgccgcgctgtcccccttccctccctcctccaccgtcgccgcacgaagctcgaggcgtccccccttgccccccctcgccccgccggcagctccagctccagcgccatggccaacagcaacctcccgcgccggatcatcaaggagacgcagcggctgctcagcgaaccagcgccggggatcagcgcgtcgccgtcggaggagaacatgcgctacttcaatgtcatggtccttggaccggcgcagtctccttacgaaggtggagtttttaagcttgaacttttcttacctgaggaatatccgatggctgctccaaaagttaggtttctcacaaaaatataccatcccaacattgacaagcttggtagaatatgccttgacatcctcaaggacaaatggagtccagcccttcaaatacgcactgttcttttgagcattcaggcactgctgagcgctccaaacccagatgaccctctctcggaaaacgttgcaaaacactggaaatccaatgaagccgaagctgttgagacagcgaaagagtggactcgcgtgtatgccagtggtgcatgacaagctaacgctggttatggatgtagtaacaccatgtcatagtcgggtctaactgaaaaccatttgcttgataagaacaaacttgaaactgttttgcgatggaagtaagtgtccatagcgataacggttcaagttatttgtggtgcatgttctggcacccgtcactgctgtgcca

SEQ ID NO: 1522 - DNA, 992 bp, Avena sativa
tggcttctcccctcgctcgcctcgggctctctcatccaggtccaggcgcatcctccctcctctcccgacctgttgacgactcctttgacctctcgcgctgtcccctcctccaccgtcgccgcacgaagctcgaggcgtccccctccccccacccccacccctcgatccgccggcaggtccagcgccatggccaacagcaacctcccgcgccggatcatcaaggagacgcaacggctgctcagcgaaccagcgccggggatcagcgcgtcgccgtcggaggagaacatgcgctacttcaatgtcatggtcctcggcccggcgcagtctccttacgaaggtggagtttttaagcttgaacttttcttacccgaggaatatccgatggctgctcccaaagttaggtttctcacaaaaatataccatcccaacattgataagcttggtagaatatgccttgacatcctcaaggacaaatggagtccggctcttcaaatacgcactgttcttttgagcattcaagcactgctgagtgctccaaacccagatgaccctctctcagaaaacgttgcaaagcactggaaatccaatgaagctgaagctgtcgagacagcgaaggagtggactcgtgtgtatgccagcggtgcatgacagtctaagagcgccgttatggatgtaataacaccatgtcgtagtcgggtctaactgaaaacaatttgcttgataagaacaaacttgaaaccgtgttgcgttggaaggaaagtgtccagagcgaataacggttccaaggtaccggttgtatttgtggtgcatgttctggcacccgtcaatactgtgccactctagccaaaatctgttgccgcttgtggaagaacatgctgtgtttccccttgatcttcaattatttattagttccgctgtgatcctatgtaaagctgtccaagtggtggttgctggttctcaatttgtgttcttaaccagagaacactaatggt

SEQ ID NO: 1523 - DNA, 983 bp, Avena sativa
ctctctcatccaggtccaggctcatccctccctcctctcccgaccggttgacgactcctttgacctctcgcgctgtcccctcctccaccgtcgccgcacgaagctcgaggcgtccccgcctccccccaccccaccccctcgacccgccggcagctccagcgccatggccaacagcaacctcccgcgccggatcatcaaggagacgcagaggctgctcagcgaaccagcgccggggatcagcgcgtcgccgtcggaggagaacatgcgctacttcaatgtcatggtcctcggcccggcgcagtctccttacgaaggtggagtttttaagcttgaacttttcttacccgaggaatatccgatggctgctcccaaagttaggtttctcacaaaaatataccatcccaacattgacaagcttggtagaatatgccttgacatcctcaaggacaaatggagtccagctcttcaaatacgcactgttcttttgagcattcaggcactgctgagtgctccaaacccagatgaccctctctcagaaaacgttgcaaagcactggaaatccaatgaagctgaagctgtcgagacagcaaaggagtggactcgcgtgtatgccagtggtgcatgacagtctaagagcgctgttatggatgtaataacaccatgtcgtagtcgggtctaactgaaaacaatttgcttgataagaacgaacttgaaaccttgttgcgttggaattaaagtgtccagagccataacacggttcaagttaccggttgtatttgtggtgcatgttctggcaccctgtctctgctgcgccactctagccaaatctgtttccgcttgtggaagaacatgctgtgtttccccttgatcttcaatcatttatcagttccgctgtgatccaatgtaaagctgtccaaatgatggtagctgattctcagtttctgttcttccccagagaacgctaatgataagtagcatttgct

SEQ ID NO: 1524 - DNA, 831 bp, Secale cereale
cgactcctttgacctctcgcgctgtccctccccccgcccctcctgcgtcgccgcaccaagctccaggcgcccccgccgcccggtcggattccatggccaacagcaacctcccccgccggatcatcaaggagacgcagcggctgctcagcgaaccagcgcccgggatcagcgcctcgccgtcggaggagaacatgcgctatttcaatgtcatggtcctcggccccgcgcagtcgccctacgaaggtggagtcttcaagcttgaacttttcttacccgaggaatatccgatggctgctcctaaagttaggtttctcacaaaaatataccatcccaacattgacaagcttggtagaatatgcctcgacatcctaaaggacaagtggagtccagctcttcagatacgtactgttcttttgagcattcaggcactgctgagcgcgccaaacccagatgatcctctctcagaaaatgtcgcaaaacactggaaaaccaatgaagctgaagctgttgagacagcgaaggaatggactcgtatgtacgccagtggcgcatgacaagctaacgctgttatggatgtaataacaccgtgtcatagttgggcctaatcgaaaaccatttgcttgataaaaacaaacttgaaatgatttgtgatggacgaatgtgtccagagcggcatcatttctagttggtggttgtatttgtggtgcgtgttctggcacgcttcataacttgctgcttatagaacacgctctgtttctcgttcatcttcgattgtttctccaattaaaaatatccgttgtgatccgagtatgtaagctctccaaatgataa

SEQ ID NO: 1525 - DNA, 2988 bp, Brassica napus
aagaaagtgaaaagcttctgccaggaacatctaccgagattctcgaaaagggtcgacctgaataccttcgatgtctctgctgttagctcacaagggattccgaaagttatgcttttgtcaacaaagaaagacactcctgtcatctggcgtgttctaagtggcttgtacaatggacgctttgtcttctataacacagaggttcatgatgcttctgatccgaaggttaagaacctaggggttgacgcatttccagcgatagttggctggttatctaatggggagaagcaagtcttgaagacagggatcactgtgaaaaatctgaaatcagctgtccaggagattggtaaattgctagaagcatttgagaagaagaacaaaaagttctcttctagtagtcagcctggccaagcaaagagcgagtccgtagaaaagatacatcttctctcgagaacaaatctcgattccatttgtggagagaaggttcctgtttgtatcattggtgctttcagatcctcacagggtaaagagaagctgcagtcaatattatctaaggtgtcacagaagtctttgtctagacgacaagcttcaggaacaggctctcaggacacggtttcatattcccttgtagacgcggcaaaacaatcttcgttcttgagctcatttgacaaatcagagttcaaaacatctgacaaggttctaatagcatacaagcctaaacgaggtaagtttgctacgtttaaaggcgacatgacgatggaagaagctgagaaattcgtagcggctgttctgaacggagacatacagttctcaaagacaagacagaaacctcagattaaatgaaaagttttgtttcttaagggaatcctttatcttttctcgagtcctgtggaggttcttgtaattggagaagggaaagtatgtgtattagagacgtgagtgaaatagttttataggaatagaggttacataaacatggaactgaggttaactttgtaattattatgaatgtaaacactctggagcataatgctttagaagagtataatgatggcggataacacgagaactgtccaaatccaaaggcttgtgttcgccttcatctttttcacttctcctctttagcgttttactcattctttcttaatttgcttcggatccaattcaagtcagctatggtggctatggcctctgcttctggttctgctcttcgcttcactgatgctcctagctctcgcgctatcagacgcgatgttggagcttcctgtcttgctcctaggacagtcacgttcggattcgtcgataaatctgttaccaatctcaaccgactaagactatcttgtttgaagactagagcatctaatgctactgctgtggagaatgcaaatgctgctgattctgataaagttccgacaccagtggtcataatcgaccaagattctgaccctgatgcgaccgtcgttgaagttacattcggagaccgtcttggagctctacttgacactatgaatgcgctcaaaaacttgggtttgaatgtggtcaaggctaatgtctaccttgattcttctggcaagcacaacaaatttgccattactaaagcggatagtggaagaaaagtagaagacccagagttgctggaggccatccgtctcactgtcatcaacaacatgcttgagtttcatcctgaatcaagttcacaactggcaatgggagcagcttttggtgttcttccaccaactgaactggttgatgtggacattgcaacacaagtaagcattaaagatgatggaccagaccgcagtttactatacatagaaacagcagataggcctgggctattagttgagctggtgaagatcatttctgatatcagcgttgctgtcgaatctggagaattcgacaccgagggtttgttggctaaggtaaagttccacgtaagctacagaaacaaagcccttatcaagcctctccagcaggttcttgctaatagtctgaggtacttcttgaggcgtccatccactgacgagtcaagtttctgaaatgtaatctaccaaaagataaagaagtcacattccatatgactgccttttaccactttttttttttacgtttgacaaaaataagctgcttccttttagtggcctttgcatacatctgtagtagtaacattctctatttcaatcattttatcaaatttactttcatttacgacctgtaaaatcttatctttaacacgaacaaagctcaagcaaatatgggtaaacgagtcttaaattcttctagttatacatattcggagagtgcaaatctttttcccttgttttaagaaaaaggattcagataaactttgaggtagagttatcaccatatataatgttatttaaatgacaacatcattctcctttttgcactccccccatcaagcgccacttgcatatagacgagtccactccttagctgtctcaacagcttctgcttcattactcttccaatgcttagctatgttctcagacagtggatcatccgggtttggtgcacttagaagagcttgaatactcaagagcacagttcttatttgaagcgcaggactccatttgtctttcagtatgtcaaggcagatccttccaagcttgtcaatgttaggatggtatatcttggtgagaaacctaactttgggagctgccatagggtattcttcaggtaaaaagagctccaacttgaaaactcctccttcataaggagactgggtaggaccaagaaccataacattgaaataacgcatgttttcctctgacggagacgcacttatccccggagcaggttcactaagtagacgttgtgtttccttgatgattcttcgcggtagattgctattcgccattatcgaagtctatcggattcgattggtctcggacaatttagggtttttgagctaaagctcaagacgcacggtgattatcgacaacgcttcgtcgtctctctcgtctcgtg

SEQ ID NO: 1526 - DNA, 697 bp, Brassica juncea
aaaaaccctaaattctccgagagcaatcgaatccgatagacttcgataatggcgaatagcaatctaccgcgaagaatcatcaaggaaacacaacgtctacttagtgaacctgctccggggataagtgcgtctccgtcagaggaaaacatgcgttatttcaatgttatggttcttggtcctacccagtctccttatgaaggaggagttttcaagttggagctctttttgcctgaagaataccctatggcagctcccaaagttaggtttctcaccaagatataccatcctaacattgacaagcttggaaggatctgccttgacatactgaaagacaagtggagtcctgcgctacaaataagaactgtgcttttgagtattcaagctcttctaagcgcaccaaacccagatgatccactctctgagaacatagctaagcattggaagagtaacgaagctgaagccgtggagacagctaaagagtggactcgtctgtatgcaagtggcgcttgatggggggagtgcaaaaagagaaagaccattgtcctaaataacgttatatatatggtgaaactctatctcaaagttttatccgaatcccttttctaaaacatggaaaacggatttgtactctcttgatttgtgtaactactaggggggatttaagactcgtttacccatatttgcaaactaactttct

SEQ ID NO: 1527 - DNA, 866 bp, Brassica rapa
actcccaaaatgaaaaaaaaaaaagaattaaagggacacgcacgagacgagagagagacgacgaagcgttgtcgataatcaccgtgcgtcttgagctttagctcaaaaaccctaaattgtccgagaccaatcgaatccgatagacttcgataatggcgaatagcaatctaccgcgaagaatcatcaaggaaacacaacgtctacttagtgaacctgctccggggataagtgcgtctccgtcagaggaaaacatgcgttatttcaatgttatggttcttggtcctacccagtctccttatgaaggaggagttttcaagttggagctctttttgcctgaagaataccctatggcagctcccaaagttaggtttctcaccaagatataccatcctaacattgacaagcttggaaggatctgccttgacatactgaaagacaaatggagtcctgcgcttcaaataagaactgtgctcttgagtattcaagctcttctaagtgcaccaaacccggatgatccactttctgagaacatagctaagcattggaagagtaatgaagctgaagctgtggagacagctaaggagtggactcgtctatatgcaagtggcgcttgatgggggggagtgcaaaaaggagaatgatgttgtcatttaaataacattatatatggtgataactctacctcaaagtttatctgaatcctttttcttaaaacaagggaaaaagatttgcactctctggatatgtataactagaagaatttaagactcgtttacccatatttgcttgagctttgttcgtgttaaagataagattttacaggtcgtaaatgaaagtaaatttgataaaatgattgaaatagagaa

SEQ ID NO: 1528 - DNA, 1922 bp, Brassica rapa
tgtaactactattttaaaaaggcagagaaaaggaatcgaattaaaagctcatcatcgaggagcacgtcagattctatatagacgagacgaaagtgttctctcggatctctctctctctaaaaccctaactctgatcaatcgaattcggcagcagcgagatcatggccaacagtaatctgccccgaagaatcatcaaggaaacgcaacgtctgctcagcgaaccggctccgggtataagtgcatctccatctgaggagaacatgaggtacttcaacgttatggttcttggtccttctcaatcaccttatgaaggaggtgttttcaagttggagctctttttgcctgaagagtaccctatggcagctcccaaggttaggtttctcaccaagatataccatcctaatattgacaagctgggaagaatctgtcttgatatcctgaaagacaaatggagccctgctctacaaatacgaacagtgctcttaagtattcaagctcttctgagtgcaccaaaccctgatgatccattgtctgagaacatcgctaagcattggaagagtaatgaggctgaagctgtggagacagctaaagaatggacccgtctgtacgcaagcggcgcatgatgggatgggaagggtgaaaacatctcatattcatccaattaacatttacatctcgtgataatctatctcaacttcaaagttacaaaaagcttatattttactgtgtttcggcacaggaagctgtaatctctctgaatcatttactaatagatgatcttctctattagtcaagtttgcttgaatttaaagattatttactctgtactctgtttaagctctgcaactttcgtatgttgcaaataaccataaaggttgataaatcatcaaatgttatccaaacaaaatagagaaggcatattaaattaggacacaagtttaaaactttacaattacaaaccataacacaaattaagtgacagtaaagtaatcaacaaccatcataaccatcaacctaatgttactcggatataaaataataagagatattaaaagtaaagaaaataaaaacactaccatagaaaaccaccaacaccaaaggaatcatcatcagtagagtagagagcaccagacaacacatttcagatttcatgagaaatattaatgaagccgaagtgagacaagtgcgtctaccaacacgtggaaggactttactatctagacaggaatggcgtctacgttcgatgaatcttcacatctcaatacaatcccttcgaggcttgcagggaacgtgcacttactccactgccaaccagcagctaacggctccgtcgtcgggactatcatcagcacgctctcgtttcgctgcaccactcctatcacactcactgtgcttccttctttgatatacctgcaaacgaaaggaagtatcatcatcatcacagagaccaacatgttttttgagcaactcttttctaagtctacattacccttcttttagccgcattactctttcatcattggagagattcttctgacccaaccacctcacgaagtccggagacgcttgctcgctccctggcttgaagtctatgacaacagaatcatcgacgatgggtgttacctttgcaccgttcccagtcttcaccaatgctctcagcccggattgaaaatcagagatgtagaagtccaccacatgcctctgccatgtattgaaaagtttagagacatttcacactgaaagagaaggaaatatcatctaacctctgctgatctcagtccccatgtgaagcggcggtgtgaagcattagccggcttcgaaccccatccacggtactcgtataaacaagtagacgtgtaaacacatctgggaactctatggaacgatgactcaagcggcacgttaccacaggtgacaacctt

SEQ ID NO: 1529 - DNA, 1098 bp, Hordeum vulgare
ggcactctggaatggaataaagcaacagatgtattctccacctttagcagaaccgcgtccgtgcgtataatagggagcatccacccgcactgcctcccccgtgttcttcccccatcccaactgacgcctcctccgcacgaaacaccggcgccgcactcatcggagaggaggaagctcctgccccggctcgatccgatggccaacagcaacctcccgcgacgaatcatcaaggagacgcagagactcctcagcgagccagctccggggattagcgcttcgccctcggaggagaacatgcggtatttcaacgtcatgatccttgggccggcgcagtcgccctacgaagggggagtttttaagctggaactatttttacccgaggaatatccgatggctgccccaaaggttaggtttctgaccaaaatatatcatcccaacattgacaagcttggtaggatatgccttgacattctcaaggataaatggagtccggctcttcagattcgaacagttcttttgagtatccaggcactcttaagtgcaccaaatccagatgaccctctctctgaaaacattgccaagcactggaaatccaatgaggcagaagctgttgaaacagcgaaggagtggacccgtctgtacgccagtggtgcatgacaaccccatgctgctcttgatgtaataacccatcatactttagccagcaatctagtgccatttggttggtaaagaacaaactggagatgtttgggctggaaggaagtatctaaatgactagtgctcgagctattgggttggttgtacacctgtgttggttggttccctttaccctggggcaccttctggctgatctgtatctgatagaactttctatgctccagtacattgcccttgtgtaggagaacttaacaagtgtccacattgttgaaattgaagctggcttgttaatttgttctcgcccttgttgtttgggagttgtgcctatcatccatgctatgcttgcgggagtttgaatgctccaggttgcatctggtacgcccgaatactgcctgatttgtttgttactcaaggtgtccgttccgttacttttaccatctt

SEQ ID NO: 1530 - DNA, 755 bp, Brassica napus
tctatctatatagacgagacgaaagtgttctctcggatctctctctaaaaccctaactctgatcaatcaaattcggcagcagcgagattatggccaacagcaatcttccccgaagaatcatcaaggaaacgcaacgtctgctcagcgaaccggctccaggtataagtgcatctccatctgaggagaacatgaggtacttcaacgttatggttcttggtccttctcaatcaccttatgaaggaggtgttttcaagttggagctctttttgcctgaagagtaccctatggcagctcccaaggttaggtttctcaccaagatataccatcctaatattgacaagctgggaagaatctgtcttgatatcctgaaagacaaatggagccctgctctacaaatacgaacagtgctcttaagtattcaagctcttctgagtgcaccaaaccctgatgatccattgtctgagaacatcgctaagcattggaagagtaatgaggctgaagctgtggagacagctaaagaatggacccgtctgtacgcaagcggcgcatgatgggatgggaagggtgaaaacatctcatattcatccaattaacatttacatctcgtgataatctatctcaacttcaaagttacaaaaagcttatattttactgtgtttcggcacaggaagctgtaatctctctgaatcatttactaatagatgatcttctctattagtcaagtttgcttgaatttaaagattatttactctgta

SEQ ID NO: 1531 - DNA, 941 bp, Leymus cinereus x Leymus triticoides
cctccgcacgaaacaccggcgccgcactcatcggaggaggaagctcccgccccggctcgatccgatggccaacagcaaccttccgcgacgaatcatcaaggagacgcagagactcctcagcgagccagcgccggggatcagcgcttcgccctcggaggagaacatgcggtacttcaacgtcatgattcttgggccggcgcagtcgccctacgaagggggagtttttaagctggaactctttttacccgaggaatatccgatggctgccccgaaggttaggtttctgaccaaaatataccaccccaacattgacaagcttggtaggatatgccttgacattctcaaggataaatggagtccggctcttcagattcgaacagttcttttgagtatccaggcactcctaagtgcaccaaatccagatgaccctctctctgaaaacattgcaaagcactggaaatccaatgaggcagaagctgttgaaacagcgaaggagtggactcgtctgtatgccagtggtgcgtgacaacccccacgctgctcttgatgtaataacccatcatactttagccagcaatctagtgccattctgttggtaaagaacaaactggagatgtttgggctgaaaggaagtatctgaatgactggtgctcgatctatttggttggttgtacacccgtgttggttggttccctttaccctggggcaccttctgactgatctgtatctgatagaactttctatgctcctccactacattacccttgtgtagaagttaacaagtgtccacattgttgaaattgaagctggcttgttaatttgttctcgctcttgtcgtttgggagttgtgctgcctaacaccgcgcaatgcttgcggagtctgaatacttgaagtttttttttgagactctgaatactcaagttgcatctgatacgcctga

SEQ ID NO: 1532 - DNA, 1104 bp, Pennisetum glaucum
aggcagcacgcccgggtagagagaccactacagcaaaaagccgcgtccgcgtacaatagcgagcgcccaacgccccaacccgcctctccccccgttccccaccctcgaccgcctgcttcctcctcctccaccaccgcgcgatcctcaaggcatcagcggcgccgcaacttcgcaggggaggaagcccgcgccccggccccgacccgatggccaacagcaacctcccgcgccggatcatcaaggagacgcagcggctgctcagcgagccagcaccggggatcagcgcgtcgccctcggaggagaacatgcgctacttcaacgtcatgatccttgggccggcgcagtcgccgtatgaaggtggagtttttaagcttgagctctttttacctgaggaatatccaatggctgccccaaaggttaggtttctgaccaagatttatcatcccaacattgacaagcttggtaggatatgcctcgacattctcaaggacaaatggagcccagcacttcagatccgaacagttctcttgagtatccaggctctcttgagtgcaccaaatccagatgaccctctgtccgataacattgcaaaacactggaaatccaatgaggcagaagctgttgaaacagcgaaggaatggactcgcatgtatgcgagtggtgcatgacaacccaatactgttcttgatgtaataacccgtcatacttcagtcctaatctattgccatttgcttgatgagagcagactggagatattgccatggaaggaagtctctaaatgacttaccagtcgaattgtttggttgtacacctgtggtcggttccctttacctttgggcaccttttgactaatcagtatctgtggtagaacttgctctactccaatatatttattacttcatgtaggggagtttctcaactgtccatattgttaaaactgaggcttgttaccttggctgcactttggttggtccactcgtttttgtgcttgtcatctgtgaaaccgtgctgctgaaactagagttgttcttgcacatttacattttgatagggatcactctagtcagtaactaaaagaaaaaaaaagctggtctactgtattca

SEQ ID NO: 1533 - DNA, 889 bp, Pennisetum glaucum
ggtgtcaacaatgtcaacaaccttcaccgcctgatcatcatcgccctcttcctttgacccccctcgtctcgtctttcctctccgtcgccgcacgaagcttgaggcaatctccgtcccccccatagccccgcgcaatccagcccggcgccatggccaacagcaacctcccgcgccgaatcatcaaggagacgcagcggctcctcagcgaaccagcgccagggattagcgcgtcgccgtcggaggagaacatgcggtacttcaatgtcatgatccttggccccgcgcagtcaccctatgaaggtggtgttttcaagcttgaactattcttgcctgaggagtatccgatggctgctccaaaagttagatttctcaccaaaatttaccatcccaacattgataagcttggtaggatatgccttgacattcttaaggacaaatggagtccagctcttcagatacgtactgttctgttgagcatccaggcactgctgagcgcaccaaacccagatgatcctctctcagacaacattgcaaaacactggaaaagcaacgaagctgaagctgtcgagacagcgaaagagtggactcgcatgtatgcaagtggggcatgacaaccaagtgtgttgttatctttgtaataacagtgtcgtagttcgatgcctattgaatgtcacagcaaattgcaatattttccgacggggaaaatgttcgaacaaattaacagttcgaattatgctttgtacttggtggctctggctcccttcactagttgctcttgctcctttgacagtacatctattttgacttgtcagttgttaccattcctgctctttcttctttgtgcgtcttcttgaacatttcctgccttacaagactatactgagctgtc

SEQ ID NO: 1534 - DNA, 975 bp, Avena sativa
gttcccccaccccggctgacgcctcctcccgtcgccccctcctccgcacgaacaccggcgccgcactcatcagggaggaagaagccctcaccccggctcgatccgatggctaacagcaacctcccgcgacgaatcatcaaggagacgcagagactcctcagcgagccagcaccgggtatcagcgcttcaccctcggaggagaacatgcgctacttcaacgtcatgatccttgggccggcgcagtctccctacgaaggtggagtttttaagctggaactctttttacctgaggaatacccgatggctgccccgaaggttaggtttctgaccaaaatataccatcccaacattgacaagcttggtaggatatgccttgatattctcaaggacaaatggagtccggctcttcagattcgaacagttctcttgagtatccaggcacttctaagtgcaccaaatccagatgaccctctctctgagaacattgctaagcactggaaatccaatgaggcagaggctgttgaaacagcgaaggagtggactcgtctgtacgccagtggtgcatgacaacccgacacagggcctgatgtaataacccatcaccatactctagtcggtaattgagtgccatttgcctgataagaccaaactggagatacctgcaatggaaggaagtatctaaaatatgactagcgctctatttggttgtacaccgtgttggttccctttaccatttgggtacctttgaccgatcaatgtctgtgctagacctttctgtgctgctccaaatatattggttactctatgtaggagaacttaacaagtgtccacatcattggagttgaagctggcttgtttccgctgaggttttgttcttcctttgtcatctgggaattgttctgccaaacttcgttgttgcagtacctgtcggtaatttaattgcctgatgctgcatgtgataaactcatgaataat

SEQ ID NO: 1535 - DNA, 911 bp, Pseudoroegneria spicata
ctggaagaattcgccgccgcacgacacaccggcgccgcactcatcggagaggaggaagctcccgccccggctcgatccgatggccaacagcaaccttccgcgacgaatcatcaaggagacgcagagactcctcagcgagccagcaccggggatcagcgcttcgccctcggaggagaacatgcggtacttcaacgtcatgatccttgggccggcacagtcgccctacgaagggggagtttttaagctggaactctttttacccgaggaatatccgatggctgccccgaaggttaggtttctgaccaaaatataccatcccaacattgacaagcttggtaggatatgccttgacattctgaaggataaatggagtccggctcttcagattcgaacagttcttttgagtatccaggcactcctaagtgcgccaaatccagatgaccctctctctgaaaacattgctaagcactggaaatccaacgaggcagaagctgttgaaacagcgaaggagtggactcgtctgtacgccagtggtgcgtgacaaccccacgccgctcttgatgtaataacccatcatactttagccagcaatctagtgctattctgttggtaaagaacaaactggagatgtttgcgctggaaggaagtatctgaatgactggtgctcgagctatttggttggttgtacacctgtgttggttggttggttcccttcaccctgggggctccttctgactgatctgtatctgatagaactttctatgctcctccactacattacccttgtgtagaagaacttgacaagtgtccacattgttgaaattgaagctggcttgttaatttgttcttgctcttgtcgtttgggagttgttacttgcggtgtctgaatacgcccgaatattttctcgtca

SEQ ID NO: 1536 - DNA, 971 bp, Secale cereale
ccccactgacgcctcctccgcacgaaacaccggcgccgcactcatcggagaggaggaagctcccgcccccggctcgatccgatggccaacagcaaccttccgcgacgaatcatcaaggagacgcagagactcctcagcgagccagcaccggggatcagcgcttcgccctcggaggagaacatgcggtacttcaacgtcatgatccttggtccggcgcagtcgccgtacgaagggggagtttttaagctggaactctttttacccgaggaatatccgatggctgccccaaaggttaggtttctgacaaaaatataccatcccaacattgacaagcttggtaggatatgccttgacattctcaaggataaatggagtccagctcttcagattcgaacagttcttttgagtatccaggcactcctaagtgcaccaaatccagatgaccctctctctgaaaacattgccaagcactggaaatccaacgaggcagaagctgttgaaacagcaaaggagtggactcgtctgtatgccagtggtgcgtgagaaccccacgccgcccttgatgtaataacccatcatactttagccagcaatctagtgccgttttgttggtaagaacaaactggagatgtttgcgctggaaggaagtatctgaatgactagtgctcgagctatttggttggttgtacacctgtgttggttggttcccttcacccttgggcaccttctgacagatttgtatctgatagaactttctatgctccactacattacccttgtgtaggagaagttaacaagtgtccacattgttgaaattgaagctggcttgttaatttgttcttgcccttgtagtttgggagtttgaatactcaaggtttcatctgatactcccgaactattttcttcagtaacgaaaaaaaaaaaaaaagaaaaaaaagtaaaactactgtcgttgtactacctactcgtcg

SEQ ID NO: 1537 - DNA, 879 bp, Secale cereale
tgttctcccatccccactgacgcctcctccgcacgaaacaccggcgccgcactcatcggagaggaggaagctcccgccccggctcgatccgatggccaacagcaaccttccgcgacgaatcatcaaggagacgcagagactcctcagcgagccagcaccggggatcagcgcttcgccctcggaggagaacatgcggtacttcaacgtcatgatccttggtccggcgcagtcgccgtacgaagggggagtttttaagctggaactctttttacctgaggaatatccgatggctgccccaaaggttaggtttctgacaaaaatataccatcccaacattgacaagcttggtaggatatgccttgacattctcaaggataaatggagtccagctcttcagattcgaacagttcttttgagtatccaggcactcctaagtgcaccaaatccagatgaccctctctctgaaaacattgctaagcactggaaatccaacgaggcagaagctgttgaaacagcaaaggagtggactcgtctgtatgccagtggtgcgtgacaaccccatgctgcccttgatgtaataacccatcatactttagccagcaatctagtgccgttttgttggtaagaacaaattggagatgtttgcgctggaaggaagtatctgaatgactagtgctcgagctatttggttggttgtacacctgtgttggttggttcccttcaccctggggcaccttctgactgatctgtatctcctccagcacattacccttgtgtagaagaacttaacgagtgtccgcattgttgaaattgaaagatggcttgttaatttgttcttgcccttgtagtttgggagtttgaacactcaaggctgcatct

SEQ ID NO: 1538 - DNA, 939 bp, Triticum aestivum
agcaaagccgcgtccgtgcgtataatagcgagcatccacccgcaccgcctcccccgtgttcccccatccccactgacgcctcctccgcacgacacaccggcgccgcactcatcggagaggagcaagctcccgccccggctcgatccgatggccaacagcaaccttccgcgacgaatcatcaaggagacgcagagactcctcagcgagccagcaccggggatcagcgcttcgccctcggaggagaacatgcgctacttcaacgtcatgatccttggtccggcgcagtcgccctacgaagggggagtttttaagctggaactctttttacccgaggagtatccgatggctgccccaaaggttaggtttctgaccaaaatataccatcccaacattgacaagcttggtaggatatgccttgacattctcaaggataaatggagtccggctcttcagattcgaacagttcttttgagtatccaggcactcctaagtgcaccaaatccagatgaccctctctctgaaaacattgctaagcactggaagtccaatgaggcagaagctgttgaaacagcgaaggagtggactcgtctgtatgccagtggtgcatgacaaccccatgccgctcttgatgtaataacccatcatactttagccagcaatcaagtgccattttgttggtaagaacaaactggagatgtttgcgctggaagggagtatctgaatgactagtgctcgagctatttggttggttgtacacccgcgttggttggttcccttcgccctggggcaccttctgactgatctgtatctgatagaactttctatgctcctccaccacattacccttgtgtaggagaagttaacaagtgtccacattgttgaaattgaagctgacttgttaatttgttcttgctcttgtagtttgggagtttgaatact

SEQ ID NO: 1539 - DNA, 979 bp, Triticum aestivum
gaagcaacggacgtttaagctccacattagcaaagccgcgtccgtgcgtataatagcgagcatccacccgcaccgcctccctcgtgttcccccatccccactgacgcctcctccgcacgaaacaccggcgccgcactcatcggagaggaggaagctcccgccccggctcgatccgatggccaacagcaaccttcctcgacgaatcatcaaggagacgcagagacttctcagcgagccagcaccggggatcagcgcttcgccctcggaggagaacatgcggtacttcaacgtcatgatccttggtccggcgcagtcaccctacgaagggggagtttttaagctggaactctttttacccgaggaatatccgatggctgccccaaaggttaggtttctgaccaaaatataccatcccaacattgacaagcttggtaggatatgccttgacattctcaaggataaatggagtccggctcttcagattcgaacagttcttttgagtatccaggcactcctaagtgcaccaaatccagatgaccctctctctgaaaacattgctaagcactggaagtccaatgaggcagaagctgttgaaacagcgaaggagtggactcgtctgtatgccagtggtgcatgacaaccccatgccgctctcgatgtaataatccatcatactttagccagcaatcaagtgccattttgttggtaagaacaaactggagatgtttgcgctggaagggagtatctgaatgactagtgctcgagctatttggttggttgtaacacctgtgttggttggttcccttcaccctggggcaccttctgactgatctgtatctgatagaactttctatgctcctccactacaatacccttgtgtaggagaagttaacaagtgtccacattgttgaaattgaagctggcttgctaatttgttcttgctcttgtagtttgggagtttgaatactcagggttggat

SEQ ID NO: 1540 - DNA, 951 bp, Mimulus guttatus
ttatttttaattatttaattattaatatgaatttacaaaataaagatgaaagtttctctgaacggtaatcattccccattttctagagagagagaaaaaagaaaaaagaaaaacccttttattagcgtaaactctccgacgaagaacaacacaggaaacggaaaaagcttcgcaaaatcaattcaatggctaacagcaatttaccgcgtcggatcattaaggaaacgcagcgtcttctgagcgaaccagcaccaggaataagtgcatctccgtcagaagaaaatatgcggtatttcaatgttatgattcttggtccaacacagtccccttatgaaggcggtgtttttaagctggagttgtttttacctgaggaatacccaatggctgctccaaaggttcgcttcctcactaaaatctaccacccgaacatcgacaagcttggaagaatatgcctagatattctcaaggacaaatggagtcctgctcttcaaattagaaccgtacttttgagcattcaagcacttcttagtgctccaaatcccgacgacccactttctgaaaacatcgccaaacattggaaatcaaacgaggctgaagctgttgaaacagctaaagagtggacgcgtttatacgcaagtggtgcgtgaaattacgtggaaattcggggtttcgttcggtaactaaaaaaattgtatttgcatctcgtttaaatgaaatattcggaagaatgatggtcaagaccattggaatttactgtactactaagcattactacttgttttcgtgttttgaactgtctttggaaaatgtgcattaatataaaggcacttactggtataaaactgtcgattattgctagcttcttttttttttttcgataaatggttcttactagtttaaatctataatttaattgcatattgtgaatatttcaagaagtcatggcaaaat

SEQ ID NO: 1541 - DNA, 862 bp, Arabidopsis lyrata
aaaggaaaaaaaaaaaagaattaaaaggatcaaaggggcacgaaattagagacgacgaagagtagtcgattatcatcagccttctctagcttcgttctctctcaaaaaccctaacttctctgagaccgatcgaatccgatagcgtgcgataatggccaatagtaatcttccccgaagaatcatcaaggaaactcaacgtctgcttagtgaacctgctcctgggataagtgcgtctccatcagaggaaaatatgcgatatttcaatgttatgattcttggtcctactcaatctccttatgaaggaggagttttcaagttggagctctttttgcctgaagaatatcccatggcagctcccaaggttaggtttctcaccaagatataccatcctaacatcgacaagcttggaagaatctgccttgacatactgaaagacaagtggagtcctgcactacaaatacgtactgtgctcttgagtatccaagctcttctaagtgcaccaaatccagatgatcctctgtctgagaacatagctaagcattggaagagcaatgaagcagaagctgtggaaacagctaaggaatggactcgtctttacgcaagtggtgcttgaagattgcaaatggaaaaagaacattgtcatttaaataacattatatggtgaaactctatctcaaggttttatctaaatcctttttctgaaaacagggaaaaaagatttgtactctctgaatttgtataactagggggatctaagtttacccatatctggaatctaactttcatcaattgtgcttgcttttgatctttggttgtgttaaatatgctctataatctttaaagcagtgtagataatcagatt

SEQ ID NO: 1542 - DNA, 887 bp, Arabidopsis thaliana
atttccgtaaaggaaaaaaagaaagaattaaaaggatcaaaggggcacgaaactagagacgacgaagcgtactcgattattatcagcctttggtagcttcgttctctctcaaaaaccctaacttctctgtgacgatcgaatccgatagcgtgcgataatggccaatagtaatcttccccgacgaatcatcaaggaaactcaacgtctgcttagtgaacctgctcctgggataagtgcgtctccatcagaggaaaatatgagatatttcaatgttatgattcttggtcctactcaatctccttatgaaggaggagttttcaagttggagctctttttgcctgaagaatatcctatggcagctcccaaggttaggtttctcaccaagatttaccatcctaacatcgacaagcttggaagaatctgccttgacatactgaaagacaagtggagtcctgcactacaaatacgaactgtgctcttgagtatccaagctcttttaagtgcaccaaacccagatgatcctctgtctgagaacatagctaagcattggaagagcaatgaggcagaagctgtggaaacagctaaggaatggactcgtctttacgcaagtggtgcttaaagaagactgcaaatggagaaagatcattgtcatttaaataacattatatatggtgaaactctatctcaaggttttatctgaatcctttttctgaaaacagaggaaaaagatttgtactctctgaatttgtataactagggggatctaagactcgtttacccatatctggaatctaactttcttcaattgtgcttgcttttgatctttgtttttgttatatatgctctataataatctttataaagtggtgtagataatcagattttca

SEQ ID NO: 1543 - DNA, 793 bp, Brassica juncea
aaaagagttcgtaaacattttctgaagttatcaacgagacgagagacgaagaagcttcttttagctaatagctccgttctctctgagaaaaaccctaaattctctgagagatcgatcgaatcggatagcacgcagttatggcgaatagtaatcttcctcgaagaatcatcaaggaaactcaacgtcttcttagtgaacccgctccggggataagtgcgtctccgtcagaggaaaatatgcgctacttcaatgttatgattcttggtcctacccagtctccttatgaaggtggagtttttaagttggagctctttttacctgaagaatatcccatggcagctcccaaggttaggtttctcaccaagatataccatcctaacattgacaagcttggaagaatctgccttgacatactgaaagacaagtggagtcctgcgctacaaataagaactgtgctcttgagtattcaagctcttctaagtgcaccaaacccagatgatcccctctctgagaacatagctaaacactggaaaagcaatgaagcagaagctgtggagacagctaaggagtggactcgtctatatgcaagtggtgcttgatatagagtgcaaaggagaaagttctttgtcattttaaataacaatatatatggtgaaacactatatctcaaggttttatctgaatccttctttctaaaacaggaaagaaaaagatttgtactctatgaatctgtataactagggggggttctaagactcgtttatccacatttgcaaactaactttcttcaaat

SEQ ID NO: 1544 - DNA, 846 bp, Brassica juncea
acgacgtagcttcgttctctctcgaaaaccctaatttatctgcgagatcgagcgatcgaatccgatagcgtgcgagaatggcgaatagcaatctaccgcgaagaatcatcaaggaaactcaacgtctacttagcgaaccggctccggggataagtgcgtctccttcagaggaaaatatgcgatatttcaatgttatgattcttggtcctacccagtctccttatgaaggaggagttttcaagttggagctctttttgcctgaagaatatcctatggcagctcccaaggttaggtttctcaccaagatataccatcctaacattgataagcttggaagaatctgtcttgatattctgaaagacaaatggagccctgctctacaaatacgaacagtgctcttaagtattcaagctcttctgagtgcaccaaaccctgatgatccattgtctgagaacatcgctaagcattggaagagtaatgaggcagaagctgtggagacagctaaagaatggacccgtctttacgcaagcggcgcatgatggatgggagggtgaaaaaaaatctcatttatccaaataacattgcatttgttgaaatctatctcaacatctaagttatgtattgcttgttcttactgtatcattactaatagggtcgagactcgttcaccaatttgtcaaagtttcgttgaatcaaaacttctctactgtgttgccacttttgtattttgtatatacttttgtattttgcaaatatacaaaaggttgataaatctttaaagaaacgacatagacaggggccattatattaggacaacacgttcagaactttacaattacaaaccat

SEQ ID NO: 1545 - DNA, 697 bp, Brassica juncea
aaaaccctaaattctccgagaccaatcgaatccgatagactgcgataatggctaatagtaatctaccgcgaagaatcatcaaggaaactcaacgtctgcttagtgaacctgctccggggataagtgcgtctccgtcagaggaaaacatgcgttatttcaatgtcatgattcttggtcctacacagtctccttatgaaggaggagttttcaagttggagctctttctgcctgaagaataccctatggcagctcccaaagttaggtttctcaccaagatataccatcctaacattgacaagcttggaaggatctgccttgacattctgaaagacaaatggagtcccgcgcttcaaataagaactgtgctcttgagtattcaagctcttctaagtgcaccaaacccggatgatccactgtctgagaacatagctaagcattggaagagtaacgaagctgaagccgtggagacagctaaagagtggactcgtctgtatgcaagtggcgcttgatggggggagtgcaaaaaagagaaagaccattgtcctaaataacgttatatatatggtgaaactctatctcaaagttttatccgaatcctttttctaaaacatggaaaacggatttgtactctcttgatttgtgtaactactaggggggatttaagactcgtttacccatatttgcaaactaactttct

SEQ ID NO: 1546 - DNA, 832 bp, Brassica juncea
aaaggaaaaagaataaaaaacaatcaagggtcacaagacaagacacgacgtagcttcgttctctctcaaaaaccctaattatctttgacatcgatcgaatccgataagcgagcgagaatggcgaatagtaatctaccgcgaagaatcatcaaggaaactcaacgcctgcttagcgaaccggctccggggataagtgcgtcaccgtcagaggagaatatgcgatatttcaatgttatgattcttggtcctacccagtctccttatgaaggaggagttttcaagttggagctctttttgcctgaagagtatcctatggcagctcccaaggttaggtttctcaccaagatataccaccctaacattgacaagcttggaagaatttgccttgacatactgaaagacaagtggagtcctgcgctacaaataagaactgtgctcttgagtattcaagctcttctaagtgcaccaaatccagatgatcccctctctgagaacatagctaagcactggaaaagcaatgaagcagaagctgtggagacagctaaggaatggacccgtctttatgcaagcggcgcatgatgcagtggagggtgaaaagatgtcattcatccaaataacattacatttggttaaatcttatcttttgctggtccccttcattatgataaaaatgttgtgtctcggcacaagaagttgtaatctttctaagtgaattgtatcattaactaatagggtcaagactcgttcatccaaataacaatacatttactagttgcatgccaaacgaaaatagataaaagaataaagctttacaattacaaaccataacaca

SEQ ID NO: 1547 - DNA, 789 bp, Brassica oleracea
  misc_feature (563)..(563): n is a, c, g, or t
  misc_feature (603)..(603): n is a, c, g, or t
  misc_feature (618)..(618): n is a, c, g, or t
  misc_feature (622)..(622): n is a, c, g, or t
  misc_feature (646)..(646): n is a, c, g, or t
  misc_feature (650)..(650): n is a, c, g, or t
acgcgtccgatcgaggagacgaaagtgttctctcggatctctctctaaaaccccaactctgatcaatcgaaatcggcagcgcgagatcatggccaacagcaatctgccccgaagaatcatcaaggaaacgcaacgtctgctcagtgaaccggctccgggtataagtgcatctccatctgaggagaacatgagatacttcaacgttatggttcttggtccttctcaatcaccttatgaaggaggtgttttcaagttggagctctttttgcctgaagagtaccctatgtcagctcccaaggttaggtttctcaccaagatataccatcctaacattgacaagcttggaagaatctgtcttgatatcctgaaagacaaatggagccctgctctacaaatacgaacagtgctcttaagtattcaagctcttctgagtgcaccaaaccctgatgatccattgtctgagaacatcgctaagcattggaagagtaatgaggctgaagctgtggagacagctaaagaatggacccgtctgtacgcaagcggcgcataatggattggagggngaaacgatctcacattcatccaaataacatttacagtttngtgataatctatctnaacntccaaagttataaaaagcttatantttnctgtttctcccctcttataatgataaaaatgtgagtttcggcacaggaagatgtatattgtatcattactagtagggtcaagactcgtgtgcctacttgagctcgtcaagtttcgttgaatcaaaacatcttctctacg

SEQ ID NO: 1548 - DNA, 766 bp, Brassica oleracea
gaattaaaagcagcacgcacgagacgagagacgacgaagcgttctcgataatcaccgtgcttctttagcttagcttcgttctctctctcacaaaaaccctaaattctccgagaccgatagaccgcgataatggctaatagcaatctaccgcgaagaatcatcaaggaaacacaacgtctacttagtgaacctgctccggggataagcgcgtctccgtcagaggaaaacatgcgttatttcaatgtcatgattcttggtccttcacagtctccttatgaaggaggagttttcaagttggagctctttttgcctgaagaataccctatggcagctcccaaagttaggtttctcaccaaaatataccatcctaacattgacaagcttggaaggatctgccttgacattctgaaagacaaatggagtcctgcgctacagataagaactgtgctcttgagtatccaagctcttctaagtgcaccaaaccctgatgatccactttctgagaacatagctaagcattggaagagtaatgaagctgaagctgtggagacagctaaggagtggactcgtctatatgcaagtggcgcttgatggggggggagtgcaaaaaggagaatgatgttgtcatttaaataacattatatatggtgataactctacctcaaagtttatctgaatcctttctcttaaaacaagggaaaaagatttgcactctcttgatgtgttgttgtcattaagactcgtttttacccatatttgcttgagc

SEQ ID NO: 1549 - DNA, 2842 bp, Brassica rapa
gcaataaactattagtttttctttgcattgaggagcacttcagattcgacccaagacgacaacgaccaagaagtgttctcgattctcagcgtgcggacaactcttatcgatcgatcgagcgagcgagcgagcgataatggccaacagtaatctcccccgaagaatcatcaaggaaacgcaacgtctgctcagtgaacccgctccgggtataagtgcatctccatctgaggagaacatgcgttacttcaacgttatggttcttggtccttctcaatcaccttatgaaggaggagttttcaagttggagctctttttgcctgaagaataccctatggcagctcccaaggttaggtttctcaccaagatataccatcctaacattgacaagcttggaagaatctgtcttgatattctgaaagacaagtggagccctgctttacaaatacgaactgtgctcttaagtattcaagctcttctgagtgcacccaaccctgatgatcccttgtctgagaacatcgctaagcattggaagagtaatgaggccgaagctgtggagacagctaaggaatggacccgtctttacgcaagcggcgaatgatgcgcagtcgagggcgaaaagatctcattcatccaaataacattacctttggtgaagtcttatcttttgttggttctttttatcattatgataaaaacgtgttttatgggacacgaagttgtaatctctctgaatgattgtttcattaactaatagggtcaagactcgttcatccaaataacaatacattcactagttgcattccaaacgaaatagataaaggccattgtattaggacacgagtaaaaaaactagaatagctttacagttacaaaccaaaacacaaaccaagtaaatcaatatccatcatcctaatgtaataacaaatatttagaggcaaaaaaaaactaccataaaaccacaaaccaaaggaatcatctcagcagagcgagtgaaaagccaccaacaaagaacacaattcagatttcatgaaaaatattttatgaagccgaagtgaaccaaccgtggaagaagaacaagaaaaaagacttgctactaaccgcactagacgggaattgcgtctacattggatgaatcttcacatctcaaaacaatgccttcaagacttgcagggaacgtgcacttgctccattgccaaccagcagctaatggctctgtcgttgggactatcattaacacgctttcgttcctctgcaccactccaattacacttactgtgcttccttctttgatatccttctttaagccgcatcactctttcatcattagatagattcttctgacccaaccaccttacgaaatctggagacgcctgctcgtttcctggcttgaaatcgatgacaacagagtcatcaacaataggtgttaccttcgcaccgtttccgcttttcaccaatgctctcagaccagactggaaatcagaaatgtagaagtctaccacatgcctctgccatgtattgtagatgcaaagtttagagacatttccacatagaaagattaacatttttttctctcaaacgaaatatcatcaaacctctgctgatctcagtccccaagtgaagcggcggtgtgaagcattggctggctttgaaccccacccacggtactcatatagacaagtagacgtgtaaacacatctgggaactctatggaacgatgactcaagcggcacgttaccacatgtgaccacctttacagcaaacaaaaatataagaaccaatgtcataaacatagtacatcccatgcgtgtgtgcttagacactacttaccccagtgaccttaacgtattgaccgtttttggcagttctaagatcagcatcaggataaccaccaacgaaatctgtgaagccacgtctttcacaagaaagattccaaaagaaaagcgcagcaacaagagcgaacaaggccgccacaacgatgaggagaactgcattgtgaaccgctccaaggatgaagcctccagagaggaaccccatcacaaatataagtataaccagccagaggacaggcttcgggaagctcttcatgcaggagaagtcatcttcaggaccaagtgtagttacggcctggttatggacaagggaaggcttatgatgtgtcttcatcgaaccagagtagtctagaggaccagagatcttcctaggacccccagatgagttcagaggaccagaagtaatcggcccagatgttatcagacctgtagtgggaagcataggaatagaaccagagttttgacgtgttacaccaccagactgcggcccagaggttttctttagaggctccccgtgcttagacaaagggccagagtttgttttcttcatggaactcgacccagtggcagaggccaaagagccagacatacgaccggttgcattaggcaaaggaccagactgcccgccgcttcttgaagaagctccggtgatcggaccagacttccttgacttggttccatcggtgggaatgtcaaacatcttccccaactctccagatttcttgatatcgccgccggtgtaaggcgtggctactgagctcatcgtaggaggcttttctttgggttgctccggcctacccccagacacaaagagaccgttgctgagctggtgagatgcgtatctcgaacccatttaatatcttaaactgccacaaacaatgcgttgttgcaacgttaggggtttcaaagtcctgcaggaacgcccatgagaattgagaaacgaacaaaatagttacagaactggtttatatatagatgatgtaacattatatacataagaagaataagacaag

SEQ ID NO: 1550 - DNA, 1162 bp, Brassica rapa
aaacgtcccccgttcacggttcatagtggtttgtagtgaatctctccacaaggcaaaaggaagatcatgttattgatgttgacacactaatgctctcccaataatgtctaactttgttatcccttctttatattttgcgttagaccaacgcgtcgctaaaaggaaaaaaaaagaggaaaaagaataaaaaacaatcaagggtcacaagacaagacacgacgtagcttcgttctctctcaaaaaccctaattatctttgacatcgatcgaatccgataagcgagcgagaatggcgaatagtaatctaccgcgaagaatcatcaaggaaactcaacgcctgcttagtgaaccggctccggggataagtgcgtcaccgtcagaggagaatatgcgatatttcaatgttatgattcttggtccttcccagtctccttatgaaggaggagttttcaagttggagctctttttacctgaagagtatcctatggcagctcccaaagttaggtttctcacgaagatttaccatcctaacattgacaagcttggaagaatttgccttgacatattgaaagacaagtggagtcctgcgctacaaataagaactgtgcttttgagtattcaagctcttctaagcgcaccaaacccagatgatccactctctgagaacatagccaagcattggaagagtaatgaagctgaagctgtggagacagctaaggagtggactcgtctgtatgcaagtggcgcttgatggggggagtgcaagaggagaaagatcattgtcatttaaataacattatatatggtgaaatactctatctcaaggttttatccaaatccttttttttctaaaacaagaaaaaaagatttgtactctctggatatgtataactactagggaggatttaagactagtttatccatatttgcaaactaactttcttcaaatgtgcttgcgcttgtgctttctctgtgttttttaaactgctccagttattagagcactgctagtgataagatttgacagatcgtgaatgaagcaaatttggtgaatggttgaagtagagagaaatgttaataatacagatgcatgtatgagcaaaagctactaaaacgaagcagattattttggtcaaaagtagaaaaaggtgtaaaaaatcgtt

SEQ ID NO: 1551 - DNA, 2702 bp, Brassica rapa
ttgaagggcatctcggaaaaaataaaactttttattttattctacaaaaagagttcgtaaacattttctgaagttatcaacgagacgagagacgaagaagcttcttttagcgaatagctccgttctctgtgagaaaaaccctaaattctctgagagatcgatcaaatcggatagcacgcaataatggcgaatagtaatcttcctcgaaggatcatcaaggaaactcaacgtcttcttagtgaacccgctccggggataagtgcgtctccgtcagaggaaaatatgcgctacttcaatgttatgattcttggtcctacccagtctccttatgaaggtggagttttcaagttggagctctttttacctgaagaatatcccatggcagctcccaaggttaggtttctcaccaagatttaccatcctaatattgacaagcttggaagaatctgccttgatatactgaaagacaagtggagtcctgcgctacaaataagaactgtgctcttgagtattcaagctcttctaagtgcaccaaatccagatgatcccctctctgagaacatagctaagcactggaaaagcaatgaagcagaagctgtggagacagctaaggagtggactcgtctatatgcaagtggcgcttgatatagagtgcagaaggagaaagttctttgtcattttaaataacattatatatggtgaaacactatatctcaaggttttatctgaatccttctttctaaaacaggaaagaaaaagatttgtactctatgaatctgtataactaggggggggtctaagactcgtttatccacatttgcaaactaactttcttcaaatagctttgtctgtgttgaatatcctctataatcatttaatcgttgtgaatgaaggtaaatgtgataaatggttggagtagggaaaatgttactattacagatgtatgagacggccactaaaatgaagcagcttattttgtcaaatgtaaaaaagaaagtagacatgtggaatgatatttttcgatttgtttttttcttctttcttataaatggcattttcagattcagaaactggagtcgtcagtagatggacgcctcaagaagtacctcaaactattggcaagaacctacaaacaacattttgactttactcatttaaacggcaaaacaagatttaaaataaaaagtctggtttctgaacttctgaattacctgctgaagaggcttgatcagggctttgtttctgtaacttacgtggaacttaaccttagccaacaaaccctgttttgtttgtttcacataaaacaagaagaagaagaagaagcaacatgagcaaaaagcagagtggttggttatatcttaggtttaaaatcactagttacctcagtgtcgaattctccagattcgacagcgacgctgatatctgtaatgttcttcactagctcaactaatagtccaggcctatccgctgtttctatgtatagtaaactgcattctcaacaacaatacttatggatcatacattaaaagatagtgttttatagttgagatcattggagaaaaggtttttgaagttgagataaggtatgggtttccctttacctgcggtctggtccatcatcttcaatttttatatgcgttgctatgtccacatcaacctgtcaacttggtggaagaacaccaaaagctgctcccattgccaactgagaacttgattcctgatccaaataattgacaagcaatgtgtgagttaagaaatgctacgcaagatataaacgtttattttaagataacgacaagttgttggttatacaggatgaaactcgagcaaattgttaatgacagtgagacggatggcctcgagcaattcagggtcttctacttttcttccactatccctgtttcagataaatacacaagattcaatctagagtcagctctatgatttgattaaaaagtaacgttaatgttaataaagacatacgctttagtaatggcaaatttgttgtgcttgccagaagaatcgaggtagacattagccttgacaacattcagacccaaatttttgagcgcattcatcttgtcaagtagagctcctagacgatctccaaatgttacttcaacaacggttgcatcagggtcagaatcttggtcgattatgaccactggagttgggacttcgtcagaatcctgcttaccattcttcaaaaagaaaaagaaaacactttttaaaatattttattttgatcgttggtactatactcttctcgtgtaatccgatcatttcatacctccacagcagtagcgtttgctgctcgaggcttcaaccccgataatctgacacaggaaagtaacacaagtttcaccaatatacaaaaacaaagctcaaacaaatcattgctaaaacagctcataacataaaaaatagaaacctgagtcgctgaagatttataataggcttatcgacaaatccaaacgtgattgtgctaggaggaagacataaagctccaagatcacgtctgattgcgggagaagtagaagcatcagtgaagcaaagagcagaaccagaagcagaggccatagccaccatagctgacttgaacccgaagcaaaaaaaaaaaagaacgttagagactaaaagtgaagaagaacaagagcctctggacacctctggtgttatccgccatgagaggatgataattt

SEQ ID NO: 1552 - DNA, 772 bp, Brassica napus
aatcaagggtcacaagacaagacacgacgtagcttcgttctctctcaaaaaccctaattatctttgacatcgatcgaatccgataagcgagcgagaatggcgaatagtaatctaccgcgaagaatcatcaaggaaactcaacgcctgcttagcgaaccggctccggggataagtgcgtcaccgtcagaggagaatatgcgatatttcaatgttatgattcttggtccttcccagtctccttatgaaggaggagttttcaagttggagctctttttgcctgaagagtatcctatggcagctcccaaagttaggtttctcaccaagatttaccatcctaacattgacaagcttggaagaatttgccttgacatattgaaagacaagtggagtcctgcgctacaaataagaactgtgctcttgagtattcaagctcttctaagtgcaccaaacccagatgatccactctctgagaacatagctaagcattggaagagtaatgaagctgaagctgtggagacagctaaggagtggactcgtctgtatgcaagtggcgcttgatggggggagtgcaacaggagaaagatcattgtcatttaaataacattatatatggtgaaacactctatctcaaggttttatccaaatccttcttttctaaaacatggaaaaaaaagatttgtactctctggatatgtataactactagggaggatttaagactagtttatccatatttgcaaactaactttcttcaaatgtgcttgcgcttgtg

SEQ ID NO: 1553 - DNA, 741 bp, Brassica napus
gacttcagattcgaccaaagacgacgacgacgaccaagtgttctcgattctcagcgtgcggatcttctctctcccaaaaaacccgaatcgatcgagcgagcgagcgataatggccaacagtaatctcccccgaagaatcatcaaggaaacgcaacgtctgctcagtgaacccgctccgggtataagtgcatctccatctgaggagaacatgcgttacttcaacgttatggttcttggtccttctcaatcaccttatgaaggaggagttttcaagttggagctctttttgcctgaagaataccctatggctgctcccaaggttaggtttctcaccaagatataccatcctaacattgataagcttggaagaatctgtcttgatattctgaaagacaaatggagccctgctttacaaatacgaacagtgctcttaagtattcaagctcttctgagtgcacccaaccctgatgatcccttgtctgagaacatcgctaagcactggaagagtaatgaggccgaagctgtggagacagctaaggaatggacccgtctttacgcaagcggcgaatgatgcgcagtcgagggcgaaaagatctcattcatccaaataacattacctttggtgaagtcttatcttttgttggttctttttatcattatgataaaaacgtgttttatgggacacgaagttgtaatctctctgaatgattgtttcattaactaatagggtcaagactcgtt

SEQ ID NO: 1554 - DNA, 709 bp, Brassica napus
catcgaggagacgaaagtgttctctcggatctctctctaaaaccccaactctgatcaatcgaaatcggcagcgcgagatcatggccaacagcaatctgccccgaagaatcatcaaggaaacgcaacgtctgctcagtgaaccggctccgggtataagtgcatctccatctgaggagaacatgagatacttcaacgttatggttcttggtccttctcaatcaccttatgaaggaggtgttttcaagttggagctctttttgcctgaagagtaccctatgtcagctcccaaggttaggtttctcaccaagatataccatcctaacattgacaagcttggaagaatctgtcttgatatcctgaaagacaaatggagccctgctctacaaatacgaacagtgctcttaagtattcaagctcttctgagtgcaccaaaccctgatgatccattgtctgagaacatcgctaagcattggaagagtaatgaggctgaagctgtggagacagctaaagaatggacccgtctgtacgcaagcggcgcataatggattggagggcgaaacgatctcattcatccaaataacattacatttcgtgataatctatctcaacttccaaagttataaaagcttatattttgctgtgtttcggcacaggaagctgtaatctctctgaatcattgtatcatttactaatagatgatcttttctat

SEQ ID NO: 1555 - DNA, 823 bp, Brassica napus
aacgagacgagagacgaagaagcttcttttagctaatagctccgttctctctgagaaaaaccctaaattctctgagagatcgatcgaatcggatagcacgcagttatggcgaatagtaatcttcctcgaagaatcatcaaggaaactcaacgtcttcttagtgaacccgctccggggataagtgcgtctccgtcagaggaaaatatgcgctacttcaatgttatgattcttggtcctacccagtctccttatgaaggtggagttttcaagttggagctctttttacctgaagaatatcccatggcagctcccaaggttaggtttctcaccaagatataccatcctaacattgacaagcttggaagaatctgccttgacatactgaaagacaagtggagtcctgcactacaaataagaactgtgctcttgagtattcaagctcttctaagtgcaccaaatccagatgatcccctctctgagaacatagctaagcactggaaaagcaatgaagcagaagctgtggagacagctaaggagtggactcgtctatatgcaagtggcgcttgatacggagtggaaaaggaaaaagttcattgtcattttaagtaacaatatatatggtgaaacactctatctcaaggttttatctgaatccttctttctaaaacaggaaagaaaaagatttgtactatatgaatatgtataactagggggatctaagactcgtttatccacatttgcaaactaactttcttcaaatgagtttgtgcttgaactttgtctgtgttgaatatcctctataatcatttaatcgttgtaaatg

SEQ ID NO: 1556 - DNA, 772 bp, Brassica napus
ttcagattcgacccaagacgacgaccaagtgttctcgattatcggcgtgcggatcttctctctcccaaaaaaccccaactcttatcgatcgagcgagcgataatggccaacagtaatctcccccgaagaatcataaaggaaacgcaacgtctgctcagtgaacctgctccgggtataagtgcatctccatctgaggagaacatgcgttacttcaacgttatggttcttggtccttcacaatcgccttatgaaggaggtgttttcaagttggagctctttttgcctgaagaataccctatggcagctcccaaggttaggtttctcaccaagatataccatcctaacattgataagcttggaagaatctgtcttgatattctgaaagacaaatggagccctgctttacaaattcgaacagtgctcttaagtattcaagctcttctgagtgcacccaaccctgatgatccattgtctgagaacatcgctaagcattggaagagtaatgaggccgaagctgtggagacagctaaggaatggacccgtctttacgcaagcggcgaatgatgcagtcgagggcgaaaagatctcattcatccaaataacattacatttggtgaagtcttctcttttgttggttcttcctcctcattatgataaaaatgtgtgtttcggcacacgaagttgtaatctctctgaatgattgtattgtatcgttaactaatagggtcaagacacgttcatccaaataacaatacgttcactagttgcattc

SEQ ID NO: 1557 - DNA, 731 bp, Brassica napus
acgacgaccaagtgttctcgattctcagcgtgcggatcttctctctcccaaaaaacccgaatcgatcgagcgagcgagcgataatggccaacagtaatctcccccgaagaatcatcaaggaaacgcaacgtctgctcagtgaacccgctccgggtataagtgcatctccatctgaggagaacatgcgttacttcaacgttatggttcttggtccttctcaatcaccttatgaaggaggagttttcaagttggagctctttttgcctgaagaataccctatggcagctcccaaggttaggtttctcaccaagatataccatcctaacattgataagcttggaagaatctgtcttgatattctgaaagacaaatggagccctgctttacaaatacgaactgtgctcttaagtattcaagctcttctgagtgcacccaaccctgatgatcccttgtctgagaacatcgctaagcattggaagagtaatgaggccgaagctgtggagacagctaaggaatggacccgtctttacgcaagcggcgaatgatgcagtcgagggcgaaaagatctcattcatccaaataacattacatttggtgaagtcttatcttttgttggttctttttatcattatgataaaaatgtgtgttatggcacacgaatttgtaatctctttgaatgattgtatcattaactaatagggtcaagactcgttcatccaaataacaataca

SEQ ID NO: 1558 - DNA, 951 bp, Cenchrus ciliaris
tacagaaaaaccgcgtccgcgtacaatagcgagcgcccaacgccccaacccgcctctcccccccgttccccaccctcctcgaccgactgcttcctcctcctccacaccaccgcgcgatcctcaaggcatcagcggcgccgcaacttcgcagaggaggaagcccgcgccccagccccgatccgatggccaacagcaacctcccgcgccggatcatcaaggagacgcagcggctgctcagcgagccagccccggggatcagcgcgtcgccctcggaggagaacatgcgctacttcaacgtcatgatccttggcccggcgcagtcgccctatgaaggtggagtttttaagcttgagctctttttacctgaagaatatccaatggctgccccaaaggttaggtttctgaccaagatttaccatcccaacattgacaagcttggtaggatatgccttgacattctcaaggacaaatggagcccagcacttcagatccgaacagttcttttgagtatccaagctctcttgagtgcaccgaatccagatgaccctctgtccgataacatcgcaaaacactggaaatccaatgaggcagaggctgttgaaacagcgaaggaatggactcgcctgtatgcaagtggtgcatgacaacccagtgctgttcttgatgtaataacctgtcatacttcagtcctaatctattgccatttgcttgatgagaacagactggagatatttgccatggaaggaagtctctaaatgacttaccagtctgaattgtttggttgtacacctgtggtcggttccctttacctttgggcacctttgactaatcagtatctgtggtagaacttgctctactccaatatatttattacttcatgtaggagagtttctcaaactgtccatattgttaaaactgaggctcaacctcggctgctcttttgttggtcca

SEQ ID NO: 1559 - DNA, 820 bp, Solanum melongena
aaccctattaaacacaagttttcttagtgagagaaacagtgattttgaaaccctcaatcctttctctctctagaaaaagtgcgttttagcgtaaattttctgcgaccaaaaaaaaataaaaaaattcatcgattcaatttcaatggccaacagcaatcttcctcgaagaattatcaaggaaactcagcgtcttctaagcgaacctgcaccaggaattagtgcttctccctcagaagaaaacatgcgatattttaatgtcatgattcttggtccaacacagtctccttatgaaggaggtgttttcaaactggaactctttttgcctgaagagtacccaatggctgcgccaaaggttcgattcctcaccaaaatctaccatccgaacattgataagcttggaaggatatgccttgatattctcaaggacaagtggagtcctgctcttcagattcgtactgttcttttgagcattcaagcacttttgagtgctccaaatccagatgatccactctctgagaacattgcaaagcactggaagtcaaatgaggctgaagctgttgaaacggctaaagaatggacgcgtctttatgcaagtggtgcctgaagaccataattaagttattgatcgactgtttaatctgaatgggactagggaggactgaagctgaaagcttcaaattacccgtctagaattatttccctgtcctagaaattgtacaattgaacaatgcaccttctttttcaagttgaattggtctttacttctagaccagaaacgcggttctaaagaattatctcacagaacactgatttggttgac

SEQ ID NO: 1560 - DNA, 879 bp, Euonymus alatus
acacgtcaatattttcgctagggagagacgactctctctctctccctctctctccctcaaaaacctttttagcgttttctgtaatctaaccttggaacacaatggcgaacagtaatctccctcgaagaatcattaaggaaactcagcggcttctcagtgaaccagcaccgggcattagtgcgtcaccctctgaagaaaatatgcggtacttcaatgtgatgattcttggcccaacacaatcaccatatgaaggaggagttttcaagttggaattattcttgcctgaagaatacccaatggcagctccaaaggttcgatttcttacaaaaatataccatcctaacattgacaagcttgggaggatatgccttgatattctgaaagacaaatggagtcctgctctccagattcgaactgtacttttgagcatccaagcacttcttagtgctccaaatcctgatgatccactttctgaaaatattgcaaagcattggaagtcaaatgaggctgaagcggttgaaacagcaaaggaatggactcggttgtacgcaagtggtgcctgatgcgataattggaaactttccttcaaataacattgactgcaatgtatgtgatttgactgttgattttgggcagagaattggaagaattgatctctctccgaatggttattgtttattattctcaaaaagcttccagttactacttaatgttaaatgttttcttttggaggcctcgtctttgacatgtatgataaatacgttgttcatccgttactcaaatgcagaatttgcttagtaataatcctagtcatgtagaacttttgagttctgttaaatcattcaacattgtggtagtggttaagaaatttgttgcgta

SEQ ID NO: 1561 - DNA, 991 bp, Festuca arundinacea
  misc_feature (96)..(99): n is a, c, g, or t
  misc_feature (102)..(103): n is a, c, g, or t
  misc_feature (115)..(115): n is a, c, g, or t
  misc_feature (121)..(121): n is a, c, g, or t
  misc_feature (443)..(443): n is a, c, g, or t
ggcacgaggcgtataatagcgagcatccaacccccaccgcctccccaagcccggctgacgcctcctcccgtcgcccacctcctccgcacgaaacannnncgnngcactcatcggngaggangaagacatcgccccggcttgatccgatggccaacagcaacctcccgcgacgaatcatcaaggagacgcagaggctcctcagcgagccagcgccggggatcagcgcttcgccctcggaggagaacatgcgctacttcaacgtcatgatccttgggccggcgcagtcgccctatgaaggtggagtttttaagctggaactctttttacctgaggaatatccgatggctgccccgaaggtaaggtttctgaccaaaatataccatcccaacattgacaagcttggtaggatatgccttgacattctcaaggacaaatggagtccngctcttcagattcgaacagttctcttgagtatccaggcactcctaagtgcaccaaacccagatgaccctctctctgataacattgctaagcactggaaatccaacgaggcagaagctgttgaaacagcgaaggagtggactcgtctttacgccagcggtgcatgaagacccaacgctggcgctgatgtaataatcaatcatactctagtcggtagtcgagtgccatttgcctgataagaagaaactggagatatctgcagtggaaggaagtatctaaatgactaccgctcgtcgctctatctggttgtacaatgtgttggttccctttaccctggggtgcctttgactgatcaatatttgtggtagacctttccgtgccgctccaagtatatcggttactctatgtaggagaacttaacaagtgtccacattattgtagttgaagttaaagattgcttgttttgctgcgaatttgttcttcctactaggctatctgggaattgttctgtcagacttggttgcgatttccgacggaatttagtttggtg

SEQ ID NO: 1562 - DNA, 977 bp, Setaria italica
atgtggcctaacacaagtttcgcaacgacgtcgaaagcgcagaaatactggcactacggcggcgctgaaacggaagaccttataaaggcgtccgtccgtccgttggtgtgtcgctgccctttcgccctctcctttgacccctcgtctcgtcctcctctccaagcccccccgcccccccgcccccgcgggcgtaatccagctcggctcggcgccatggccaacagcaacctcccgcgccgaatcatcaaggagacgcagcggctcctcagcgaaccagcgccagggattagtgcctcgccgtcggaggagaacatgcggtacttcaatgtcatgatccttggccccgcgcagtcaccctatgaaggtggagttttcaagcttgaactattcttgcctgaggagtatccaatggctgctccaaaagttagatttctcaccaaaatttaccatcccaatattgataagcttggtaggatatgccttgacattcttaaggacaaatggagtccagctcttcagatacgtactgttctgttgagtatccaggcactgctgagcgcaccaaatccagatgatcctctctcagacaacattgcaaaacactggaaaagcaatgaagctgaagctgtcgaaacagcgaaagagtggactcgcctgtatgcaagtggggcatgacaaccaagtgtgttgttatctttgtaataacagtgtcatagtttgatcccgattgaatatcacttgcttgagcgagcaaattgcgatattttgcaacggggaaaaatgttcgaacaaaacaacagttcgaattatgctttgtacttgtggctctagctcccttcactgcagtaagcatcagagcaggtgttgtttggtctgtttctacttgctctttagtggctcgtgctcccgttacagtccgatctattttgacttgttcaccattcctgctatttcttctaaactgtctaaacctcttg

SEQ ID NO: 1563 - DNA, 820 bp, Vitis vinifera
ccccaaattccaccttttccttcttcgtgttgccaaaatacaactcttgactccctccctccctccctctctctaaaatctcagagtcaatggccaatagcaatcttcctcgaaggattatcaaggaaacacagaggcttctcagtgaaccagctccaggaattagtgcttctccttcagaagagaacatgcggtattttaatgtaatgattttgggtccaacacaatccccttatgaaggaggggttttcaaattggaattatttctccccgaagaatatccaatggcggctcccaaggttcgcttcttgaccaagatataccatcctaacattgataagcttggaaggatatgcctggatattctcaaagacaagtggagtccggccctccaaatccgaacggtgttgctgagcatccaagctcttctaagtgctccaaatcctgatgatccactttctgagaacattgcaaagcattggaagagcaatgaggctgaagctgttgaaactgcaaaagaatggacccgcttatatgcgagtggtgcatgatgggagttgtcgtctggaaatactatttctgcattgtatgttaaaccgaatgcttttcctttggactttaatccaaaaagaaaaaaaaatgggaatgatccgatggatcatttagagatgaatcttcctgaaattggcggacatggatttggttctattttttttatcttctggaagggcatgttttaagaccgtatggttataaaagttgatggtttttccattttatgtttcttaccaatgagctacatttttacattttcctccta

SEQ ID NO: 1564 - DNA, 850 bp, Lactuca sativa
aaacggaggtgaagatccaaaagcacccccttcacattctctctctaaaacccctctctatttctcttctcaaaaatccaaaagctcctttagcgtaacttctactccttccatggcgaacagtaatctacctcgaagaatcatcaaggagacacagcggttgcttagcgaaccagctcctgggataagtgcatcaccatcagaagagaatatgcgttatttcaatgtcatgatccttggtccatcacaatctccttatgaaggaggagtcttcaaattggagttatttttgcctgaagaatatccaatggcagcccccaaggttcgatttctcacaaagatatatcatcctaacattgacaagcttggccgaatatgtcttgatatacttaaagataaatggagccctgctcttcaaattcgcactgtactcttaagtattcaagcacttttgagtgctccaaatccagatgatccattatctgaaaacatagcaaaacactggaaatctaatgaagctgaagctgttgaaacagcaaaggaatggacccatatgtatgctagtggagcctaacacaggtatcatgttttttttttctctcaagaaaataatatgtataattagatattttaattcacaatttccattagggataaaagttttattttatttcgagataaattactctcatgttatatttttcattgggtggaacaaaggaaaattgtaattttttatttgttagacattggttggttgtatgcgatgtttgataacctctgaacgaatcaaaaacctcttaacggtttaagaaccctaccttttcttaaccattcggttggaatcatt

SEQ ID NO: 1565 - DNA, 826 bp, Lotus japonicus
gttgttgttttgtgttagtgagagaaagcttgttctctctctcttgactctaaaccctattgcgtgctttgtaatcgaccacgataatggcgaacagtaacctccctcgaagaatcatcaaggaaacgcagcgtttgctcagtgagccagcgcctggaattagtgcttccccttcggaagaaaatatgcgatatttcaacgtgatgatccttggcccgtcacagtccccttatgaagggggtgttttcaagctagaactatttttgccagaagaatatccaatggctgctccgaaggttaggtttctgacaaaaatataccatccaaacatcgataagcttggcaggatatgtcttgatattctgaaagataagtggagtcctgcacttcagattcgtactgtacttttgagtattcaagctcttttaagtgcgcctaaccctgatgatccactttctgagaacattgccaagcattggaaatctaatgaggccgaggctgttgaaacagccaaagaatggacccgattatatgccagtggcgcctgatgatttggtggaagatcttggcctcaaataactgtagtggagtgtatgctattaactgtcgaattgaaaatggaaatttagaggaattgtctgaactgttctggagtcaatattcctcatagcttctggttacctatttattacttttttttccaggaagcattatcttggaacatgtattaatatgtgatcttgtgtcaaaaatttagaaattgctccatcttaaactgctaaatgtaatttggattctcaacttataaaatcatataacttacctg

SEQ ID NO: 1566 - DNA, 824 bp, Mimulus guttatus
aagtttctctgaacggtaatcattccccattttctagagagagagaaaaaagaaaaaagaaaaacccttttattagcgtaaactctccgacgaagaacaacacaggaaacggaaaaagcttcgcaaaatcaattcaatggctaacagcaatttaccgcgtcggatcattaaggaaacgcagcgtcttctgagcgaaccagcaccaggaataagtgcatctccgtcagaagaaaatatgcggtatttcaatgttatgattcttggtccaacacagtccccttatgaaggcggtgtttttaagctggagttgtttttacctgaggaatacccaatggctgctccaaaggttcgcttcctcactaaaatctaccacccgaacatcgacaagcttggaagaatatgcctagatattctcaaggacaaatggagtcctgctcttcaaattagaaccgtacttttgagcattcaagcacttcttagtgctccaaatcccgacgacccactttctgaaaacatcgccaaacattggaaatcaaacgaggctgaagctgttgaaacagctaaagagtggacgcgtttatacgcaagtggtgcgtgaaattacgtggaaattcggggtttcgttcggtaactaaaaaaattgtatttgcatctcgtttaaatgaaatattcggaagaatgatggtcaagaccattggaatttactgtactactaagcattactacttgttttcgtgttttgaactgtctttggaaaatgtgcattaatataaaggcacttactggtataaaactgtcgattattgctagcttctttttttttt

SEQ ID NO: 1567 - DNA, 949 bp, Tropaeolum majus
tctccggttacttcagcggccgggggattagagcaagcaaaaagtatcttcttccaaagtcattctctctagctaaagaaggcggatcttcctctctgaaaaaccctaactggattggcctgctctcaatctacctcaacaatggcaaacagtaatctgcctcgaagaatcatcaaggaaactcaacgcctcctgagtgagccagctcctggaataagtgcctctccatcggaggagaacatgcgatattttaacgtgatgatacttggtcctactcaatcaccttacgaaggtggtgttttcaagttggagttatttcttcctgaagaatatcctatggctgctcctaaggttcgatttctaaccaagatataccatcctaacattgacaagcttgggaggatatgcctagatattctgaaggataagtggagccctgctctccagatcagaactgtgcttttgagtattcaagcactactaagtgctccaaatccagatgatcctctttctgagaacgttgctaagcactggaaaagtaacgaagttgaagcggtggaaacagcaaaggaatggacccgtttgtatgcaagtggtgcataatatcgactggcccaaaaagaaagtcatcttaaataacatgaaaatgaaatgtatggtgtaatcaaaaagccaatttgaaatgcaaaatgggaagaacatttgaaccattggatttttcccaaagcttccagtttagagcctgttgaatcgttttatgctgtcggaagccttgtgattgaacatgtatcataaagatattgaatggtaaatcatcaaacgcaattaaaaaaccaaagtattatgtgaaatgtgtgaatagttttctgttttccccctcattggtttccttgcagaatgctccaacttatcatgtggatttgaatctttgatgcatcataattgtatt

SEQ ID NO: 1568 - DNA, 831 bp, Capsicum annuum
gagtgaaaaatctgtcaaaatccattttctactttctctctctaaaaaaaaataatccaatcgattcaattttcaatggcgaacagcaatcttcctcgaagaattattaaggaaacgcaacgtctactaagtgaacctgccccaggaataagtgcttctccctcggaagaaaatatgcgatattttaatgtcatgattcttggtccaacacagtctccttatgaaggaggtgttttcaaactggaactctttttgcctgaagagtacccaatggctgcgccaaaggttcgattcctcaccaaaatctaccatccgaatattgataagcttggaaggatatgcctcgatattctcaaagacaagtggagccctgctcttcagattcgtaccgttctcttgagcattcaagcacttttgagtgctccaaatccagatgatccactttcggagaacatcgcgaagcactggaagtcaaatgaggctgaagctgttgaaacagctaaagaatggacgcgtctttatgctagtggtgcctgaaggcattattaagtgattttgacaaagaaaaaagcgaaaaatctgtggaatgccattgtaattcactgtctaatcagaacgggacttgggaggaccgaaagctgaatgcttcgacttaccatctataattgtttccctgtcctcgaaattgtataattaaaacgttgcacctttgctttttcagagttgaatcggtctttcactttgagaccagaagaattatctcacagaacactgaattggaaggctaacatttgttgtggactgtgagtcagtcatgaatttaacaaaatt

SEQ ID NO: 1569 - DNA, 1071 bp, Lippia dulcis
agaaaacaaagaaaggatctcactgttgcgtaaactccccaactagagagagagaggagagcagatccaatcgtcatggcgaacagcaatctaccgcgcagaatcatcaaggaaacccagcgtcttcttagcgaaccagccccaggaataagtgcctcgccttctgaagaaaatatgcgatatttcaatgtaatgattcttggtccgacacaatctccgtatgaaggaggtgtttttaagctggagttatttttaccagaagaatacccaatggctgccccaaaggtgcgcttcctaacaaaaatttatcacccaaacattgacaagcttggaagaatatgcctggacattcttaaagacaaatggagtcctgcacttcagataagaactgtacttttgagcattcaagcacttttaagtgctccaaatcccgatgatccgctctcagaaaatattgcgaagcattggaaatcaaatgaggctgaagctgtcgaaacagctaaagaatggacacgtttatatgcaagtggtgcgtgaagtaaccatggaaaactcgggattcccaagcaataacctgattgtatcctattgacctcaattggaatggaaaattcgaagaatgattttgctcaaaactagagaatgtaatactcgtttcctgttctaaactgctgctcaaaatgtataatgaattacgatatacttgttacataccgtgatctgtgagagttacgaacactatcttgcttctagaattcgaagattgtctactagcttatattggcctacagcagagtaccgatttgatcggatggaacgataattttgtttggaagtacgccttgtccgtcaacaactcggaaattctcggccatttttaggccagtcgaaccagaaaaaatgtcgatctaagttgcacgaggaaatgtggccccatattgagacacccttgctttaccttctttttttgttaatgagacttgtatggaatgatatttgcttggctcctacatgctattttttagggtgtattgcacatgttgtttaatactcctatctgtcccaaggtaa

SEQ ID NO: 1570 - DNA, 910 bp, Cajanus cajan
gcttggaaataaagttttcaatctctctccgttcatatctctgttagtgaaagaatctctctctgtttggaaaccctattgcactttttgcaatcgaacgaactcgataatggcgaacagcaacctccctcggagaatcatcaaggaaacacagcgattgctcagtgagccagctccgggaattagtgcttccccttctgaagaaaacatgcgatatttcaatgtgatgatccttgggccgacccaatcaccttatgaaggtggagttttcaagttagaactatttttgccagaagaatatccgatggctgctccaaaggtcaggtttctaacaaaaatatatcatccgaacatcgataagcttggcaggatatgcttggatattcttaaagataagtggagtcctgcccttcagatacgcactgttctactaagcattcaagctctattgagtgcaccaaacccagatgatccactttctgagaacattgccaaacattggaaatctaatgaggccgaggctgtcgagacagcaaaggaatggacccgattgtatgctagtggcgcctgatgattggtttcaaacttatggctccaaataacaattgtaatcatcattttatattgaaaatttggagaaattcatgtatcaactatgggagttaatattcctcgtagcttccagttacctgttaatttcttcccttggaagctgcgttatcttgaaacttgtatgaatgtgatcatttatctgtcaaacaatttggaacgtgcttcaatcatcaaacttgtatgaatgtgatcatttatctgtcaaacaatttggaacgtgcttcaatcatcgtctgtgaagtaatttgttattcacaaacatcaaaggcctaaatttgtgaattagtttctgttcttt

SEQ ID NO: 1571 - DNA, 913 bp, Raphanus sativus
ggagcgtttgaccaacgcgtacgaaaagatttgaagggcatctcggaaaaaagccttttattttattttaaaaaaagagttcgtaaacattgtctgaaagtatatcaacgagacaagagacgaagaagctcgttctctctcaaaaaaaacctaaattctctgagagatcgatcaaatcggatagcacgcaataatggccaatagtaatcttccacgaaggatcatcaaggaaactcaacgtctgcttagtgaacctgctcctgggataagtgcgtctccatcagaggaaaatatgcgctacttcaatgttatgattcttggtcctacccagtctccttatgaaggaggcgttttcaagttggagctctttttgcctgaagaatatccgatggcagctcccaaggttaggtttctcaccaagatataccatcctaacattgacaagcttggaagaatctgccttgacatactgaaagacaagtggagtcctgctctacaaataaggaccgtgctcttgagtattcaagctcttctaagtgcaccaaacccagatgatcccctctctgagaacatagctaagcactggaaaagcaatgaagcagaagctgtggagacagctaaggagtggactcgtctatatgcaagtggcgcttgatatagagtgcaaaaaggagaaagttccttgtcattttaaataacaatctatctggtgaaacactcttatctcaaggttttatctagaatcctttttttttctaaaacaggaaagaaaaagatttgtactctatgaatatgtataacttgggtggggatttaagactcgtttgcccatatttgcaaactaacttatgagctttgtctgtgttgttctattatcatttgctcactgtagacaataagatttcactttcca

SEQ ID NO: 1572 - DNA, 769 bp, Raphanus sativus
  misc_feature (32)..(32): n is a, c, g, or t
gagacgacaaagcgttctcgataaccaccgtncgtctcgagctttaccttccttctctctcaaaaaccctaaaaaaaatcatctctggagatcgatcgatcgaatccgttagtaatggcgaatagcaatcttccgcgaagaatcatcaaggaaactcaacgtctacttagtgaacctgctccggggataagcgcgtctccgtcagaggaaaatatgcgttatttcaatgtcatgatccttggtcctacccagtctccttatgaaggaggagttttcaagttggagctctttttgcctgaagaataccctatggcagctcccaaagttaggtttctcaccaagatataccatcctaacattgacaagctcggaaggatctgccttgacatactgaaagacaagtggagtcctgcgcttcaaataagaactgtcctcttgagtattcaagctctcctaagtgcaccaaacccagatgatccactgtctgagaacatagctaagcattggaagagtaatgaagcagaagccgtggagacagctaaggagtggactcgtctatatgcaagtggcgcttgatgatggagtgcaaaaggagaacgatcgttgtcatttaaataacattatatatggtgaaactctttaaggttttatctgaatcttttttctttaaaaaaagaactggggaaaaagatttgtactctctgaatcttctttgtataactagaagaattgaaagactcgtttatccatgcaaactaacgttcttcaa

SEQ ID NO: 1573 - DNA, 751 bp, Raphanus sativus
aaccaccgtgcgtctcgacctttaccttccttctttctttctctctctctcaaaaaccctaaattcttctcaggagatcgatcgaatccgttagtaatggcgaatagcaatcttccgcgaagaatcatcaaggaaactcaacgtctacttagtgaacctgcgccggggataagcgcgtctccgtcagaggaaaatatgcgttatttcaatgtcatgatccttggtcctacccagtctccttatgaaggaggagttttcaagttggagctctttttgcctgaagaataccctatggcagctcctaaagttaggtttctcaccaagatataccatcctaacattgacaagctcggaaggatctgccttgacatactgaaagacaagtggagtcctgcgcttcaaataagaactgtcctcttgagcattcaagctcttctaagtgcaccaaacccagatgatccactgtctgagaacatagctaagcattggaagagtaatgaagcagaagccgtggagacagctaaggagtggactcgtctatatgcaagtggcgcttgatgatggagtgcaaaaggagaacgatcgttgtcatttaaataacattatatatggtgaaactcttaaggttttcttatctgaatcctttttcttaaaaagaaaaaactggggaaaaagatttgtactctctgaatcttctttgtataactaaagaattgaagactcgtttatccatgcaaactaacgttctcca

SEQ ID NO: 1574 - DNA, 743 bp, Raphanus sativus
aaccaccgtgcgtctcgacctttaccttccttctttctttctctctcaaaaaccctaaattcttctcaggagatcgatcgaatccgttagtaatggcgaatagcaatcttccgcgaagaatcatcaaggaaactcaacgtctacttagtgaacctgctccggggataagtgcgtctccgtcagaggaaaatatgcgttatttcaatgtcatgatccttggtcctacccagtctccttatgaaggaggagttttcaagttggagctctttttgcctgaagaataccctatggcagctcctaaagttaggtttctcaccaagatataccatcctaacattgacaagctcggaaggatctgccttgacatactgaaagacaagtggagtcctgcgcttcaaataagaactgtgctcttgagtattcaagctcttctaagtgcaccaaacccagacgatccactctctgagaacatagctaagcattggaagagtaatgaagcagaagccgtggagacagctaaggagtggactcgtctatatgcaagtggcgcttgatgatggagtcgcaaaaggagaacgatcgttgtcatttaaataacattatatatggtgaaactctttaaggttttatctgaatcctttttcttaaaaaaaaaactggggaaaaagatttgtactctctgaatcttctttgtataactagaagaatttaagactcgtttatccatgcaatctaacgttctt

SEQ ID NO: 1575 - DNA, 863 bp, Raphanus sativus
  misc_feature (712)..(712): n is a, c, g, or t
  misc_feature (784)..(784): n is a, c, g, or t
atatcaacgagacgagagacgaaaaagcctctttagctagctccgttctctatcaaaaaaaaaaaagaaaacctaaattctctgagagatcgatcaaatcggatagcacgcaataatggccaatagtaatcttccacgaaggatcatcaaggaaacacaacgtctgcttagtgaacctgctcccgggataagtgcctctccgtctgaggaaaatatgcgctacttcaatgttatgattcttggtcctacccagtctccttatgaaggaggcgttttcaagttggagctctttttgcctgaagaatatccgatggcagctcccaaggttaggtttctcaccaagatataccatcctaacattgacaagcttggaagaatctgccttgacatactgaaagacaagtggagtcctgctctccaaataaggaccgtgctcttgagtattcaagcccttctaagtgcaccaaacccagatgatcccctctctgagaacatagctaagcactggaaaagcaatgaagcagaagctgtggagacagctaaggagtggactcgtctatatgcaagtggcgcttgatatagagtgcaaaaaggagaaagttccttgtcattttaaataacaatctatctggtgaaacactctcatctcaaggttttatctagaatcctttttttttctaaaacaggaaagaaaaagatttgtactctatgnatatgtataacttgggtgggtatttaagactcgtttgcccatatttgcaaactaacttatgagctttgtctntgttgttctattatcatttgctcactgtagacaataagatttcacttttcacaggctgtggataaaggtaaatttgaca

SEQ ID NO: 1576 - DNA, 817 bp, Raphanus sativus
gggacattttccgaaaaagaaaaaaataggggaaaaagaataaaaaggagacgagacgacgaggaagcgttctcaataaccaccgtgcgtctcgacctttaccctccttctctctctctcaaaaaccctaaattcttctttgaagatcgatcgaatccgttaataatggcgaatagcaatcttccgcgaagaatcatcaaggaaactcagcgtctacttagtgaacctgctccggggataagtgcgtctccgtcagaggaaaatatgcgttatttcaatgtcatgatccttggtcctacccagtctccttatgaaggaggagttttcaagttggagctctttttgcctgaagaataccctatggctgctcccaaagttaggtttctcaccaagatataccatcctaacattgacaagctcggaaggatctgccttgacatactgaaagacaagtggagtcctgcgcttcaaataagaactgtcctcttgagtattcaagctcttctaagtgcaccaaacccagatgatccactgtctgagaacatagctaagcattggaagagtaatgaagcagaagccgtggagacagctaaggagtggactcgtctatatgcaagtggcgcttgatgatggagtgcaaaaggagaacgatcgttgtcatttaaataacattatatatgctgaaactcttaaggttttatctgaatcctttttcttataaaaaaaactggggaaaaagatttgtactctctgaatcttctttgtataactagaagaattgaagactcgtttatccatgcaatctaacgttcttcaa

SEQ ID NO: 1577 - DNA, 781 bp, Raphanus sativus
tctcgataaccaccgtgcgtctcgacctttaccttccttctctctctctcaaaaaccctaaattcttctttgaagatcgatcgaatccgttaataatggcgaatagcaatcttccgcgaagaatcatcaaggaaactcagcgtctacttagtgaacctgctccggggataagtgcgtctccgtcagaggaaaatatgcgttatttcaatgtcatgatccttggtcctacccagtctccttatgaaggaggtgttttcaagctggagctctttttgcctgaagaataccctatggcagctcccaaagttaggtttctcaccaagatataccatcctaacattgacaagctcggaaggatctgccttgacatactgaaagacaagtggagtcctgcgcttcaaataagaactgtgctcttgagtattcaagctctcctaagtgcaccaaacccagatgatccactgtctgagaacatagctaagcattggaagagtaatgaagcagaagccgtggagacagctaaggagtggactcgtctatatgcaagtggcgcttgatgatggagtcgcaaaaggagaacgatcgttgtcatttaaataacattatatatggtgaaactctttaaggttattttatctgaatcctttttcttaaaaaaaaactgggaaaaagatttgtactctctgaatcttctttgtataactagaagaattgaagactcgtttatccatgcaaactaacgttcttcaaataatgctttggcttgatcaaaaaaaaaaaa

SEQ ID NO: 1578 - DNA, 664 bp, Senecio madagascariensis
ctctagattacatttttctctctctagattccatggcgaacagcaacctacctcgacggatcatcaaggaaacacagcgtttacttagcgaaccagcaccggggataagtgcgtcgccgtcggaagataatatgcggtattttaatgtcatgattcttggtccatcacaatctccttatgaaggaggagtcttcaagttggagttatttttgcccgaggaatatccaatggctgcccccaaggtccgtttccttacaaagatataccatccgaacattgataagcttggcagaatatgtcttgatatcctaaaagacaaatggagccctgctcttcagattcgcaccgtactccttagcattcaagcacttttgagtgctccgaacccagatgatccgttgtcagaaaacgtagcgaaacattggaaatcaaatgaagcagaagcagtggaaacagcaaaggaatggacgcgtttgtatgcaagtggcgcttaactaaagaaaacaaagtaacaaaaatgtatttctataacataatattccatgtcttgattattctcttcactttcaaaccctgttttctttttcattcgaatatatgattattgtatcttttatcatgtggggtttcggaagaaggaagagccaaccaagcgcttttcacg

SEQ ID NO: 1579 - DNA, 1218 bp, Saccharum officinarum
cctcccccgacccacaccgattgacggctcctttgaccccttcggtcgtctggtctcatctacctccccagcgccgcgcgaagcttgaggcaatccccgccccctccccctgcgcaatcatcagtccggttccatggccaacagcaacctcccgcgccgaatcatcaaggagacgcagcggctcctcagcgaaccagcgccagggattagcgcgtcgccgtcggaggagaacatgcggtacttcaatgtcatgatccttggccccgcacagtcaccctatgaaggtggagttttcaagcttgaactattcttgcctgaggaatatccaatggctgccccgaaagttagatttctcaccaaaatttaccatcccaacattgacaagcttggtaggatatgcctcgacattcttaaggacaaatggagtccggctcttcagatacgtacagttctgctgagcattcaggcacttctgagcgccccaaatccagatgatcctctctcagacaacattgcgaaacactggaaatccaatgaagctgaagctgttgagacagcgaaggagtggactcgcctgtatgcaagtggggcatgacaaccaagtgttgattcagatggaataacactttcatggtttggggccgattgaataccccttttgcttgatgagagcaaatttgtgaaatgttgcaatggggtcaaaacatgttcgcgaatcgtgctttgtacttgtggctgtagctccattcgctgcagtgcccgtaagcatcaaagcaggtgttgctttgtctgttcgactgttcctatctgaccatcagttgcatatccctcgtgtcccatctgttgtgctctgaggattgagattcatgctgccggatagctgctagcttgttcttaacttctttactcgggagtactgaaactgcctaggctacctcggcgaaccatggtttagtatggttagtttggaggccgttttgccatgatatctcaacactctggaggagctcgttaagggcttaatcagttaatccccttccatagtggggattggaggggatgaggcgaattttgatttgtagggagattcaattctcttcaattcccggtaaactgaacaaggccctataagtttggcatgcattggtttcttttctcgtttgggacgaatatctggtctaggccttgatcaacgcattgggcctgatgtatcttggt

SEQ ID NO: 1580 - DNA, 883 bp, Eutrema halophilum
gtgtcctgcgtagaatttttaaggcagagaaaggaaatcggaattaatatcatcgaggagcacgtcagattcgacagacgactaaagtgttctcgattatcggcgttcggattctctctctctttctcaaaaaccctaactctcttagtttcgatcgaaatcggcagcgcgcgagaatggccaatagtaatttgccccgaagaatcatcaaggaaactcaacgtctgcttagcgaaccggctcccggtataagcgcctctccatctgaggataatatgcggtatttcaacgttatggttcttggtcctacacaatcaccttatgaaggaggagttttcaagttggagctctttttgcctgaagaataccctatggcagctcccaaggttaggtttctcaccaagatataccatcctaacattgataagctcggaagaatctgtcttgatattctgaaagacaaatggagccctgcactacaaatacgtacagtgctcttaagtattcaagctcttctgagtgcaccaaaccctgatgatccgctgtctgagaacatcgctaagcattggaagagtaatgaggcagaagctgtggagacagcgaaggaatggacccgtctttacgcaagcggggcatgatggattggagggtgaaaaggtctctttcatccaaataacattacatctgatgaaatctatcccaagatcaaagttataagaaagcttatattttggtggttcgtccccgtcattatgataaaaatgtgttttcgtcacagggagctgtaatctctctgaatgcttgtatcattactaatagggtcaagactctgcccgtatttgaaattcgtcaaatttcgttgaattaaaagatctcctctgct

SEQ ID NO: 1581 - DNA, 1012 bp, Eutrema parvulum
aaaagaattaaaagcatcaaggggcacgagacgagagacgacgtagcgtcttcgattatcaccaccgcccgtcctttgctagcttcattctctctcaaaaaccctaaattctctcagatcgatcaaatccgatagctcgcgataatggcgaatagtaatcttcctcgaagaatcatcaaggaaactcaacgtctacttagtgagccggctccggggataagtgcatctccgtcagaggaaaatatgcgctatttcaatgttatgattcttggtcctacacaatctccttatgaaggaggagttttcaagttggagctctttttgcctgaagaatatcctatggcagcccccaaggttaggtttctcaccaagatataccatcctaacattgacaagcttggaagaatctgccttgacatactgaaagacaagtggagtcctgctctacaaataagaactgtgctcttgagtattcaagctcttctaagtgcaccaaacccagatgatccactttctgagaacatagctaagcattggaagagtaatgaagcagaagctgtggagacagctaaggagtggactcgtctatatgcaagtggcgcttgatggagagtgcaaaaggagaaagatcattgttatttaaataacattatatatggcgaaactctatctcaaggttttatctaaaatttttttttctaaaacagggaaaaaagatttgtacgctcggaatctgtataactagggtggtttaagactcgtttacccatatttgcaaactaactttcttcaaatgtgcttgcgcttgagctttgattgtgttaaagatcctctctaatcattgaaataatatagatcataaggattcacaggttgtgggtgaagataaatctgataaatgattgacgtagagaagtgttactattacagatgtatgagaaggcagcttattttggtcaaatgtaaaaaaacgaaaaagttgtaaaaagcagtcatatggaatgagatttca

SEQ ID NO: 1582 - DNA, 893 bp, Eutrema parvulum
tgtccaatgtagaattttaaaggtagagaaaggaaatcgaattaaaaaaatcatcgaggatcacgtcagattccacagacgacgaagtgttctcgattatcggcttgcggaccttctctctctccccctctctcaaaaaccctaactgcgatcgatcggattcgtcagcgcgagataatggccaacagtaatctgcctcgaagaatcatcaaggaaactcaacgtctgctcagcgaaccagctcccggtattagtgcctctccatctgaggataacatgcggtatttcaacgttatggttcttggtcctacacaatcaccgtatgaaggaggagttttcaagttggagctctttttgcctgaagaataccctatggcagctcccaaggttaggtttctcaccaagatataccaccccaacattgataagcttggaagaatctgtcttgatattctcaaagacaaatggagccctgctctacaaatacgaacagtgctcttaagtattcaagctcttctgagtgcaccaaaccccgatgatccgttgtctgagaacatcgcaaagcattggaagagtaatgaggcagaagctgtggagactgccaaggaatggacccgtctttacgcaagcggcgcatgatggatcggaggctgaaaaggtctctttcatcgaaataacattacgtttgctgaaatctccctcaacatcaaagttataaaaaaagcttatattttgctggttctcccccctcattatgataaaaatgtgttctccgcacaggaagctgtaatatctctgaattattgtatgattactaatagggtcaagactcgtttacccatatttcaaatttcgtcaagtttatttaaataaaaaaaatctcgttctctact

SEQ ID NO: 1583 - DNA, 853 bp, Nicotiana tabacum
ggaaccctattaagcacaggtttttagtgagagaaagagtgtgaaactctcttaccatttctactttctctctctagaaaaaacgagccacttagcgtaaactttctgcgaccaaaaaaaaaaaaacttcgattcaattcaatggccaacagcaatcttcctcgaagaattattaaggaaactcaacgtcttctcagcgagcccgcgccgggaataagtgcatctccttcggaagaaaatatgcgatacttcaatgtcatgattcttggtccaacacaatctccttatgaaggaggtgttttcaaactggaactctttttgcctgaagagtacccaatggctgctccgaaggttcgatttctcaccaaaatatatcatcccaacattgataagcttggtaggatatgccttgatattcttaaggacaagtggagtcctgctcttcagattcgtaccgttcttttgagcattcaagctcttctgagtgcaccaaatccagatgatccactctctgagaatattgcgaagcactggaagtcgaatgaggctgaagctgttgaaacggctaaagaatggacacgtctgtatgcgagcggtgcgtgaaagtgcacgttaaatgatgttgaaaagaaaaagaaaaaagatgtggaatatattttatgcactgcctaatcagaatgggaaatgggagaaccgaaagctgaatgctccaaattacatctataatatttttcttacccttgaaattgtataatcaaatcttgcaccttttttttcaagttgaagaaagtctctttactatgaagtaaaagaactatcatatgtaagactagttaattccttgttccaatcc

SEQ ID NO: 1584 - DNA, 822 bp, Nicotiana tabacum
ttcgattcaattcaatggctaatagcaatcttcctcgaagaattattaaggaaactcaacgtcttctcagcgaacccgcgccgggaataagtgcatctccttcggaagaaaatatgcgatacttcaatgtcatgattcttggtccaacacaatctccttatgaaggaggtgttttcaaactggaactctttttgcctgaagagtacccaatggctgctccgaaggttcgatttctcaccaaaatataccatcccaacattgataagcttggtaggatatgccttgatattcttaaggacaagtggagtcctgctcttcagattcgtaccgttcttttgagcattcaagcacttttgagtgcaccaaacccagatgatccactctctgagaacattgcgaagcattggaagtcgaatgaggctgaagctgttgaaacagctaaagaatggacacgcctgtatgcgagcggtgcctgaaccggcacgactaagtgattttgaaaagaaaaagaaaaaagatgtggaatgtaatttatcaacggtctaatcaggggacttgggaggactgaaagctaaatgcttcagattaccatctataatattttccctacccttgaaattgtataatcaaatattgcaccttttttttttcaagttgaagaaagtttttactatgagaacagaaacggttctgaagtgaaagaagtatcatatgagagactagttatttccttgttgcaatcctgaaactggaggattggtgctgcagcaaatatttatctgcattattaagggttaatcatgttctgatttccaactgctg

SEQ ID NO: 1585 - DNA, 1099 bp, Solanum lycopersicum
gagaaacagtgcttctgaaactcccaatccatttttctactttctctctctagaaaaagtgcgttttagcttaaattttctgcgaaccaactttttttttcaatcgattcaatttcaatggctaacagcaatcttcctcgaagaatcatcaaggaaactcagcgtcttctaagtgaacctgcaccaggaataagtgcttctccctcagaagaaaatatgcgatattttaatgtcatgattcttggtccaacgcagtctccttatgaaggaggtgttttcaaactggaactctttttgcctgaagagtacccaatggccgctccaaaggttcgattcctcaccaaaatctatcatccgaatattgataagcttggaaggatatgccttgatattctgaaggacaagtggagtcctgctcttcagattcgtaccgttcttttgagcattcaagcacttttgagtgctccaaacccagacgatccactctctgagaacattgcaaagcactggaagtcaaacgaggctgaagctgttgaaaccgctaaagaatggacacgtctttatgcaagtggtgcctgaagaccataaattagtgaaaaaaaaacccgtggaatgttatcgatccactgttaaatccgaatgggacttgggaggactgaagctgaacgctttgaattacccatctaaaattgtttccctgtccttgaaattgtacaattgaacgatgcacctttttttcaagttgaattggtctttacttctagaccagaaatggttctaaagtattatctcacagatcactgaattggaggacaacgtttgttgcgtgagcaggttgctttctccacttctctttttgaaccaagggtctatcggaaatcacctctctacctacccccataaaggtaggtaggggtaaggctttgtgtacatcttatcctctcaaacctaacttgtggggttacatgtgctcccgttgtcatctaaagctcatgtacttccttgacaagacttgcccatagcttcttgaaaagtatcatgcgtttcgctttagatgttatcatcttcagttcaatcttataatattagtttgtgtcat

SEQ ID NO: 1586 - DNA, 940 bp, Triphysaria pusilla
gaaattccgccattagggacggagaaaatcttcgcactacacgggaccattccccattttatagtgagataaacatatttagaaaagcaaaacccttttgttagcgtaaaatctccgaacagaggacccgtgggaagaaattcagggaaacagcttcgcaaatccgattcaatggccaacagcaacttaccgcgtaggatcatcaaggagacacagcgtcttctgagtgaaccagcaccaggaataagtgcatccccatcagaagaaaatatgcgatatttcaatgttatgattcttggcccaagtcaatctccttatgaaggaggtgtttttaagctggagttgtttttacctgaggaataccccatggctgccccaaaggttcgcttcctcaccaagatttaccaccctaacattgacaagcttggaaggatatgcctagatattcttaaggacaaatggagtccggctcttcagattagaactgttcttttgagtatacaagcacttttgagtgctccaaatcctgatgaccctctctctgaaaacgttgcaaagcattggaaatctaacgagtctgaagctgtggaaacagctaaagagtggacgcgtttatacgcgagtggtgcttgagtaagcatggaacattggcttacttttattgtattctattgtcgtctggcaagtaaaacgtggaaaagttggaaggacgactctctatagggattgtgttttcaactgctcgtttttgttttagactgttcttaaatgtgtgtcagatgatatatatatatgcacttgtgttatggaattattgattttacaactttgaagcttgcaattcgcttggatttggctctgtatatcttgtcagttttgggtttaacccaaagttaggccctgcttgggttgatcttattaaaggagtttatacattaag

SEQ ID NO: 1587 - DNA, 1246 bp, Brachypodium distachyon
aaacctgcactgatcctatcgcagggttctgtagcatggaataaagccatggaagcaaacccgcgtccgtgcgtataatagcgagcatccatccatctccaccgcctacccccgtaccctgttccccatctcggctgacggctcctgcgcctctcccgcacggaacttaaagcatctccggcgccgcgctcaccggagggagaaacccgcgccccggcccgatccgatggccaacagcaacctcccgcgacgaatcatcaaggagacgcagagacttctcagcgagccagcgccgggtatcagtgcgtcgccctcggaggaaaacatgcgctacttcaacgtcatgatccttgggccggcgcagtcgccctacgaaggtggagtttttaagctggaactcttcttgcctgaggaatatccgatggctgcaccaaaggttaggttcctgaccaaaatataccatcccaacattgacaagcttggtaggatatgccttgacattctgaaggacaaatggagtccggctcttcagatccgaacagttcttctaagtatccaggcactcctaagtgcaccaaatccagatgaccctctctctgataacattgcgaagcactggaaatccaatgaggcagaagctgttgaaacagcaacgcagagtggactcgtctgtatgcgagtggcgcatgaacccaacactgctcttgatgtaataactcatcatactttagctggtaatgaagtgccattcgcttgataagaacatacaggagatatttgcaatgaaaagatcttaatgactaccactatttggttgtacacctgtggttggttccctttaccctggggcacctttgactaatcagtatctgtggtagaacttcctgctactccagtatattaattactctatgtaggggaacttaacaagtgtgctcttgaaattgaagctggtttgtttggctgttgattttgttgttcctcttttcctgccattggggaatttttctgccaaatcttactccctccgttcatgttaattggcacaaatttagtacaatccgtgccaattatggaacggagggagtagttgaatatgtggcgatgtttcctgagactgcatctgatactcttttatcttactagttgcgttagtcactttttgcaggttcacggcccttagcttgtttctcaaggtggccgttttattttttgacttgaaagtgaaatcttttatcatctggcc

SEQ ID NO: 1588 - DNA, 1881 bp, Centaurea maculosa
aacgatgcttttcagacgtaaaaacgtgccaatttaaaccttcgatgggtgatcgccaatggtttatccatttctctattgattttccaaacagtagtagtagtagttaaagggtgttattaactctacttgttatttagatttaggtttagatcgaaaatgagaagaccacaaatagtattatttggggattcaatcacagagcaatccttcagatatggcggatggggtgcttctcttactgatacctactctcgcaaggcggatatagtggttagaggatatggtggatacaacactcgttgggctttgttcttattgcatcacattttccctctggattctaccactcctcctgccgccgctaccattttcttgggggcgaacgatgccgcacttccaggaaggtcgagcgaacgtcaatatgttcctcttgaagaatacaaagagaatttgagaaaaatggttcgtcatttaaaggaatgctccccgaccatgctaattgtgcttataactcccccgccaattgacgaagaagggcgcaaagaatatgcaacatctttatatggcgaaaaagcgatgaaacttcccgaaaggacaaatgaagtcacgggaacttacgccaatggatgtgtggaggttgccaaggaactcggtgttttttccgtcaacttatggtccaagatgcaagaaacacagggttggcagaaaaaatttctaagtgatggactgcatctaacaccagatggaaatggagttgtttatgaagaagttgtaaaggcattcaaaggggcttggctttcggctaccgaaatgccttctgatttccctcaccattcggagatcgatccgcaaaaccctgaaaaggtttttcagcaaagatgcttgtaaaccacatctctgcaatttaagatataggaaatgtaatgcatacatcttatgattttcagacctttttctatgtggggtggtattaccgagttttatggttttaatgcagctatgaatcattttattttacttttcatcacaagaatgttataagatatgcttggtgtaaggtatattaccttttttaacttatccgaatttagtttatagcctaaaatgttttacttaaaaagaaaacagcgagttacttatgaaaaaaaacacaagtaagggtatgaaggaagtgaacaacattgatcgttcggttcagcagtagaatcattcaagttttcaatctcaagacctaatcaagtacattgttattttctttttcattcattccgatcaacactcatcttccacatctcggttaagcaccactagcatacaaacgggtccattcctttgctgtttcaacagcttcagcttcattagatttccagtgcttcgctatattctcagagagaggatcatctgggtttggagcacttagaagagcttgaatgctcaggagtacagtgcggatctgaagagcagggctccatttgtctttgagaatatcaaggcaaatcctaccaagcttgtcaatgtttggatggtatatttttgtaagaaaccgaaccttgggagcagccattggatattcttctggcagaaataactccagcttgaaaactcctccttcataaggagactgtgttggaccaaggatcatgacattaaagtaccgcatgttatcttccgatggcgatgcgcttatccccggagctggttcgctgagtaagcgctgagtttccttgataattctgcgagggagattgctgttcgccatggaaggggaagatttacgctaagggcgcttttgcctttttttagagagagaaagagggttttctagagagagaaagtgaatgggaagattacggattttgagaactttcttctctctat

SEQ ID NO: 1589 - DNA, 2399 bp, Cirsium arvense
acccataaccataatgacaaagctcatggttcagtctcaacctcatttcctcttgctaacctttccaacccaaggtcacatcaaccccaccctccagttcgctaaacgactcctccgcctaggcgtcaaagtcaccttcgccacctgcgtttccgcccaccgccgcatgaccaaagctggccagaatattcccgagtctttgaacttcgcggttttctccgatgggtttgatgacggctatgcctatgatgtcaatgactacacttccttcatgaatcaactgaaaacccggggatcacagagcgtgaaagaaaccattctttcatgcgccaatgatggcactcccatcacttgtttggtttacaccctcctccttccgtgggcagcgggggtggcgcgtgaactcaacgtgccatccgcgcttctctggattcaacctgcgtccgtatttcgtatctattactattacttcaaagggtacgataagctcattggagaaggttgcagtgaaccctcatggtcgatcaaattaccagggctaccgttgctcaaaagccgcgatctcccctccttttgcctcccctccaacatgtacgattttgttctgactttattcaaagaacagctacaagtgttggatttggaagacaagcctaagatacttgtaaacagcttcgatgcgttggaagaagaggccttgaaagagattgatgacaagatgaagttgatcgccgtagggccgttgattccatccgctttcgtggatgacgttgatccatctgacaaatcttttggtggagatctctttgaaacatcaacagactatgtggaatggatgaacacgaagccggaagggtccatcgtttacatatcttttggtagcatcataatgttgtcaaagaaacaaaaggaggcgatggcacgtggtttgttagcgagcaagaggccgtttttatgggtggtcagaaataaagatggaaaccgaaaagcacacaatgagggggaaaaagaagaggatgatgaggaagtgagttgcaaagaggaattggaagaattggggaagattgtgccatggtgtagtcaactagaggtgctatcacatccatctttgggttgttttgtgacgcattgcggttggaattcgacgatggagagtatagtttgtgcggttccggtggtcgcatttcctcactggaccgatcagacaacaaacgcgaagctcttggaagacgagtggcggacaggagtgcgggtggcggctaacgaagagggagtggtcgaaggcgatgagatcgcaaggtgcatagagatggtgatgggaggtgaagaaacagaaatgagaaagaatgctaagaaatggaaagatttggcaagagaagcaatgaaggaaagtggatcttcacatatgaatctcaaggcttttgttgaacaagttaatggaagtgtaacttaaaacaaagtgatgatttcaagtacagaatctgaatccaaatctgctgtataaatcctgcattgaatgattggataattctatatagaatatttgtatcaaagtagtgcaagcatatcaaacatatgatatgttgcatatggtgtagaatgtatgcacgtagtctaactaaaaatattaaagttcaacgcagagtcgcagtcggtacttttttcttttttacccataatactacttatgctataacaaaagtaaattaggaaacagagagttacttatcgaaaaaacacaagggtatgacgaaagtgaacaacactgatcgttcagttcagcagtagaatcattcaagttttcaatctcaagacctaatcaagtacattgttattttctttttcattccgaccaacactcatcttccacatttcggttacgcaccactagcatacaaacgggtccattcctttgctgtttcaacagcttcagcttcattagatttccagtgctttgctatgttctcagagagaggatcatctgggtttggagcacttagaagagcttggatgctcaggagtacagtgcgaatctgaagagcagggctccatttgtctttgaggatatcaagacaaatcctaccaagcttgtcaatgttcggatggtaaatctttgtaagaaaccgaaccttgggagcagccattggatattcttccggcagaaataactccagcttgaaaactcctccttcataaggagactgtgttggaccaaggatcatgacattaaaataccgcatgttatcttccgatggcgatgcgcttatccccggagctggttcgctgagtaagcgctgagtttccttgataattctgcgagggagattgctgttcgccatggaaggggaagatttacgctaagggggcttttgccttttttaggtagtagagagagagaa

SEQ ID NO: 1590 - DNA, 662 bp, Gossypium hirsutum
ctcggattctctcttcatctcccaattctcaaaaccctaatttatatttttaattccctttttgattcagcaatcggggcttgccaatggccaacagtaatctccctcgaagaatcatcaaggaaactcagcgtctcctcagtgaacctgctccgggaattagtgcttcaccatcagaggataatatgcgatatttcaatgtgatgatccttggtcccacacagtctccatatgaaggaggggttttcaagttggaactattttttgcctgaagaatatcccatggctgctcccaaggttcgatttcttacaaagatatatcatcctaacattgataagcttgggagaatatgccttgatattctcaaggacaaatggagtccagctctgcagatccgaactgtacttttaagcatccaggcactcttgagtgctccaaatccagatgatccactctccgagaatattgctaagcactggaaatcaaacgaggctgaagctgttgagacagcaaaggaatggacgcgtttatatgcaagcggtgcatgaagaccggtggaaccgtttgctctcataaaataacatttttatgcaatgtgagctattcaatgtcaatttcatatggaaatctggacgaatgacagtttgaaacagtttgatat

SEQ ID NO: 1591 - DNA, 637 bp, Salvia sclarea
ctactagaccttggctgtcactcattagcgtaaaatccccaactcagagagagagagagagagagagagcatcaatggcgaacagcaatttaccgcgcagaatcatcaaggaaacccagcgccttctcagcgaaccacgccccaggaataagtgcttctccttcagaagaaaatatgcggtatttcaatgtaatgattctcggtccaacacaatctccttatgaaggaggtgtttttaagttggagttgtttttacccgaagaatacccaatggctgccccaaaggttcgcttcctaacaaaatttaccatccaaacatcgacaagctcggaagaatttgcctggacattcttaaagacaaatggagtcccgctcttcagattagaactgtacttttgagcattcaagcacttttgagtgctccaaatcctgatgacccgctctcagaaaacattgcaaagcattggaaatcaaacgaggctgaagccgttgaaacagctaaagaatggacacgtttatatgcaagtggtgcatgaagtaatcatggaaaaaacccgggatttccaagaaataacctaattgtatctcctattgactccaatcggtatggaaaatttggtaagaacgattatatgct

SEQ ID NO: 1592 - DNA, 941 bp, Nicotiana benthamiana
ggaaccctattaagcacaggttttagtgagagaaagtgtgtgaagctctattaccattgctactttctctctctagaaaaaacgagccccttagcgtaaagtttctgcgaccaaaaaaaagaggaaaaaaaattcgattcaatccaatggccaacagcaatcttcctcgaagaattattaaggaaactcaacgtcttctcagtgaacccgcgccgggaataagtgcctctccttcggaagaaaatatgcgatacttcaatgtcatgattcttggtccaacacaatctccttatgaaggaggtgttttcaaactggaactctttttgcctgaagagtacccaatggctgctccgaaggttcgatttctcaccaaaatataccatcccaacattgataagcttggtaggatatgccttgatattctcaaggacaagtggagtcctgctcttcagattcgcaccgttcttttgagcattcaagcacttctgagtgcaccaaatccagatgatccactctcagagaacattgcgaagcattggaagtcgaatgaggctgaagctgttgaaacggctaaagaatggacacgcctgtatgcaaccggtgcctgaaacggcatgactaagtgattttgaaaagaaaaagaaaaaagatgtggaatgtaatttatccactgtctaatcaggggacatgggaggactgaaagctaaattaccatctataatattttccctacccttgaaattgtatagtcaaatattgcacctttttattccaagttgaagaaactttttactatgagaacagaaacagttctgaagtgaagtatcacatgagagactagttatttcctttttccaatcctgaaactggaggattgctgctacagcaaatatttatctgcattattagctgctaatcatgttctaattcccaactgctaa

SEQ ID NO: 1593 - DNA, 1146 bp, Nicotiana benthamiana
attgtaccacacgtattttagtgagaaagagttgtcaaattcttaaaactatctccactatctctttctctctctagacaaattaagaacccttagcgtaaactctgcgaccgaagaaccccacccacccaggcagccttcaattcaattccaatggcgaacagcaatcttcctcgccgaattatcaaggaaactcaacggcttctcagcgaacctgcaccaggaataagtgcatctccatcggaagataatatgcgatactttaatgtcatgattcttggtcctacacagtctccttatgaaggaggcgtcttcaagctcgaactctttttgcctgaagagtacccgatggctgctcctaaggttcgattcctcaccaaaatctaccatccgaacattgataagcttggaaggatatgtcttgatattcttaaagacaagtggagtcctgcacttcagatccgtactgtacttttgagcattcaagcacttttgagtgctccaaatccggatgatccactctctgagaatatcgcaaagcactggaagtcaaatgaggctgaagctgttgaaacggctaaggagtggacacgcctatatgcaagtggtgcatgaaggcattagcaacgaaatatttaaaaataacaaaaattatggactgtatcctattgacttgcttatcaatatggatggctgttaatgcctggactcttccgattgcctcccataattgcttccctgtccttgaaattgtattatttaatgtgacatccgttggttttccagtgttcaggaatgaacttacaaaaaaactggatatggttttgagaaaaggataatgtcactgcaagggtagttaatgattcagatctgttgttgggattggaaactaaggttgctgcagctggtatgaacctccatagacttgtttcaagatgatgaatgtgctaacgtataaatcaatgtttgacctgtttctttttattttcatgtttgccctatcctggattgcgtgcgtgggtttgcttgcttgctttttgtttctttttccattcaacgtttttgtcctaccattccaatctagtttgggcacggttagaaacccaaaacaattttttataatactcaacgaagataattcgaaca

SEQ ID NO: 1594 - DNA, 2507 bp, Panicum virgatum
cctgccccctgcggctgcacaggtagaccactacagcaaaaaccgcgtccgcgtacgatagcgagcggccaacgccccaacccgccgcaccccccgttccccacccccgcccgacgcacgactgctcctcctcctccgcgcgatcctcaaggtaccagcggcgccgcaacttcgcagaggaggaagcccgcgcccccggccccggccccgatccgatggccaacagcaacctcccgcgccggatcatcaaggagacgcagcggctgctcagcgagccagcgccggggatcagcgcgtcgccctcggaggagaacatgcgctacttcaacgtcatgatccttggcccggcacagtcgccctatgaaggtggagtttttaagcttgagctctttttacctgaggaatatccaatggctgccccaaaggttagatttctaaccaagatttaccatcccaacattgacaagcttggtaggatatgccttgacattctcaaggacaaatggagcccagcacttcagattcgaacagttcttttgagtatccaggctctcctgagtgcaccaaacccagatgatcctctctcggataacattgcaaaacactggaaagccaatgaggcagaagctgttgaaacagctaaggagtggactcgcctgtatgcgagcggtgcatgacaacccagtgctgtccttgatgtaataacccatcatacttcagtcctaatctattgccatttgcttgatgagaacagactggagatatttgccattgaaggaagtctctaaatgacttgccagtcgaattgtttggttgtacacctacctgtggtcggttccctttaccttgggcacctttgactaatcagtatctgtggtagaacttgccgctactccaatatatttgttacttcatgtaggagagtttctcaactgtccatattgttgaaactgaggcttgttaccttggctgcgcttttgttgctcctctcgtttttgtgctttctcatctggaaaccgcattgctgaggctagggttggacttgcacattctctgcggaattgtacggaaggatatgatttttttttcacaatgctttgatagctttacccacagggattacgtcggtcagtaacaaaaaaaagtctctgaccaatatatttgtagttagtgtcttgatactgatgagatttaaaagccatgaattttgtactcaggtatgcactgaatatatttgttactgaataatattctagagtggtgtgaccttgtgatagccttttttttccatctaagagcatttccaacagattactcatccctctttctaatacaaaaaaattgatgttttagtgataggagatgttcgagtaaattaccacttcaatccctattacctaaaattttcttgtaatcaccaaaatacatcaacctctcacctaaatgaaggagattttccctctactctatttttagtgattggattgtggtagtactgcagcaaccattaccaaaatataaaaatagttattggtggagagtgagagagtatgttttgaaaatatgaagaggatgtttcctctactttattcttggtcattggattgtggtcgtctgctgaagcaaccattaccaaaacataaaagtaattctgcgaggataccatagcctgttagcaagctgcgccgcttcaaaggtggcctttggtcacccccaatgtggcatcatcgtattccttttctcttttaccacctgtgttggatacttggatcccctgatctgtgtggtacctgcttctgggaatggatcgaagtccatataaaaaaaaaggaatccaagagattcaaatattaataatccatatccagtttagtcgaacttatattattgaaaaaaatctcatccaatcccctcggtcaaatgtaatccatatatagatgtccattcggcctgctgcttccctgcggagctgtcgccgtccacgagaaccgtccggcggcgaccacggccaccctacccttccgcgcggcccccgacggcgcagctgcggctcccgggcaacacgacggcgccgccgaagttgcatggccggtcctcgtcgattcgcaccatacctatgctctggctccgcggatgagctccgaaggccctcgcactccctcgccacgcacaggcagcgcccaccacagtccgcacacgtggtagagatgcttgccggcgccgccaccccagctcgtggcgaacagctgctactgcctcgatggctcgatcgatcagcagctcgccaacgccttataggcaccgccgctgcacgttccatgctgcctagcccggttctctagatagtttagaaatccaacatgaattggattatcctattttgtctatccaacaaaatccaacgatagttggatcaaaccctatttactgtttactttcatctagattttgtatgcatccacgctgttgccggacttcgattgcttttcacaggcacccttgcagcg

SEQ ID NO: 1595 - DNA, 1043 bp, Panicum virgatum
tggccacgacgtcaaacctgcgagcgcagaattaccgcggcgcggcgtcggccgtgtgttgctttgctggctgcgcattcgccctccctccccgacccacgattgacggctcctttgaccccccatcgtctcgtctcgtctcgtctcgtcttcctctgtcgccgcacgaaggttgaggcaatccaccccgctccccccgcccgcgcccccaagccctgcgctccgcagcccggatccatggccaacagcaacctcccgcgccgaatcatcaaggagacgcagcggctcctcagcgaaccagcgccagggattagcgcgtcgccgtcggaggagaacatgcggtacttcaatgttatgatccttggccccgcgcagtcaccctatgaagggggagtttttaagctcgaactattcttgcctgaggaatatcctatggctgctccaaaagttagatttctcaccaaaatttatcaccccaacattgacaagcttggtaggatatgccttgacattcttaaggacaaatggagtccggctcttcagatacgtactgttctgttgagcatacaggcactgctgagcgcaccaaatccggacgatcctctctctgacaacattgcaaagcactggaaagcaaatgaagctgaagctgtcgagacagcgaaggagtggactcgcctttatgcaagtggggcatgacaaccaagggttgttatctttgtaataacaatatcacctgcttgagagcaaattgcaatgttttgcaacaggggaaaaatgatcgaaccacgacagttcgaattgctttgtacttgtgtctccgttcagtgcagtaagcatcaaagcctgtgttgcttggtctgattcaatttgctgttatgtggctcttgctcccttgtctatccggccagttttgaaattattttttgattaaattgcacccaccatacaacaacttgtcaggtcggtgcaaactgatccaataacttgtataatgctcaatttagtacaataacttgacagattgatgcagatcggtccaa

SEQ ID NO: 1596 - DNA, 650 bp, Ambrosia trifida
cccctacccggtacgactccgtctaccgaataccctactaaattctactattctatccctcactacttctctctctgtaaaccacttttcttctctctctctcttcacaaaatctccgttagcgtaaatcttcccccttccgatggccaacagcaatctacctcgaagaatcatcaaggaaactcagcggttactcagcgaaccagctccggggataagtgcatcaccatctgaagataacatgcgttattttaatgtcatgatccttggtccaacacagtctccttatgaaggaggagttttcaagctggagttgtttttgccagaagaatatcccatggctgctcccaaggttcggtttcttacaaaaatttaccatccgaacattgacaagcttggtaggatttgtcttgacatcctcaaagacaaatggagccctgctcttcagattcgcactgtactcctgagcattcaagctcttctaagtgctccaaatccagatgatccgctctctgagaacattgcgaagcattggaaatctaatgaagctgaagctgttgaaacagcaaaggagtggacccgtttgtatgctagtggcgcctaacggagatgccggatgcaagtcattatgttgtttgaaaaaaataaca

SEQ ID NO: 1597 - DNA, 811 bp, Ambrosia trifida
cagaaccaagtcccaatttggcaatttaaaaaaacaataattcaccccttcaccggagctcgtcacgaatccataatcatattcatccctcactactttctctctctagaaaaccctctttttctctctctcttcacaaaatctccgttagcgtaaatcttcccccttcgatggccaacagcaatctacctcgaagaatcatcaaggaaactcagcggttactcagcgaaccagctccggggataagtgcatcaccgtctgaagataatatgcgttattttaatgtcatgatccttggcccaacacagtctccttatgaaggaggagttttcaagctcgagctgtttttgccagaagaatatcccatggctgctccaaaggttcggtttcttacaaaaatttaccatccgaacattgacaagcttggtaggatttgtcttgacatcctcaaagacaaatggagccctgctcttcagattcgcactgtactcctgagcattcaagctcttctaagtgctccaaatccagatgatccgctctctgagaacattgcgaagcattggaaatctaatgaagctgaagctgttgaaacagcaaaggagtggacccgtttgtatgctagtggcgcctaacggagatgccggatgcgggtcattatgttgtttgaaaaataacagtgtatttggttaggccttgaaatttaaaacttgaacactgcaatgttgttaactttcttgtgtttttttgagataatattgtaatttgggttaactatgtgaaagaatagtgtgggtaaaggggctgttttgat

SEQ ID NO: 1598 - DNA, 886 bp, Amorphophallus konjac
gtgaagcatccctttcccacctctgctctcttctgttcctccgtgccgcctcctcatcctcctcacctgtgccggctcggcgatcccccccgctcccctcttcaacaacaggagaagggagcagaagaaaccctaatctccgacccggcgggatggccaacagcaatctacctcgccggatcatcaaggagacgcagcggcttctcagtgaaccagcaccaggtattagtgcatctccttccgaggagaatatgcggtacttcaatgttatgatccttggtccaactcaatctccatatgaaggaggtgttttcaagttagaactgttcttgccggaagagtatccaatggctgcccccaaggtgcgctttcttacaaaaatatatcatcccaacattgacaagcttggaagaatatgccttgatattctcaaagacaaatggagtcctgctttacagatccggacagtattgctgagtatccaagcacttctgagtgccccaaacccagacgatccactctctgacaacattgcaaagcattggaagtcaaatgaagcggaagcagtagaaacagcaaaggagtggacccgtctttacgccagtggagcatgatcaccaagaagctatttcacatcgacacgactcctgcagcatatataacaagcccagtgcttctctaccatgaatggagatgttagtggttctaaaaggaaatggacggtgtttcctcagcgagccagattatatttgcctcttgccctggctatgcaactcgtttgcgtgtacgctgaccttcatacagtgggcatttcaaatttaaataaccttttccgagaaatttgcttgccacatattccccatcttttatcatctctgcttttaaa

SEQ ID NO: 1599 - DNA, 781 bp, Amsonia hubrichtii
tctctctgctagcgtaaactctgtggccgaagaagagaactttatagttcatctcaatcaatcaatttaattcaatggctaacagcaacttaccccgtagaatcatcaaggaaactcagcgtcttcttagcgagcccgcacctggaataagtgcatctccctctgaggacaatatgcggtactttaatgtgatgattcttggtccaacacaatctccttatgaaggaggtgttttcaagttggaattattcttgcctgaagaatatccaatggcagctccaaaggttcggttcctcaccaaaatataccaccctaacattgataagcttggaaggatatgcctggacatccttaaagacaaatggagtcctgcccttcagatccgaactgtactcttaagcattcaagctcttctgagtgcaccaaacccagatgatccactctctgaaaacattgcaaagcattggaaatcaaacgaggctgaagctgttgaaacagccaaggaatggacacgtctatatgcaagtggtgcctgaagcttatgcaaatcccatggtccaaaaaataacatgtgcaatgtaccttattgactgttgaattaatatgaaaatttggaagaaatattgattcctaattcatggggaatttaatgttaaaaagtatccagttactgcaggataattgttttcttgccctgaacatgtctttcaaattgtaaaattaaatgaaaggttttatttctctgtgtttgtctttatttggtggaggaacttgagccatt

SEQ ID NO: 1600 - DNA, 676 bp, Arabidopsis lyrata
gaattttgaagatagagaaaggaaatcgaattaaaatcatcgtcagattcgagagacgacgacgaagttgttctcgattatcatcagcggctcccttcaaaaaccctaactctctgagctcgatcgacaagtgataatggccaacagtaatttgccgcgaagaatcatcaaggaaactcaacgtctgctcagtgaaccggctcccggtataagtgcctctccgtctgaggataatatgcggtatttcaacgttatgattcttggtcctacacaatcaccttatgaaggaggagttttcaagttggagctctttttgccggaagaataccctatggcagctcccaaggttaggtttctcacaaagatataccatcctaacattgacaagcttggaagaatctgtcttgatattctgaaggacaaatggagtcctgcactacaaatacgaacagtgctcttaagtattcaagctcttctgagtgcaccaaacccagatgacccgctgtctgagaacattgcgaagcactggaagagtaatgaggcagaagctgtggagacagccaaagaatggacccgcctttacgcaagtggcgcataatggattggagggtgaaaagatctctttcatccaaataacattacatttgatgaaatctatctcaacagaaagcttata

SEQ ID NO: 1601 - DNA, 1269 bp, Arnica chamissonis
ctcactacatactatcatacaaacaaatttaaaaaacaagtgacaggtacgcttaaaacctcgggttggtgttggtaggtaacctaattgctcccaaaccgcccttacgtctcaagattacgaaccaactactcatcagcaacaccaacattaatgcctcaaatccaaggaccgatagcttttcttcattaacagcaggtatacagcttctgtaagttacatacatttctgatccagcttctatgctggatgaatcttcctttcccttccgcttcttgctctcatcaacaattttcacacatctcataggtatacgatacccagtttcactgcatcgataacttacatctttctttctctagaaaaccctcattttcatctctctcttcgtcaaaaggcaaaatcctccatagcgtaaatcttccattcgatggcgaacagcaatcttcctcgaagaattatcaaggaaactcagcggttactcagcgaaccagcccctgggataagtgcatcgccatcggaagataacatgcgatatttcaatgtcatgatccttggtccgacacagtctccttatgaaggaggagttttcaagctggagttatttttgccagaagaatatcctatggctgctcccaaggttcggtttcttacaaaaatttaccatccgaacattgacaagcttggtaggatttgtcttgatatcctcaaagacaagtggagccctgctctccagattcgcactgtactcctgagcattcaagctcttttaagtgctccaaacccagacgatccactctctgagaacatagcaaagcactggaaatctaatgaagctgaagctgttgaaacagcaaaagagtggacccgtttgtatgccagtggcgcctgacagagattctggtcatcatgttgtttgaaaaataacgatgtatttggttaggtcttgaaattcaaaacttgaaccgtacggcctgctgcaatgttgttcacttctttttcagataagatgctctcctttcctaactttcttatgtgaaacattcatctggttaactatgtgaaatagtatcttctgaacacagttgttcttgattgtatgtgcattgcattgatgagaaccttaagacatgcgtcgggtcgggtggtgtgattctcactgctatatccgcccagttgtctttaggtttgacgtcacagaatgacatcaaatgtaacaataagaatttgttacgacatgtattaatgttactatttaatcttaaggtt

SEQ ID NO: 1602 - DNA, 605 bp, Persea americana
ttttcaagagaacctttacaacccgaaattcgatcgcacgtcttctgtccttcaagcctcttcagcaaatctccttgtcagggttttgcttgcatatctctctctccaaatctcatctgtatctctcttgaatggcaaacagcaatctaccacgtcgtattatcaaggagacgcagcggctactcagcgaaccagctccgggcatcagtgcttctccttctgaagagaatatgcggtacttcaatgttatgattcttggtccaacacagtctccttatgaaggaggggtgtttaagttggagttgtttttgcctgaagaatatccaatggctgctcctaaggttcgctttctcacaaagatttaccatcctaacattgacaagcttggtagaatatgcctcgatatcttgaaagacaaatggagtccagctcttcagatccgaactgtactgctgagcattcaagccctactgagtgcaccaaacccggatgatccactttctgataacgttgcgaagcattggaagacaaatgaagctgaagctgtggaaactgcgaaggagtggactcgtttatatgcaagtggggcgtgatgcacaggtcta

SEQ ID NO: 1603 - DNA, 760 bp, Vaccinium corymbosum
tgcgtactctgcaatcgaaccttcatcatcaatggctaacagcaatctacctcgaaggatcatcaaggaaacacaacgtctcctcagcgaacctgcaccaggaataagcgcttcaccttcggaagaaaatatgcggtactttaatgtaatgatacttggtccatcacagtctccttatgaaggaggggtttttaagttggaattatttttgcctgaagaatacccaatggctgcccccaaggttcggtttcttaccaaaatctaccatcctaacattgataagcttggaaggatatgccttgatattcttaaagacaaatggagccctgctcttcagattcgaactgtactcttgagcattcaagcacttttgagtgctccgaacccagatgatcctctgtctgagaacattgctaagcattggaaaacaaatgaagcagaggccgtagaaacagcgaaggaatggacccgtctatatgcaagtggtgcatgatgaagtgatggagatagcttccccggaaataacgggctatgcaatgtatcttataatgactgttgaatttagtggaactttgaaaggattgatgctcgaaatgaatatctgccaaaccttcccaatgctgatgataactgttttttcactttgaaattgtataaatcggtgatatactttttgtgtcttaatcttagaatttgggagtattatctggaatttgggattaatgatggggattgttgtgcaatagtttggaaggtttga

SEQ ID NO: 1604 - DNA, 801 bp, Brassica napus
ggtcgaaagccctaaattctctgagagatcgatcaaaacggatagcaagcacgcaataatggcgaatagtaatcttcctcgaaggatcatcaaggaaactcaacgtcttcttagtgaacccgctccggggataagtgcgtctccctcagaggaaaatatgcgctacttcaatgttatgattcttggtcctacccagtctccttatgaaggtggagtttttaagttggagctctttttacctgaagaatatcccatggcagctcccaaggttaggtttctcaccaagatttaccatcctaacattgacaagcttggaagaatctgccttgacatactgaaagacaagtggagtcctgcgctacaaataagaactgtgctcttgagtattcaagctcttctaagtgcaccaaacccagatgatcccctgtctgagaacatagctaagcattggaagagtgatgaagcagaagctgtggagacagctaaggagtggactcgtctatatgcaagtggcgcttgatacggagtgcaaaaggagaaagttcgttgtcattttaaataacaatatatatggtgaaacactctatctcaaggttttatccgaatccttctttctaaaacaggaaagaaaaagatttgtactatatgaatctgtataactaggggggtctaagactcgtttatccacatttgcaaactaactttcttcgaatgtgtttgtgcttgaactttgtgtgttgaatatcctctataatcatttaatcgttgtgaatgaaggtaaatgtgataattgattgaagt

SEQ ID NO: 1605 - DNA, 807 bp, Catharanthus roseus
gcctctccattcccaactatcaaataattctctctctcgctctccccaaaagcccttagcgtaaactctgggagcaaagaagaaaactttatagctctctactcgatcaatcaattcaattcaattcaatggctaatagcaacttacctcgtagaatcatcaaggaaactcagcgtcttcttagcgagcccgcacctggaataagtgcatctccttccgaagacaatatgcggtactttaacgtgatgattctcggtccaacgcaatctccctatgaaggaggcgttttcaagttggaattgttcttacctgaagaatatccaatggcagctccaaaggttaggttcctcaccaagatataccaccctaacattgataagctgggaaggatatgcctcgatatccttaaagacaagtggagtcctgcgcttcagataagaactgtgcttttaagtattcaagcacttctgagtgcgccaaaccctgacgatccgctatctgaaaacattgcaaagcattggaaatcaaatgaggctgaagctgttgaaacagcaaaggaatggacgcggctgtacgcaagtggtgcttgaagctcatccaaattccatggtctcaaaaataacatgtgcaatgtactttattgactattgaattaatatgaacattcggaagaaacattgatgatgcctaattcatggggaatttagtgtcaaaaaggcattcagttatgcaggataatcgctttctggttctgaacatgtctttcaaattgtaaaattaaatgaaaattctcatttccttgtgttg

SEQ ID NO: 1606 - DNA, 753 bp, Centaurea maculosa
ctttctctctactaaaaaaaggcaaaagccccgttagcgtaaatcttccccttccatggcgaacagcaatctccctcgcagaattatcaaggaaactcagcgcttactcagcgaaccagctccggggataagcgcatcgccatcggaagataacatgcggtactttaatgtcatgatccttggtccaacacagtctccttatgaaggaggagttttcaagctggagttatttctgccagaagaatatccaatggctgctcccaaggttcggtttcttacaaaaatttatcatccgaacattgacaagcttggtaggatttgccttgatatcctcaaagacaaatggagccccgctcttcagattcgcactgtactcctgagcatccaagctcttctaagtgctccaaacccagatgatcctctctctgagaatatagcgaagcactggaaatctaatgaagctgaagctgttgaaacagcaaaggaatggacccgtttgtatgctagtggtgcgtaaccgagatgtggaagatgagtgttggtcggaatgaaaaagaaaaataacaatgtacttgattaggtcttgagattgaaaacttgaatgattctactgctgaactgaacgatcagtgttgttcactttcgtcatacccttgtgttttttcgataagtaactctctgtttcctaatttacttttgttatagcataagtagtattatgggtaaaagtagcagcagcctcttctgtttttt

SEQ ID NO: 1607 - DNA, 914 bp, Castanea mollissima
ctttctttccgtctttctgcgtttctctttcttcacctgcaaactcctctctctctcttcgccaaatcttcgaagaatcaatggcgaacagtaatcttcctcgacgaattatcaaggaaacccagcggcttctcagtgaaccagctcccggaataagtgcttctccttctgaggacaacatgcgatacttcaatgttatgattcttggtccagctcaatctccatatgaaggtggagtgttcaaattagaattgtttcttcctgaagaatatccaatggccgctcctaaggttcgcttcctgaccaaaatatatcatcctaatattgataagcttggaaggatatgcctcgatattcttaaagataaatggagtccagccctccaaatccgaacagtattgcttagcatccaagctcttttgagtgctccaaaccctgatgatccactttctgagaacattgcaaagcattggaagacaaatgaagctgaagctgttgagacagcaaaggaatggacccgtctgtatgcaagtggagcctgatgagcttgatggtcaacatatcaatctctaaaatgtctgttaaacttgatggttggtttgtcatttggtattaaaaatatgaatggaaaaatgatctatgacttgatctatgaaagatgaatcttcttgagaacatcaattaactgagagtcatcatcaggaatgaacaaatgatttctgaattgatcaatgaaagatgattcttgtgaagaacttcatttatttgatagtcatctttaataacttgaaaggctttttcatcttttgaagagcctgcatgattatattgaagtttaatatcaattttttgtgcacttcaactttaatttcagatgtttaatttttaaatatatttgtgtgttacaaaaaaaa

SEQ ID NO: 1608 - DNA, 824 bp, Cichorium intybus
ggcgggggctccggctagagaaggagtctcgaatcaataatctgcccttcactttctctctctagaaaaccctcttttctctctttgtcgaaaaaaggcaaaagcccccttagcgtaaatcttccccttccatggcgaacagcaatctacctcgaagaattatcaaggaaactcagcgcttacttagcgaaccagctccggggattagcgcatcgccatcggaagataacatgaggtatttcaatgtcatgatccttggtccaacacagtctccttatgaaggaggagttttcaaattggagttatttttgccagaagaatatccaatggctgctcccaaggttcggtttcttacaaaaatttaccaccccaatattgacaagcttggtaggatttgtcttgatatccttaaagacaaatggagccctgctcttcagattcgcactgtcctcttgagcattcaagctcttctaagtgctccaaatccagatgatccgctctcagagaacatagcaaaacactggaaatccaatgaagctgaagctgttgaaacagcaaaggaatggactcgcctgtatgctagtggtgcctaatggatgagatgtgggtcattcgtgaaaataacaatgtactttgttaggtcttcaaatttaaaaattcaaaacttgaatgattttactctgccagtccctgaaccatcaatgttgttcacttcctaccttcatatctttgtgttttcttctgagtatatgagataagctactctcttttttcaattttcctttcatcatacactcatatgcttaactatgtgaaattgcata

SEQ ID NO: 1609 - DNA, 784 bp, Cichorium intybus
tagtctcagcgtgaaagaaagtgcttaaatccatcatcccccaacacattctctctctataactttatctctctctctctctctctctctctctctctctctctaaaaaggcaaaagccccttagcgtaaatcttccacttctatggcgaacagcaacctacctcgaagaattatcaaggaaactcagcgcttacttagcgaaccagctccggggataagcgcatcgccatcagaagataacatgcggtatttcaatgtcatgattcttgggccatcacagtctccttatgaaggaggagtttttaagctggaattatttctgcccgaggaatacccaatggctgcccccaaggtccgattccttacaaaaatataccatccaaatatcgacaagcttggcagaatatgtcttgatattctaaaagacaaatggagccctgctcttcagattcgcacagtacttttgagcattcaagcacttttaagtgcaccaaatccagatgatccactttcagaaaatatagcaaaacactggaaatcgaatgaagcagaagctgtggaaacagcaaaggagtggacacgtttgtatgcaagtggcgcctaatgaatatagacgctcaaaataaaagataacaaatttacttttattacaaaatattcaccatttgcttattactctttttcatttgtaaactcttgtttctttttgggttgaatgaatatatgatgtatcttttatttcaagaatttagtgaaacaatgtttacttgatttggttaaaaa

SEQ ID NO: 1610 - DNA, 1094 bp, Trifolium pratense
  misc_feature (22)..(22): n is a, c, g, or t
  misc_feature (24)..(24): n is a, c, g, or t
gaaaccttctttttcctctttntntctctctctctctgaaactcaaagccctattgcgtattttgcaatcgaccccaataatggccaacagtaaccttcctcgaagaatcatcaaggaaacacagcgtttgctcagtgagccagcgcctggaattagtgcatctccttcggaagacaatatgagatatttcaatgtgatgatccttggcccaactcagtctccttatgaagggggtgttttcaagctagaactatttttgccagaagaatatcctatggctgctccaaaggttaggttcctgacaaaaatatatcatcctaacattgataagcttggcaggatatgtcttgatattctgaaggacaagtggagtcctgcccttcagatacgcactgtacttttgagtattcaagcacttttgagtgctccaaacccagatgatccactttctgagaacattgccaagcattggaaatctaatgaggccgaggctgttgagacagccaaagagtggaccagattatatgctagcggcgcttgacaattgggtggatacttttggtctcaaataacaatagtggaagtgtatgcttattaactatcaaattgaaatggaaaaatttagaggaattgtctaaactattttggagtccatattcctcttagcttccggttacatgtttattgttttctatctcctggaagccttctattggaacttgtatgaatatatgggatgttttatgtgtcaaatttaaaacttggtccttcttcaactgctaaatgtaatttgggattctaaactcatcatacttttgaataagtttttttttattttggattgtcctcgttaccacggatttggcttctcttaagtgaagagtgccttttaaagaaagtgtgaaatcatatctgattaagtgcatgttttgtgatcgtgtttggtatcacagtcggttgctagaataatagtgagtcaccatgattttggcaaactcactttgttaccgaacatgctactttataataatctcagccgtggaattttatcacctatcaattttaacattatcactttcctcagagaaaaaaa

SEQ ID NO: 1611 - DNA, 1045 bp, Coffea canephora
agtctccccataattcattgctagtgagagaaagcagagattctcttcgaaactctgaaaaccttcttctctttctctctctacaaaaagcccttgttgcgtagactctgcgaacccatcaagcaaaaactctcagccatcttcgccgaatcaatcccattcaattcgatggctaatagcaatttacctcgtagaatcatcaaggaaactcagcgtcttcttagcgaacccgcaccgggcataagtgcatccccctctgaggacaatatgcggtactttaatgtcatgattcttggtccaacacaatcgccttatgaaggaggtgttttcaagttggaattatttttgcctgaagagtatccaatggcagctccaaaggttcgattcctgaccaaaatatatcatcctaacatcgataagcttggaaggatatgccttgatattctcaaagacaaatggagtcctgctcttcagatccgaactgtacttttaagcattcaagctcttctgagtgctccaaacccggatgacccactttccgaaaacattgcaaagcattggaagtcaaatgaggctgaagctgttgaaacagctaaggagtggacgcgtctatatgcaagcggtgcctgaagttgtccggacctggtgcttccaaaaagtaacatgtgcaatgtactttattgacttggtaattcatatggaatctggaagaaaggctgatagttggttaggggaatttaatgttctcagtgcttccagttacttcgtttaaattgttttcttgccatgaactctgtctttcaaactgtataattaaatgaaacgtacaatttatccgtgtttgcatcaccctgttagaggactttctacatttttagtttgaagttgaactagggtttaacttgtaaaatatttagagcaggcttcttcttgaatttgcccatgcccatgtaggagttgaaagtgctggttatgcgatgtctttgacttggaggtgacaagaatctgcatgcaaacttgtaactcaaaattgattttggtagca

SEQ ID NO: 1612 - DNA, 908 bp, Gossypium hirsutum
ttctttcctctgattttcttattcccggattctctcttcatctcccacttctcaaaaccctaattatatttttttatttcccattttgattcagaaatcgaagcttgccaatggccaacagtaatctccctcgaagaatcatcaaggaaactcagcgtctcctcagtgaacctgctccgggaattagtgcttcaccatcagaggataatatgcgatatttcaatgtgatgatccttggtcccacacagtctccatatgaaggaggggttttcaagttggaactttttttgcctgaagaatatcccatggccgctcccaaggttcgatttcttacaaagatatatcatcctaacattgataagcttgggagaatatgccttgatattctcaaggacaaatggagtccagctctgcagatccgaactgtacttttaagcatccaggcactcttgagtgctccaaatccagatgatccactctccgagaatattgctaagcactggaaatcaaacgaggctgaagctgttgagacagcaaaggaatggacgcgtttatatgcaagcggtgcatgaagaccggtggaaccgtttgctctcataaaataacatttttatgcaatgtgagctattcaatgtcaatttcatatggaaatctggacgaatgacagtttgaaacagtttgatatttgcaaaaaaaaaaagaaaaaagacttccaggtgctacccttttaattgtaattcggtcggaagcaatctctaagcttgtatgataatacacatggttctctaaaactcccaaaggcttcaactatgggattattctctaatatggtgatttcagattctggttatatgtgtgtgtgtaatgaatctatcaactggaaatgaaagaatggattgattaaattt

SEQ ID NO: 1613 - DNA, 849 bp, Cucurbita pepo
ctaccttcaaagctaagtctttataatctagagagaggaaagcgtcccttttcctgttttctctctcttcatttcgtctaaaccctatcgcgagctctcaatcgatcttcaatggcgaacagtaatcttccccgaaggatcatcaaggaaactcagcgtctccttagtgaaccggcccctgggattagtgcctcgccgtcagaagataatatgcgatattttaacgtgatgatccttggcccgacccagtcaccctatgaaggaggagttttcaagttggagctatttttacccgaagaatatcctatggctgctcccaaggttcgatttctcacaaagatttatcacccgaatattgataagcttgggaggatatgccttgatattctgaaagacaaatggagtccagctctacagatacgaactgtacttttgagtattcaagctcttctgagtgctccaaacccagatgatccactttccgagaacattgccaaacattggaaatcgaatgaggccgaagctgttgaaacagcaaaggaatggactcgattatacgcaagtggtgcgtaaagaagggaaactgcggaagccttttatctcttcggtttttaataacatgaatgtgccatttgctctgtggattttaatgaaaaatctggaagaatttagtgtcaaaattgtaactgtctctataattgtgcgtcttttggcaggagtctgtacccccatactttgtatgatcatgatatgattagatggaataccttcttctaagttcaatatctcctaaattgtaagccctcgccatatgccccttattttcagaatgttttaattattaattaa

SEQ ID NO: 1614 - DNA, 786 bp, Cyamopsis tetragonoloba
ctctgtttctctctctggtttctctctttgcgactcaaaaccctattgcgtgctttgcaatcgaccccgattatggccaacagtaatctccctcgaagaatcattaaggaaacacagcgtttgctcagtgagccagcgcctggaattagtgcgtccccttcggaagacaatatgcgatatttcaatgtgatgatccttggcccaacccagtcaccttatgaagggggggttttcaaattggaactatttttgccagaagaatatccaatggctgctcctaaggttaggtttctgacaaaaatatatcatccaaacattgataagcttggcaggatatgtcttgatattctgaaagataagtggagtcctgcccttcagattcgcactgtacttttgagtattcaagctcttttaagtgcaccaaacccagacgatccactatcagaaaacattgctaaacattggaaaagtaacgaggccgaggctgttgaaacagcaaaggaatggacccgattatatgctagcggcgcctgaggattgggtggaaacttttggcgtaaaaaataacaaaagtgaaagtgtatgctattaactgttaatttgaaatgaaaatttggagcaagtgtctaaactattttagagttcatactcctttcagcttccagttacctgttaattgctttcatcttctggaagccttatcttggaacttgtatgaatatatatgacctctcttatgtgtcaaaaatttaaaacattctccacatcttcaactgctagcaatgt

SEQ ID NO: 1615 - DNA, 899 bp, Cynara scolymus
  misc_feature (844)..(844): n is a, c, g, or t
ggcggggggctgcggctgagagagaagtctcgaatccataatttcccattcactttctctctctagaaaaccctctttctctctttatctctcctaaaaaaggcaaaagcccccttagcgtaaatcttccccttccatggcgaacagcaatctccctcgcagaattatcaaggaaactcagcgcttactcagcgaaccagctccggggataagcgcatcgccatcggaagataacatgcggtattttaatgtcatgatccttggtccaacacagtctccttacgaaggaggagttttcaaactggagttatttctgccagaagaatatccaatggctgctcccaaggttcggtttcttacaaaaatttaccatcctaacattgacaagcttggtaggatttgtcttgatatcctcaaagacaaatggagccctgctcttcagattcgcactgtactcttgagcattcaagctcttctaagtgctccaaaccctgatgatcctctttctgagaacatagcaaagcactggaaatctaatgaagctgaagctgttgaaacagcaaaggaatggacccgtttgtatgcgagtggtgcgtaaccgagatgtggaagacgagtgttggtcagaatgaaagaaataacaatgtacttggttaggtcttgagattgaaaacttgaatgattccgctgaatgaacgatcaatgttgttcacttccttcataccgttgtatttttttcgataagtaactctccatttcctaaattgttttgtgaacatctatagcggtagtattatggggtaaagtagcagcagcagcatcttatgttttagagacttcatancacctgaatctctgttgttttgttgcacaaaagagatccataaatttgggtggtg

SEQ ID NO: 1616 - DNA, 779 bp, Taraxacum officinale
ataaatacgatctaactcttcttgggtcgcggctagagaagaaggaagtctcaaatctataatcggcccccttctctttctatctctagaaaccccctttctctctctgaaaaagcaaaagcccccttagcgtaaatcttccccttccatggcgaacagcaatctacctcgaagaattatcaaggaaactcagcggttacttagcgaaccagctcctgggataagcgcatcgccatcggaagataacatgaggtatttcaatgtcatgatccttggtcctacacaatctccttatgaaggaggcgttttcaagctggaattatttttgccagaagaatatccaatggctgctcccaaggttcggtttcttacaaaaatctaccaccccaacattgacaagcttggtagaatttgtcttgatatccttaaagacaaatggagccctgctcttcagatccgcactgtactcctcagcattcaagctcttctaagtgctccaaatccagatgatccgctctctgagaacatcgcaaagcactggaaatctaatgaagctgaagctgttgaaacagcaaaagagtggacccgtttgtatgctagtggtgcctaatggagacgtgggtcactggaacgaaataacaatgtactttggttagatcttgaaatttaaaaatttgaaaacttgaatatgattctgctatgaacgatcaatgttgttcacttccttttcatatctttatgtttttttttctgagtatatgagataatttactcttttt

SEQ ID NO: 1617 - DNA, 844 bp, Solanum melongena
ttgtcaaattctcacataactattctccacttgctccccttttcaccctttctctctctagaaattagcgtagaaccccaaaagctttcaattcaatggctaacagcaatcttcctcgaagaattatcaaggaaactcaacgtcttctcagcgaacctgcgcctgggataagtgcatctccatcagaagacaatatgcggtactttaatgtcatgattcttggtccaacacagtctccttatgaagggggtgtcttcaagctcgaactatttttgcctgaagagtacccaatggctgctcctaaggttcgattcctcaccaaaatctaccacccaaacattgacaagcttggaaggatatgtcttgatattcttaaagacaaatggagtcctgctcttcagatccgtactgtacttttgagcattcaagcacttttgagtgctccaaatccagatgatccactctctgaaaacattgcaaagcactggaagtcaaatgaggctgaagctgttgaaacggctaaggagtggacgcgcctatatgctagtggtgcatgaagagatagcaacgaaatattcaaaataacaaaaatcatggaatgtaatctattgactggcctatcaatatgacacccgaatagctgttaatggctgaactcttccaattatctcctcataattgcttccctgcccttgaaattgtataattgaatgacaccctttggtttttctaatgttcaggaatgaactggttacaacaaaactggatgtggtaagaattttgtcactgcaagtgtagttaatgattcagatctgtgggttggaataggaaactagtgttgctg

SEQ ID NO: 1618 - DNA, 910 bp, Euonymus alatus
gtgagagaagactctctctctttgtctctgttctcaaaaacccttgttagctttttctgcaatcaagctcgaaacacaatggcaaacagtaatctccctcgaagaattatcaaggaaactcagcggcttctcagtgaaccagcacctgggattagtgcttcaccctctgaggaaaacatgcgatacttcaatgtgatgattcttggtccaacacaatcaccatatgaaggaggagttttcaagttggaattatttttgacagaagaatatccaatggcagctccaaaggttcgatttcttacaaaaatataccatcctaacattgacaagcttgggaggatatgcctagatattctgaaagacaaatggagtcctgctctccagattcgaactgtacttttgagcatccaagcacttcttagtgctccaaatcctgatgatccgctttctgaaaatattgctaagcattggaagtcaaatgaggctgaagcagttgaaacagcgaaggaatggactcggctgtacgcaagtggtgcctaatgccataattggaaactttccttcaaattacatttactgcaatgtatgtgattgactgttgattttggacacagaattggaagaattgatctctctgaatggttattgttgtttattagtctcaaaaggcttccgggtattactacgtgttaaatttctctcttttggaggcctcgtctttgacatgtatgataaatacatcgttcatcctttactgaaatgcagaatttgcagggtaatcccagtcatgtagtactttgagttctgttaaataattcgacattgtgaagtaattaagaaatttgttgcgccgctagaaaaaaaaaaaaaagacgctcgacacccacagggagtagcagccacagggagt

SEQ ID NO: 1619 - DNA, 898 bp, Euonymus alatus
tagtcttgctttggggaaataaagagactccaaaagcaacaaacaagaaagtacacgtcaatattttcgctagggagagacgactctctctctctctgtgcctcaaaaacctttttagcgttttctgtaatctaaccttggaacacaatggcgaacagtaatctccctcgaagaatcattaaggaaactcagcggcttctcagtgaaccagcaccgggcattagtgcgtcaccctctgaagaaaatatgcggtacttcaatgtgatgattcttggcccaacacaatcaccatatgaaggaggagttttcaagttggaattattcttgcctgaagaatacccaatggcagctccaaaggttcgatttcttacaaaaatataccatcctaacattgacaagcttgggaggatatgccttgatattctgaaagacaaatggagtcctgctcttcagattcgaactgtacttttgagcatccaagcacttcttagtgctccaaatcctgatgatccgctttctgaaaatattgcaaagcattggaagtcaaatgaggctgaagcggttgaaacagctaaggaatggactcggttgcatgcaagtggtgcctgatgggataattggaaacttgccttcaaataacattgactgcaatgtatgtgatttgactgttgattttggacagagaattggaagaattgatctctctccgaatggttattgtttattattctcaaaaagcttccagttactacttaatgttaaatgttttcttttggaggcctcgtctttgacatgtatgataaatacgttgttcatcctttagtcaaatgcagaatttgcttagtaataatcctagtcatgtagaacttttgagttctgttaaatcattcaacattgt

SEQ ID NO: 1620 - DNA, 736 bp, Euphorbia peplus
tctctctttctctcaaaaaccctcgagtagcgttcgttctctgcaatccacctctaaagaaatggccaacagtaatcttcctcgaagaatcatcaaggaaacccaacgtcttcttagtgaacccgctccgggaataagtgcctcgccatcagaggataatatgcggtatttcaatgtcatgattcttggcccaacacagtctccatatgaaggaggggttttcaagctggaattgtttcttcctgaagaatatccaatggctgcacccaaggttcgatttttgaccaaaatttatcatcctaatatcgacaagcttggaaggatttgtcttgatattctgaaagacaaatggagtcctgctcttcagatacgaactgtacttttgagcatccaagcgctgcttagtgctcctaaccctgatgatccactctccgagaatatagcaaagcactggaaatcaaatgaagctgaagctgttgaaacagcaaaggaatggactcgtttgtatgctagtggtgcatgaagatgtgcgtcaactatttctcccttcaaacaaacttcatgtgatatatgctctctattaacttgttaaattgaatggaaaattgaagaattgatgtttgaacaaattataatttaatgttttcccaagcttccagatactgccatgatgagaatgtctgaagttggaagcatctttgttgaatttgtatgattagataaagtacatttttcc

SEQ ID NO: 1621 - DNA, 720 bp, Flaveria ramosissima
tcactttctctctctagaaaaccctcttttttctctcttcttacaaaacgcaaaatcccctatagcgtaaatcttccccttcgatggccaacagtaatctacctcgaagaatcatcaaggagactcagcggttactcagcgaaccagctccggggattagtgcttcaccgtctgaagataatatgcggtattttaatgttatgattcttggtccaacgcagtccccgtatgaaggaggagttttcaagctggagttatttttgccagaagaatatccaatggctgctcccaaggttcggtttcttacaaaaatttaccatcccaacattgacaagcttggtaggatttgtcttgacattctcaaagacaaatggagccctgctcttcagattcgcactgtactcctgagcattcaagctcttctaagtgctccaaacccagatgacccactttctgagaacattgcaaagcactggaaatctaatgaagctgaagctgttgaaacagcaaaggaatggacccgtttgtatgctagtggcgcctaacaaagacgcagatgattatgttgtttggaaaaataacagtgtatttggttaggtcatgaaatttataacttgaatgctgcaatgctgttaactttcttctgtttttttctagacagttttcctaattttgttatgtggaacatttatctggttaactatgtgtcaaagggttgcg

SEQ ID NO: 1622 - DNA, 662 bp, Flaveria ramosissima
cccccttttctctctctaaaaatccccctttgcgtaagtcttccttcaatggcaaacagcaatcttcctcgaagaatcatcaaggagactcagcgcttgctcagcgaaccagctccggggataagtgcgtcgccatcggaagataacatgcggtattttaatgtcatgatccttggtccgacacagtctccttatgaaggaggagttttcaagctggagttatttttgccagaagaatatcctatggctgctcccaaggttcggtttcttacaaaaatttaccatccgaatattgacaagcttggtaggatttgtcttgatatccttaaagacaaatggagccctgctctccagatacgcacagtactcctgagcattcaagctcttttaagtgctccaaacccagacgacccactctccgagaacatagcaaagcactggaaatctaatgaagctgaagccgtggaaacagcaaaagagtggacccgtttgtatgccagtggcgcctaacagagattctggtctttgcgttgcgtggaaaaaataacgatgtatttggttaggtcttgaaatttatacttgaatgattccgcctgcttcactttcttttcagataagagtctcttctttcctattttcttatgtgaaatattcattcagtt

SEQ ID NO: 1623 - DNA, 718 bp, Flaveria ramosissima
tcactttctctctctagaaaaccctcttttttctctcttcttacaaaacgcaaaatctcctgtagcgtaaatcttccccttcgatggccaacagtaatctacctcgaagaatcatcaaggagactcagcggttactcagcgagccagctccggggattagtgcttcgccgtctgaagataatatgcggtattttaatgttatgatacttggtccaacgcagtccccgtatgaaggaggagttttcaagctggagttatttttgccagaagaatatccaatggctgctcccaaggttcggtttcttacaaaaatttaccatcccaacattgacaagcttggtaggatttgtcttgacattctcaaagacaaatggagccctgctcttcagattcgtactgtactcctgagcattcaagctcttctaagtgctccaaacccagatgacccactttccgagaacattgcaaagcactggaaatctaatgaagctgaagctgttgaaacagcaaaggaatggacccgtttgtatgctagtggcgcctaacaaagacgcagatgattatgatgattatgttgtttggaaaaataacagtgtatttggttaggtcctgaaatttttaactttgaatgctgcaatgctgttaactttcttgtgtttttttgtagacaattttcctaatttagttatgtggaacatttatctggttaactatgtgt

SEQ ID NO: 1624 - DNA, 751 bp, Flaveria ramosissima
cctcactttctctctctagaaaaccctcttttttctctcttcttacaaaacgcaaaatcccctatagcgtaaatcttccccttcgatggccaacagtaatctacctcgaagaatcatcaaggagactcagcggttactcagcgagccagctccggggataagtgcttcaccatctgaagataatatgcggtattttaatgtcatgattcttggtccaacgcagtccccgtatgaaggaggagttttcaagctggagttatttttgccagaagaatatccaatggctgctcccaaggttcggtttcttacaaaaatttaccatcccaacattgacaagcttggtaggatttgtcttgacattctcaaagacaaatggagccctgctcttcagattcgcactgtactcctgagcattcaagctcttctaagtgctccgaacccagatgacccactctctgagaacatagcaaagcactggaaatctaatgaagctgaagctgttgaaacagcaaaggaatggacccgtttgtatgctagtggcgcctaacgaagacgcagatgattatgttgtttggaaaaataacagtgtatttggttaggtcctgaaatttataacttgaatgctgcaatattgttaacttctgttaacttgtgtttttcgagacaattttcctaattttgttatgtggaacatttatctggttaactatgtgtcaaagggttgcgttaatcatatttgcatgaaccatac

SEQ ID NO: 1625 - DNA, 901 bp, Linum usitatissimum
ggagagaaaacccgacgccattctcccccaaatcccttcagaaacccaacttcagacccctgatcctgtcacccgattctccctagttacgattcaatcttctgattgaaacttaggagggtaaccatccatggcgaacagcaatcttcctcgcagaatcatcaaggaaacgcagcggctcctcagtgaaccagctccaggaatcagtgcttctccttcagaagagaacatgcgatacttcaatgtgatgattcttggtccaacacaatcgccttatgaaggtggtgttttcaagttggaattgttcttacctgaagaatacccaatggcacctcccaaggttcgcttcctgaccaaaatttaccaccctaacattgacaagctcggaaggatttgccttgatatcctgaaagacaagtggagtccagcacttcaaatccgaacagttctgctaagcatccaagctctattgagtgctccgaatcctgatgatccgctgtctgagaacatcgccaagcactggaaatcaaatgaagctgaagctgttgaaacagctaaagaatggactcgcctatatgcaagtggtgcgtgacgagtagcaagggggagatattcaatcaatgccgatggatttgtgtgactacttaacattggttgaatgaacttcgaagaatgtagcatgtcgggtacaattagatttggaagaaatgggaatgcttgaaatgtatggcaccactctaaacaaaaaccatcagatacacgaatctggaaaatcgtaccagtactcttgtttttagcaccaccttcgagacctgtatcataccatcattgaagcttcgtattgacttgtttgtgatcgtgtgagaatcaatccggtttgtttgcgcagcaaaccctttca

SEQ ID NO: 1626 - DNA, 837 bp, Linum usitatissimum
gacgccattctcccccaaatccctccagaaacccaacgtcagacccccgatcctgccacccgattctccctgattacgattcaatcttctgattgaaacttaggagggaaaacatccatggcgaacagcaatcttcctcgcagaatcatcaaggaaacgcagcggctcctcagtgaaccagctccaggaatcagtgcttctccttcagaagagaacatgcgatacttcaatgtgatgattcttggtccaacacaatcgccttatgaaggtggtgttttcaagttggaattgttcttacctgaagaatacccaatggcacctcccaaggttcgcttcctgaccaaaatttaccaccctaacattgacaagctcggaaggatttgccttgatatcctgaaagacaagtggagtccagcacttcaaatccgaacagttttgctaagcatccaagctctattgagtgctccgaatcctgatgatccgctgtctgagaacatcgccaagcactggaaatcaaatgaagccgaagctgttgaaacagctaaagaatggactcgcctatatgcaagtggtgcgtgacgagtagcagaggggagatattcgatcgatgcctatggatgtgtgtgactacttacattggttgaatgaactttgaatttggaagaaatgggaatgcttgaaaatgtatggcaccactctaaacaaaaaccatctcgaatctggaaaatcgtactagtactcttgtttttagtaccgcctttgagacctgtatcataccatcattgaagcttcttatcgacttgtttgtgatcgtgcgagaatcaaaccggtttgttt

SEQ ID NO: 1627 - DNA, 1202 bp, Setaria italica
actacagcaaaaaccgcgtccgcgtacaatagcgagcgcccaacgccccaacccgcctctccccccgttccccaccctcgaccgactgcttcctcctcctcctccaccgcgcgatccttaaggcatcagcggcgccgcaacttcgcagaggaggaagtccgcgccccggccccgatccgatggccaacagcaacctcccgcgccggatcatcaaggagacgcagcggctgctcagcgagccagcgccggggatcagcgcgtcgccctcggaggagaacatgcgctacttcaacgtcatgatccttggcccggcgcagtcgccctatgaaggtggagtttttaagcttgagctctttttacctgaggaatatccaatggctgccccaaaggttaggtttctgaccaagatttaccatcccaacattgacaagcttggtaggatatgccttgacattctcaaggacaaatggagcccagcacttcagatccgaacagttcttttgagtatccaggctctcttgagtgcaccaaatccagatgaccctctgtctgataacattgcaaaacactggaaagccaatgaggctgaagctgttgaaacagcgaaggaatggactcgcctgtatgcgagcggtgcatgacaacccagtgctgttcttgatgtaataacccgtcatacttcagtcctaatctattgccatttgcttgatgagaacagactggagatatttgccatggaaggaagtctctaaatgacttaccggtcgaattgtttggttgtacacctgtggtcggttccctttacctttgggcacctttgactaatcagtatctgtggtagaactttctctactccaatatatttattacttcatgtaggagagtttctcaactgtccatattgttgaaactgaggcttgttaccttggctgcacctttgttggtccactcgtttttgtgctggtcatctgtgaaactagagttgcacttggctgcacttttgttggtccaaccgggtgtatgccgctcatgttatgccgtttgcccacccggttgcggttggcactttgctcgtgggactgtgggagcaagcgataagcggagcgcaattaataaagccacgctttctcggctcggatgtgccgaacgtcgccgccgggaagtcaccggtcgtgcgacgggggcgcagctttgcccatgac

SEQ ID NO: 1628 - DNA, 1106 bp, Gossypium raimondii
tggagggccaaataaatcattatgcctaaaaagaaaggtatagtataaggacctaaaaataatatatacctaaagcaagttaagggaaagggacctttcttctttcctctgtttttcttattctcggattctctcttcatctcccaattctcaaaaccctaattatatttttttatttccctttttgattcagcaatcggggcttgccaatggccaacagtaatctccctcgaagaatcatcaaggaaactcaacgtctcctcagtgaacctgctccgggaattagtgcttcaccatcagaggataatatgcgatatttcaatgtgatgatccttggtcccacacagtctccatatgaaggaggggttttcaagttggaactatttttgcctgaagaatatcccatggctgctcccaaggttcgatttcttacaaagatatatcatcctaacattgataagcttgggagaatatgcctcgatattctcaaggacaaatggagtccagctctgcagatccgaactgtacttttaagcatccaggcactcttgagtgctccaaatccagatgatccactctcggagaatattgctaagcactggaaatcaaacgaggctgaagctgttgagacagcaaaggaatggacgcgtttatatgcaagcggtgcatgaagaccggtggaaccgtttgctctcataaaataacatttttatgcaatgtaagctattcaatgtcaatttcatatggaaatctggacgaatgacagtttgaaagagtttgatatttgcaaaaaaaaaaaaaaaagcttccaggtgctacccttttaatagtaattcggtcggaagcaatctctaagcttgtatgataatacacatggttctctaaaactcccaaaggctttaactatgggattattctctaatatggtgatttcagattctggctatatgtgtgtgtgtaatgaatctatcaactggaaatgaaagaatggattgattaaattttgaggcttagggttgtgtattgttcttggaccgttgaaacctataacatttttaacttgttttaatgttatgctaagttcaccaatatattctggtagtata

SEQ ID NO: 1629 - DNA, 744 bp, Guizotia abyssinica
aagaaagtctgaaatccatattcactttctctctctagaaacccctctttttcctctctctcttcctgaaaaggcaaaatctccttagcgtaaatcttctccctccgatggcaaacagcaatcttcctcgaagaattatcaaggaaactcagcgcttgctcagcgagccagctcctgggataagtgcatcgccatcggaagataacatgcggtatttcaatgtgatgatccttggtccatcacagtctccttatgaaggaggggttttcaagctggagttatttttgccagaagagtatcctatggctgctcccaaggttcggtttcttacaaaaatttaccatccaaacattgacaagcttggtaggatttgtcttgatatcctcaaagacaaatggagtcctgctcttcagatccgcactgtactccttagcattcaagctcttttgagtgctccaaacccagatgatccactatctgagaacattgcaaagcactggaaatctaatgaagctgaagctgtagaaactgcaaaagagtggacccgtttgtatgctagtggcgcctaatggagattcgggttgtttggaaaaaaaataactatgtatttggttaggtcttgaaattcaaacttgaatgattcagcctgctgcaatggttgtcacttctttttcagatagatactctcctttcctattttcatatgtgaaacatcatctagttactatgtgaatagtagcatct

SEQ ID NO: 1630 - DNA, 1202 bp, Mesembryanthemum crystallinum
  misc_feature (867)..(867): n is a, c, g, or t
ctccggattctctctttctctctcttcgtatctgaagctttctgcatcgaagctcgccccaatttcatcgatggcgaacagcaatctgcctcggagaattatcaaggaaactcagcgtctcctcagcgagccagctccgggcattagtgcttcgccatcagaagagaatatgcgatacttcaatgttatgattcttgggccttctcagtctccatatgaaggaggagttttcaaattggaactattcttgcccgaggaatatcctatggctgctcctaaggttcggtttctcaccaaaatatatcatcccaacattgataagcttggaaggatatgccttgatattctcaaggacaaatggagtcctgctctccagatacgaactgtacttttgagcattcaagcacttctcagtgctcccaaccctgatgaccctctctccgagaacatagctaaacactggaaagcaaatgaagctgaagccgttgaaactgcaaaagaatggactcgtctatatgcaagtggggcgtgacaacatggcgaaaacattatcttcttaaagacatttcatgagaatatgtttactatcaattgtcaattctgatttgagctgcaggattagaaatgaatctccaagtgaaaaatttagaagaaatgatgttaaaatgtgagtatgagatggctaaagcttcttgttacttgttctttaactgttttatcgtgtctttgaaatggtaaaagtagatgggttgctttcgttcccattaagttgtgtggtctggagacgctatcttttactgataaaaggcaacttagaattctaagtacatgtcattactgcacaagggtacctgttgtacatgcatngtgagcttttagtggcactgggtgaattaacacaacatgtagccaattatgagaggaggaagataatcatgcaggttcagtgcagttaaaaaaaaaaatcaattaatataaaataaatcaggggggcccgtaccaatcgcctatgtggtcgattaaccgctactgccgctttacacgtctgactgaaaaaccgcgtacccactaatgctgcagaatcccttcgccgtgctatatcaaagccctacgacgccttcacagtgcaactgatgtatggaccgcctgtcggtctaatccgcctagtttgtcccatgtccttaatttcagccttcccttcg

SEQ ID NO: 1631 - DNA, 688 bp, Ipomoea batatas
cgggggctatcatcgctctctctctctatacaaaagtctcaggcgtaaactctccgacagagagaaccttccaactcatctcaatggcgaacagcaatctcccccgaagaatcatcaaggaaactcagcgtcttctcagcgaaccagcaccaggaataagtgcatctccatcagaggaaaatatgcgttattttaatgtcatgattcttggtccaacacagtctccttatgaaggaggtgttttcaaactggaattgtttttgcctgaagaatatccaatggctgctccaaaggttcggttcctcaccaaaatctatcatccgaacattgataagcttgggaggatatgtcttgatatacttaaagacaaatggagtcctgctcttcagattcgtacagtacttttgagtattcaagcacttttgagtgctccaaatcctgacgatccactctctgagaacattgcaaaacattggaagacaaatgaggctgaagcagttgaaacagcaaaagaatggacacgactatacgccagtggtgcctaacagttgtggagaaaggtgttttaaaaaataacaaaatgtgcaatgtactctttgactgtctaattattatgatatcttggaagaactgaagaatgtttgaaacaaaatggacattgttctaattgcttctaattattgctcga

SEQ ID NO: 1632 - DNA, 983 bp, Lactuca sativa
aaatttagcctcaatttacaaatcggggaataaataccaccgaactcttctttcgaagcctggctcgcggctagagaaggaagtctcgaatcaataatcagcccttctctttctatctccagaaacccccctttctatctctctctctctaaaaaagcaaaagcccccttagcgtaaatcttccccttccatggcgaacagcaatctacctcgaagaattatcaaggaaactcagcgcttacttagcgaaccagctccggggataagcgcatcgccatcggaagataacatgaggtatttcaatgtcatgatccttggtccaacacagtctccttatgaaggaggagttttcaagttggagttatttttgccagaagaatatccaatggctgctcccaaggttcgatttcttacaaaaatttaccaccccaacattgacaagcttggtaggatttgtcttgatatccttaaagacaaatggagtcctgctcttcagattcgcactgtactccttagcattcaagcacttctaagtgctccaaatccagatgatccactctctgagaacatagcaaaacactggaaatccaatgaagctgaagctgttgaaacagcaaaggagtggacccgattgtatgctagtggtgcctaatggagatgtgggtcccgcaaagaaataacaatgtactttgattaggtcttgaaatttgaaaattgagaacttgaatatgattctgctctgttagtccctaaactatcaatgttgttcacttcctaccatcatatctttgtgttctatcgagtatatgagataatttactcttttttttttctttctaattttcttttctgatatacattttgtctgcttaactatgtgaaatagcatttgaactggatttcaaacttgctaaattgtgaacagaatactggagaatgtgagggtgaggagttttaaatgattttggatggctatttggtat

SEQ ID NO: 1633 - DNA, 977 bp, Lotus japonicus
ttttttaattccatctttcttcattttgtgcaattgttctagtgagagaaactctctccctttctctctctaaagtaaaaaccctattgcttccttcgcaaccgaacccaacccaacaatggccaatagtaacctacctcgaagaatcatcaaggaaacgcagcgtctgctcagtgagccagcacctggaattagtgcttccccctccgaggagaatatgcgatatttcaatgtgatgatcctcggaccgacccagtcaccttatgaaggaggagtttttaagttagaactatttttgccagaagaatatccaatggctgctccaaaggtcagatttctaacaaaaatatatcatccaaacattgataagcttggcaggatatgtctcgatatccttaaagataagtggagtccagcccttcagatacgcactgttcttttgagcattcaagcacttctgagtgcaccaaaccctgatgatccactttctgagaacattgccaagcattggaagtctaatgaggtcgaggctgttgaaacagcgaaggaatggaccagattatatgctagtggcgcctgatgatgttgggttcaaacttttgtccccaaaataacaatggtgatggtcaaattgaattggatatctggaggaatcgttaatgtttcttatagcttccagttacctgatattttcttctcttggaagctgtcttatattggaactagtatgaatatgtgttggtcatttacctgtcttacattttagaacctgcttcatcttaaactgccaagtaatttgggattctcaaacatcaaagtctaaaatctgtgaataagtttgttttcattttgaagatttgctgcaagatgtgtttggttatacacttgtatgattcaacagaattttgactaaaacgtgtagacatttggagctgggcaaacagttatttcaataaatcaggtcctataatttttcg

SEQ ID NO: 1634 - DNA, 852 bp, Zea mays
cccaacccaacccaacccaccactgcctccctccccgttccccagtccccaccccgaccggctgctcctcctcctttccccgcgccatcctcgaggcatcaccggcgccgcaacttcgttgaggaggaagcccgcacccgcccccgatccgatggccaacagcaacctcccgcggcggatcatcaaggagacgcagcgactgctcagcgagccagcgccggggatcagcgcgtcgccctcggaggagaacatgcgctacttcaacgttatgatccttgggccggcgcagtcgccctatgaaggtggagtttttaagcttgaactctttttacctgaggaatatcccatggctgccccaaaggttaggtttctgaccaagatttatcatcccaacattgacaagcttggtaggatatgcctcgacattctcaaggacaaatggagcccagcacttcagattcgaacagttcttttgagtatacaggctctactgagtgcaccaaatccagatgaccctctctccgataacattgcaaagcactggaaatccaatgaggtagaagctgttgaaacagccaaggagtggactcgcctgtatgcgagcggtgcatgagagcgcagtgctgttcttggtgtaataaccccatcatacttcagtcctaatccgttgccatttgcttgataaaaatagactggagatatttgccatggaatgaagtctctaaatgactaccactctgaattgtttggttgtacacctgtggtcggttccctttacctttgggcacctttgactaatcagtatatgtggtagaacttgcagttactctaatatatttgtcacttcatgta

SEQ ID NO: 1635 - DNA, 866 bp, Zea mays
gaatcctgcggatagcctgacggctcgtttgaccttcgtctgtcgtctcgtctcgtccacctccccagcggcgcgtgaagcttgaggcaatccccgccctctctagccctgcgcaaccagttcggttccatggccaacagcaatctcccgcgccgaatcatcaaggagacgcagcggcttctcagcgaaccagcaccggggattagcgcgtcgccgtcggaggagaatatgcggtacttcaatgtcatgatccttggccccgcgcagtcaccctatgaaggtggagttttcaagcttgaactattcttgcctgaggaatatccaatggctgccccaaaagttagatttctcacaaaaatttaccatcctaatattgacaagcttggtaggatatgcctcgacattcttaaggacaaatggagtccagctcttcagatacgtacagttctactgagcattcaggcacttctgagcgccccaaacccagatgatcctctctcagacaacattgcgaaacactggaaatccaacgaagctgaagctgttgagacagcgaaggagtggactcgcctgtacacaagtggggcatgacagccaagtgttgttccagatgtaacaacacttccatagtttggggtcgattgaacacccctcttgcttggtgtgcgcaaatttgtgaaatgttgcaatggggtaaaaaacaaaaagctccaatcatgctttgtacttgtggctgtagctccgttcgctgcagtgcccatgaacatcaaagcaggtgttgctttgtccgttcctatccgaccatcagttgcttatcccccctgttccatgtgttgtggctatgaggattcagattcatgctgcct

SEQ ID NO: 1636 - DNA, 761 bp, Medicago truncatula
agaaaccttctttttctctctcttctctcatcaaccctcaaacccctattgcgtactttgcaatcgacccaataatggctaacagtaaccttcctcgaagaatcatcaaggaaacacagcgtttgctcagtgagccagcgcctggaattagtgcatccccttccgaagacaatatgcggtatttcaatgtgatgatccttggcccaactcagtctccttatgaagggggagttttcaagctagaactatttttgcctgaagaatatccaatggctgctccaaaggttaggttcttgacaaaaatatatcatcctaacattgacaagcttggcaggatatgtcttgatattctgaaagataagtggagtcctgccctccagattcgcactgtacttttgagtattcaagctcttttgagtgcaccaaacccagatgatcctctttctgagaacattgctaagcattggaaatctaacgaggctgaggctgttgagacagccaaagagtggaccagattatatgcaagcggtgcttgacaatttggtggatacttttggtctcaaataacaatagtggaagtgtatgctattaactatcaaattgaaatggaaaaatttagaggaattgtctaaactatgtggagtccattttcctcttatagcttccggttacatgtttattgctttctatcttccggaagacttctattggaacttgtatgaatatatggatgttttatgtgtcaaatttaaaacatggtc

SEQ ID NO: 1637 - DNA, 796 bp, Tropaeolum majus
tttcctaattttatatgctgcaaaactacgctactgccactcaccatccgagcccctaaacttattcttcctcaccaacgatctcttccaaaaaccctaattggcgttttctgcaatcaatctcctcaacaatggcaaacagtaatctgccccgaagaatcatcaaggaaactcaacgtctcctcagtgaaccagctcccgggataagtgcttctccatcagaggaaaatatgcgatattttaacgtgatgatactgggtcctactcaatctccttatgaaggaggtgttttcaagttggaactttttctgcctgaagaatatcctatggctgctcctaaggttcgattcctcaccaaaatataccatcctaacattgataagcttggaaggatttgcctggatattttgaaggataaatggagccctgctctccagatcagaactgtacttctgagtattcaagctcttctaagcgctcccaacccagatgatcctctttccgagaacattgccaagcactggaaaacaaatgaagttgaagctgttgaaacagcaaaagagtggactcgaatgtatgcaagtggcgcatgatcggttgccgcaaaagacatgtcttcttttttctaccgtataataacaatttatgaaatgtatggtatccagagccaattttatgtacaaactgggaaagaatatttgagcaactggattttgcgaaagcttccagttaatcaatcacccattgttgatgaacctgtgtatgattattagataagtaatgatgttcttctgtg

SEQ ID NO: 1638 - DNA, 1160 bp, Quercus alba
tagaaagaaagaaaagaagaagaagaatcaaaataaataaatacgaaccactatataagaagacttagcttagcttgcctttaaaaacttttagatccttccccatataattctctctttttctctttctttctttctgcgtttctctttcttcacctgcaaacttcaatctctctctctttcttccccaaatcttcgaagaatcaatggcgaacagtaatcttcctcgaagaattatcaaggaaacccagcggcttctcagtgaaccagctcccggaataagtgcttctccttccgaagacaatatgcgatacttcaatgttatgattcttggtccagctcaatctccttatgaaggtggagtgttcaaattagaattgtttcttcctgaagaatatccaatggcagctcctaaggttcgcttcctgaccaaaatatatcatcctaatattgataagcttggaaggatatgcctcgatattcttaaagacaaatggagtccagccctccaaatccgaacagtattgctgagcatccaagctcttttgagtgctccaaaccctgatgatccactttccgagaacattgcaaagcattggaagacaaatgaagctgaagctgttgaaacagccaaggaatggacccgtctgtatgcaagtggagcctgatgagcttgttggtcaacatatcaatctctaaaatgtctgttaaacttgatggttggtttgtcatttggtattaaaaatatgaatggaaaaatgatctgtgacttgatctatgaaagatgaatcttcttgagaacatcaattaactgagagtcatcatcaggaatgaacaaatgatttctgagttgatcaatgaaagatgattcttctgaagaacttcatttatttgatagtcatctttaataacttgaaaggctttttcatcttttgaagagcctgcttttaagatctgcatgattatattgaagtttgatatcgattttttgtgcacttcaactttaattttagatgtgtaatttttaaatatatttgtgtgttgcggaaataactatgataaacaggattatgcttgactgattaaatgtaacctgttaaaacaagaaaatgaatatccctggaagacactgtcctttgtaacatgtagttacagaataa

SEQ ID NO: 1639 - DNA, 985 bp, Arachis hypogaea
ctaatttcttttttctttgtgtgttcctctctttctctctttctttttctccgagactcaaaaccctattgcgtgttttgcaatcgaccctccaaaaatggcgaacagcaacctccctcgaagaatcatcaaggaaacgcagcgtttgctcagtgagccagcacctggaattagtgcttcgccttcggaagacaacatgcgatatttcaatgtgatgatccttggccctactcagtcaccctatgaaggtggagttttcaagttagaactatttttgccagaagaatatccaatggctgctccaaaggttcggtttctaacaaaaatatatcatccaaacatcgataagcttggcaggatatgtcttgatattctgaaagataagtggagccctgcccttcagatacgcactgtactcttgagtatccaggctctgttgagtgcaccaaacccagatgatccactatctgagaacattgccaagcattggaaaagtaacgaggccgaggctgttgaaactgcgaaggaatggactcgattatatgctagcggtgcctgatttacgtggtggagactttcaggctgaaataacaatagtgcaagtgtaatggtagtaactgcaaatttgaaatgggaacgcggaggaattgatgtctgaacttattttggagttgatgttcctcatacatagtttccagttacctgttaattgctttcttccccgggtggaagcctttatcttggagcttgtattaatataaatgtgatctttttatctgccaaaatttagaacacactcccaacttcaactgttaagtaatttggaattgttaaagtcaaaatcaaaatcaaaacttttaaataagctgttgttgggtttcactcaatatctctgcatttatgtccgtaaatatgtgacagcgatgtcaagtagtgtcttgaaggccgaagggaagacacatttgaatcagaaggcgctctatca

SEQ ID NO: 1640 - DNA, 1005 bp, Arachis hypogaea
ggggaatagcttagttcgtatttggaattgtgacagtggggagttgaggaactgtctctctcgctgtgttctgaaaagagggaaaaccctattgcgtgcattgcagtcgacccctgacaatggccaacagtaatctccctcgaagaatcatcaaggaaacgcagcgtttgctcagtgagccagcaccgggaattagtgcttccccttcggaagataatatgcgatatttcaatgtcatgatcctcgggccgacccagtcaccgtacgaaggtggagtcttcaaattagagctatttttgccagaagaatatccaatggctgctccaaaggttaggtttctgacgaaaatatatcacccaaacattgacaagcttggcaggatatgtcttgatattcttaaagataagtggagtcctgcccttcagatacgcaccgttcttttgagtattcaggctcttttgagtgcaccaaacccggacgatccactttctgagaatattgcaaagcactggaaatcaaatgaggccgaggctgttgaaacagcaaaggaatggactcgattatatgcaagcggtgcctgatgattgggttcaaacttacggcttcaaacgttcaagtgtataatatgaactgtcagttttaaatggaaaatatggtcaaattgttgtctaacttgtgagtttatattccaaatagcctccagtttcctcttaatttccgtatcttggaagtcagaattcttatgtgctttacgttgatctgtctttaaaattagcgcatccttcattgagctctatacgtagttacgtactattttacaatagctaaaatttttgtataggtttatgtgttctcttcgttttatttgtttggttatgaaatctatgatcgccaaaagtgtacattggtagtcacggcacatttctaacacttgcagctaacgaattttagggtgagctttgtgtgttatgaataatttttagggcttgggattgactaagtctt

SEQ ID NO: 1641 - DNA, 821 bp, Catharanthus roseus
ggcacgaggcgcctctccattcccaactatcaaataattctctctctcgctctccccaaaagcccttagcgtaaactctgggagcaaagaagaaaactttatagctctctactcgatcaatcaattcaattcaattcaatggctaatagcaacttacctcgtagaatcatcaaggaaactcagcgtcttcttagcgagcccgcacctggaataagtgcatctccttccgaagacaatatgcggtactttaacgtgatgattctcggtccaacgcaatctccctatgaaggaggcgttttcaagttggaattgttcttacctgaagaatatccaatggcagctccaaaggttaggttcctcaccaagatataccaccctaacattgataagctgggaaggatatgcctcgatatccttaaagacaagtggagtcctgcgcttcagataagaactgtgcttttaagtattcaagcacttctgagtgcgccaaaccctgacgatccgctatctgaaaacattgcaaagcattggaaatcaaatgaggctgaagctgttgaaacagcaaaggaatggacgcggctgtacgcaagtggtgcttgaagctcatccaaattccatggtctcaaaaataacatgtgcaatgtactttattgactattgaattaatatgaacattcggaagaaacattgatgatgcctaattcatggggaatttagtgtcaaaaaggcattcagttatgcaggataatcgctttctggttctgaacatgtctttcaaattgtaaaattaaatgaaaattctcatttccttgtgttgtctt

SEQ ID NO: 1642 - DNA, 814 bp, Petunia hybrida
cgcggggacttttgtagcacatatattattatcaaattctcaaaaaagtatctccactctctctagaaatagaaataacaaaaagaagaacccttagcgtaaagtaaaagcttgaaattcaatggctaatagtaatcttcctcgaagaattatcaaggaaactcaacgtcttctcagtgaacctgcgcccggaataagtgcgtcgccatcggaagaaaatatgagatattttaatgtgatgattctgggtccaacacagtctccttatgaaggaggtgtctttaagctcgaactctttttacctgaagagtatccaatggctgctcctaaggttcgattcctcaccaaaatctaccatccaaatattgacaagcttggaaggatctgtctcgatattcttaaagacaagtggagtcctgctcttcagatccgtactgtacttttgagcatccaagcacttctgagtgctccaaatccggatgatccactctctgagaacatcgcaaagcattggaagacgaatgaggctgaggctgttgaaacagctaaggagtggacacggctatatgctagtggtgcatgaagagcatagtgatgaaaaagtaaaaacaaaaaaataacaaatattatgaaaatgtattctattgactggcttatcaatgtggcacttgggatggctgttaatgcctgaactcttccagttaccccataattgttccctccacttgaaattgtataatgaaatgtgacgccctttggttttttgatgttcaggaatgaacttataaaaaaactgcaagggtagttaatgatt

SEQ ID NO: 1643 - DNA, 781 bp, Solanum tuberosum
gctattctccacttgctccccattcaccctttctctctctagaaaagaagaacccttagcgtaaactctgcgaaccgaagaaccccaaaaggctttcaattcaatggctaacagcaatcttcctcgaagaattatcaaggaaactcaacgtcttctcagcgaacctgcgcctgggataagtgcgtcgccgtctgaagaaaatatgcgatactttaatgtcatgatacttggtccaacacagtctccatatgaaggaggtgtcttcaagctcgaactatttttgcctgaagagtacccaatggctgctcctaaggttcgattcctcaccaaaatctaccatccgaacatcgataagcttggaaggatatgtcttgatattcttaaagacaaatggagtcctgctcttcagatccgtacagtacttttgagcattcaagcacttttgagtgctccaaatccagatgatccactctctgaaaacattgctaagcactggaagtcaaatgaagttgaagctgttgaaacggctaaggagtggacacgcctatatgctagtggtgcatgaagatatagcaacgaaatattcaaaataacaaaaatcatggaatgtaatcaatattgactggcttatcaatatgacgcccggattgcacccttgaaattgtataattgaacatgacaccctttggttttttaatgttcaggaatgaactttgttgcaacaaaactggaaatggtaaggatttggtcactgcaaagagtagtaatgattcagatctgt

SEQ ID NO: 1644 - DNA, 887 bp, Solanum tuberosum
ggagagagagtgcttctgaaactctcaatccattttttctactttctctctctagaaaaagtgcattttagcttaaattttctgcgaacaattttttttttcatcgattcaatttcaatggctaacagcaatcttcctcgaagaattatcaaggaaactcagcgtcttctaagtgaacctgcaccaggaataagtgcttctccctcagaagaaaatatgcgatattttaatgtcatgattcttggtccaacacagtctccgtatgaaggaggtgttttcaaactggaactctttttgcctgaagagtacccaatggccgcgccaaaggttcgattcctcaccaaaatctatcatccgaatattgataagcttggaaggatatgccttgatattctcaaggacaagtggagtcctgctcttcagattcgtaccgttcttttgagcattcaagcacttttgagtgctccaaatccagatgatccactctctgagaacattgcaaagcactggaagtcaaacgaggctgaagctgttgaaacggctaaagaatgggcgcgtctttatgcaagtggtgcctgaagaccataattaagtgattttctaacggaaaaaaaaccccgtggaatgttattgatccactgtttaatccgaatgggacttgggaggactgaagctgaatgcttcaaattacccatctagaattgttgccctgtccttgaaattgtacaattgaacgatgtacctttttttcaagttgaattggtctttactactatatcagaaacggtactaaagtattatctcacagaaacactgaattgaaagacaacgtgtgtgtgcgaacctccgtgaactagtccgaggtagttggttcccaaaaaaaaaaa

SEQ ID NO: 1645 - DNA, 774 bp, Raphanus sativus
  misc_feature (3)..(3): n is a, c, g, or t
ggnttcattaatctgaccgacgacgacgacgacgacgacgaagtgttctcgattctcggcgtgcggatcttctctctcgaaaccctaactattatcgatcgattgaggttagcagcgagcgataatggccaacagtaatcttccccgaagaatcatcaaggaaactcaacgactgctcagtgaacctgctcctggtataagtgcgtctccatctgaggagaacatgcgttacttcaacgttatggttcttggtccttctcaatcaccttatgaaggaggagttttcaagttggagctctttctgcctgaagaataccctatgtcagctcccaaggttaggtttctcaccaagatataccatcctaacattgataagcttggaagaatatgtcttgatattctgaaagacaaatggagccctgctctacaaatacgaacagtgcttttaagtatccaagctcttctgagtgcaccaaaccctgatgatcccttgtctgagaacatcgctaagcattggaagagtaatgaggcagaagctgtggagacagctaaggaatggacccgtctttacgcaagtggcgaatgatgcagtgttggagggttaaaaagatctcgctcatccaaataaacattacatttggttaaatcttattatcctttgctggttcttccctctcattatgataaaaaatgttgtgtgtcggcacacaaaagctgtaatctctctgaatgattgtatcattaactaatagggtctgtcaagacatttagtaa

SEQ ID NO: 1646 - DNA, 732 bp, Raphanus sativus
  misc_feature (41)..(41): n is a, c, g, or t
  misc_feature (131)..(131): n is a, c, g, or t
  misc_feature (185)..(185): n is a, c, g, or t
  misc_feature (209)..(209): n is a, c, g, or t
  misc_feature (248)..(248): n is a, c, g, or t
  misc_feature (356)..(356): n is a, c, g, or t
  misc_feature (428)..(428): n is a, c, g, or t
  misc_feature (515)..(515): n is a, c, g, or t
  misc_feature (551)..(551): n is a, c, g, or t
  misc_feature (646)..(646): n is a, c, g, or t
ggccattcattaatctgaccgacgacgacgacgaagtgttntcgattctcggcgtcccgaaaccctaactcttatcgatcgatcgatcgatcgagcttagcagcgagcgaataatggccaacagtaatctnccccgaagaatcatcaaggaaactcaacgtctgctcagtgaacctgctcctggnataagtgcgtctccatctgagganaacatgcgttacttcaacgttatggttcttggtccttcncaatcaccttatgaaggaggagttttcaagttggagctctttttacctgaagaataccctatgtcagctcccaaggttaggtttctcaccaagatataccatcctaanattgataagcttggaagaatttgtcttgatattctgaaagacaaatggagccctgctctacaaatacgaacngtgcttttaagtatccaagctctgctgagtgcaccaaaccctgatgatcccttgtccgagaacatcgctaagcattggaagagtaangaggcagaagctgtggagacagctaaggaatggacncgtctttacgcaagtggcgaatgatgcagtgtctctcgctcatccatcaaataacattacatttggttaaatcttatcctttgctggttcttccncctcattacgaagttgtaatctctctgaatgattgtatcattaacttatatgttcaagacatttactagttgcatttccaaacgca

SEQ ID NO: 1647 - DNA, 1296 bp, Oryza sativa
cgcactagtagcagaagaaaaaagctaccggggcgggccacagtctctccactatagcaaaagggaaacgcgtccgtgcgcccgtgtataatagcgggcgatccacccgtcgtctcgtctcccccgtttcccccaccctcggctgacggctcctcctcctcctcctcctcttcctccctcccgatcccctcccccgcacgaaactcaaagcatccccggcgccgcagctccccggaggaggaagcccccgcgccccgccccgaccagatccgatggccaacagcaacctcccccggcgaatcatcaaggagacgcagcgactcctcagcgagccagcgccgggaatcagcgcgtctccgtcggaggagaacatgcgctacttcaacgtcatgatccttggcccggcacagtccccctatgaaggtggagtttttaagcttgaactctttttacctgaggaatatcctatggctgctccaaaggttaggttcctgaccaaaatataccaccccaacattgacaagcttggtaggatatgccttgacattctcaaggacaaatggagcccagcccttcagattcggacagttcttttgagtatccaggcactcctaagtgcaccaaaccctgatgatcctctctctgataacattgcaaagcactggaaagccaatgaagcagaagctgttgaaacagcaaaggagtggactcgcctgtatgccagcggtgcataaaacccaatgcctctcgtgatgtaataacccgtcatgctttagccttaatcaaatgccatttgcttgataagaacaaactggagatattggcagtggaagggagtttaaatgactaccgcttgaattatttgtctgtatacatgtggttggttccctttaccctagggcacccttgactaatcagtatctgtggtagaacttggtgctcctccaatatatttattactttatgttggaaaacttaaattgttgaaattggatctttgttcgtgtggctgcactttgtaccctctagtttctgttacctgggaaatgggagatcgttccgacgaagcctgacgggacgatttggcaaaatcggttgcggttgtcgtcgacttgtggcatcgtcttgccactttgttggcaaagtactaccgtacttgtatgcctgtagcttgtcaactgcatatataagcgtatacgccttccaaacgtgcgtttcgatttggcagatgtactgtatgtgctgtcgcaggtgcccctttgttttgttttttctttttcagtatcagttcggcga

SEQ ID NO: 1648 - DNA, 816 bp, Carthamus tinctorius
acgctaggcgggggtatctctctcagaaaccctctttctctctctctctctctctctcctaaaaaaggcaaaagccccccttagcgtaaatcttccccttccatggcgaacagcaatctccctcgcagaattatcaaggaaactcagcgcttactcagcgaaccagctccgggaataagcgcatcgccatcggaagataacatgcggtattttaatgtcatgatccttggtccaacacagtctccttacgaaggaggagttttcaagctggagttatttctgccggaagaatatccaatggctgctcccaaggttcggtttcttacaaaaatttaccatccgaacattgacaagcttggtaggatttgccttgatatcctcaaagacaaatggagccccgctcttcagattcgcactgtactcctgagcatccaagctcttctaagtgctccaaacccagatgatcctctctctgagaatatagcaaagcactggaaatctaatgaagctgaagctgtggaaacagcaaaggaatggacccgtttgtatgctagtggtgcgtaaccgagatgtggaagatgagtgttggtcggaatgaaaagaaaaataacaatgtacttgattaggtcttgagattgaaaacttgaatgattctactgctgaactgaacgatcaatgttgttcacttcatacccttgtgttttttcgataagtaactctctgtttcctaatttacttttgttatagcataagtagtattatgggtaaaagtagcagcaacatcttctgttttttggacttttatcacatatctgt

SEQ ID NO: 1649 - DNA, 971 bp, Solanum phureja
gagaaacagtgcttctgaaactctcaatccattttttctactttctctctctctagaaaaagtgcattttagcttaaattttctgcgaacaattttttttttcatcgattcaatttcaatggctaacagcaatcttcctcgaagaattatcaaggaaactcagcgtcttctaagtgaacctgcaccaggaataagtgcttctccctcagaagaaaatatgcgatattttaatgtcatgattcttggtccaacacagtctccgtatgaaggaggtgttttcaaactggaactctttttgcctgaagagtacccaatggccgcgccaaaggttcgattcctcaccaaaatctatcatccgaatattgataagcttggaaggatatgccttgatattctcaaggacaagtggagtcctgctcttcagattcgtaccgttcttttgagcattcaagcacttttgagtgctccaaatccagatgatccactctctgagaacattgcaaagcactggaagtcaaacgaggctgaagctgttgaaacggctaaagaatgggcgcgtctttatgcaagtggtgcctgaagaccataattaagtgattttctaacggaaaaaaaaaccccgtggaatgttattgatccactgtttaatccgaatgggacttgggaggactgaagctgaatgcttcaaattacccatctagaattgttgccctgtccttgaaattgtacaattgaacgatgtacctttttttcaagttgaattggtctttactactatatcagaaacggtactaaagtattatctcacagaacactgaattggaggacaacgtttgttgtgcgagtcctcgttgctttccacttctctttttgaaccaaggatctatcggaaacaacctctctaccccatgaaggttggggcaaggcttgtgtacttgttatcctctcaaacctcacttgtgggattacat

SEQ ID NO: 1650 - DNA, 964 bp, Solanum phureja
gtcaaattctcacaaactattctccacttgctccccattcaccctttctctctctagaaaagaagaacccttagcgtaaactctgcgaaccgaagaaccccaaaaggctttcaattcaatggctaacagcaatcttcctcgaagaattatcaaggaaactcaacgtcttctcagcgaacctgcgcctgggataagtgcgtcaccgtctgaagaaaatatgcgatactttaatgtcatgatacttggtccaacacagtctccatatgaaggaggtgtcttcaagctcgaactatttttgcctgaagagtacccaatggctgctcctaaggttcgattcctcaccaaaatctaccatccgaacatcgataagcttggaaggatatgtcttgatattcttaaagacaaatggagtcctgctcttcagatccgtacagtacttttgagcattcaagcacttttgagtgctccaaatccagatgatccactctctgaaaacattgcaaagcactggaagtcaaatgaagttgaagctgttgaaacggctaaggagtggacacgcctatatgctagtggtgcatgaagatatagcaacgaaatattcaaaataacaaaaatcatggaatgtaatcaatattgactggcttatcaatatgacgcccggatagcacccttgaaattgtataattgaacatgacaccctttggttttttaatgttcaggaatgaactttgttacaacaaaactggaaatggtaaggattttgtcactgcaaagagtagtaaatgattcagatctgtgggttggaattggaaactagtgttgctgcagctgctatcaacctccatagatttgtttcaggaaattgaatttgcaaggggaaatcttttgtttgtccctttttgttctctctttctttctttcccgcccgccctatcctgcattgtttgttcgggttctgcatgct

SEQ ID NO: 1651 - DNA, 924 bp, Glycine max
tcattttaatagagtgtttgctgattgaaaataaagtttttcgatctcagcattgttcatttctgtctcactgagagaaactctctctctctctctctctctctctctagaaaccctattgcacgttttgcaatcgaactcgacaatggccaacagcaacctccctcgaagaatcatcaaggaaacgcagcgtttgctcagtgagccagcacctggtattagtgcctccccctctgaagagaatatgcgatatttcaatgtgatgatccttgggcctacccagtcgccttatgaaggaggcgttttcaagttagaactatttttgccagaagaatatccaatggctgctccaaaggttaggtttctaacaaaaatatatcatccgaacattgataagcttggcaggatatgtcttgatattctgaaagataagtggagtcctgcacttcagatacgcactgttctattaagcattcaagctctattgagtgcaccaaacccagatgatccactttctgagaacattgccaagcattggaaatctaatgaggccgaggctgtcgaaacagcgaaggaatggacccaattatatgctagtggcgcctgatgataggcttcaaacttatggctccaaaataacaattgtaaccattttatattggaaatctacaggaatttatgtatgaactattcgaattaatattcctagcagcttccagttacctgttaatttcttctcttggaagctgccttatgttggaacttgtatgaatatatgtgttgatcatttacctatctaacaatttagaacgtgcttcagtcgttgactgaagtaatttggtattctcaacatcaaaggccaaaatttgtgatttagtttctgttctctttatctcaatgaatcagtcaaagatttgattggtt

SEQ ID NO: 1652 - DNA, 949 bp, Glycine max
tttttttttttttcattttaatagagtgtttgctgattgaaaataaagtttttcgatctcagcattgttcatttctgtctcactgagagaaactctctctctctctctctctctctctctagaaaccctattgcacgttttgcaatcgaactcgacaatggccaacagcaacctccctcgaagaatcatcaaggaaacgcagcgtttgctcagtgagccagcacctggtattagtgcctccccctctgaagagaatatgcgatatttcaatgtgatgatccttgggcctacccagtcgccttatgaaggaggcgttttcaagttagaactatttttgccagaagaatatccaatggctgctccaaaggttaggtttctaacaaaaatatatcatccgaacattgataagcttggcaggatatgtcttgatattctgaaagataagtggagtcctgcacttcagatacgcactgttctattaagcattcaagctctattgagtgcaccaaacccagatgatccactttctgagaacattgccaagcattggaaatctaatgaggccgaggctgtcgaaacagcgaaggaatggacccaattatatgctagtggcgcctgatgataggcttcaaacttatggctccaaaataacaattgtaaccattttatattggaaatctacaggaatttatgtatgaactattcgaattaatattcctagcagcttccagttacctgttaatttcttctcttggaagctgccttatgttggaacttgtatgaatatatgtgttgatcatttacctatctaacaatttagaacgtgcttcagtcgttgactgaagtaatttggtattctcaacatcaaaggccaaaatttgtgatttagtttctgttctctttatctcaatgaatcagtcaaagatttgattggttatggcatggttgg

SEQ ID NO: 1653 - DNA, 890 bp, Glycine max
ggattttcattgagctttgttctcttttgtgttagtgagagaaagttctctctgcttctctctcttagactcaaaaccctattgcgtgctttgcaatcgaccccgattatggccaacagtaacctccctcgaagaatcatcaaggaaacgcagcgtttgctcagtgagccagcacctggaattagtgcgtccccttcggaagacaatatgcggtatttcaatgtgatgatccttggcccaactcagtcgccttatgaagggggagttttcaagttggaattatttttgccagaagaatatccaatggctgctccaaaggttaggtttctgacaaaaatatatcatccaaacattgataagcttggcaggatatgtcttgacattctgaaagataagtggagtcctgcccttcagattcgcactgtacttttgagtattcaagctcttctaagtgcaccaaacccagatgatccgctttctgagaacattgccaagcattggaaatctaatgaggccgaggcagttgaaacggccaaggaatggacccggttatatgctagcggcgcttgatgctttggtggaaacttttggcttcaaataactatagtgtgggagtgtatgctatataactgtcaaattgaaatggaaatttggaggaattgtctaaactattttggagttaatattccccgtagcttccggttacctgttaattactttctttctcctggaagcattatcttggaacttgtatgaaaaatatgtgatcttttctgtgacaaatttaaacatgcttcatctcccaactcctgagtaatttgggatcctcaaacttaatagtaaaaaatttcgaataagcttctgttggtttgtgtccttttcgatgaatt

SEQ ID NO: 1654 - DNA, 1027 bp, Glycine max
gtcatgtaatgtaatatttactctttattttttccttattatattttttaggaagcaaaaattatataaatagcgacgagagataaaggattttcattgagctttgttctcttttgtgttagtgagagaaagttctctctgcttctctctcttagactcaaaaccctattgcgtgctttgcaatcgaccccgattatggccaacagtaacctccctcgaagaatcatcaaggaaacgcagcgtttgctcagtgagccagcacctggaattagtgcgtccccttcggaagacaatatgcggtatttcaatgtgatgatccttggcccaactcagtcgccttatgaagggggagttttcaagttggaattatttttgccagaagaatatccaatggctgctccaaaggttaggtttctgacaaaaatatatcatccaaacattgataagcttggcaggatatgtcttgacattctgaaagataagtggagtcctgcccttcagattcgcactgtacttttgagtattcaagctcttctaagtgcaccaaacccagatgatccgctttctgagaacattgccaagcattggaaatctaatgaggccgaggcagttgaaacggccaaggaatggacccggttatatgctagcggcgcttgatgctttggtggaaacttttggcttcaaataactatagtgtgggagtgtatgctatataactgtcaaattgaaatggaaatttggaggaattgtctaaactattttggagttaatattccccgtagcttccggttacctgttaattactttctttctcctggaagcattatcttggaacttgtatgaaaaatatgtgatcttttctgtgacaaatttaaacatgcttcatctcccaactcctgagtaatttgggatcctcaaacttaatagtaaaaaatttcgaataagcttctgttggtttgtgtccttttcgatgaattcatagatatcttgtttggttgtgtaaaatcaagagcttaacgcataaaca

SEQ ID NO: 1655 - DNA, 957 bp, Glycine max
tttatcattttaatagagtgtttgctgattctctcggcgttgttcatttctgtctcagtgagagaaactctctctctagaaaccctattgcacgttttgcaatcgaactcgacaatggccaacagcaacctccctcgaagaatcatcaaggaaacgcagcgtttgctcagtgagccagcaccaggaattagtgcctccccttctgaagagaatatgcgatatttcaatgtgatgatccttgggccaacccagtcgccttatgaaggaggagttttcaagttagaactatttttgccagaagaatatccaatggctgctccaaaggttaggtttctaacaaaaatatatcatccaaacattgataagcttggcaggatttgtcttgatattctgaaagataagtggagtcctgcccttcagatccgcactgttctactaagcattcaagctctattaagtgcaccaaacccagatgatccactttctgagaacattgccaagcattggaaatctaatgaggctgaggctgtcgaaacagcgaaggaatggacccgattatatgctagtggcgtctgatgatagggttcaaactcatggctccaaaataacaattgtaaccattttatattggaaatctagaggaattgatttatgaactattggaattaatattcctcgcagtttccagttaccttttaatttcttctcttgaaagctgccttatgtttgaatttgtatgaatatatgcgttgatcatttacctatctaacaatttagagcgtgcttcaatcatcgactgtgaagtaatttggtattctcaacatcaaaggccaaaatttgtgaattagtttctgttctctttactcatcaatgaatcattcaaagatttgattggttagggcatgttggaaatttctctattagtacttatgagagaagaaataattatacttttta

SEQ ID NO: 1656 - DNA, 975 bp, Glycine max
tttttttgtcccctttttatcattttaatagagtgtttgctgattctctcggcgttgttcatttctgtctcagtgagagaaactctctctctagaaaccctattgcacgttttgcaatcgaactcgacaatggccaacagcaacctccctcgaagaatcatcaaggaaacgcagcgtttgctcagtgagccagcaccaggaattagtgcctccccttctgaagagaatatgcgatatttcaatgtgatgatccttgggccaacccagtcgccttatgaaggaggagttttcaagttagaactatttttgccagaagaatatccaatggctgctccaaaggttaggtttctaacaaaaatatatcatccaaacattgataagcttggcaggatttgtcttgatattctgaaagataagtggagtcctgcccttcagatccgcactgttctactaagcattcaagctctattaagtgcaccaaacccagatgatccactttctgagaacattgccaagcattggaaatctaatgaggctgaggctgtcgaaacagcgaaggaatggacccgattatatgctagtggcgtctgatgatagggttcaaactcatggctccaaaataacaattgtaaccattttatattggaaatctagaggaattgatttatgaactattggaattaatattcctcgcagtttccagttaccttttaatttcttctcttgaaagctgccttatgtttgaatttgtatgaatatatgcgttgatcatttacctatctaacaatttagagcgtgcttcaatcatcgactgtgaagtaatttggtattctcaacatcaaaggccaaaatttgtgaattagtttctgttctctttactcatcaatgaatcattcaaagatttgattggttagggcatgttggaaatttctctattagtacttatgagagaagaaataattatactttttacaa

SEQ ID NO: 1657 - DNA, 738 bp, Euphorbia esula
  misc_feature (400)..(400): n is a, c, g, or t
  misc_feature (668)..(668): n is a, c, g, or t
  misc_feature (724)..(724): n is a, c, g, or t
tctctctttctctcaaaaaccctcgagtagcgttcgttctctgcaatccacctctaaagaaatggccaacagtaatctccctcgaagaatcatcaaggaaacccaacgtcttcttagtgaaccagctccggggataagtgcctcgccatcagaggataatatgcggtatttcaatgtcatgattcttggcccaacacagtctccatatgaaggaggagttttcaagctggaattgtttcttcctgaagaatatccaatggctgcacccaaggttcgatttttgaccaagatttatcatcctaatattgacaagcttggaaggatttgtcttgatattctgaaagacaaatggagtcctgctcttcagatacgaactgtacttttgagcatccaagcgctncttagtgctccaaaccccgatgatccactctcggagaatatagcaaagcactggaaatcaaatgaagctgaagctgttgaaacagcaaaggaatggacccgtttgtatgcgagtggtgcatgaagatgtgcgtcaactatttctcccttcaaacaaacttcatgtgatatatgctctctattaacttgttaaattgaatggaaaattgaagaattgatgtttgaacaaattataatttaatgttttcccaagcttccagatactgccntgatgagaatgtctgaagttggaagcatctttgttgaatttgtatgattagataangtacatttttcctc

SEQ ID NO: 1658 - DNA, 843 bp, Helianthus annuus
gcgtaaatcagctcttctatggcgaacagcaatcttcctcgaagaattatcaaggaaactcagcggttactgagtgaaccagctccgggaataagtgcatcgccgtcggaagataatatgcggtattttaatgtcatgatccttggtccaacacagtctccttatgaaggaggagttttcaagctggagttatttttgccagaagaatatcctatggctgctcccaaggtccggtttcttacaaaaatttaccacccgaatattgacaagcttggtaggatttgtcttgatatccttaaagacaaatggagccctgctcttcagattcgcactgtactcttgagcattcaagctcttttaagtgctccaaacccagacgatccactctctgagaacatagcaaagcactggaaatctaatgaagctgaagctgttgaaacagcaaaagagtggacccgtttgtatgccagtggcgcctaacggagattcggtcaccgtgttgtttggagaaaataacgatgtatttggttaggtctaaaacttgaatggttccgcctgctgcaatgttgttcacttctttatttcagataagacactaatttttatatgtgaaacattcatctggtaactatgtgaaaaagtacttctggacacggttgttataaccttgagacttgggtcgggtgatgtgattcctgtcgctacaaccgccgggttgtgttttgggttgatgtcacgaaatgacattaaatgtaacaataagagttcgtcaaaaaattataatagtgacatgttctcacgccgtttatctgtgtactatttaccaatagagtttgttcacaa

SEQ ID NO: 1659 - DNA, 792 bp, Helianthus annuus
gaagatcgtctcaaatccataataatatattattatcaatattaatcccccacactttctctctctagaaaaccctcactttctctctcttcgcaaaatctccggtagcgtaaatcttccccttccatggcgaacagcaatctacctcgaagaattatcaaggaaacgcagcggttactcagcgaaccagctccggggataagcgcgtcgccgtccgaagataatatgcgttattttaatgttatgatccttggtccaacgcagtctccttatgaaggaggagttttcaagctggagttgtttttgccagaagaatatcccatggctgctcctaaggttcggtttcttacgaaaatttaccatccgaacattgacaagcttggtaggatttgtcttgacatcctcaaagacaaatggagccccgctcttcagattcgcactgtactcctgagtattcaagctcttctaagtgctccaaacccagatgatccgctctctgagaacattgcgaagcattggaaatctaatgaagctgaagctgttgaaacagcaaaggagtggactcgtttgtatgcaagtggtgcctaatggagatgcgggtcactatgttgtttttaagaaaataacagtgtatttggttaggtcttgaaattcaaaacttgaatgctgcagtgttgttcactttcttgtgtttttcgagataatattgtaattctggttaattaactatgtgaaagaatagtgtgggtaacagggttgttttgatctgcatcccaaaactgggatggcttt

SEQ ID NO: 1660 - DNA, 1239 bp, Panicum virgatum
ccactacagcaaaaaccgcgtccgcgtacgctagcgagcgaccaacgcgtccaacccgccgcaccccccgttccccacccccgcccgacgcccgactgctcctcctcctcctcctcctccgcgcgatcctcaaggtaccagcggcgccgcaacttcgcagaggaggaagcccgcgcccccggccccgatccgatggccaacagcaacctcccgcgccggatcatcaaggagacgcagcggctgctcagcgagccagcgccggggatcagcgcgtcgccctcggaggagaacatgcgctacttcaacgtcatgatccttggcccggcacagtcgccctatgaaggtggagtttttaagcttgagctctttttacctgaggaatatccaatggctgccccaaaggttagatttctaaccaagatttaccatcccaacattgacaagcttggtaggatatgccttgacattctcaaggacaaatggagcccagcacttcagattcgaacagttcttttgagtatccaggctctcctgagtgcaccaaacccagatgatcctctctcggataacattgcaaaacactggaaagccaatgaggcagaagctgttgaaacagctaaggagtggactcgcctgtatgcgagcggtgcatgacaacccagtgctgtccttgatgtaataacccatcatacttcagtcctaatctattgccatttgcttgatgagaacagactggagatatttgccattgaaggaagtctctaaatgacttaccagtcgaattgtttggttgtacacctacctgtggtcggttccctttaccttgggcacctttgactaatcagtatctgtggtagaacttgccgctactccaatatatttgttacttcatgtaggagagtttctcaactgtccatattgttgaaactgaggcttgttaccttggctgcgcttttgttgctcctctcgtttttgtgctttctcatctggaaaccgcattgctgaggctagggttggacttgcacattctctgcggaattgtacggaaggatatgattttttttttcacaatgctttgatagctttacccacagggattacgtcggtcagtaacaaaaaaagtctctgaccaatatatttgtagttagtgtcttagtgatactgatgagatttaaaagccatgaattttgtactcaggtatgcactgaataatattctagagtggtgtgaccttgtgat

SEQ ID NO: 1661 - DNA, 789 bp, Panicum virgatum
tcctttgaccccccatcgtatcgtctcgtctcgtcttcctctgtcgccgcacgaagcttgaggcaatccaccccgctccccccgcccgcgcccccaagccctgcgctccgcagcccgggatccatggccaacagcaacctcccgcgccgaatcatcaaggagacgcagcggctcctcagcgaaccagcgccagggattagcgcgtcgccgtcggaggagaacatgcggtacttcaatgttatgatccttggccccgcgcagtcaccctatgaagggggagttttcaagctcgaactattcttgcctgaggaatatcctatggctgctccaaaagttagatttctcaccaaaatttatcaccccaacattgacaagcttggtaggatatgccttgacattcttaaggacaaatggagtccggctcttcagatacgtactgttctgttgagcatacaggcactgctgagcgcaccaaatccggacgatcccctctctgacaacattgcaaagcactggaaagcaaatgaagctgaagctgtcgagacagcgaaggagtggactcgcctttatgcaagtggggcatgacaaccaagggttgttatctttgtaataacaatatcacctgcttgagagcaaattgcaatgttttgcaacaggggaaaaatgatcgaaccatgacagttcgaattatgctttgtacttgtgtctccgttcagtgcagtaagcatcaaagcatgtgttgcttggtctgattcaatttgctgttatgtggctaaagctcccttctct

SEQ ID NO: 1662 - DNA, 686 bp, Tabernaemontana elegans
gcaaaagcccttagcgtaaactctgcgaccaaagaagaaaactttacagctcttctcaatcaatcagttcaattcaatggctaacagcaacttacctcgtagaatcatcaaggaaactcagcgtcttcttagcgaacccgcacctggaataagtgcatctccctctgaggacaatatgcggtactttaatgtgatgattcttggtccaacacaatctccttatgaaggaggtgttttcaagttggaattgttcttacctgaagaatatccaatggcagctccaaaggttcggttccttaccaaaatataccaccccaacatcgataagctaggaaggatatgccttgatatccttaaagataaatggagtcctgcccttcagatccgaactgtacttttaagcattcaagcacttctgagtgccccaaacccagacgatccactctctgaaaacattgcaaagcactggaaatcaaatgaggctgaagctgttgaaacagcaaaggagtggacacgtctatatgcaagtggtgcctgaagcttatgcaaattccatggtcccaaaataacatgtgcaatgtactttattgactgttgggttgatatgaaatttggagaaatattgatgcctaattcatggggaatttagtgttaaaaacatccagttactgcaggataattgtttt

SEQ ID NO: 1663 - DNA, 823 bp, Camellia sinensis
gttttttcaagtgagaaagtctctaacaaacagctttctctctctactctctctctctattctttttcgcgaacccttagcgtgcccttcaatcgaaccttcccttcaatggcaaacagcaatttgcctcgaagaatcatcaaggaaactcagcgtctcctcagcgagcctgcaccgggaataagtgcatcaccttcggaagataatatgcggtattttaatgtcatgattcttggtccatcacagtctccttatgaaggaggggttttcaagctggaattatttttacctgaagaatacccaatggctgctcccaaggttcgattcctcaccaaaatctaccatcctaacattgataagcttggtaggatatgcctcgatattctcaaggacaaatggagtcccgctcttcagattcgaaccgtactcttgagtattcaagcacttttgagtgctccaaatccagacgatccactatctgagaacattgcaaagcattggaaatcgaatgaagctgaagctgttgaaacagcaaaggaatggacccgtctatatgcaagtggtgcatgaaaaaatgttgggagtttagggcccctccggcaataacagaatatgcaatgtatcttatggactgttgaattttaatggaaatttgaaagaattgatgcttggatgattggaattgaacattctcaaagcttccaaataccgctctgataaaattgtttcttcactttgaaactttgtcatgaaattgtataattagataagatgcttctgtgttgtataaaaaaaaaaacatgtcggccgcctcggcctatgt

SEQ ID NO: 1664 - DNA, 1036 bp, Eutrema halophilum
gacatattttccgaaaaagaaaggaaaaatagaattaaaagcatcaaagagagacgacgaagcgtcctcgattatcaccgtgcgtcctttgctagcttcgctctctctcaaaaaccctaacttctctgagatcgatcgaacctgatagcgcgcgataatggcgaatagtaatcttccccgaagaatcatcaaggaaactcagcgtctacttagtgagccggctcctgggatcagtgcatctccgtcagaggaaaatatgcgctatttcaatgttatgattcttggtcctacacaatctccttatgaaggaggagttttcaagttggagctctttttgcctgaagaatatcccatggcagctcccaaggttaggtttctcaccaagatataccatcctaacatcgacaagcttggaaggatctgccttgacatactgaaagacaagtggagtcctgctctacaaatacgaactgtgctcttgagtattcaagctcttctaagtgcacccaacccagacgatccactgtctgagaacatagctaaacattggaagagtaatgaagcagaagctgtggacacagctaaggagtggactcgtctatatgcaagtggtgcttgatgaagattggaaacggagaaagatcattgtcatttaaataacattatatatggtgaaactctatctcaaggttttatctgaatcctttttctaaaactaaggaaaaagatttgtactctctgaatctgtataactagggggatttaagactcgtttacccatatttgcagtttatttttctttaaatgtgcttgcttaagctttgtttgtgttaaagatcttctctaatctctaaaacgctgtggatatcagatttcacaggttgtgaatgaaggtaaatttgatgaatgattgaagtagagaatgttactattacagatgtatgagaaggccactaaaatgaagcagcttattttggtcaaatgtatatataaaaaaaaggtggtaaaaagtagtcatgtgaaatgaaatttcaaa

SEQ ID NO: 1665 - DNA, 1174 bp, Nicotiana tabacum
gtaccacacatgtatttcagatttttagtgagaaagagtggtcaaattcttaaactatctccactatctcaattctccagttctctctctagaaaaattaagaacccttagcgtgaactctctgcgaccgaagaaccccacccacccaggcagccttcaattcaattccaatggcgaacagcaatcttcctcgtagaattatcaaggaaactcaacggcttctcagcgaacctgcaccaggaataagtgcatctccatcggaagataatatgcgatactttaatgtcatgattcttggtcctacacagtctccttatgaaggaggtgtcttcaagctcgaactctttttgcctgaagagtacccgatggccgctcctaaggttcgattcctcaccaaaatctaccatcctaacattgataagcttggaaggatatgtcttgatattcttaaagacaagtggagtcctgcacttcagatccgtactgtacttttgagcattcaagcacttttgagtgctccaaacccggatgatccactctctgaaaacattgcaaagcactggaagtcaaatgaggctgaagctgttgaaacggccaaggagtggacacgcctatatgctagtggtgcatgaagacatagcaacgaaatattcaaaaataacaaaaattatggaatgtattctattgacttgcttatcaatatgacacttcggacggctgttaatgcccggactcttccgattacctcccataattgcttccctgcccttgaaattgtataatttaatgtgacatccgttggttttccagtgttcaggaatgaactacttacaacaaaactggatatggttttgagaaagggataatgtcactgcaagggtatttaatgtttcagatctgtggttggaattggaaactaatgttgctgcagctggtatgaacctccatagatttgtttcaagataatgaatgtgctaacgtagagatcaatgtttgacctgtttttctttcttattttctgttttgcccattcctggattgcgtgcttgggtttgcttgctttttgtttctttttccattcaacgtttttgtcctaccattccatgtattgtggacacggttagaaacccaaaacaatattttataatactaaacgaagatacttcgagcaaaa

SEQ ID NO: 1666 - DNA, 820 bp, Triphysaria pusilla
acgcccacaggaccatttcgcattttctagtgagagaaaccaatcgagagaagaaaaccttttcgtgttagcgtaaaatctacgaacagagacccgtgggaagaagctcacgaaatcagcttagcaaatccgatctaatggccaacagcaacttaccgcgtagaatcatcaaggagacgcagcgtcttctgagcgaaccagcaccaggaataagtgcatccccatcagaagaaaatatgcggtatttcaatgttatgattcttggcccaacacagtctccttatgaaggaggtgtttttaagctggagttgtttttacctgaggaataccccatggctgccccgaaggttcgcttcctcactaaaatttaccaccccaacattgataagcttggaaggatatgcctagatattctgaaggataaatggagtccggctcttcagattagaactgttcttttgagcatacaagcacttttgagtgctccaaatcctgatgaccctctctctgaaaacattgccaagcattggaaatcaaacgagactgaagctgtcgaaacagctaaagagtggacgcgtttatatgcgagtggtgcttgaataagcatggaactttggtttacttatttaataattaaaaattgtattatattatcgtctggcaagtaaaacgtggaaagattggaaggacggctctctatagggcttgtgttttcaattgttctcgtttttgttcgactgttcttgaaagtgtgcagatgatatatataaaggcactcgtgttatgtcttgtcattgggaagtctatgaaattcttgatt

SEQ ID NO: 1667 - DNA, 1005 bp, Triphysaria pusilla
atctcaaaatttccacgatcgaacatttccccatttcctagtgacggagagcaaagaaaaatccctctgttagcgtaaaatctcaaactgaaagagccgagggaagaaaacgaagcttgtgaacccaatccaatggccaacagcaatttgccgcggagaatcatcaaggagacacagcgtcttctgagcgaacctgctccaggaataagtgcatctccttcagaagagaatatgcggtactttaatgtaatgattcttggtccaacacagtctccttttgaaggaggtgtctttaagctggagttatttttacctgaagaatacccgatggctgctccaaaggtccgtttcctcacgaaaatctaccacccaaacatcgacaagcttggaaggatatgcctagatattctcaaggacaaatggagccccgcacttcagattagaactgtacttttgagcatccaagcacttttgagtgctccaaatcccgacgatccactctctgaaaacgttgccaagcattggaaatcgaacgaggctgaagctgttaatacagctaaagaatggacgcgtttatatgcgagtggtgcttgaagcacatggtactaccacctaagtagtgattgtaccttgttgaccatcaaatgatttcggaacatttggaagaacacttatacaaacaactggtgtttctatctggcatttaactagttcccaaatttaaacagttgctcaaagtttataattggatgagaattgtttgttaattgtttctcatgatatgtgattttgctatacactaaaaaaaattctctttcagtttggggtttgttactgcctgaatgatgattgccaactggttttatctggcgaaatgttttgtacaaaaaatcaatagagcaatatcattgcctgaggatgtggaaggaaatttgtttagaatctgcgaaaggttatgttcaaactattttcaagcggaaggaggaaaaatgtgttttttcatgt

SEQ ID NO: 1668 - DNA, 909 bp, Utricularia gibba
gtggtggagtagggagcaatttgtttttgtgttggcttcaaatctacgcttggggaggcggaaaaagggaagctttggattccgtgtcaatggcgaacagtaatttgccccggcgaatcatcaaggaaactcagcgactgctgagcgaaccagctccgggaataagcgcttccccttcagaggaaaatatgcgctatttcaacgtaatgatccttggtccaactcaatccccttatgaaggtggagtctttaagcttgagttgtttttaccggaagagtatccaatggctgcaccgaaggttcgcttccttacaaaaatttaccatcccaacattgacaagcttggaagaatatgccttgatattctcaaggataaatggagtccagcacttcagatcaggactgtacttttgagcattcaagctctcctgagtgctcctaatccagatgatccactttctgaaaacattgccaagcattggaaatcaaatgaagcagaagctgtggatacagccaaagaatggactcgcttatatgcaagtggtgcataagtgacactcgtgggatccacaactgcaaaaaatgaccaccaaagagttcctgtatgttatgttgataattcttaccgaattcagaggctgctgagaccctttggtttccaatgggggaagttctgaactcatgaaccagttccatcgtagcttgtgagtccgcgcattatgtaaccttacttttaactgtgattagtctgctatcgcctatttcctgtgtgttatttcaactcttgtcaaccatgttgtcttgttggatttcaaatggccgagtcacatagcagtggctttctttgctcatccaggtatcatggtgcaagctagtacatgtataaccgtttactgtgggagtttttta

SEQ ID NO: 1669 - DNA, 833 bp, Valeriana officinalis
ttctctctctaactctcctatagaaccatcttccatggctaacagcaatctacccagaaggataatcaaggaaacccagcgtttgctcagcgaaccagcgcctgggataagtgcatcaccgtccgaagataatatgcgctactttaatgtcatgattcttggtccgtcgcagtctccttatgaaggtggggttttcaagcttgagctgtttttgcctgaagaatatccaatggctgctcccaaggttcggtttcttaccaaaatatatcatcccaatattgataagctcgggaggatatgccttgatatcctaaaagacaaatggagtcctgctcttcagattcggaccgtactcttgagcattcaagcacttttgagtgctccaaatcctgatgatccactttcggagaacatagcaaaacattggaaatcaaatgaggctgaagctgtcgaaacagcgaaggaatggacacgtctatacgctagcggagcatagtgaaagactaaatagatgtttgggcttaaataacttacgaagtatgtactatattttaatactggaatgttgggattttaatgcgacttttggagaattattgggtgataaaattggagttgagtaccctcttattgccaaataattactctaatcttgtcctttatattgtacgaggagattgcaagctccatatgtctcgtgtttttactttagatgcatagagatgaaatttaattgaatctgttactcctatatttaatcgcatgtaaggagtcgtttctgaactcttagattcggatttaagaatatatttccaaattaatggagatgctaa

SEQ ID NO: 1670 - DNA, 699 bp, Vinca minor
gaaaactctgcgaacaaaagaagaaaaactttatagctctctactcgatcaatcaattcgattcaatggctaatagcaacttacctcgtagaatcatcaaggaaactcagcgccttctcagcgaacccgctcctggaataagtgcatctccctctgaggacaatatgcggtacttcaatgtgatgattcttggtccatcacaatccccttatgaaggaggtgttttcaagttggaattattcttacctgaagaatatccaatggcagctccaaaggtcaggttcctcaccaaaatataccaccctaatattgataagctaggaaggatatgtctcgatatccttaaagacaaatggagtcctgcccttcagatcagaacggtgcttttaagcattcaagcgcttctgagtgccccaaacccagacgatcccctgtctgaaaacattgcaaagcattggaaatcgaatgaggctgaagctgttgaaacagcaaaggagtggacacgtctatatgcgagtggtgcctaaagctgatgcagattccatggtcctaaaaataacatgtgcaatgtattctattgactgttgaattgatatgaaaattcggaagtaacattgatgcctaattcatggggaatttagtgttaaaaaagcatcacatgtgccggataattgttttgttgttctgaacatgtctttc

SEQ ID NO: 1671 - DNA, 1006 bp, Ricinus communis
aaagtataatatataattaatggaattgtggggggtattaatctagtttaggcaggtagatataagaaagataagaaaaagagaaaaagagagaagggaaaatgtcaaaatcatatgatatgggcttagtataaaaaccgcccagaaagttacgagcaaaggcatgcccttagaaaaagttgctaatagagttgtagtgagggaaagaaataaatattctctctccctgaaaaacccttgaagtagcgttcattgcaatcgacttttcaaagaaatggcaaacagtaatctccctcgaagaatcattaaggaaactcaacgacttctcagtgaaccagctccaggaataagtgcttcgccctctgaagataatatgcgatatttcaatgtgatgattcttggccccacacagtctccttatgaaggtggagttttcaagctggaactctttcttcctgaagaatatcccatggctgcaccaaaggttcggtttctgaccaaaatataccatcctaacattgacaagcttgggagaatatgtcttgatattctgaaagacaaatggagtcctgctcttcagatacgaactgtacttctcagcatccaagcactgctcagcgccccaaaccccgatgacccactttctgagaacattgccaagcattggaagacgaatgaggctgaagctgtggaaacagccaaggaatggacccgtttatatgcaagtggtgcgtgaagatttggtgggaacttctaccctttcaaacaacgttcatgtgatatatccttttaactgttaatttgaatggaaatttgaagaattgatgtttgaacaaatcaaaaaatttaatatttttcaaagcttccagatactgcatatcaaattgttctctgatgttggaagcaccgtctttgaacttgtatgattagataaatacattattctactctttctctgactctccccatctttttgtcaattctttagcaaaatttaacttgactg

SEQ ID NO: 1672 - DNA, 1654 bp, Cicer arietinum
ctttgctatttcaaagtgggagaggtcgagtaagaggggaaaagaggatagatcagtaattatcataatttatttttgaaaatgggttgttaaaaaaaatctaatttttgttatattattgtaataattatgttattctatctaattatcattattaaactaaagtaaaacgtgtatataaataatagaagcaagagaaaggcattttcgttgagttttgtttctggttcgtgctagtgagagaaacttctttattttcttctctctcttctttcagtgactcaaaagccctattgcgtactttgcaatcgaccaaataatggccaacagtaacctccctcgaagaatcatcaaggaaacgcagcgtttgctcagtgagccagcgcctggaattagtgcgtccccttcggaagataatatgcgatatttcaatgtgatgatccttggcccaactcagtctccttatgaagggggtgttttcaaactagaactatttttgcctgaagaatatccaatggctgctccaaaggttaggttcctgacaaaaatatatcatcctaacattgataagcttggcaggatatgtcttgatattctgaaagataagtggagtcctgcccttcagattcgcactgtacttttgagtattcaagctcttttgagtgcaccaaacccagatgatccactttctgagaacatcgccaagcattggaaatctaacgaggtcgaggctgttgagacagccaaagaatggacccgattatatgccagcggtgcttgacgattgggtggatacttttggtctcaaataacaatagtggaagtgtatgctattaactatcaaattgaaatggaaatttagaggaattgtctaaactattttggagtccatattcctcctagcttccagttacatgttaatttctttctatctcatggaagccttatatcgaaacttgtatgaatatatgggatcttttatgtcaaaaatttaaaacatgctctatcttcaactactaatggtaatttggtattctcaactcaaacttttgaataatcttttgatttttcccccatttcaatggatttggattctctcaagagaagggcacccattaaagggaaaagtgcttgattaattgaaaatctaacagttgcattttataaaaatctaactttggaaaaatctcaccttatttttagagaagtcaaatccattgccctatgaattcatgtttgatgtctggttgtgaattaaaggaaactatctaactcaagacgactgtgtccaatcagtaaaagatgcctatgtttttgtgaagagtctttagacaaaagtgttttaattaaaaacctatgtctctttccttgtaggatcatgtgaataaacacgttgaggccttaagggtctatttccaggtcaaatcgttaattggcatattttttttaattttaattgatcatgccctgatagaattaatgttttagaagtgtatctgttttggttacatagttgtcatgatattgacatctataaagcacttaactgcctgcaatttttctggtccatccataggaatcacacattacaattgagggccataagatttaattttgctgtgaaatgtcaactttgggggaacttttttttttt

SEQ ID NO: 1673 - DNA, 723 bp, Mimulus guttatus
gtaaactctccgaactcgaagaacagagaaaagtagaaagaggagaagcttgcaaatcaaatccaatccaatccaattcaaatggccaacagcaatttaccgcgtcgaatcatcaaggagacgcagcgtcttctcagcgaaccagcaccaggaataagtgcatcaccttcagaagaaaatatgcggtatttcaatgtaatgattcttggtccaacacagtctccttatgaaggaggcgtttttaagctggagttatttctacccgaagaatacccaatggctgcgccaaaggttcgcttccttaccaaaatttaccacccaaacattgataagctcggaaggatatgcttagatattctcaaggacaaatggagtccggcgcttcagattagaactgtacttttgagcattcaagcacttctgagtgctccaaatccagacgacccactgtctgaaaacattgcgaaacattggaaatcgaacgaggttgaagcagttgaaacagctaaagaatggacacgtttatacgcaagtggtacttgaagaaacggaatcccagaatttcccaaataataagtgtaccttattgaccccaaaatgaatattgaatgttttagaagaatggttgtcatgctcaaaccaattggacttctccatcttcttttagagtcttgcgttcgattacgttaacactgtcgttcaaaaatgtataattagttttgg

SEQ ID NO: 1674 - DNA, 961 bp, Prunus mume
ttacaaactgcattgagaagctagcgtcaacatatcaagggtataattggaagtataaaaaaaaaattgcagaggcgagttgcaaaattgaagagttcgttcgaagttaaaaaccatttaccagattcccgttttcttccttcatcttcctcagcttcttagtcttcttctcttctgcctctccgtgattccacgtctggaacagtaatttcccaaagagaagaagagacttgatggcgaacagtaatctcccccgaagaattatcaaggagacgcagaggcttctcagtgaaccagctccgggcattagtgcttctccttcagaagaaaacatgcgatattttaacgtaatgattcttggtccagctcaatctccttacgaaggtggggttttcaagttggaattgtttttacccgaagaatatccaatggcacctcccaaggttcgtttcctcaccaaaatatatcatcctaacattgataagcttgggaggatatgccttgatatcctgaaggacaaatggagtccagccctccaaatccgaacagtattgctgagcatccaagcacttctgagtgctccaaacccggatgatccactttccgagaacattgcaaagcactggaagacaaatgaagcagaagctgttgagacagcaaaggagtggacccgtttgtatgcaagtggtgaataatgacgagagattatttctcagaatttcatttttcaattgtgtgttgaacataatgtatgcctttagtcttataacatatgtactactaaacatggagattttcaagcccatcagtccttgttgataatcactttcatcctcctcaaagggctagcttaaactttgtacgatcataatgccaaggtagatctcaattgctattttttgttcattttttgaatcatgggtttcaaaatgtgtcggttgttgccaatgttgattagtat

SEQ ID NO: 1675 - DNA, 1263 bp, Zostera marina
tttcggggtataatattaccatcgagtttctctctagcttctgctgaaaattgttttttccatcgtcactatcttttccgacccgccctagaaaacagaaaacgaattcacttcaccgaagagggaaccagcagatggccaacagtaatctacctcgccggatcatcaaggaaacgcagcggctcctcagcgaaccagcgccggggatcagcgcatccccctcggaggataatatgagatacttcaatgtaatggttcttggtccaactcagtccccttacgaaggaggtgtgttcaagctcgagctatttcttcctgaagagtatcctatggctgcccccaaggtccggtttctcaccaaaatatatcatccaaatatcgacaagcttggaagaatatgtcttgatattctaaaagataaatggagtcctgctctccagatccgtacggtgttgctcagtattcaagctcttctaagtgctccaaacccagacgatccactttcagaaaacattgcgaaacattggaaagcgaatgaagttgaagcagttgaaacagccaaggaatggacccgtctctatgcaagtggagcttaagatttcggttgtaccccaccttgttgtaaggaaggcaacttttccaacattttaaattaaatgctcatatttgacaacaaaattggattgatgctataaaactatcaaagtaaattcttgtagtaagattcaaaatttcaaattattctctgctctggtatacagacttgttttttgtgatagaaagctaaatattctagtgacgaacccatgttgcagtagtgtcataaactgccacttgtattacttacaatacaagttaatgatttttctttctttctattaaaaatgctgcatgacctgcaacgacctaataaataatagatcgattattatcacatcaaatttatattacatgacaaattgacaaacggatgacgtaggtaaaaagaacacaaaaacttctgtttttgaataaccaaactatatataatatcaagtcaagctttaccgtcgacaaaatcaagcaccagacttattcacatgctggtttcgtaccaaagctggttagacagattgcaaatgcctagaaaaacagacagtggcttaccgaaaaagtaccaattagtaaacacatcatctgtctactttgacctaaattggagaagcactagtagcttacaatttacccctgaggactgaccaaggccaacacgagggggatagg

SEQ ID NO: 1676 - DNA, 716 bp, Antirrhinum majus
  misc_feature (72)..(72): n is a, c, g, or t
ggttagcgtactctctctctctctccagagacttaaaaagagtcgaacagagatcatcatcatcatcatcancaacaacaacaaaaagtcttcgcaatttcaattcaatggccaacagcaatctaccgaggagaatcatcaaggagacgcagcgtcttctcagcgaaccagctccaggcataagtgcatctccatctgaagagaatatgcggtatttcaatgttatgattctcggtccgacacaatctccttatgaaggaggggtttttaagctggaattgtttttgcccgaagaatacccaatggctgctccaaaggttcgcttcctcacaaaaatctaccacccgaatattgataagcttggaaggatatgtcttgatatcttgaaagacaaatggagtcctgcccttcagattagaaccgtacttttgagcatccaagcactattgagcgctccaaaccccgatgatccactttctgaaaacattgctaagcattggaaagctaatgaggttgaagctgttgaaacagccaaagaatggacccgtctgtatgcaagtggggcatgaggtatatggaactccggttcctatgaataattgaaaatgtaatattgcgagtccatgaatttgggtaaatttatgatgttcgaaactgttgggattaactgtttccagactccccattagtactttatactttatttcctgcatgaa

SEQ ID NO: 1677 - DNA, 844 bp, Arabidopsis thaliana
agagttgaattttaaagatagagaaaggaaatcgaattaaaatcttcgtcagattcgagagacgacgacgacgaacttgttgttctcgattatcatcagcagctcccttcaaaaaccctaactctctgagctcgatcgacaagtgataatggccaacagtaatttgccgcgaagaatcatcaaggaaactcaacgtctgctcagtgaaccggctcccggtataagtgcctctccatctgaggataatatgcggtatttcaacgttatgattcttggtcctacacaatcaccttatgaaggaggagttttcaagttggagctctttttgcctgaagaataccctatggcagctcccaaggttaggtttctcacaaagatataccatcctaacattgacaagcttggaagaatctgtcttgatattctcaaggacaaatggagccctgcactacaaatacgaacagtgctcttaagtattcaagctcttctgagtgcaccaaacccagatgatccgctttctgagaacattgctaagcactggaagagtaatgaggcagaagctgtggatacagctaaggaatggacccgtctttatgcaagcggcgcatgataaattggagggtgaaaactgaaaagatctctttcatccaaataacattacatttgctgaaatctatctcaacatcaaagttataagaaagcttatattttgctggttatttccccccgccactgctctgtaatctctcttaatcacactgtatcattactcctaggatcaatactcgttcttatatttgaagttcgtcaaagtcttttgagtaaaaaatatctatatttctct

SEQ ID NO: 1678 - DNA, 852 bp, Artemisia annua
aaaaagtagcgtaaaatttcagcttgaatggctaacagcaacctccctcgaagaatcatcaaggaaacacaacgtttactcagtgaacctgcaccggggataagtgcttcaccgtcagaagaaaatatgcggtattttaatgtgatgatacttggtccctcgcagtctccttatgaaggaggagtattcaagctggagttatttttgcctgaggaatatccaatggctgcccctaaggtccgatttcttacaaaaatataccatcccaacattgataagcttggcagaatatgtcttgatatcctaaaagacaaatggagccctgctcttcagattcgcaccgtgctcctgagcattcaagcccttctaagtgctccaaaccctgatgatccgttgtcagagaacatagcaaagcactggaaatcaaatgaaacagaagctgtggaaacagcaaaggagtggacacatttgtatgcaagtggcgcctaacggccatacaacaaacagaaataacaattgtacctttattacaagaaattcagtgtcgtgattactccattcgcttactttttggtcccaatgtatatgatatatcttttattataagtatttagtaatggaagagccaaccaagtgcttttcaaggtctttgtcatatcagctttttttctttatttcttttggcttcttccggggaccgatcaattattgcatttatactggaaaagtacgacacgctatgttttaacaagtccttgactctcatacgtgtagcttgattgatacacgattgaaccaacccaatttacaactataattatatacttgacaatggtgaaacacttctgcccc

SEQ ID NO: 1679 - DNA, 841 bp, Persea americana
gtccttcgttaccacctcttttactttaatggcgaacagcaatctgcccaggagaatcatcaaggagacgcagcggctcctcagcgaaccggctccaggtattagtgcttctccttctgaagaaaatatgcgttatttcaatgttatgattcttggtccaacgcaatctccttatgaaggaggggttttcaaattggaactatttttgccggaagaatatccaatggctgccccaaaggttcgttttctcacgaaaatataccatcctaatattgacaagcttggaagaatatgccttgatatcttgaaagataagtggagtcctgctcttcagattcgaacggtattactgagcatacaagcacttttgagtgctccaaaccctgatgaccctctttcagaaaacattgcaaagcattggaagacaaatgaagctgaagctgtcgaaacagcaaaggagtggacccgtctatatgcaacaggggcatgatggatgtggactgctgcgtggtgaaaaatgcctattattgaagtcttcgtgcctgctttcacttcagaattgaaatggaaccattgaatgtgggactaagcagatgttaatccgctcaatttcctcagtcttcagtcaaattactacaaatcattacctcccaaggcctgtcttggtgtttgtacgattagttaaactactctccgataagaaactcgaggtttcgtttttgttgtcccctagcatattcaaactctgcctggtttatcattttgtaaagccgaatatgcctttcatcaaatacggaaatggtgctgaattcctccgaaaaaaaaaaaaaaggaccgcctc

SEQ ID NO: 1680 - DNA, 898 bp, Musa acuminata
gctgtatataaagccattccactcgagcgacatgaggccgtgccctttttcttttgccgggggctttccatacgagagtgaaggtctagatcggtaagagagagagagagagagagagagatcatcgtcccgatggcaaacagcaacctccctcgacggatcatcaaggaaacgcagcgtcttcttagcgaaccagctcctggcataagtgcatctccgtccgaggataacatgcgctacttcaatgtgatgatccttgggccaactcagtctccgtatgaaggaggggttttcaagctcgagttgtttttgcctgaggaatatccaatggctgccccaaaggtccgttttctcaccaaaatttatcaccccaacattgacaagcttggaagaatatgccttgacattttaaaggacaaatggagtccagccctccaaattcgaacagtactacttagcatacaagcacttcttagtgccccaaacccagatgaccctctttcagaaaacattgcaaaacattggaagacaaatgaagcagaagctgtcgaaactgcaaaagaatggacacgtctctatgctagtggggcataaaactcttcaggtagttctaataacatgtctaagtttatttgtccaacgccggctgctgacagttaaaaagggtggccgtcacgctgtcatatcgcagggtgtatatcattttcttgagttgaaggtacctcttcatatatttatgtcatgaagttatattcctacgtctctttctagctagcagggtttttattatgcccataccctttaatttcttgactgtgttcgtgtaacttatgttgtcacattttgcgctctcttgctgttattatataacatggatcatgatggctgttatgtagtt

SEQ ID NO: 1681 - DNA, 827 bp, Fagus grandifolia
tcctcctgtggccagttgatttcattttcctcttttctctctctctctctctactaaagtaacttaaaccctttgcttgttagcgtgctctgtaatccaagctctcgaaatggccaacagtaatctcccccgaagaatcatcaaggaaactcagcgtctactaagtgaaccagcaccaggaattagtgcttcgccgtccgaggacaacatgcgatattttaatgtaatgatccttggcccaacacagtctccatacgaaggaggggttttcaagttggaactatttttgcctgaagaatatccaatggctgctcccaaggtccggtttctcaccaaaatatatcatcctaacattgacaagcttggaagaatatgtcttgatattctgaaagacaaatggagccctgctctccaaatacgaactgtacttttgagcattcaagctcttctgagtgctccaaaccctgacgatccactttccgagaacattgctaagcattggaaaacgaatgaggctgaagctgtggaaacagcaaaggagtggacccgtttatatgcaagtggtgcctgatgacatggtggaaagttttgcttcccctgaataacattaatgaaatgtatgctattgactgtcaattttaaatggaaaatttggtacaattaatccttgaacaatcggagtttaatattctcaaagcttccagtttctgcccgttcatatttttcccctcatggaagcctggtgaaaattgtatgataaattgggccattaatttggcaaaatattctatatatataatattcctgcttagtaggtttctttaggt

SEQ ID NO: 1682 - DNA, 775 bp, Vaccinium corymbosum
cagaattgtcgagcaattggttccaaattttgggaattggaccgaacgaaagtctcaatccatcagctttctctctctacgttcccgcatccttcagcgtagtcttcaatcgaaacgtacctcaatggcgaacagcaacctacctcgtagaatcatcaaggaaacgcagcgtctccttagcgaacctgcaccaggaataagtgcatcaccttcggaagataatatgcggtattttaatgtcatgattcttggtccttcacagtctccctatgaaggaggagttttcaagttggaattgtttttgcctgaagaatacccaatggctgctcccaaggtccgattcctcaccaaaatctaccatcctaacattgataagcttgggaggatatgccttgatattctcaaggacaaatggagtcctgctcttcaaattcgaactgtactcttgagcattcaagcacttttgagtgctccaaatccagacgatccactttccgagaacattgcaaagcattggaaaacaaatgaagccgaagccgttgaaacagcaaaagaatggacccggctatacgcaagtggtgcttgatgaagtcgtggagtttacaacagaagatgtaatgtagtatcttgtttgactctagaaattaaatggaaattggggaagacatcttctcatgaaattgaattgtataataagattagcttgtgttctttagccttgcaatttcgaattgttcccttggaggttggggtcggtgcagtttaattgggcttt

SEQ ID NO: 1683 - DNA, 764 bp, Bupleurum chinense
attgtctagcgtaattcgtaatctgagtttcagctgctgcttcaatggcgaacagtaatctacctcgacgaatcatcaaagaaacccagcgtcttctgagcgagccagctccagggataagtgcatcaccttcggaagaaaatatgcgctactttaatgtcatgattcttggtccaacacaatctccgtatgaaggtggagtttttaagctggaactgtttttacctgaagaatacccaatggctgctccaaaggttagattcctcactaaaatataccatcctaacatcgacaagcttggaagaatatgtcttgacatcctcaaggacaaatggagtccagctcttcaaattcgcacagttctgttaagtattcaagccctgttgagtgctccaaacccggatgatcctctctctgagaatattgccaaacattggaaaacaaatgagactgaagctgttgaaacagccaaggagtggacccgcctgtatgccagtggtgcgtgacactgtcttttacaccaggaataataggagatgcagtgtaaccctaccaatgttgaaattatatagaatttagaaggatcctttagcagctggagcttacaattatcaaagcgtgcttgcagagtacatgtttcttgaattaaatttacaagactaatacatgtttcttgacttaaatttggaattggatttgtattgttaaatgtgatgctcgtgttctgttttctttggtccagttaatattaaaattgtgtgtag

SEQ ID NO: 1684 - DNA, 1731 bp, Theobroma cacao
acctaaaaaatatattgcttttgtaagaaaagaaaataataatatttattttattataataaaaaagaaaaaggaggaaagtaaagaacagcgggaagagggtcaaaatcactgcgctttagggcaaagtaaaataaaataaatgcaaaagacacattcagggaacaagcgaccttttttattttctgtgttttgttcgccaaaatttttctctctcttcccctttctctctcaattctcaaaaaccctaaatttttttggctttcccttttgcttcatcaatcgatcctcgtcaatggccaacagtaatctcccgcgaagaattatcaaggaaactcagcgtctcctcagtgaaccagcacctggaattagtgcttcaccatcagaagataacatgcgatatttcaatgtgatgattcttggtcccacacagtctccatatgaaggaggggttttcaagttggaactatttttgcctgaagaatatcccatggctgctcccaaggttcgatttcttacaaagatatatcatcctaacattgataagcttggaagaatatgccttgatattctcaaagacaaatggagtccagctctccagatccgaactgtacttctgagcattcaagcacttctaagtgccccaaatcctgatgatccactctccgagaacattgctaagcactggaaaacaaatgaggctgaagcggttgagacagcgaaggaatggacccgtttatatgcaagtggtgcatgatgactggtgcaaacgattgccctcttgaaataactttctatgcaatgtaagctattcaatgtcaatttgatatggaaatttggaagaattgatgttttaaagagtttgatatctatcaaaagcttccagttgctacctgttaattgttttccttgttggaagcagtctctgaacttgtatgataatatataccttgttctctgaaactctcaaatgctgaactaagtgattattctcaaatatagctctatttcagattccagtaactgatcaggtaaaagggttgaggcattttttatataatgtttgttcgtttattgaaactggaagcaaagaatacactggatgttccctgatttgaatctgacaaaatttcatcaaaaaagcttccttttccgtcctgaagatcatgtggcacatcctgatgaggattcccccattttgtacctaattacactaagccaataactcctacttgcataccactgaatcaagaaaatggaatttgtgtttctatgacaagcaaaggaattggcttgagatgcttctaagagcgaagattcccaacaagaattcaacaacttaaaatgtaattaataatttatcttaaagctgcagcatatactaaggaagggtatcttgtacttaaatgtacatggttgtgagattatgcaaagtagaatagcactaaaatagcacaggaaaaatgggttaaaaattcttttaagagagaaacaacgtaggattatagtaaatgacatggacacatgatgtagttaagtggaaatgctaagagatgtaaaccaagacacaacttttcgaaaagtacaacagtttggtttatggtttaaacatttaattacctctattctgtctccacgtatgcagtccacgacaatgttctactccatatagctttattgtatcactggcagatatattaagggttaaggccataaatttgtcttgatttc

SEQ ID NO: 1685 - DNA, 741 bp, Manihot esculenta
cattttagtgagggaaagaaaatatctcccaaaaacccttgaagtagcgttctctgcaatcgacctcctagaaatggccaacagtaatcttccgcgaagaatcattaaggaaacccaacgtctcctcagtgaaccagcaccaggaattagtgcttcgccatcagaggataatatgcgatattttaatgtgatgattcttggccccacacagtctccatatgaaggtggggttttcaagctggaattgtttttgcctgaagaatatccaatggctgcaccaaaggttcgatttcttaccaaaatttaccatcctaatattgacaagcttggaaggatatgccttgatattctaaaagacaaatggagtcctgcccttcagatacgaacagtgcttttgagtatccaagcacttcttagtgctccaaaccctgatgacccactttctgagaacattgcgaagcattggaaaacgaacgaggcagaagctgttgaaacagcaaaggaatggacccgtttatatgcaagtggtgcgtgattgtgtggtggaacttgccttcaaatgacggtcatgtgttatatgctattaactgttaatttgaatcaaaatttcaagatttgatgtttgaacaagttatacccttgatatttttcaaagcttccagttactgccctattaaattgacgtgtgatttggaagcatcgtctgtgaacttgtatgataagcaacactattcatctccc

SEQ ID NO: 1686 - DNA, 975 bp, Ricinus communis
aaagtataatatataattaatggaattgtggggggtattaatctagtttaggcaggtagatataagaaagataagaaaaagagaaaaagagagaagggaaaatgtcaaaatcatatgatatgggcttagtataaaaaccgcccagaaagttacgagcaaaggcatgcccttagaaaaagttgctaatagagttgtagtgagggaaagaaataaatattctctctccctgaaaaacccttgaagtagcgttcattgcaatcgacttttcaaagaaatggcaaacagtaatctccctcgaagaatcattaaggaaactcaacgacttctcagtgaaccagctccaggaataagtgcttcgccctctgaagataatatgcgatatttcaatgtgatgattcttggccccacacagtctccttatgaaggtggagttttcaagctggaactctttcttcctgaagaatatcccatggctgcaccaaaggttcggtttctgaccaaaatataccatcctaacattgacaagcttgggagaatatgtcttgatattctgaaagacaaatggagtcctgctcttcagatacgaactgtacttctcagcatccaagcactgctcagcgccccaaaccccgatgacccactttctgagaacattgccaagcattggaagacgaatgaggctgaagctgtggaaacagccaaggaatggacccgtttatatgcaagtggtgcgtgaagatttggtgggaacttctaccctttcaaacaacgttcatgtgatatatccttttaactgttaatttgaatggaaatttgaagaattgatgtttgaacaaatcaaaaaatttaatatttttcaaagcttccagatactgcatatcaaattgttctctgatgttggaagcaccgtctttgaacttgtatgattagataaatacattattctactctttctctgactctccccatcttttt

SEQ ID NO: 1687 - DNA, 1086 bp, Cedrus atlantica
cgggaacgcgaatagcgtaaatatattcacaccacttttctccaaagtgagaatcacttctatatcggcatatataacaaatactgggtttgaagctcaagcagcccctgccctcgcttcctctcgtcgacctgtacgattttcgctgcggtcttgcaggcacaatccagcctatccgttcgtccattccttctgccagagggcgaggaaaagagaatcaagaacgattcggggttcgatctctgtatctctctctaccgccagccctcgtcaacaatggccaacgccaatctacctcgcagaatcatcaaggaaactcagcgtttactcagcgagccggcccctggaatcagtgcatctccctcagaggacaacatgcgatacttcaatgtgatgattcttggacctactcagtctccatatgaaggtggtgttttcaagttggagttattcttacctgaagaatatccaatggctgctccgaaggtccgatttttgacaaagatataccatccaaatattgataagctaggtcggatatgtctagacattttaaaggataaatggagtcctgctcttcaaattcgaacagttttgctcagcatccaagcattgttgagtgcacccaatcctgatgatccactttctgaaaacattgctaaacactggaaatcaaatgaagccgaggctgtggaaacagcaaaggaatggacaaggctgtatgcaagtggcgcgtgacagtgttttgaggcttgtttctttgaataacacatttgtaatgtgaaagttgtcatcccattgttatcagacatggatttttcttaatttattagcgaatattcatgtatcgtgtactttggtaacaaagaatatggtctgtgaccagaccatgctgattggtatgtcaatcaaagaatgacatagcaactgtcactagcaacattatgatatttgtagaatttgtttatgtaaagttcctaccgtatgctatgttaagaaaggaatctggtatagcaatctagtgtaagatttttcacctagttataggtggaagttcctcatcacaattttcaaaagttgaaattc

SEQ ID NO: 1688 - DNA, 1272 bp, Centaurea maculosa
caaaccgaaccatttgcaggcttaaaagaaccatcattcactttctctctctaaaaagggcaaacaacaaaaaaaagacctcaaaattccacttcaatggcgaacagcaaccttcctcgaagaattatcaaggaaactcagcgcttgctcagcgaaccagcaccggggataagtgcatcgccatctgaagaaaatatgcggtatttcaatgtcatgattctaggcccatcacagtcaccttatgaaggaggagtctttaagctggagttatttctgcctgaggattatccaatggctgcccccaaggttcgattccttacgaaaatataccatccgaacatagataagcttggtagaatatgtcttgatatcctaaaagacaaatggagccctgctcttcagattcgcaccgtactcctcagcatccaagcgcttttaagcgctccaaacccagatgatcccctttccgaaaacatagcaaagcattggaaatcaaatgaagcagaggctgtggaaacagccaaggagtggactcgtctgtatgcaactggtgcttaatcgaatgtattgctactcgtgcttctgtcactttgtaaatccaaaacggaattgcccacaaatttcaattggtttatcgatacaagttttctactaccacatttcaaggatacatacttttcgtttacaaatagtcaaaaagtggcaatgcattatcggttttagtctaaagtgtgtaattgatataattgactcgatacactttaactactatgctgactactgggtgctctttaagtttgttcttctaactggttacttcttaaatcaacccctctttaaccaatcaaaatgcgatctttcatggcctttaaccgtttttttatcaagtatgtataatcgatcgaaatcgtcttacaaattatgtaccactttttgagggtgtaaataagccgagacaactcgcgagctactcgagattgactcggttaaaacttgactcgaactacctgatactcggcttgactcagctcgtttacactcctaacttttgtgcaatttacccaagaaactgtaaagggtctgcttgttaacgagcgtagtgggacctatagctgattcggttgactatgcatgactggttgttaatgactttatgatacagaaaatggcttgttaaataagctttaggggcctgatgtagaaaacggagttatctcaaacttgtcttgtccaattaataaagacgctcatatttacttaaaaaatcttatt

SEQ ID NO: 1689 - DNA, 874 bp, Castanea mollissima
ttcgccctcggcactttcgtcttaattttaaaaagtaattgcaattgcaatagtggtagtaacagcgtgggcctggtctggaaatcaatagaaaaaaatggccaacagtaatctcccccgaagaatcatcaaggaaactcagcgtcttctaagtgaaccagcaccgggaattagtgcttctccatcagaggacaacatgcgatattttaatgtaatgatcctcggcccaacacagtctccatacgaaggaggagttttcaaattggaactatttttgcctgaagaatatccaatggctgctcctaaggtccgatttctcaccaaaatatatcatcctaacattgacaagcttgggaggatatgccttgatattctgaaagacaaatggagtcctgctcttcaaattcgaactgtacttttgagcattcaagctcttctgagtgctccgaaccctgatgatccactctctgagaacattgcgaagcattggaaaacgaatgaggctgaagctgttgaaacagcgaaggagtggacccgtttatacgcaagtggtgcctgatgacatggtggaaagttttgcttcccctgaataacattaatgaaatgtatgctattgactgtcaattttaaatggaaatttggtacaactgatctttgaacaatcggagtttaatattctcaaagcttccagttgctgtccggtcattgttttactctcacggaagccttgtgaaacttgtatgataaaatgggccattaagtggcaaactattctatatataatattcatgcctggtaggtttctttagtcaaaattgttttaagtcatgttaaaagctagtttctttggcttaccagttggtacaaactcatc

SEQ ID NO: 1690 - DNA, 1031 bp, Cicer arietinum
gttatattattgtaataattatgttattctatctaattatcattattaaactaaagtaaaacgtgtatataaataatagaagcaagagaaaggcattttcgttgagttttgtttctggttcgtgctagtgagagaaacttctttattttcttctctctcttctttcagtgactcaaaagccctattgcgtactttgcaatcgaccaaataatggccaacagtaacctccctcgaagaatcatcaaggaaacgcagcgtttgctcagtgagccagcgcctggaattagtgcgtccccttcggaagataatatgcgatatttcaatgtgatgatccttggcccaactcagtctccttatgaagggggtgttttcaaactagaactatttttgcctgaagaatatccaatggctgctccaaaggttaggttcctgacaaaaatatatcatcctaacattgataagcttggcaggatatgtcttgatattctgaaagataagtggagtcctgcccttcagattcgcactgtacttttgagtattcaagctcttttgagtgcaccaaacccagatgatccactttctgagaacatcgccaagcattggaaatctaacgaggtcgaggctgttgagacagccaaagaatggacccgattatatgccagcggtgcttgacgattgggtggatacttttggtctcaaataacaatagtggaagtgtatgctattaactatcaaattgaaatggaaatttagaggaattgtctaaactattttggagtccatattcctcctagcttccagttacatgttaatttctttctatctcatggaagccttatatcgaaacttgtatgaatatatgggatcttttatgtcaaaaatttaaaacatgctctatcttcaactaaaaaaacaaaaagaagaacgttcttaagaaaaacaaaatagataaaaataaaaacgaggtaggtgggaggggtacgaatatagtagtatagtatatactatcgtagtaataacgaactactttc

SEQ ID NO: 1691 - DNA, 1438 bp, Citrus clementina
cactttttcaacttttgtttatgcatattttttggggttttcattgaagctcaatcttctttccactatttactggctcgactaccggaatgttgttgttgatgatgtctctaatggctacccttctttttataggggctctagatagtctttcttcctaagttcttcctgaaaaaatcagaggaatcatttgcaatgacaattttggaagataatatggtggagatctaggagggacaaaaatgtaaaatcaacttcccaaaaaagactagtattgttttcgcataaataaataattaaaattaaaattaagttaaaaaaaaaaacaaaaaaacaactttgatccatcatttcacttaaacttgttcttgtattctatttgctattctgttagacttagaaaaccctatcagcgttctttctctgcaacaacaagaaggttaaaaaacaaaaaaaatcgatcttggaaatggcgaacagtaatctccctcgacgtatcatcaaggaaacacagcgtctcctcagtgaaccagcaccaggaataagtgcatctccctcggaagataatatgcgatactttaatgtgatgatccttggtccgacgcaatctccatatgaaggaggggtgttcaaattggaattatttttgcctgaagaatatccaatggctgctccaaaggtccgatttcttaccaagatatatcatcctaacattgataagcttggaaggatttgtcttgatattctgaaagacaagtggagtccagctctccagattcggactgtactgttgagcattcaagcacttctgagtgctcctaaccccgatgatcctctctccgagaacattgccaaacactggaaaacaaatgaggccgaagcagttgaaacagcgaaggaatggacacgtttatatgccagtggtgcttgatgacatggtggaaaatatcacttcattcaaataacaattgtgcaatgtatgctattcactgtctgtttaaaatggaaaatttggaagaattgaattgatgtttgaacattcggagtttgacattctgaaagcttccatcttaccgcacatgtcaattattttcttcttgtggaagccatgtctttgaacttgtatgattagatgatatacattgtttctcaactcttaaatttcgaagcaatgtttattgtctgctatagtagtaatctggaaataccgattattatcaggaaaccttgacttcagttggcatcagtatggggaaaaaacttgcgttgagctaggagggtccaaaggttcgctgccattgatatttttagtattagatttagtgagtttcatactgttggtcccagaataggatccacagaattattgggctatcctttgttctaccacttcagcatagtttcgcacaagtagtcttgtgctgtgtttactcttggg

SEQ ID NO: 1692 - DNA, 857 bp, Cleome gynandra
aagaagtgtttcctcgataatcatcatccttcgtcttccttctacagtttctctctctctctctctctctcaagaaaccctaagctctgtgagatcgatcgacccatagcgcgaaacaatggcgaacagtaatttgccccgaagaattattaaggaaacccaacgtcttctcagtgaaccggctcccgggataagtgcttctccatctgaggacaatatgcgatacttcaatgttatgattcttggccctactcaatctccttatgaaggaggcgttttcaagttggagctctttttgcctgaagaatatcctatggcagctcccaaggttcggtttctcaccaagatataccatcccaacattgacaagctcggaaggatttgccttgatattctgaaagacaaatggagtcctgcactacaaataagaacagtactcttgagtattcaagcccttctaagtgccccgaacccagatgatccactgtctgagaacattgctaagcattggaagacaaatgaggcagaagccgtggaaacagcgaaggaatggacccgcctatacgcaagcggagcatgatcgagcgaaagagaataagttatcttccctaataacattccattccatggcaaaaacatatatcccatcaacaggttttaagaacaaaaaaaaacaacgaaaaacaaaaggtttgaatggaatccgaatgataagaaagcttctttatgggtttctggttcctcctcttccctttaaaactgtgttacgcattgcagagaaagctgtaatattactgaatttgtatcactacactgtctgccattaaggagcttgaaccgaaggcatttgcgtttac

SEQ ID NO: 1693 - DNA, 763 bp, Cleome spinosa
tataaattatggaaaggaggacgtcagagagacgacgaagcgtctcctcgattatcagccttcgtctttcacagcttctctctctggaaaaccctaagctctgtgagatcgatcgagccatagcacgcgacaatggcgaacagtaatcttccccgaagaatcattaaggaaactcaacgtctgctcagtgaacctgctcccgggataagtgcttctccatctgaggacaatatgcggtacttcaatgttatgattctcggccctactcaatctccttatgaaggaggagttttcaagttggagctctttttgcctgaagaatatcccatggcagctcccaaggttcggtttctcaccaagatataccatcctaacattgacaagcttggaaggatttgccttgatattctgaaggacaagtggagtcctgcactacaaataagaacagtgctcttgagtattcaagctcttctaagtgcaccgaacccagatgatccgctgtctgagaacatcgctaagcactggaagacaaacgaggcagaggccgtggaaacagctaaggaatggacccgcctttacgccagcggagcatgatcatggggccgaaagaagaatcattggatcgtcccccccaataacattccattacaagaaaagaacaaaaggtttggaacggaatccgagttataagaaaaggcttatttctgggtttctggtggtaaaaaaactccgttttgtctcccttctatgtgcgtcatttttt

SEQ ID NO: 1694 - DNA, 718 bp, Cleome spinosa
acgtcagagacgacgaaccgtcctcacgattgtcaccagctcccttcgtctttctcagcttctcgctcttaaaaggaaaagaaaaccctaggctctgtgaggatcgatcggcgtgacaatggcaaacagcaatcttccccgaagaatcatcaaggaaactcaacgtctgctcagtgaaccggctcccgggataagtgcttctccatctgaggataatatgcggtacttcaatgttatgatcctcggccctacgcagtctccttatgaaggaggcgttttcaagttggagctctttctgcctgaagaatatccaatggcagctcccaaggttcgttttctcaccaagatataccatcctaacattgacaagctgggaaggatttgccttgatatcctgaaagataagtggagtcctgcactacaaataagaacagtgctcttgagcatccaagctcttctaagtgcaccgaacccagatgatccactgtccgagaacatagctaagcattggaagacaaacgaggcggaagccgtggaaacagcaaaggaatggacgcgcctctatgcaagcggagcatgagcatatatatgatcatgatcgggcgaaagagaagccgagaataaatattccatggcgaaatatatatatatatatatatcccatcaacaagtgaaggaaaacatatatatatacatatatgggtttctggttcatcct

SEQ ID NO: 1695 - DNA, 970 bp, Gossypium hirsutum
gcttagcgtggtcgcggccgaggtacgcggcgatctttcctctgtttttcttattctcggattctctcttcatctcccaattctcaaaaccctaattatatttttttatttccctttttgattcagcaatcggggcttgccaatggccaacagtaatctccctcgaagaatcatcaaggaaactcaacgtctcctcagtgaacctgctccgggaattagtgcttcaccatcagaggataatatgcgatatttcaatgtgatgatccttggtcccacacagtctccatatgaaggaggggttttcaagttggaactatttttgcctgaagaatatcccatggctgctcccaaggttcgatttcttacaaagatatatcatcctaacattgataagcttgggagaatatgcctcgatattctcaaggacaaatggagtccagctctgcagatccgaactgtacttttaagcatccaggcactcttgagtgctccaaatccagatgatccactctcggagaatattgctaagcactggaaatcaaacaaggctgaagctgttgagacagcaaaggaatggacgcgtttatatgcaagcggtgcatgaagaccggtggaaccgtttgctctcataaaataacatttttatgcaatgtaagctattcaatgtcaattccatattgaaatctggacgaatgacagtttgaaagagtttgatatttgcaaccaaaaaaaaagcttccaggtgctacccttttagtagtaattcggtcggaagcaatctctaagcttgtatgataatacacatggttctctaaaactcccaaaggctttaactatgggattattctctaatatggtgatttcagattctggctatatgtgtgtgtaatgaatctatcaactggaaatgaaagaatggattgattaaaattttgaggcttagggttctgtattgttcttggaccgttac

SEQ ID NO: 1696 - DNA, 880 bp, Gossypium hirsutum
agcgagttaaagagaccgagggatctctttgtcttctcagattttctctttccatctctcaattctcaaaaccctaatttctctgctttcccttttgcttaatcaatcgatcctcgtcaatggccaacagtaatctccctcgaagaatcatcaaggaaactcagcgtctcctcagtgaacctgcacctggaattagtgcttcaccatcagaggataacatgcggtatttcaatgtgatgatccttggtccaacacagtcaccatatgaaggtggggttttcaagttggaactatttttgcctgaagaatatcccatggctgctcccaaggttcgatttcttacaaagatatatcatcctaacattgacaagcttggaagaatatgccttgatattctcaaagacaaatggagtccagctctccagattcgaactgtacttttaagtattcaagcacttttgagtgctccaaatcccgatgatccactctctgaaaacattgctaagcactggaaaacaaatgaggctgaagccgtcgagacagcaaaggaatggacccgtttgtatgcaagcggtgcatgaagactgtttggtatcatttgccctcttaaaataacatgttatgcagtgtaagctattccatgtcaattacatatggaaatttggaaaatttgatgtttgaaaagagtctgatattcacaaaaagcttccagttgcgacctgtttatcgttttctggttggaagcagtcactgaagttgtatgataaaaatacaatgttgtctaaaactctcaaatgctgaactaagagattattctcaaatgcagctatttcatgttctgtttatttatgatattaaagtttgatgcatacatacatga

SEQ ID NO: 1697 - DNA, 618 bp, Gossypium hirsutum
gcaatcgatctcgccaatggccaacagtaatctccctcgaagaatcataaaggaaactcagcgtctcctcagtgaaccagcgcctggaattaatgcctcaccatcagaggataatatgcgatattttaatgtgatgatccttggtccaacacaatctccatatgaaggaggggttttcaagttggaactatttttgcctgaagaatatcccatggctgctcccaaggttcgatttcttacaaagatatatcatcctaacattgataagcttgggagaatatgcctcgatattctcaaggacaaatggagtccagctctgcagatacgaactgtacttttaagcatccaggcactcttgagtgctccaaatccagatgatccactctccgagaatattgctaagcactggaaatcaaacgaggctgaagctgttgagacagcaaaggaatggacgcgtttatatgcaagcggtgcatgaagaccggtggaaccgtttgctctcataaaataacatttttatgcaatgtgagctattcaatgtcaatttcatatggaaatctggacgaatgacagtttgaaacagtttgatatttgcaaaaaaaaagcttccaggtgcta

SEQ ID NO: 1698 - DNA, 849 bp, Vigna unguiculata
ggattgagaattgttctgttttgtgttagtgagagaaaggtgtctctgtttctctctctttgactcaaaaccctattgcgtgctttgcaatcgaccctgattatggccaacagtaaccttcctcgaagaatcatcaaggaaacgcagcgtttgctcagtgagccagcgcctggaattagtgcttccccctctgaagacaatatgcgatatttcaatgtcatgatccttggccctactcagtcaccttatgaaggtggagtttttaaactagaactatttttgccagaagaatatccgatggctgctcctaaggttaggtttctgacaaaaatataccatccaaacattgataagcttggcaggatatgtcttgacattctgaaagacaagtggagtcctgcccttcagattcgcactgttcttttgagtattcaagctcttctaagtgcaccaaaccctgatgaccctctttctgagaacattgcgaagcattggaaatctaacgaggctgaggctgtggaaacagccaaggaatggactcggttatatgccattggcgcctaatgctggatgggttgggaacttttggcttcaaataactatagtagaagtgtatgctgtataactgtcaaatctaaatgcaaatttggagttatctattaaactattttggagttaatatttcccatagcttcaggttacctgtttattactttctttcacctggaaggcttgtcttggaatttgtatgaaaatatgtgatattttatctgacaaatttaaacactaagtaatttgagatcttcaaacttaatagtacaaaattttcgaataaaaaaaaaaaaaaaa

SEQ ID NO: 1699 - DNA, 922 bp, Vigna unguiculata
ggatcttaattaagggttttctgacttgaaaatgaagttaaaacggttctcagcgttctttgtacatctatgccagtgagagaaactctctcttcctctctttagaaaccctattgcacgcttttcaatccagctccacaatggccaacagcaatctccctcgaagaatcatcaaggaaacgcagcgtttgctcagtgagccagcacctggaattagtgcgtccccatctgaagacaatatgagatatttcaatgtgatgatcctgggaccgacccagtcaccttacgaaggaggagtatttaagctagaactatttttgccagaagaatatccaatggctgcaccgaaggttcggtttttaacaaaaatatatcatccgaacattgataagcttggcagaatatgtcttgacattctgaaagacaagtggagtcctgctcttcagattcgtactgttctattaagtattcaagctctattgagtgcaccaaacccagatgatccactttctgaaaacattgccaagcattggaaatctaatgaggctgaggctgttgaaacagcgaaggaatggacccgattatatgctagtgacgcctgatgataaggttcaaagtatggctccataataacaattgtaaccatcattttatactggaattctagcagatctatgatatcggagttaatatccctggcagcttccagttacctgttaatttcttctcctgggagctgccataccttgaaacatgtatgaatagacgtgtttttgtcttttacatatctaacaatttagaacatgcttcaatcatcggctgtgaagttatttgttgttctcaactcaacgtcaaaggccaaaatttgcgaattattttatgttctctttatcttaatgaaccatgcatgatttgttgagtt

SEQ ID NO: 1700 - DNA, 817 bp, Cucumis sativus
acctccgaagctttccttcaactcttttataatctagagagaggaaacctttcttctctccacaatttctctctcttcctttcctctaaaccctatcgcaacctttcaatccaaccttaccaatggcgaacagtaatcttccccgaagaatcatcaaggaaactcagcgtcttctgagtgaaccagcccctgggatcagtgcttcgccatcagaagataacatgcgatattttaacgtcatgattcttggcccgacccagtcaccctatgaaggaggtgttttcaaattggaattattcttacctgaagaatatcctatggctgctcccaaggttcgatttctcacaaagatttatcatccgaatattgacaagcttgggaggatatgccttgatattctgaaagacaaatggagtccagctctacagatacgaactgtacttttgagtattcaagctcttctgagtgctccaaacccagatgatccactttccgagaacattgccaaacattggaaaacgaatgaggcggaagctgttgaaacagcaaaggaatggactcgattatacgcaagtggtgcctaaaggaaagtgcagaaggcttttactcttttcggtttaataacatgaatctaatgtctctatggtgccatttggtgtggattttaatgaaatatttggaagaatttacagtgtcaaaattgtctctaaaattgtaacgatctctaaaattgcgtctcttttggcaggagtctgtgcccccatactttgtatgatgatatgattagatgaattacattcttctcttaagttctatt

SEQ ID NO: 1701 - DNA, 663 bp, Taraxacum officinale
cgtaaatcctccacttctatggcgaacagcaacctccctcgaagaattatcaaggaaacgcagcggttacttagcgaaccagcacccggaattagcgcatcgccatcagaagataatatgcggtttttcaatgtcatggttcttggtccatcacagtctccttacgaaggaggagtcttcaagctggagctatttctacctgaggaataccccatggctgcccccaaagttcgattccttacaaaaatataccatccgaatattgataaacttggaagaatatgtcttgatattctaaaagataaatggagccccgcccttcagattcgcacagtactcttgagtattcaagcgcttttaagtgcaccaaatccagatgatccgctttcagagaacattgcaaaacattggaaatctaatgaagtagaagctgtggaaacagcaaaggagtggacccgtttgtatgcaagtggcgcgtaacaaatggatgtatattgttcgggattacgaaaaaaaaaaaattattttcattataacatgttgtttatgtactaattactatcttggattttaaaccatgtttcattttggtttaaatgaatgtatgatgtatcttctttatcaagaatgaaatcagattaaacgcaaaaaaaaaaaaaaaaa

SEQ ID NO: 1702 - DNA, 701 bp, Eschscholzia californica
ttttagggagaattctactgaccaaagtgacaactactttctctcacgccagccactatcttttctgcttgttcttaatcttctctcatggcaaacagtaatctaccaagaaggatcatcaaggaaacacaacgactcctcagtgaaccagctcctggaattagtgcttctccttcagaagataacatgagatatttcaatgttatgattcttgggccatctcaatctccttatgaaggcggtgtcttcaagttggaactgtttttgcctgaagaatatcccatggcggcgcctaaggtccgctttctgaccaaaatttaccatccgaatattgacaagcttggaaggatatgtcttgatattctgaaagataaatggagtcctgctctccagattcgaactgtactcctcagtattcaagcacttctaagtgctccaaacccagatgatccgctctctgaaaatgtcgctaagcattggaaagctaatgaggttgaagcagttgaaacagcaaaagagtggactcgtctttatgctagtggcgcatgagagcaagatggctgtgaaggaacctaaatgttagtgcaaacaacgattaacgcaatataagatcagaaaagtgaagctagatgggatcgttttcaaaatacggacaaaagaacaaatgtcattattgtgaaaagatcattactagctgttgt

SEQ ID NO: 1703 - DNA, 697 bp, Euphorbia peplus
tttctctgtcaaaacccttgaagtagcgttctctgcaatcgacctctgagaaatggccaacagtaatctacctcgaagaatcattaaggaaactcaacgtcttcttagcgaaccagcgccgggaataagtgcctcaccgtcagaagataatatgcgatattttaatgtgatgattcttggcccaacacagtctccatacgaaggtggggttttcaagctggaattgtttcttcctgaagaatatccaatggctgcaccgaaggttcgatttttgaccaaaatttatcatcctaacattgacaagcttggaagaatatgccttgatattctgaaagacaaatggagtcctgctcttcagatacggactgtacttttgagcatccaagcgctgcttagtgccccaaacccggatgaccccctctctgagaatatagcgaagcactggaaaacaaatgaagctgaagctgtcgaaacagcaaaggaatggacccgtttatatgcaagtggtgcatgaagatgtgcttccaactctttttcccttcaaacgaagttcatgtgatatatctattaactgttaaattgaatggaaaattgaagaattgctgtttgaacaaatcataatttaatgttttccaaagcttccagatactgccctgatatgaattgcttgaagttggaagcatcttcgttgaacttg

SEQ ID NO: 1704 - DNA, 1068 bp, Flaveria ramosissima
tctctagtaaacattcactttctctctctaaaaaggcaaaatctctttagcgtgcatcctaagcttcaatggcgaacagcaatctacctcgaagaatcatcaaggaaacgcagcgtttactcagcgaaccagcaccgggaataagtgcatcgccatcggaggataatatgcggtattttaatgttatgattcttggcccaacacagtctccttatgaaggaggagtcttcaagctggagctttttctgcctgaggaatatccaatgtctgcccccaaggtccgattccttacaaaaatataccaccctaatattgataagcttggcagaatatgtcttgatattctaaaagataaatggagccctgctcttcagattcgcaccgttctcctcagcattcaagcacttttaagtgctccaaacccagatgacccactgtctgagaacatagcaaagcactggaagtcgaacgaagcagaagctgttgaaactgcgaaggaatggacgcgtttgtacgcaagcggtgcctaatggacatatgttacaaaaccgaaaaataacaaatgtatttctatcacaacatattccgtgtcctgattatacttcctttcaccatctttttggtcccaatatatgatgtgtcattttaatgaatttagtgatgggagatccaatcaagcacttttcaaggtcttgtccaataaccctttttttatcattatttctggggaccaattaataattgcatctatatacgctaatacgtatttgattcctatacggcttgctcgtgttgatttggacaacatattatttgtgaaccatattgattgtcatacgtcaaaccgtcttggtctaattgcacgaagtaaaagtaaaccaaatttcgcaatcagtctgctcagacgatggttcaactgaagttgatccaatagaatatgcttaagcaatcatgaaaaacacaatgaagaaagtgactataaagagaattaggttataacaaataagttggaatgtagattgattgatgcatattgaaagtattaatttttgtttgttttgcagtaac

SEQ ID NO: 1705 - DNA, 731 bp, Flaveria ramosissima
ccataatctcccttcactttctctctctaaaaaaccctcattttttttctctctctaaaaatccccatagcgtaaatcttccttcgatggcaaacagcaatcttcctcgaagaatcatcaaggagactcagcgcttgctcagcgaaccagctccggggataagtgcgtcgccatcggaagataacatgcggtattttaatgtcatgatccttggtccaacacagtctccttatgaaggaggagttttcaagctggagttatttttgccagaagaatatcctatggctgctcccaaggttcggtttcttacaaaaatttaccatccgaatattgataagcttggtaggatttgtcttgatattctcaaagacaaatggagccctgctctccagattcgtactgtactcctgagcattcaagctcttttaagtgctccaaacccagacgatccactctctgagaacatcgcaaagcactggaaatctaatgaagctgaggctgtggaaacagcgaaagagtggacccgtttgtatgccagtggcgactaacagagattcgtgtcttcgtgttgcgtggaaaaaataacaatgtatttggttaggtcttgaaattcaaatttcaaaacttgaatgattccgcctgctgcattgttgttcgcttccttttcagataagatgctcttctttcctaatttcttatgtgaaatattcattcagttaactatgtaaaat

SEQ ID NO: 1706 - DNA, 858 bp, Linum usitatissimum
tgctactaccgaaacccatagccttgcctactacctacctttaccccaccgattatctcgaacagttattcaccggactccgaagaagaaaagaaacctcaatggcgaacagtaaccttcctcggagaattatcaaggaaacgcagcggctgctcagtgaaccagcccctggaattagtgcttccccttctgaagaaaacatgcgatacttcaatgttatgattcttggtccaacacaatcaccttatgaaggtggtgtttttaagttggaattgttcttgcccgaagaatacccaatggcacctcccaaggttcgcttcttgacgaaaatttatcaccctaatattgacaagcttggaagaatttgccttgatattctgaaagataaatggagccctgcactccagatccgaactgttctgctaagtatccaagctctcttgagcgcaccaaatcctgatgatcctctgtctgagaacattgcaaagcactggaagtcaaatgaagctgaagctgttgaaacagctaaagaatggagccgcttatatgcaagtggtgcatgaggaggcaagctggagcagtgcaaatgatctatgttgtttcttgttacattggttaaatgaatttgaaatgtaatgtctgttggttcctaaaatgggaaatatgcttcaatgtatgctctgaacactatcagatacatgaatccttaaagagtctcgagtcttgaatcgcagcagtactctcctttcagtatactggacctgtatcatacagcgtcattggaagcttccctttaattgacttgcgataatgactgattgacttgtgaatgcgttcagagcgtgatgagaatcttac

SEQ ID NO: 1707 - DNA, 685 bp, Fraxinus spp
gagaaaagaccttttattagcgtaaaatctccgaccgaaagcagagagacatttgcaagattcaattcaatggccaatagcaatttaccccggagaatcatcaaggagactcagcgtcttctcagcgaacctgcacctgggataagtgcttctccatcggaagacaatatgcggtatttcaatgtaatgattcttggtccaacacagtctccttatgaaggaggtgttttcaagctggaattatttttgcctgaagagtacccaatggctgctcccaaggtccggttcctcaccaaaatataccaccctaacattgataagcttggaaggatatgccttgatattcttaaagacaagtggagtcctgctcttcagattcgaacagttcttttaagcattcaagcacttttgagcgctccaaatccagacgatccactctctgaaaacattgctaagcactggaaaacaaatgaggccgaagctgtcgaaacagcaaaagaatggacgcgtttatatgcaagtggtgcgtgaagtacatggaactcagggctttgatattacaaaaacatgtatttgattgatggaaactttgaaggaatcgatgatgctcaaactaatgggaattcaaattaatgttctcaaaggctataaatttatttcctgctttcgaactatgtaattgaaa

SEQ ID NO: 1708 - DNA, 834 bp, Fraxinus spp
aaagccattgtcagctgaggctctccataacaggaataaacgaaaaacccttttcctctttgcgaaattcagttaatggctaacagcaatttacctcgaagaattatcaaggagactcagcggcttctaagcgaaccagccccaggaataagtgcatctccatcagaagagaatatgcggtattttaatgtaatgattcttggcccaacacagtctccttacgaaggaggagttttcaagctggaattgtttttgcctgaggagtacccaatggctgctccgaaggttcgcttccttaccaaaatttaccatcctaacattgataagcttggaaggatatgcctagatattcttaaagacaaatggagtcctgctcttcagattcgaactgtacttttgagcattcaagcacttttgagcgctccaaacccagatgatccactctctgaaaacatagcaaagcattggaaaacaaatgaggcggaagccgttgaaacagcaaaagaatggacgcgtttgtatgcaactggtgcttgaagagcttggtgctaacgtaataaccatatatgtaactcattgactgttcaatgaagatggaaaacatggaagaattagctatgatacaaaatcgcaatttaatgatctactctatgattgtttccttgataaaatgggtatttgaagttgtataatgagatcatatactcttattatgtctcttgacctgttgtgtcaatcttcaccgttaagtagacaattctatttagagggcgttttcatttggaatagagactagaatcgcaagttgattgatgtcgaagatgagatttttcc

SEQ ID NO: 1709 - DNA, 1449 bp, Gossypium raimondii
aaaagggatttgatcccaataatttataaatatttttatttatacatggaataaaaaaaaaaagtaaagaacaaagtcaaaatcattgcattttggaaaaaaaaaaaaaagagagcgagttaaagagaccgagggatctctttgtcttctcagattttctctttccatctctcaattctcaaaaccctaatttctctgctttcccttttgcttaatcaatcgatccttgtcaatggccaacagtaatctccctcgaagaatcatcaaggaaactcaacgtctcctcagtgaacctgcacctggaattagtgcttcaccatcagaggataacatgcggtatttcaatgtgatgatccttggtccaacacagtcaccatatgaaggtggggttttcaagttggaactatttttgcctgaagaatatcccatggctgctcccaaggttcgatttcttacaaagatatatcatcctaacattgacaagcttggaagaatatgccttgatattctcaaagacaaatggagtccagctctccagattcgaactgtacttttaagtattcaagcacttttgagtgctccaaatcccgatgatccactctctgaaaacattgctaagcactggaaaacaaatgaggctgaagccgtcgagacagcaaaggaatggacccgtttgtatgcaagcggtgcatgaagactgtttggtatcatttgccctcttaaaataacatgttatgcagtgtaagctattccatgtcaattacatatggaaatttggaaaaattgatgtttgaaaagagtctgatattcacaaaaagcttccagttgcgacctgtttatcgttttctggttggaagcagtcactgaagttgtatgataaaaatacaatgttgtctaaaactctcaaatgctgaactaagagattattctcaaatacagctatttcatgttctgtttatttatgatattaaagtttgatgcatacatacatgaatattctcttaaaatacaacactttggtctcattacaatcttttaactcaatactagtacgagtcttaggcattgcgttgggatgattatttgtttgtgttaatttacggagtataaatttaaaggtcaaaatatactcttaaggtcgaagcttacttttattttcagaaatttactctagttttttggatttaaaattttaggttaaatttttatcacaagcacttggtagttaagtatcaataaaaataatattgaaaatatttgtatagattttttaaaaaacattctttccaatttgtcatgataaaataaattttttagattagcgttccgaataaaaattgatgtcaaaatattttaattaaatattaaatatttaaattaattagctaatataagggctaaagctaaagtttgatccttgtcaagcaaacctaaaaagaaataaagaac

SEQ ID NO: 1710 - DNA, 1142 bp, Vitis vinifera
ataagcagctgctcttagtgagagaaaagtctgaaccctcttttctctctttactttctctctgcctttcgtcctctcttcaatggcgaacagcaaccttcctcgccggatcatcaaggaaactcaacgtctccttagtgaaccagcgccgggaatcagtgcttcgccatctgaagacaatatgagatattttaatgtcatgatccttggtccaactcaatctccatatgaaggtggggttttcaagttggagttgtttctgcctgaagaatatccaatggcagctcccaaggttcgttttctcaccaaaatatatcatcctaacatcgacaagctcggaaggatatgccttgatatcctgaaagacaaatggagccctgctctccagattcgaaccgtactcttgagcattcaagcactactaagtgctccaaacccggatgatcctctttctgagaacattgctaagcattggaagacaaacgaagctgaagctgttgaaacagcgaaggaatggactcgcctgtatgcaagtggcgcatgatggcgatgacatggtgaaaatttgtgccctctttgaataacttctgtgcttctgtatgttaatgactgaatttcaaatggaacttgtgtagaagtaatgcttgatcgatcagagtttaatatttgcaaagcttctcgataatgcctattaattattctcctttggaagctttgtatttcaacttgtatgattagaatgacataccaatcttctctatatctctccaatgcaggattttggatgggagatgggggagtaattgaaatgtgaaagttgattaggaaaatattgtgaataaccttggtaaactcattaaggcggctcatgttatggctcttgcattttcctctcatgtgtattgtatttttgcaaatcgtatttttattaacacaagacagcttttgaatgaaaacagaatttttgcaaactgtgtttttcttaacacagcttttgcatgaaatccatctatttagatgataagatattttgagaatgatttgttatgtcggtaatgatttattgaatactaatgaaaaggagatgtataaattgagatattgaaggttattaaagatagatggtgaagagaattgagaaa

SEQ ID NO: 1711 - DNA, 729 bp, Guizotia abyssinica
aagtttcgtcgacgtacgacatatgccgggattcgccattacgcccgggatcgattcatcattcccccaagctttctcttcaagaaaacttcggcaaaacttaaccgtgaatcctaagcttccattccatggcgaacagcaatctacctcgaagaattatcaaggaaactcagcgtttactcagcgaaccagcaccgggaataagcgcctcaccatcggaagataatatgcgctatttcaatgtcatgattcttggcccaacacagtctccttatgaaggaggagtcttcaagctggagctatttctgcctgaggaatatccaatgtctgcccccaaggttcggttccttacaaaaatataccacccgaatattgataagcttggcagaatatgtcttgatattctaaaagataaatggagccctgctcttcagattcgcacagtgctcctgagcattcaagcacttctaagtgcaccaaacccagatgacccactgtctgagaacatagcaaagcactggaaatcaaatgaagcagaagctgttgaaacagctaaggaatggacacgtttgtatgcaagcggcgcctaatgggcatatgttacaaaaccagaaaataacaaatgtatttctattacaacatgtcctactccttttttgtccccaatatatgtatgatgtgtcctttatttttatgaattcagtgatggaagagccaatcaagcacttt

SEQ ID NO: 1712 - DNA, 721 bp, Humulus lupulus
ctccaaaaaccctcgttttgtgttggcgtagtttgcaatcgacccagttatggcgaacagtaatcttccccgaaggatcatcaaggaaacgcagcgtcttctgagtgaacctgctccgggcattagtgcttcgccatcagaagacaatatgcgttattttaatgtgatgatccttggcccgacgcaatcgccttacgaaggaggagttttcaagttggaactatttttgcctgaagaatatccaatggctgctcctaaggttcggtttctcaccaagatatatcatcctaacatcgataagctcggtagaatttgtctcgatatcttgaaagacaaatggagtcctgctcttcagatacgaactgtacttttgagcattcaagcacttcttagtgccccaaatcccgacgaccctctttcagagaacattgccaagcattggaaaagcaacgaagttgaggctgtcgaaacagctaaggaatggacccgtttgtatgctagcggagcgtaaaggcacagtggaacttttttcatgcctgcaaataacattttattgcaatgtgtaagttattaactgtcaatttgaaagaaaattaagtgaattaatgatgcttttgaaaatgggagcttaaaatgttgtctaaatcttccagtcattattggatgtcaattgttttcctctctttgaatcttttgcctctgtaacctgtataattatcaa

SEQ ID NO: 1713 - DNA, 723 bp, Ipomoea batatas
gggggccagcgcttttggcgagagaagtctccgactctcaacactctatcgctgtctctacagaagccttagcgtagaaactccgaccgaaaggaactttcgattcaattcaatggcgaacagcaatcttccccgtagaatcatcaaggaaacacagcgcctcctcagcgaaccagcacctggaataagtgcttctccctcggaagaaaacatgcggtattttaatgtcatgattcttggtccaacacagtctccctatgaaggaggtgttttcaagctggaattatttttacctgaagaatacccaatggctgctcctaaggttcggttcctcaccaaaatctaccaccctaacattgataagcctggaaggatctgtcttgatattcttaaagacaaatggagtcctgctcttcagatacgtactgtgcttttgagtattcaagcacttttaagtgctccaaatccagatgacccgctatctgaaaacattgcgaagcattggaagacaaatgaggccgaagctgttgaaacagcaaaggaatggacacgcctgtatgctagcggtgcctgaagttagtttgttgaagtggaaatggtgcgataaataacaaaatgtgcaatgtattatatcaagtgtctgattaaatgttgccaaggatgcttggttcaaattggaatatatatattcatcctggctacaacaggataattgtttccttg

SEQ ID NO: 1714 - DNA, 787 bp, Ipomoea nil
ggagagaaagtctccgactctcaacactctatcgctgtctctacaaaagccttagcgtaaaaactccgaccgaaaggaactttcgattcaattcaatggcgaacagcaatcttccccgtagaatcatcaaggaaacacagcgtctcctcagcgaaccagcacctggaataagtgcttccccatcggaggagaacatgcggtattttaatgtcatgattcttggtccaacacagtctccctatgaaggaggtgttttcaagctggaattatttttacctgaagaatacccaatggctgctcctaaggttcggttcctcaccaaaatataccaccctaacattgataagcttggaaggatctgtcttgatattcttaaagacaaatggagtcctgctcttcagatacgtactgtgcttttgagtattcaagcacttttaagtgctccaaatccagatgacccgctatctgaaaacatcgcgaagcattggaagacaaatgaggtcgaagctgttgaaacagcaaaggaatggacgcgcctgtatgctagcggtgcctgaagtttgttgaagtggaaatggtgcgtgcgataaataacaaaatgtgcgatgtattatatcaagtgtctgattaaatgttgccaaggatgcttggttcaaattggaatatatatatgttcatcctggctacaacaggataattgtttccttgccatgaagaagttgtacaattaaatggtgcattctgttttcatcatctctgcaaaaaagctatataatgtcttctcaca

SEQ ID NO: 1715 - DNA, 647 bp, Ipomoea nil
gatcgctctctctctctctctatacaaaagtctcaggcgtaaactctccgacagagagaaccttccaactcatctcaatggcgaacagcaatctcccccgaagaatcatcaaggaaactcaacgtcttctcagcgaaccagcaccaggaataagtgcatctccatcagaggacaatatgcgttattttaatgtcatgattcttggtccaacacagtctccttatgaaggaggtgttttcaaactggaattgtttttgcctgaagaatatccaatggctgctccaaaggttcggttcctcaccaaaatctatcatccgaacattgataagcttgggaggatatgtcttgatatacttaaagacaaatggagtcctgctcttcagattcgtacagtacttttgagtattcaagcacttttgagtgctccaaatcctgacgatccactctccgagaacattgcaaaacattggaagacaaatgaggctgaagctgttgaaacagcaaaagaatggacacgtctatacgccagtggtgcctaacagttgtggagaaaggtgttttaaaaaataacaaaatgtgcaatgtactctttgactgtctaattagtatgatatcttggaagaactgaagaatggtgaaacaaaatg

SEQ ID NO: 1716 - DNA, 766 bp, Jatropha curcas
attctccttattgagcttagtgacgagaaacaatctctctctctctcaaaacccttcaagtagcgttttcggcaatcgaccttgaagaaatggctaacagtaatctccctcgaagaatcataaaggaaactcaacgtcttctgagtgaaccagctcccggaataagtgcttcaccatctgaggataatatgcggtattttaatgtgatgattcttggcccaacacagtctccatatgaaggtggggttttcaaactggaattatttctaccagaagaatatccaatggctgctccaaaggttcgatttctgaccaaaatctaccatcctaacattgacaagcttggaaggatatgccttgatattctgaaagacaaatggagtcctgctcttcagatccgaactgtacttttgagcatccaagcacttcttagtgctccgaaccccgatgacccactttctgagaacatcgctaagcattggaaaacaaacgaggctgaagctgttgaaacagcaaaggaatggacccgtttatatgcaagtggtgcatgatgacgatgcggtggaaaacttcccttccctttccctttagatgatggtgatgtgaaatatgctattaactgttaatttcaatcgaaaaaagaagtttgaaagaattataatttgatatttttcaaagcttccagatactgcccctattaaaaattgtttgatgttggaagcattgtctttgaacttgtatgattagataacgcacattattcgcc

SEQ ID NO: 1717 - DNA, 706 bp, Actinidia deliciosa
  misc_feature (596)..(596): n is a, c, g, or t
aaattcgatccaaccaaaacacagttttcccaagtctcgattctcaaaccatcagcttctctctctactttctctctctatttgttctgtctcaaacccttagcgtactctgcaatcgaaccttgtacaatggcgaacagcaatcttcctcgaagaatcatcaaggaaactcaacgtctcctcagcgaacccgcaccgggaataagtgcatcaccttcggaagaaaatatgcggtattttaatgtcatgattcttggtcccacgcagtctccttatgaagggggcgttttcaaacttgaactgttcttgcctgaagaatacccaatggctgctcccaaggtccgatttctcaccaaaatctaccatcctaacattgataagcttggaaggatatgccttgatattctcaaggacaaatggagtcccgctcttcagattcgaactgtactcttgagcattcaagcacttttaagcgctccaaaccctgacgatcccctatctgagaatattgcaaagcattggaaaacaaatgaagctgaagccgttgaaacagcgaaggaatggactcttctatacgcgagtggtgcgtgatgaangggtggaggtgatggttctccgaaataacagaatatccaatgtatcttatttaactgttgaatttaaattgaaatttgaaaaagtgatgtgctgggatgattggaattgg

SEQ ID NO: 1718 - DNA, 768 bp, Glycyrrhiza uralensis
gcgttgagctttgttctggtctgtgttagtgagagaaagttcttttttctctctctttctctctgtgactcaaaaccctattgcgtgctttgcaatcgaccccgataatggccaacagtaacctcccccgaagaatcatcaaggaaacgcagcgtttgctcagtgagccagcgcctggaattagtgcgtccccttcggaagacaatatgcgatatttcaatgtgatgatcctaggaccaacccagtctccttatgaagggggtgttttcaagctagaactatttttgccagaagaatatccaatggctgctccaaaggttaggttcctgacgaaaatataccatccaaacattgacaagcttggcaggatatgtcttgatattctgaaagataagtggagccctgcccttcagattcgtactgtacttttgagtattcaagctctgttaagtgcaccaaacccagatgatcccctttctgagaacattgctaagcattggaaaactaatgaggcagaggctgttgaaacagccaaggaatggacccgactatatgctagtggcgcctgatgattgggtgggaacttctggcctcaaataacaatagtggaagtgtatgctattaactgtcaaattgaaatggaaatttgaaggaattgtctgaactattttggagttctcttagcttccggttacatgttaattgctctctttctcatggaagccgtatattgaaacttgtattaatatatgcgatcttttatgtgtc

SEQ ID NO: 1719 - DNA, 928 bp, Zea mays
agcacaataagttgaggtaacgtgacagggccgagataaaacccaagcaaagcagcaggtagaccgctgcagcaaaaccgcgccccaccgcttccccgttccccaccccgaccgactgctccccctcccccgcaccagcctcaagccctcaaggcctcaaggcatcgccggcgccgcaacttcgctgaggaagcccgcacccctgcccggatccgatggccaacagcaacctcccgcggcggatcatcaaggagactcagcggctgctcagcgagccagcaccggggatcagcgcgtcgccctcggaggagaacatgcgctacttcaacgttatgatccttgggccggcgcagtcgccctatgaaggtggagtttttaagcttgaactctttttacctgaggaatatccaatggctgccccaaaggttaggtttctgacaaagatttatcatcccaacatcgacaagcttggtaggatatgcctcgacattctcaaggacaaatggagcccagcacttcagattcgaacagttcttttgagtatacaggctctactgagtgcgccaaatccagacgaccctctttcggataacattgcaaagcactggaaagccaatgaagtagaagctgtcgaaacagctaaggagtggactcgcctgtatgcgagcggtgcatgagaacgcagtgatgttcttgatgtaataacccatcatacttcagtcctcatctattgccatttgcttgataaaaaataggctggagatatttgccatggaatgaagtctctacatgactatcactctgaattgtttggttgtacacctgtggtcggttccctttaccttggggcacctttgacaaatcagtatctgtggtagaacttgctgatactgtaatatatttgttacttcatgtagaagagcttctc

SEQ ID NO: 1720 - DNA, 1135 bp, Zea mays
atcggcccattcgtgtccatgtccatccatgcccagcggcccattcgacctccctcgacccaccccctcgtctcgtctcgtctcgtctcgtccacctccccagcggcgcgtgcgcgtgaagcttgaggcaatccccgctccgtctagcggccctgcgcaatcagtcagggttccatggccaacagcaacctcccgcgccgaatcatcaaggagacgcagcggctcctcagcgaaccagcgccggggattagcgcgtcgccgtcggaagagaacatgcggtacttcaatgtcatgatccttggccccgcacagtcaccctatgaaggtggagttttcaagcttgagctattcttgcctgaggaatatccaatggctgccccgaaagttaggtttctcaccaaaatttaccatccgaacattgacaagcttggtaggatatgcctcgacattcttaaggacaaatggagtcccgctcttcagatacgtacagttctgctcagcattcaggcacttctgagtgccccaaatccagatgatcctctctcagacaacattgcgaaacactggaaatcaaatgaagctgaagcttttgagacagcgaaggagtggactcgcctgtatgcaagtggggcattgtaaccaagtgttgtttcagatgtgatgttataacatttccatagtttggggccgactgaatacccctcttgcttgatgagagcaaatttgtgaaatgttgcaatggggtcaaaaaaaattgtctaatcgtgctttgtacttgtggctgtacctcctcgctgcagtgcccgtgagcatcaaagcaggtgttcctttgtatacccctatctgaccatcagttgcatgtgtttcttgtgctgtgctctgaggattcagatttatgctgccggaacgttgccggattgttcttagtttgcttctttactcgagagcgctgaaactgcctaggctacctcggcgaaccatggctaaattgttggttcggtggttgtttcgacataatatctcaacactgtctagaggaactccttgagggcttgatcacttaatcccctccttaagccttgttcggttattcccaatacacatggatcggatatgattggaaaaaaataagaaa

SEQ ID NO: 1721 - DNA, 878 bp, Cucumis melo
cagaaccttctttacctccgaagctttcccttcgactcttttataatctagagagagagaggaaacctttcttctctccacaatttctctctcttcctttcctctaaaccctatcgcaacctttccaatccaaccttccaatggccaacagtaatcttccccgaagaatcatcaaggaaactcagcgtctcctcagtgaaccagcccctgggatcagtgcgtcgccatcagaagataacatgcgatattttaacgtcatgattcttggcccgacacagtcaccctatgaaggaggtgttttcaaattggaattatttttacctgaagaatatcctatggctgctcccaaggttcgatttctcacaaagatttatcatccgaatattgacaagcttgggaggatatgccttgatattctgaaagacaaatggagtccagctctacagatacgaactgtacttttgagtattcaagctcttctgagtgctccaaacccagacgatccactttccgagaacattgccaaacattggaaaacgaacgaggcggaagctgttgaaacagcaaaggaatggactcgattatacgcaagtggtgcctaaagggaaagtgcagaaggcttttactcttttcggtttaataacatgaatctaatgtgtctatggtgccatttggtgtggattttaatgaaatatttggaagaatttacagtgtcaaaattgtctctaaaattgtaacgatctctaaaattgcgtctcttttggcaggagtctgtgcccccatactttgtatgatgatatgattagatgaattacattcttctcttaagttctattaaaaaaaaaaaaaaacctagagacacgcaacagggataggac

SEQ ID NO: 1722 - DNA, 872 bp, Momordica charantia
gtgtgtgtgttcatcagaaactcctacctccaagtttcaatcaacactttataatctagagagaggaacccgtctcctctcccatttctctctctgtcttcatttcctctaaaccctatcgcgccttctgcaatccacccacaaatggcgaacagtaatcttccccgaagaatcatcaaggaaactcagcgtctcctcagtgaacctgcccccgggattagtgcctcgccgtcagaagacaacatgcgatattttaacgtgatgattcttggcccgacccagtctccctatgaaggaggagttttcaagttggaactatttttgcccgaagagtatcctatggctgctcccaaggttcgatttctcaccaaaatttatcacccgaatattgataagcttgggaggatatgccttgatattctgaaagacaaatggagtcctgctctacagatacgaactgtacttttgagtattcaagcacttctgagtgctccaaatccagatgatccgctttctgagaacattgcaaagcattggaaaacaaatgaggcagaagccgtcgaaacagcaaaggaatggactcgattatatgcaagtggtgcctaaagggaactgcagaagccttttacttcggtctaaaataacatcaatctaatgtctatgatgccatttgctctgtggatttgaatggaaaatttggaagaatttatagtgtcgaaattgtctctaaaattgtaactgcctctaaaatttgcctcttttggcagaagtctttgcccccatactttgtatgatgattagatggattacattcttcttaagtttttattatctcccatattttatgtcaggacccacaagctccattgaag

SEQ ID NO: 1723 - DNA, 1057 bp, Quercus alba
gcaatataaaaagggcagaaattggtgaaatcgagcccgcttcgtattcgtcttcgtcttcgtcttcgtcctcggcactgtcgtcttaattttgaaaaagtaattgcaatttgcaatagtagtagtaacagcgtgggtctggtctggaaatcaaaagaaaaaaatggccaacagtaatctcccccgaagaatcatcaaggaaactcagcgtcttctaagtgaaccagcaccgggaattagtgcttctccatcagaggacaacatgcgatattttaatgtaatgatcctcggcccaacacagtctccatacgaaggaggagttttcaagttggaactatttttgcctgaagaatatccaatggctgctcctaaggtccgatttctcaccaaaatatatcatcctaacattgacaagcttggaaggatatgccttgatattctgaaagacaaatggagtcctgctcttcaaattcgaactgtacttttgagcattcaagctcttctgagtgctccgaaccctgatgatccactttctgagaacattgcgaagcattggaaaacgaatgaggctgaagctgttgaaacagcaaaggagtggacccgtttatacgcaagtggtgcctgatgacatggtggaaagttttgcttcccctgaataacattaatgaaatgtatgctattgactgtcaattttaaatggaaatttggtacaactgatctttgaacaatcggagtttaatattctcaaagcttccagttgctgtccgttcattgttttcctctcatggaagccttgtgaaacttgtatgataaaatgggccattaagtggcaaactattctatatataatattcatgcctggtaggtttctttagtcaaaattgtttttaagtcattgttaaaagctagtttgctttggcttaccagttggtacaaactcatcagtagttttgaagttgatgctctccagtatcctccaatggtacttgatattttatgtacactgctgtagattttattgaagccattggcttattatgtctgctctctgagagga

SEQ ID NO: 1724 - DNA, 848 bp, Olea europaea
gaaaacaaagaaaagaaatcgtcagcttaggctctccgaacagacaaaaacgaaaaaccctctttgcaaaattcagaatggctaacagcaatttacctcgaagaattatcaaggagactcaacggcttctaagcgaaccagccccaggaataagcgcatccccatcagaagagaatatgcggtatttcaatgtaatgattcttggcccaacacagtctccttacgaaggaggagttttcaagctggaattgtttttacccgaagagtacccaatggctgctcccaaggttcgcttccttaccaaaatttaccatcctaacatcgataagcttggaaggatatgcctagatattcttaaagacaaatggagtcctgctcttcagattcgaactgtacttttgagcattcaagcacttttgagtgctccaaacccagatgatccactctctgaaaacatagcaaagcattggaaaacaaacgaggctgaagccgttgaaacagcgaaagagtggacgcgattatatgcaactggtgcttgaggaggagcttcgtgattccgtaataacaatatgtgtaactcattgactgttgaatgaagatggaaaagatggaagaattagctatgataaaaaatcgaaatttgatgatctactctatgattgttctttgttaaaatgggtattcgaaattgtataatgagatcatatactcctgttacttctctttgatctgttgtgttgatcttctccgttaagaagacaattaaattaagagggcgttttcgtttggaatagagcctaaaacatctgattctactctcattccgcccccttttgggtttttaaatc

SEQ ID NO: 1725 - DNA, 922 bp, Olea europaea
atcgtcagcttaggctctccgaacagacaaaaacgaaaaaccctctttgcaaaattcagaatggctaacagcaatttacctcgaagaattatcaaggagactcaacggcttctaagcgaaccagccccaggaataagcgcatccccatcagaagagaatatgcggtatttcaatgtaatgattcttggcccaacacagtctccttacgaaggaggagttttcaagctggaattgtttttacccgaagagtacccaatggctgctcccaaggttcgcttccttaccaaaatttaccatcctaacatcgataagcttggaaggatatgcctagatattcttaaagacaaatggagtcctgctcttcagattcgaactgtacttttgagcattcaagcacttttgagtgctccaaacccagatgatccactctctgaaaacatagcaaagcattggaaaacaaacgaggctgaagccgttgaaacagcgaaagagtggacgcgattatatgcaactggtgcttgaggaggagcttcgtgattccgtaataacaatatgtgtaactcattgactgttgaatgaagatggaaaagatggaagaattagctatgataaaaaatcgaaatttgatgatctactctatgattgttctttgttaaaatgggtattcgaaattgtataatgagatcatatactcctgttacttctctttgatctgttgtgttgatcttctccgttaagaagacaattaaattaagagggcgttttcgtttggaatagagcctaaaacatctgattctactctcattccgcccctttttgggtttttaaatcttatgttcattggaaacaagtactattttgtttgtatcatgttttgtgggggtgttcccaaaccaacaggttatgagttgatcaaaatttt

SEQ ID NO: 1726 - DNA, 749 bp, Olea europaea
agaagaagtccatccgattcaacaaggaaggcccttttattagcgtagactctccgacagagaggagagaaaaaaaacattagcaaaattcaattcgatggccaacagcaatttaccccggagaatcatcaaggagactcagcgtcttctcagcgaaccagcacctgggataagtgcatctccatcggaagacaatatgcggtatttcaatgtaatgattcttggtccaacacagtctccctatgaaggaggtgttttcaagctggaattatttttgccagaagagtacccgatggctgctcccaaggtccggttcctcaccaaaatataccaccctaacattgataagcttggaaggatatgccttgatattcttaaagacaagtggagtcctgctcttcagattcgaacagttcttttgagcattcaagcacttttgagcgctccaaatccagatgatccactctctgaaaacattgctaagcactggaaaacaaatgaggccgaagctgtagaaacagcaaaagaatggacacgtttatatgcaagcggtgcatgaagtacatggaactcgtggctttgatataacaaaaacatgtatttgattgatggaaatatctaaaactttgatggaattgatgatgctcaaactaatgggaattcaaattaatgctctcaaaggctataaatttatttcctgctttcgaactatgtaattgaaattctataatgagcccggatactcttgt

SEQ ID NO: 1727 - DNA, 874 bp, Olea europaea
atccgattcaacaaggaaggcccttttattagcgtagactctccgacagaaaggagagaaaaataacattagcaaaattcaattcgatggccaacagcaatttaccccggagaatcatcaaggagactcagcgtcttctcagcgaaccagcacctgggataagtgcatctccatcggaagacaatatgcggtatttcaatgtaatgattcttggtccaacacagtctccctatgaaggaggtgttttcaagctggaattatttttgccagaagagtacccgatggctgctcccaaggtccggttcctcaccaaaatataccaccctaacattgataagcttggaaggatatgccttgatattcttaaagacaagtggagtcctgctcttcagattcgaacagttcttttgagcattcaagcacttttgagcgctccaaatccagacgatccactctctgaaaacattgctaagcactggaaaacaaatgaggccgaagctgtagaaacagcaaaagaatggacacgtttatatgcaagcggtgcatgaagtacatggaactcgtggctttgatataacaaaaacatgtatttgattgatggaaatatctaaaactttgatggaattgatgatgctcaaactaatgggaattcaaattaatgctctcaaaggctataaatttatttcctgctttcgaactatgtaattgaaattctataatgagcccggatactcttgtgttttttgttcttctttgctcgattttaccttgaaattggcaaatttgttgtttagatgaatttgacttagtttacaattattagcagtaatgtgtgtggaaaaatacggtttggttggttgtaaatttcaaattt

SEQ ID NO: 1728 - DNA, 1424 bp, Citrus sinensis
cactgttttaacttttgtttatgcatatttttggggttttcattgaagctcaatcttctttccactatttactgacttgactaccggaatgttgttgttgatgatgtctctaatggctacccttctttttataggctctagatagtctttcttcctaaatcttcctgagaaaatcagaggaatcatttgcaataacaattttggaagataatatggtgaagatctagaagggacaaaaatgtaaaatcaacttcccaaaaaagactagtattgtttcgcataaataaataattaaaattaaaattaagttaaaaaaaaaaaacaactttgatccatcatttcacttaaacttcttgtattctatttgctattctgttagacttagaaaaccctatcagcgttctttctctgcaacaacaagaaggttaaaaaacaaaaaaaaatcgatcttggaaatggcgaacagtaatctccctcgacgtatcatcaaggaaacacagcgtctcctcagtgaaccagcaccaggaataagtgcatctccctcggaagataatatgcgatactttaatgtgatgatccttggtccaacacaatctccatatgaaggaggggtgttcaaattggaattatttttgcctgaagaatatccaatggctgctccaaaggtccgatttcttaccaagatatatcatcctaacattgataagcttggaaggatttgtcttgatattctgaaagacaagtggagtccagctctccagattcggactgtacttttgagcattcaagcacttctgagtgctcctaaccccgatgatcctctctccgagaacattgccaaacactggaaaacaaatgaggccgaagcagttgaaacagcgaaggaatggacacgtttatatgccagtggtgcttgatgacatggtggaaaatatcacttcattcaaataacaattgtgcaatgtatgctattcactgtctgtttaaaatggaaaatttggaagaattgaattgatgtttgaacattcggagtttgacattctgaaagcttccatcttaccgcacatgtcaattattttcttcttgtggaagccatgtctttgaacttgtatgattagatgatatacattgtttctcaactcttaaatttcgaagcaatgtttattgtctgctatagtagtaatctggaaataccgattattatcaggaaaccttgacttcagttggcatcagtatggggaaaaaacttgcgttgagctaggagggtccaaaggttcgctgccattgatatttttagtattagatttagtgagtttcatactgttggtcccagaataggatccacagaattattgggctatcctttgttctaccacttcagcatagtttcgcacaagtagtcttgtgctgtgtttactcttggg

SEQ ID NO: 1729 - DNA, 868 bp, Orobanche aegyptiaca
ttctggtatgagtgaccttatacaggtaactcaacactacctatggagtataatcttttgtttactttttcattcgtaattaaaattttccacgattgaacacttttccatttcgtacaaaagaagaaaaaaatccccttgttagcgtaaactctccgagggaagaaaacgaagcttgcaaattcaatccgatggccaacagcaatttaccgcggagaatcatcaaggagacccaacgtcttctcagtgaaccagctccgggaataagtgcatctccctcagaagagaatatgcggtactttaatgtaatgattcttggtccaacacagtctccttatgaaggaggcgtctttaagcttgagttatttttacctgaagaatacccaatggctgctccgaaggttcgcttcctcacaaaaatttaccacccaaacattgataagcttggaaggatatgcctagatattcttaaggacaaatggagtccagcacttcagattagaactgtacttttgagcattcaagcacttctgagcgctcctaatcctgatgatccactgtctgaaaatattgccaagcattggaaaacaaatgaggctgaagctgttcaaacagctaaagaatggacacgtttatatgcaagtggtgcttgaagtgcatggtacccagagaatagaactaaatatatttgtatcttgttgatcattgaatgattacggaaaaattggaagaaagattgtggtgacggttataatatctgttctcctaagagtctgcctttactacattgttcattgctttgaattgttgctcaaatgtataatgagataagatacattttttacgtgtgtctggtgattttgtttga

SEQ ID NO: 1730 - DNA, 878 bp, Carica papaya
aaaagcctctccctctccccccctctccctctctctctctctctctctcttaaaaaccctaacttcccgttgtctgcaatcaatctcactcaacaatggcaaacagtaatctccctcgaagaatcatcaaggaaactcaacgtctcctcagtgagccggcaccgggaataagtgcttctccatcagaggacaacatgcgatattttaatgtcatgatacttggtcctacacaatcaccatatgaaggtggggttttcaaattggaactcttcttgcctgaggaatatcctatggctgctcccaaggttcgatttttgaccaagatatatcatcctaacattgataagcttggaaggatatgcctggatattctgaaagacaagtggagcccagcactccagatacggactgtgcttttgagtattcaagcgcttttaagtgctccaaacccagatgatccactgtctgagaacattgctaagcactggaagacgaatgaggcagaggctgttgaaacagcaaaggaatggacccgtttatatgcaagtggcgcgtgataacttggttggaactcttgtctttacaaacatttcaagcaatgtattgtattccatgtggatttcaaatgcaaagtagaagaatgttgaaacagaattttattttcaaaagcttccggtttaccgcctgttaattgttttcttctcttggaagtcttgtcattgaatactatgattagatgagacaagttgttccgtatagttcagtgctaaacggaatattctaaaaccatatagtaactatggaatttgtgaaaccatggtgtgaatgttgtgaataagttttgttttttggtggtataatgtgaataagttagtatc

SEQ ID NO: 1731 - DNA, 665 bp, Parthenium argentatum
atctcaaataccccaaaatccttagcgtaaaccttccttccgagtctcgatggccaacagcaatcttcctcgaagaattatcaaggaaactcagcggttactgagtgaaccagctccggggataagcgcgtcgccttcggaagataatatgcggtattttaatgtcatgatccttggtccaacacagtctccttatgaaggaggagtttttaaactggagttatttttgccagaagaatatcctatggctgctcccaaggttcggtttcttacaaaaatctaccatccaaacattgacaagcttggtaggatttgtcttgatattctcaaagacaagtggagccctgctcttcagattcgcactgtaatcctgagcattcaagctcttttgagtgctccgaatccagatgatccactctcagagaacatagcaaagcactggaaatctaatgaagctgaagctgttgaaacagcaaaagagtggacccgtttgtatgccagtggcgcctaacggagattggtcatcatgttgttcggagaaaataacaatgtatttggttaggccttgaaattcaaaacttgaatgctgcaatgttgttcaatttcttgtgttattcgagataatattgtaattctggttaactatgtgaaagaatagtgtgggt

SEQ ID NO: 1732 - DNA, 762 bp, Capsicum annuum
aaactctacccccgaagaacccaaaaggcttttctccaatttcaatggctaacagcaatcttcctcgaagaattatcaaggaaactcaacgtcttcttagcgaacctgcgcctgggataagtgcgtcgccatcggaagacaatatgcgatactttaatgtcatgattcttggtccaacacagtctccttatgaaggaggtgtcttcaagctcgaactatttttgcctgaagagtacccaatggctgctcctaaggttcgattcctcaccaaaatctaccatccgaacattgataagcttggtaggatatgtcttgacattcttaaagacaagtggagtcctgctcttcagatccgtactgtacttttgagcattcaagcacttttgagtgctccaaatccagatgatccactctctgaaaacatcgcaaagcactggaaggcaaatgaggctgaagctgttgaaacggctaaggagtggacgcgtctatatgctagtggtgcatgaagagatagcaatgaaatattcaaatataacaaaaatcatggaatgtaatctactattgactggcttatcaatatgatactcggatggctgttaatggctgaactcttccaattacctccccataattgcttccatccttgaaattgtataacataatgtgacaccctttggttttctaatgttcaggaatgaacttgttacaacaaaactggatatgtttaggattttgtcactgcaacagcagttaaatgattca

SEQ ID NO: 1733 - DNA, 1008 bp, Lippia dulcis
taaaaaggagcaccatcgaaatcgaaatctcccaccatcgatcgaattcttccccatttcccagtgagagaaaacgacgacaaagaaatcccttttgttagcgtaaactctccgactaactttgctcggaggagaacaccaattcaatcccatggccaacagcaatttgccgcggagaatcatcaaggagacccagcggcttctgagcgaaccagctccagggataagcgcatctccctcagaagagaatatgcggtatttcaatgtcatgattcttggtccaacacagtctccttatgaaggtggtgtttttaagctggagttatttttaccagaagaataccccatggctgctcccaaggttcgcttcctcacaaaaatttaccatccaaacattgataagcttggaaggatatgcctcgatattcttaaggacaaatggagtccagcacttcagattagaactgtacttttgagcattcaagcacttttgagtgctccaaatccagatgacccactctctgaaaacattgccaaacattggaaagctaatgaggttgaagctgttgaaacagccaaagaatggacgcgtttgtatgcaagtggtgcatgaagtacacccaagatttaagaaataactaaaaaaatgtatcttattgaccatcaaatgttaatctggaagagtgattatgctcataactgttggagttttctgccctaaagtgtcggccatgactacttattccctgtcttgtgttgaaattgtataatcagttaagatactgtttgtattgaagttcatccatgattctgttaaacaatctacgctcatcatactgcggcaagttgatcctagatgatcgccggctggttcatcttttcaagaggtttgtgggaaagcaccgtttggaagcttaattttgtttagatgacattgatactgattttttctgaggcttattttaggtttatcttatgaactgttaaattatacaccaatagaaaggg

SEQ ID NO: 1734 - DNA, 761 bp, Lippia dulcis
ctcatttttctagtgagagaaagagaaaaacccttttgttagcgtaaactctccgactagaggaaccgagggaaggaaaaaagctttgcaaattcaatggctaacagcaatttaccgcggagaatcatcaaggagacgcagcgtcttctgagcgaaccagctcctggaataagtgcatctccttcagaagacaatatgcggtatttcaatgttatgattcttggcccaacacagtctccttatgaaggaggtgtttttaagctggagttgtttttacccgaggagtaccccatggctgccccaaaggttcgcttcctcactaaaatttaccaccctaacattgataagcttggaaggatttgcttagatattctgaaagacaaatggagccccgctcttcagattagaactgtacttctaagtattcaagctcttctgagtgccccgaatcctgatgatccactatctgaaaacattgcgaagcattggaaatcaaatgaggttgaagctgtggaaacagctaaagagtggacgcgtttgtatgcaagtggtgcatgaatttcatgaaaacctcggttcccctttaataactaaaattgtattttaccaatcgtgaaacatttgtaagaatgacgatgctcaaaaccgttggagtttacttactgtttgtttagggatttggcattgcatcttttatatgtaattgttccatgttttaaacaagttgttcaaaatgtgcaattataagtaaggcccttttt

SEQ ID NO: 1735 - DNA, 1044 bp, Cajanus cajan
gaaaaaaaatcatataaatagcagcgatggatagaggattttcattgagctttgttctggtttatgttagtgagagaaagttctatttctctctctttgactcaaaaccctattgcgtgctttgcaatcgaccctgattatggccaacagtaacctccctcgaagaatcatcaaggaaacgcagcgtttgctcagtgagccagcgcctggaattagtgcgtccccttcagaagataatatgcggtatttcaatgtgatgatcctgggcccaacccagtcaccttatgaaggaggagttttcaagttagaattatttttgccagaagaatatccaatggctgcaccaaaggttaggtttctgacaaaaatatatcatccaaacattgacaagcttggcaggatatgtcttgacattctgaaagataagtggagtcctgcccttcagattcgcactgtacttttaagtattcaagctcttctaagtgcaccaaacccagacgatcctctttctgagaacattgccaagcattggaaaagtaatgaggctgaggctgttgaaacggccaaggaatggacccggttatatgctagtgacgcctgatgcttgggttgaaagtttggcttcaaataactatagtggaactgtatgctatatataactcaacttgaaatagaaatttggaggagttgtctgaactattttggagttaatattcctcatagcttccggttacctgttaattgctttctttctcctggaagccttgtcttggaacttgtattaaaatatgtgatcttttatgccagaaatttaaacatgcttcatctcccaaccccctagtaatttgggatcctcaaactccatagtaaaaagattttgaataagcttatattggtttgtctccttttccatcaatccatacgtgtttgatacgtttggttgtgtaattaagaacttgagggatagacacttgtctcctgaggattgagaagatgaatagttgcaagaaattagataaaattttcaatcgatgattttaaata

SEQ ID NO: 1736 - DNA, 784 bp, Plantago ovata
caaattcacttcgatggctaacagcaatttaccgcgaaggataatcaaggagactcagcgtcttctaagcgaaccagcacctggaataagtgcttctccatcagaggacaacatgaggtacttcaatgtcatgattcttggccccacacaatctccttatgaaggaggtgtatttaagctggaattgtttttgcccgaggaatacccaatggctgcccctaaggtgcgatttctcacaaagatctaccatcccaacatcgataagcttggaagaatatgtcttgatatccttaaagacaagtggagtccagctcttcaaatcagaactgtacttttgagcattcaggcactattaagtgctccaaaccctgatgatccactttcggaaaacattgctaagcactggaagacaaatgaagctgaagctgttgaaacagctaaagagtggacgcgtttatatgcaagtggcgcatgatgtatgtcatccaactggggtttcatgaaataactagaagtgtattatcaaatgtcaatgaatatgaaaaggatttcaaactatgatgttctaaaaaggttggaattttactgacctgggaatcgaatcgatattgttagtcggagactttgtttcctgcacaacattgatgaagtgttatgatttgttcttgattctccgtgttattttgtcacctgttgatatacatatttgcacttactattttgcttccgacataccctgtgtactccctgatttgtgtcttgcaattatatgttgattcttcct

SEQ ID NO: 1737 - DNA, 1039 bp, Papaver somniferum
ctctttctctctctccctctctccctagattcgtctgtgtatctctctcgcgaaatcttaacttgtaaactatggcgaacagcaatcttccaagaaggattatcaaggaaacgcagcggctccttagcgaacctgctcctggaataagtgcttctccgtccgaagaaaacatgcggtatttcaacgtcatgatcttgggaccaacacaatctccttatgagggaggtgtattcaagttggaactgtttttacctgaagagtatccaatggctgcaccaaaggttcggtttctcacaaagatttaccatcctaacattgacaagcttggaaggatatgccttgatattctaaaagacaaatggagtccagctctccagatccgaacagtattgctgagcatccaagcacttcttagtgctccaaatccagatgacccgctctctgaaaatattgccaaacactggaaagcaaatgaggcagaggctgtcgaaacagcaaaggaatggacaaacctatatgccagtggagcttgatggaattagtatagcgtgttgaccaccagccagataacattttctgtaatggtgtaagcctagatgatgtccagtttgttttctaaatggaaattaaagcattgatgtcttaatgttggaagatattccatttacagaaatgttcatgtgttcaagcagttaaatcgtttttgttctcttggaaaagaaaagcgtgttcttatatgtatgttggacgaggatcatctcagactctttatctcatagtcatctaccattcgatattgtataaaaagaaccataagtattatttcatgtatttggatattaccagcctcactgtgagtgttaaaacttcacccgcactgacccttgtcgaggtcgaacgcttatgtgacggtttaacagtctccctttcttgctgttgatgtgagattgtgagtcgtaaatttatatcagagcatctccatctagtttttgtttttctttatataagaaaaactattaagttttaaaaaaaaaaaaaa

SEQ ID NO: 1738 - DNA, 765 bp, Papaver somniferum
gccttctctcttacaaaacagagagagaccgaacctactcacagctcctctgtaactgctctctctagctgttcaatttctctaaaaatggcgaatagtaatctaccacgacgtattattaaggaaactcagcggctactcagtgaaccagctcctggaattagtgcttctccttcagaagataacatgagatattttaatgttatgattcttggtccaacacagtctccctatgaaggtggggtttttaaattggaactatttctgcctgaagaatatccaatggctgcgcctaaggtccgctttctaactaaaatttaccatcccaacatcgacaagcttggaagaatatgtcttgatatcctgaaagacaaatggagccctgccctccagattcgtactgtgctactaagtattcaagcacttcttagtgctccaaacccagatgatcctctttctgaaaacattgccaagcactggaaggcaaatgaggcagaggcagttgaaacagccaaagaatggactaggctatatgcctctggtgcatgacaatatggcaacatggagttattggatttggagtgttggtggctgttataagagaataacgtataatgcaatgtaattcggatggttgataattcccaacaacaaaaaaaaagtatatcagatgcttgttcccaaatattgaaacaaagaagtttacccccaattaaccgaaaagatcaaatatcacaattcaattagatatgtaatgaatttaga

SEQ ID NO: 1739 - DNA, 840 bp, Prunus persica
agagaaagaaagaaacccaacgcgttctctctctctctctctctcctcccttctctctctctctcgcaaaaaccctcattgcgtagcctgcaatcgactttcgaatggccaacagtaaccttccccggagaatcatcaaggaaactcaacgtctcctcagtgagcctgcaccgggaattagcgcttcaccatcggaagacaatatgcgatatttcaatgtgatgatccttggcccaacacaatctccttatgaaggaggagttttcaagttggaactatttttgccagaagaatatccaatggctgctccaaaggttcgatttctcaccaaaatttatcatcctaacattgacaagctgggaaggatatgccttgacattttgaaagacaaatggagtcctgctctccagatacgaactgtacttttgagtattcaggcacttttgagtgctccaaaccccgacgatccgctctctgagaacatcgccaaacattggaaatcgaatgaggctgaagcggttgaaacagcaaaggaatggacccgtttatatgcaagtggtgtgtgatggcatggtgcaagtttatcattccctcaaataacattgttgcaatgtatggtattcactgtcattttagatgaaagaattggaaagaattgatgtttgaaatattggagtttaatgttctcaagctaccatttattgcctgataattgtttcatctcttggaagcttgtgatgaagatacatttatcttcggtctcaagtgtcggctggggattattataggcacacaaaatatggatttctggtaatcgatagtgtgaataattctttacca

SEQ ID NO: 1740 - DNA, 761 bp, Rosa hybrid cultivar
ggagaaagtaaactccggaaaggaaagaaaagaaacgcaccgctctctctctctgaaaaaccctcattgcgtagtctgcaatcgaccttggaatggcgaacagtaaccttccccggaggatcatcaaggaaactcagcgtctcctcagtgaacctgctccgggaattagtgcttcgccatcggaagacaatatgcggtatttcaatgtgatgatccttggcccgactcaatctccgtatgaaggaggagttttcaagttggaactatttttgcctgaagaatatcctatggctgcaccaaaggttcggtttctcactaaaatttatcatcctaacattgacaagctgggaaggatatgccttgacattttgaaagacaagtggagtcctgctctacagatacgaactgttcttctcagtattcaagcacttttgagtgctccaaatcccgatgatccgctctctgagaacatcgctaagcattggaaatcaaatgaggcggaagctgttgaaacagccaaggaatggacccgtttatatgcaagtggtgtgtgatgacatggtggaagtaccagaaataaccttattgcaatgtatgctattcaatgtcattgttacatgaaatttggaagaattgatgtttcaaatattttaaaattctcaagcaattacaggctgataagtgttctcatctcatagttctgttggctctgaacctgtaagatcagccaagatacttttatctccccgtctcaaaatgat

SEQ ID NO: 1741 - DNA, 804 bp, Silene vulgaris
gaaactcctttccactttctccatcttctctttgctttctaaatcctgatctcacattggtttaactttctcaatcacattaatggctaacagcaatctccctcgaaggatcatcaaggagacccaacgtcttcttagtgaaccagctcctgggattagtgcatcaccatcagaagaaaatatgcgatattttaatgttatgattctcggcccgtctcaatctccgtatgaagggggtgttttcaagttggagttgtttttaccagaagaataccctatggcacctccaaaggttcggttccttaccaagatttaccatcctaacattgacaagcttggaagaatatgcttagacattcttaaagataaatggagcccagctctccagatccggactgtcttgttaagcatccaagctctattgagtgcccccaacccagatgatcccctgtctgagaacgttgcaaagcattggaaaagtaacgaagtcgaagctgtggaaacagcaaaggaatggacgcgctcatatgcgacaggtgcttaacagacagatctgatcgcttcagttggttctctgctttgtatgttgaaactaaaaatgatgccacccattttctaatggacatgggaaggaaaacatgtgacagtgggattttatccaaaaatgcctgcaattgctggttgtagtagttttccttatgattatcgtagttttcccgatgattctcataacagtcataaaacaacttctttaatcttgtactatccattcactactgtaacgcttatttaaaaaaaaaaact

SEQ ID NO: 1742 - DNA, 761 bp, Silene vulgaris
aactacgaagtatacctgtagtaactacggagggagagagaatcagagaagtcgtcttcaaattagccacactagattttctctaattcttctcgcaaagctcacaccaagtccatccatggcgaacagcaatcttcctcgccgaatcatcaaggaaactcagcgccttttgagcgagccagctccggggataagtgcatctccgtcagaggaaaatatgcgttacttcaatgtaatgatccttggcccatctcaatctccttatgaaggaggagttttcaagttggaattatttttgcccgaggagtatccaatggctgctcctaaggttcgctttctcacgaaaatttatcatcccaatattgacaagcttggacgcatatgcctggatatactcaaagataaatggagtcctgctctccagatacgaactgtactcttgagtattcaagccttgttaagtgctccgaatcccgacgaccctctatcggagaacgttgctaagcactggaaaacagatgaggctgaagctgttgaaactgcaaaagaatggactcagttatatgcgagcggtgcgtgatccacggggaaaagcacaaccctgtgcaaataacaattgtgtaatgtttatcaactgttaattctgaaattgaccttcggggtaagaaattgaatctaaagcgataatctgagatattatgatcaatttgtgagtatgagatggattcagcatcttgttgtctgtttcactgttctttaca

SEQ ID NO: 1743 - DNA, 1120 bp, Sorghum bicolor
gcgattaatcacgatcgttgaggtaacgtgatagcgctgagataaaacccaaagcacaggacgcaggtagaccactgcagcaaaaaccgcgtccgcgtacaatagcgagcgtccaactccaacccaccaccgcttcccccgttccccaccccgaccgactgctcctcctcccccgcgccatcctcaaggcatcgccggcgccgcaacttcgccgaggaggaagcccgcaccccggccccgatccgatggccaacagcaacctcccgcggcggatcatcaaggagacgcagcggctgctcagcgagccagcaccggggatcagcgcgtcgccctcggaggagaacatgcgctacttcaacgttatgatccttgggccggcgcagtcgccctatgaagggggagtttttaagcttgaactctttttacccgaggaatatccaatggctgccccaaaggttaggtttctgaccaagatttatcatcccaacattgacaagcttggtaggatatgcctcgacattctcaaggacaaatggagcccggcacttcagattcgcacggttcttttgagtatacaggctctcctgagtgcgccaaatccagatgaccctctttccgataacattgcaaagcactggaaagccaatgaggtagaagctgttgaaacagccaaggagtggactcgcctgtatgcgagcggtgcatgagaacctggttctgttcttgatgtaataacccgtcatacttcagtcctaatctattgccatttgcttgataaaaacagactggagatatttgccatggaaggaagtctctaaatgactaccactctgaattgtttggttgtacaactatggtcggttccctttacctttgggcacctttgactaatcagtatctgtggtagaacttgctgttactttaatatatttgtcacttcatgtagaagagtttctcaactgtccatagtgttgaaactgaggctggttagcttggttgcacttttgttgtaccttttttttctttgcctgtcaatcgtcgatcggttttcttagaatgcgaaatgctaaaactttgctgcgaggtgcttccctataagtgatcaaaggttggttttatc

SEQ ID NO: 1744 - DNA, 873 bp, Glycine max
atcacaagttatgtgatatttagtcttaattttattttttttcagcaagcaaaaattatataaacaacggcgagagataatggattttcattgagctttctttctttttgtgttagtgagagaaagttctctctctttgactcacaaccctattgcgtgctttgcaatcgaccccgcttatggccaacagtaacctccctcgaagaatcatcaaggaaacgcagcgtttgctcagtgagccagcgcctggaattagtgcgtccccttcggaggacaatatgcggtatttcaatgtgatgatccttggcccgactcagtcgccatatgaagggggagttttcaagttggaattatttttgccagaagaatatccaatggctgctccaaaggttaggtttctgacaaaaatatatcatccgaacattgataagcttggcaggatatgtcttgacattctgaaagataagtggagtcctgcccttgggattcgcactgtacttttgagtattcaagctcttctaagtgcacctaacccagatgatccactttctgagaacattgccaagcattggaaatctaatgaggccgaggctgttgaaacagccaaggaatggacccggttatatgctagtggcgcttgatgctttgggggaaacttttggcttcaaatatctatagtggacgtgtatgctgtataactgtcaaattgaaatggaaatttggaggaattgtctaaactattttggagtaaatattccccgtagcttccgggtacctgttaattactttctttctcctggaagcctgatcttggaacttgtatgaaaaacatgtgatcttttctgtgacaaatttaaacatgcttcatctccc

SEQ ID NO: 1745 - DNA, 1251 bp, Glycine max
atcacaagttatgtgatatttagtcttaattttattttttttcagcaagcaaaaattatataaacaacggcgagagataatggattttcattgagctttctttctttttgtgttagtgagagaaagttctctctctttgactcacaaccctattgcgtgctttgcaatcgaccccgcttatggccaacagtaacctccctcgaagaatcatcaaggaaacgcagcgtttgctcagtgagccagcgcctggaattagtgcgtccccttcggaggacaatatgcggtatttcaatgtgatgatccttggcccgactcagtcgccatatgaagggggagttttcaagttggaattatttttgccagaagaatatccaatggctgctccaaaggttaggtttctgacaaaaatatatcatccgaacattgataagcttggcaggatatgtcttgacattctgaaagataagtggagtcctgcccttgggattcgcactgtacttttgagtattcaagctcttctaagtgcacctaacccagatgatccactttctgagaacattgccaagcattggaaatctaatgaggccgaggctgttgaaacagccaaggaatggacccggttatatgctagtggcgcttgatgctttgggggaaacttttggcttcaaatatctatagtggacgtgtatgctgtataactgtcaaattgaaatggaaatttggaggaattgtctaaactattttggagtaaatattccccgtagcttccgggtacctgttaattactttctttctcctggaagcctgatcttggaacttgtatgaaaaacatgtgatcttttctgtgacaaatttaaacatgcttcatctcccaactcctgagtaatttgggatcctcaaacttaatagtaaaaaatttcgaataagcttctgttggtttgtgtccttttccatgaatccatagatatgtttggttgtgtaaaatcaagagcataatgcaggcatttgtccaaccaggaatagatcttctcatgaaaatagaaaatacattagttttaggtttaattagtgttaggtatgtcggggtctctctttgtcactgcaaagttttgatatatcctagggtttggtaaataaaggttagggttggtagacttgagcatatggacccaaatgtctttttatgtattcaccttttttatttatatatgtttggactctattttgagtctggcgtagcatctccttttt

SEQ ID NO: 1746 - DNA, 1192 bp, Fragaria vesca
ggaaaattattctccaagtctaaaagtgcctctcgaccccaaaaatcgagaattgcatatatgctttattttgtgtaatagcgaaaacgcaccgttctctctctcttctctctctgcaaaaccctcattgcgtagtctgcaatcgaccttggaatggcgaacagtaaccttccccggcggatcatcaaggaaactcagcgtcttcttagtgaacccgctcctgggattagtgcttcaccgtcggaagataacatgcgctatttcaatgtgatgatccttggccccactcagtctccttatgaaggtggagttttcaagttggaactatttttacctgaagaatatccaatggctgctcctaaggttcggtttctcactaaaatttaccatcctaacatagacaagctgggaaggatatgccttgacattttgaaagacaagtggagtcctgctctccagatacgaactgttcttctaagtattcaagcacttttgagtgctccaaatcccgatgatccactctcggagaacattgctaagcattggaaatcaaatgaggcggaagctgttgaaacagccaaggaatggacccgtttatatgcaagtggtgtgtgatgacatggtgaaagttatccttcccacaaataaccttattgcaatgtatgctattcaatgtcattgtcacatgaaaatttggaagaattgatgtttcaaaatattttaaattctcgagcaattacaggctgataagtgttctcatctgatagttctgttggctctgaacttgtaagatcagctaaggtacttttatctcccccgtttcaaaatgacgggggagataaaatatggtattaagtgaacactgagaataattgccggttaatttccttttcttgacttttaaatgtaattatttgatttgaagaaacctctcaatgtgtgtaattcctatgcaactgcttcaccagatcaaataccgatagtggtggagctcatggcattaaaagacaccatgagtacaaagcagcatcttctttcagttcattaatttaggagcttacttctgtgtatgattttgcagaggacctaatatatacctagctataccctaagccatgtttacaatatgagcagtcatgtttgaactacaacctttgtaacctgttggccttcaaatctcaaatgactgatc

SEQ ID NO: 1747 - DNA, 1056 bp, Saccharum officinarum
caaaaaccgcgtccgcgtacaatagcgagcgtctccaacccaccaccgcttcccccgttccccaccccgaccgactgctcctcctcccccgcgccatcctcaaggcatcgccggcgccgcaacttcgctgaggaacccagcaccccggccccgatccgatggccaacagcaacctcccgcggcggatcatcaaggagacgcagcggctgctcagcgagccagcaccggggatcagcgcgtcgccgtcggaggagaacatgcgctacttcaacgttatgatccttgggccggcgcagtcgccctatgaaggtggagtttttaagcttgaactctttttacctgaggaatatccaatggctgccccaaaggttaggtttctgaccaagatttatcatcccaacattgacaagcttggtaggatatgccttgacattctcaaggacaaatggagcccagcacttcagattcgaacagttcttttgagtatacaggctctcctgagtgcgccaaatccagatgaccctctttccgataacattgcaaagcactggaaagccaatgaggtagaagctgttgaaacagccaaggagtggactcgcctgtatgcgagcggtgcatgagaacccggttctgttcttgatgtaataacccgtcatacttcagtcctaatctattgccatttgcttgatataaaaacagactggagatatttgccatggaaggaagtctctaaatgactaccactctgaattgtttggttgtacacctgtggtcggttccctttacctttgggcacctttgactaatcagtatctgtggtagaacttgctgtcactctaatatatttgttacttcatgtagaagagtttctcaactgtccatagcgttgaaactgaggctggttagcttggttgcacttgttgtaccttttttctttgcctgtcgatcgtcgattgttgtctgagaatgcaaattgctgtgaaactatggtcgcacctgatcacctttgctgcgaggtgctttcctataagtgatcagaggttggttttatcaccc

SEQ ID NO: 1748 - DNA, 961 bp, Helianthus annuus
tacaatcgaattcatcatttcccccaaactttcttctctttctctctctaaaatccccgtagcgtgaatcctaagcttccatccatggcgaacagcaacctacctcgaagaatcatcaaggaaacgcagcgattgctcagcgaaccagctcctggaataagcgcatcgccgtcagaagataatatgcggtattttaatgtgatgattcttggccctacacagtctccttatgaaggaggtgtgttcaagctggagctatttctgcctgaggaatatccaatgtctgcccccaaggtccggttccttacaaaaatataccacccgaatatcgataagcttggcagaatatgtcttgatattcttaaagataaatggagccctgctcttcagatccgtacagtgctcttgagcattcaagcacttttaagtgctccgaacccagatgacccgctctctgagaacatagcaaagcattggaaatcaaatgaagcagaagccgttgaaacagcaaaggaatggactcgtttgtatgcaagtggcgcatgatggacatacaaaaccaccgaaaaataacaagtgtattatctatctagtacaacatattccatatcctgattatactccatttcgccatccttttggtcccaatatatgatgtgtcctttatttttattatgaatttagtgatggaagagtcaatgaagcacttttcaaggttttgtcatatactacttttttctttagttatggggaccaatcaataattgcatgttcattcgaaatggacggttcggttcgctaacatgtattcgattcctgttatactcccgtttattattgagagaggttatttgtgccccatgttaacggtcacatgtctgactgttttggctcattctgtgaggtaattcaaactcttgtcaatgatgaaaaagcagacagaatatgttattaaaaccca

SEQ ID NO: 1749 - DNA, 834 bp, Panicum virgatum
gctggctgcgcattcggcctccccgacccacgatttctccttcctttgacccccatcgtctcgtctcgtctcgtctcgtcttcctccgtcgccgcacgaagcttgaggcaatccaccccgcttccaacgcccgcgccgcctagccctgcgctccccagcccggcaccatggccaacagcaacctcccgcgccgaatcatcaaggagacgcagcggctcctcagcgaaccagcgccagggattagcgcgtcgccgtcggaggagaacatgcggtacttcaatgtcatgatccttggccccgcgcagtcaccctatgaagggggagttttcaagcttgaactattcttgcctgaggaatatcctatggctgccccaaaagttagatttctcaccaaaatttatcaccccaacattgacaagcttggtaggatatgccttgacattcttaaggacaaatggagtccggctcttcagatacgtactgttctgttgagcatccaggcactgctgagcgcaccaaatccggacgatcccctctcagacaacattgcaaaacactggaaagcaaatgaagctgaagctgtcgagacagcgaaggagtggactcacctgtatgcaagtggggcatgacaaccaagggttgtttactttgtaataacagtcatagtttgatcacgattgaatatcacctgcttaagagcaaattgcaatgttttgcaatattgggggaaaatgatcgaaccgtaacagttcgaactatgctttgtacttgtgtgtcccttcagtgcagtaagcatcaaagctggtgttgcttggtctgattcaatttgctgtt

SEQ ID NO: 1750 - DNA, 821 bp, Thalictrum flavum
ctaattctctctctttctcgattcatcatctacactttaaatggcgaacaacaatttacctagaaggatcatcaaggaaacacagcggcttctcagcgaacctgctccaggaattagtgcttcaccttctgaagaaaatatgagatatttcaaagttatgattctcggacctactcagtctccatatgaaggtggagttttcaagttggaattgtttttgcctgaagaatatccaatggctgcacccaaggttcgatttctcactaagatctaccatcctaacattgacaagcttggaaggatatgccttgatatcttgaaggataaatggagccccgctcttcagattcgaactgtgttactgagcatccaagcacttctgagtgcaccaaacccagatgatccactctccgagaatattgctaagcactggaaatcaaatgaggctgaagctgttgaaacagcaaaggaatggactcgtctgtatgcaagtggcgcatgacagctggaagactattctcacagataaagtttctgttgcataagtcattatatatctgatgttagttctggcatggttaaaaaaattgatgtctgcactatcaaaggataaattctcatactagttttttgtgatctattagtctctttggacagtccatttggcctgttcaggacagtgtacaattagataaagtctacatattctgtatcttacatatagttgttacttgtggatgaagcataagtttctgtatactttgtttttgtgtgtgtggcaacctcaataagcttagtagttcgtgacttcgtggaacctg

SEQ ID NO: 1751 - DNA, 1166 bp, Solanum lycopersicum
gttgtcaaattctcacaaaactattctccacttgctcccttttctctctctagaaaagaagaacccttagcgtaaactctgcgaaccccaaaaaggctttcaattcaatggctaacagcaatcttcctcgaagaattatcaaggaaactcaacgtcttctcagcgaaccagcgcctgggataagtgcgtcgccgtcggaagacaatatgcgatactttaatgtcatgatacttggtccaacacagtctccttatgaaggaggtgtcttcaagctcgaactatttttacctgaagagtacccaatggctgctcctaaggttcgattcctcaccaaaatctaccatccgaacatcgataagcttggaaggatatgtcttgatattcttaaagacaaatggagtcctgctcttcagatccgtactgtacttttgagcattcaagcacttttgagtgctccaaatccagatgatccactctctgaaaacattgctaagcactggaagtcaaatgaggttgaagctgttgaaacggctaaggagtggacacgcctatatgctagtggtgcatgaagatatagcaacgaaatgttcaaaataacaaaaatcatggaatgtaatcaatattgactggcttatcaatatgaacctggatagcaccctccaaatttgtataattgaatgtgacaccctttagttttttaatgttcaggaatgaactttgttacaacaaaactggaaatggtaaggattttgtcactgcaaagagtagtaagtgattcagatctgtgggtttggaattgaaaagtactgttgctgcacagcttctatcaacctccatagattttgtttcagaaaattgaattttccaagggaaatccttttgtttgaccctttttgttctctcttttctttcttttcctccctatcctgcatcgtttgttccggttctgtatgctgcttttttactcttttcagataaattatccttcattcaacctttttgtcctacctttccctatctaaagaccccaaagacgataatcaaactgtaaatatgcactcatgggctttttttgtctggttgtattgtcaaagaacaagtatgtttacaaggtctaccatgactaaagtggatgcattatctattggtagttccccaaaatgcat

SEQ ID NO: 1752 - DNA, 750 bp, Tragopogon dubius
ttcggggcgactcgggggcgttaaagaaagaaagtgctcaaatccatcatctccaccaacactttctctctctacaaaagcttctcggcaaaagccccttagcgtaaatcttcaacttctatggcgaacagcaacctacctcgaagaattatcaaggaaacccagcgcttactcagcgaaccagcaccggggataagcgcatcgccatcggaagataatatgaggtatttcaatgtcatgattcttggcccatcacagtctccttatgaaggaggagtcttcaagctggagttatttcttcctgaggaatacccaatggctgcacccaaggttcgattccttacaaagatataccaccccaatatcgataagcttggcagaatatgtcttgacatcctaaaagacaaatggagccctgctcttcagattcgcacagtactcttaagcattcaagcacttttaagtgctccaaatccagatgatccactttcagagaacatagcaaagcattggaaatcgaatgaaacagaagctgtggaaacagcgaaggagtggacgcggttgtatgcaagcggtgcctaacggaggtaggttgcaaaataaaagaattaaaaattatttttaatacaacatattctccaatgtcctgattatgctcttgactttaaaaccctgtttcttttcggttcgaatgaatatatgatgtatcttgtattttcaagagtttagtgaagcagtgtttccttggtt

SEQ ID NO: 1753 - DNA, 962 bp, Trigonella foenum-graecum
aattctagttcgttagtgagagaaaccttctttttctctctcttctctcagcaactctcaaacccctattgcgtactttgcaatcgacccaatccaataatggccaacagtaacctccctcgaagaatcatcaaggaaacgcagcgtttgctcagtgagccagcgcctggaattagtgcgtctccttcggaagacaatatgcgatatttcaatgtgatgatccttggcccgactcagtctccttatgaagggggagttttcaagctagaactatttttgcctgaagaatatccaatggctgctccaaaggttaggttcttgacaaaaatatatcatcctaacattgataagcttggcaggatatgtcttgatattctgaaagataagtggagtcccgcccttcagattcgcactgtacttttgagtattcaagctcttttgagtgcaccaaacccagatgatcctctttctgagaacattgccaagcattggaaatctaacgaggctgaggctgttgagacagccaaagagtggacccggttatatgctaacggcgcttgacaattgggtggatacttttggtctcaaataacaatagtggaagtgtatgctattaactatcaaattaaaatggaaaaatttagaggaattgtctaaactattgtggagtccatattcctcatagcttctggttacatgtttactgctttctatctcccggaagccttctattgaaacttgtatgaatatatggatgttttgtgttaaaaatttaaaacatgctccatcttcaactgctaaatgtactttgggattctcaacgcaaacttttgaataagcttttcttttggtttgtccacattaccatggatttggcttctcttgagtgaagagtaccctttgaagttaaagtgtggaatcataactgatttatggaaaaatctaacagttgtattcaataa

SEQ ID NO: 1754 - DNA, 906 bp, Tripterygium wilfordii
ttcgctagggagagaagactctttctctctctgtgccttcaaaaacccttgtcagcgttttctgcaatcgatcttggaacgcaatggcaaacagtaatcttcctcgaagaatcattaaggaaactcagcggcttctcagtgaaccagcaccggggattagtgcttcaccctctgaagacaacatgcgatacttcaatgtgatgattcttggtccaacacaatcaccatatgaaggaggagttttcaagttggaattattcttgacggaagaatacccaatggcagctccaaaggttcgatttcttacaaaaatataccatcctaacattgataagcttgggaggatatgcctagatattctgaaagacaaatggagtcctgctctccaaattcgaactgtacttttgagcatccaagcacttcttagcgctccaaatcctgatgatccgctttctgaaaatattgctaagcattggaagtcaaatgaggctgaagcggttgaaacagctaaggaatggactcggttgtacgcaagtggtgcctgatgcgataattggaaacttgcatgcaaataacatttactgcaatgtatgtgattgactgttgattttggacagagaattggaagaattgatctctttccacatgattattgtttattattctcaaaaagaaagcttccaggtactactactactactactacctgataaatgtttttttcttttggaggccgcgtctttgacatgtatgataactacatagttcatcgttgaccccttactcaaatgcagaacttgcagagtaatcccagtcatgtagaactttgagttatgtttatcattagacattgtgaatttaaaactctgaatgtggatattatatatgtggatatacttgtttagg

SEQ ID NO: 1755 - DNA, 822 bp, Juglans hindsii x Juglans regia
ggggatttctaaacaacgacgcacgcacactccgtcgcttcgtctctctgactctctctatctcgacagtaaaccctttggcatttgcgtgctctgtaatcgaactcgacatggccaacagcaatctacccagaagaatcattaaggaaacgcagcgcctcctgagtgaaccagcgccaggaattagtgcatcgccatcggaggacaatatgcgatattttaatgtaatgatccttggcccaacacagtctccgtatgaaggaggagttttcaagttggagctatttttgcccgaagaatatccaatggctgctcccaaggtccgatttctcactaagatatatcatcccaacattgacaagcttggaaggatatgccttgatattctgaaggacaaatggagccctgctctccaaatacgaactgtacttttgagcattcaagcacttctgagtgctccaaaccccgatgatccactttctgagaacattgctaagcattggaaaacaaatgaggctgaagctgttgaaacagcaaaggagtggactcgtttatatgcaagcggtgcctgatgacacacggtggaaaatctttgctccccctgaatgatagtatgaagaaatgtatgctattgactgttgattttaaatggaaatttggaacaattgatctgcaaacaattggagttttagtattcccaaagcttcctgtagctggttaattgtttttctctcacggaagcctttgtgaaacttgtatgatatatttggccatcaatttggcgaaatgttatataatatatatatatcatatatgtatcat

SEQ ID NO: 1756 - DNA, 804 bp, Juglans hindsii x Juglans regia
  misc_feature (724)..(725): n is a, c, g, or t
  misc_feature (729)..(729): n is a, c, g, or t
  misc_feature (731)..(731): n is a, c, g, or t
  misc_feature (749)..(749): n is a, c, g, or t
ggggctctccgatattcgtcatatcgggcattctcttcggtgttctctcttttaactctctctctctctctctctctaaaccctttggcatttgcgtgcactgtaatcggccctgaaatggccaacagtaatctaccgcgaagaatcatcaaggaaactcagcgtctcctaagtgaacctgcgccgggaattagtgcttcaccatcggaggacaacatgcgatattttaatgtaatgatccttggcccaacacagtctccatatgaaggaggggtcttcaagttggaattgtttttgcctgaagaatatccaatggctgctcccaaggtcagatttctcactaaaatatatcatcctaacattgacaagcttggaaggatatgccttgatattctgaaagacaaatggagccctgctctccaaatacgaactgtacttttgagcattcaagcacttttgagtgctccaaaccccgatgatccactttctgagaacatcgctaagcattggaaaacaaatgaggctgaagctgttgaaacagcgaaggagtggactcgtttatatgcaagtggtgcctgatgacacggctgaaagctttgcttcccctctagtaacatttaatgaaatgttgtatggaattgactgtcaattttaaatggaaatttggaagaaatgatctttgaaaaatcggagtttaatatttctccaaagcttccagttgccnnctcncntggaagtctttgtggaanttgtatgatatattcagccattaatttggcgaaggatctatatatatatatatat

SEQ ID NO: 1757 - DNA, 898 bp, Citrullus lanatus
aaataattggttcgtgcatcagaaccttcttaccttcaaagctttctttcaagtctttataatctagagagaggaaagcgtcttctctcccatttctctctcttcctttcgtctaaaccctatcgtaacctctcaatcctccttccaatggcgaacagtaatcttccccgaagaatcatcaaggaaactcagcgtctcctgagtgaaccagcccctgggattagtgcctcgccatcagaagataacatgcgatattttaacgtcatgattcttggcccgactcagtcaccctatgaaggaggagttttcaagttggaactatttttaccagaagaatatcctatggctgctcccaaggttcgatttctcacaaagatttatcatccaaatattgacaagcttggaaggatatgccttgatattctgaaagacaaatggagtccagctctacagatacgaactgtacttttgagtattcaagcacttcttagtgctccaaacccagatgatccactttccgagaacattgccaaacattggaaaacaaatgaggcagaagctgttgaaacagcaaaggaatggactcgattatacgctagtggtgcctaaagagaaagtgcagaagccttttactcttcggtttttaataacatcaatctaatgtctctgtggtgccatttgctgtggattttaatgaaaatttggaagaatttatagtgtcaaaaattgtctctaaaattgtaacttgtctctaaaatttcgtctcttttggcaggagtatgtgcccccatactttgtatgattaatgattagatggattacattcttctctaagttctattatctaccatcttttatacccttaggagacctccacagcgtttttgcttctcatttc

SEQ ID NO: 1758 - DNA, 836 bp, Zostera marina
gtttctctctagcttctgctgaaaattgttttttccatcgtcactatcttttccgacccgccctagaaaacagaaaacgaattcacttcaccgaagagggaaccagcagatggccaacagtaatctacctcgccggatcatcaaggaaacgcagcggctcctcagcgaaccagcgccggggatcagcgcatccccctcggaggataatatgagatacttcaatgtaatggttcttggtccaactcagtccccttacgaaggaggtgtgttcaagctcgagctatttcttcctgaagagtatcctatggctgcccccaaggtccggtttctcaccaaaatatatcatccaaatatcgacaagcttggaagaatatgtcttgatattctaaaagataaatggagtcctgctctccagatccgtacggtgttgctcagtattcaagctcttctaagtgctccaaacccagacgatccactttcagaaaacattgcgaaacattggaaagcgaatgaagttgaagcagttgaaacagccaaggaatggacccgtctctatgcaagtggagcttaagatttcggttgtaccccaccttgttgtaaggaaggcaacttttccaacattttaaattaaatgctcatatttgacaacaaaattggattgatgctataaaactatcaaagtaaattcttgtagtaagattcaaaatttcaaattattctctgctctggtatacagacttgttttttgtgatagaaagctaaatattctagtgacgaacccatgttgcagtagtgtcataaactgccacttgtattacttacaatacaagttaatg

SEQ ID NO: 1759 - DNA, 757 bp, Artemisia annua
tagagaaagaaagtctctctctctctctactaaaaaaacacttaaaaagtagcgtaaatcttcatcttcttctatggcgaacagtaatctacctcgaagaatcatcaaggagactcagcgtttactcagcgagccagcgccggggataagcgcgtcgccatcggaagataatatgcggtattttaatgttatgatccttggtccaacacagtctccttatgaaggaagttttcaagctggagttatttttgccggaagaatatccaatggctgctcccaaggttcgttttcttacaaaaatttaccatccaaacattgacaagcttggtaggatttgtctagatatcctcaaagacaaatggagccctgctcttcagatccgcacagtacttctgagcattcaagctcttctaagtgctccaaatccagatgatccactatctgagaacatagcaaagcactggaaatctaatgaagcggaagctgtggaaacagcaaaggaatggacccgtttgtacgcaagtggtgcctagctggaatgtcggtcaacaacatgttactcctgaaaaataacaatgtacttgtttaggtcttgaaatttggaaattaaaacttaaatgattctgctggctagttccaaacaccaatgttgttaacttccttctatacctttaagtttttccagtatatgagatatgtaactctctttttcgaaacatttatttggttaaccacatgaaatagtgtaccgtgggta

SEQ ID NO: 1760 - DNA, 748 bp, Brassica rapa
tgttgatcatcatcatcgtgcggaacttctctcgaattcaccagcgcgtgttaatggccaacagtaatctacccagaagaatcatcaaggaaactcaacgtctgctcagtgaaccggctcctggtataagtgcctctccgtctgaggataacatgaggtacttcaacgttatggtcttggtccttcacaatcaccttatgaaggaggagtttttaagttggagctctttttgcctgaagaataccctatgtcagctcccaaggttaggtttctcaccaagatataccatcccaacattgataagcttggaagaatctgtcttgatattctgaaagacaaatggagccctgctctacaaataagaacagtgctcctaagtattcaagctcttctgagtgcaccaaaccctgatgatccattgtctgagaacatcgctaagcattggaagagtaatgaagccgaagctgtggagacagctaaagaatggacccgtctttacgcaagcggtgcatgatggattggagagtgaaaaagatctcacattcatccaattaacattaagtttggtgaaatctatcaaacatcaaagttataaaaagcttttactttactggttctcccctcttataatgataaaaatgtgagtttcggcacaggaagatgtatattatatcattaccagtagggtcaagactcgtttgccaacttgagctcgtcagtttcgttgaatcaaaacatcttctctact

SEQ ID NO: 1761 - DNA, 953 bp, Sarracenia psittacina
agagattttctagtgagagaggcttaatccatcagctcctctactctctctctctctagattctccctcaaacctttctgcaatcgaatcttctacaatggcgaacagcaatctacctcgaaggatcatcaaggaaactcagcgtctcctaagcgaaccagcgccgggaataagtgcatcaccttctgaagataatatgcggtattttaatgtcatgattcttggtccaacacagtctccttatgaagaggggtattcaagctggaattgtttttgcctgaagaatacccaatggctgctcccaaggttcggtttcttaccaaaatctaccatcctaatattgataagcttggaaggatatgccttgatattctcaaggataaatggagtcctgctcttcagattagaacagtactcttgagcattcaagcacttttgagtgctccaaacccagacgatccactatctgagaatattgcaaagcattggaaatcaaacgaagctgaagctgtcgaaacagcaaaggaatggacccgtctatatgcaagtggagcatgatgaatcggtggtatttaggttccctcgaaaaacctgaatgtgtaatgtatctaactgaatgttgaatttgaatcgaaatttgaaagaaatgattctctgctgatcgaaatcggatcttctcaaaacttccaacagctagtgattatggttttccgttgaaaccttgtaatgaaattgttaggtaagatacttttgtgtttcaattttggaatttggaactattctgtgggaagccgaggggatcggtgcagagaaattgtgtgaaatagctgggtgggcttgacatctaatttttttgttttctaaattagtgcttgtgaaataaacgtttgttgaaatatgcagctagtcagcatattggccctgatagggaaaaaagtatttaatttacaagc

SEQ ID NO: 1762 - DNA, 837 bp, Sarracenia psittacina
attctccctcaaacctttctgcaaccgaatcttctacaatggcgaacagcaatctacctcgaaggatcatcaaggaaactcagcgtctcctaagcgaaccagcgccgggaataagtgcatcaccttctgaagataatatgcggtattttaatgtcatgattcttggtccaacacagtctccttatgaaggaggggtattcaagctggaattgtttttgcctgaagaatacccaatggctgctcccaaggttcggtttctcaccaaaatctaccatcctaatattgataagcttggaaggatatgccttgatattctcaaggataaatggagtcctgctcttcagattagaacagtactttgagcattcaagcacttttgagtgctccaaacccagacgatccactatctgagaatattgcaaagcattggaaatcgaatgaagcggaagctgtcgaaacagcaaaggaatggacccgtctatatgcaagtggagcatgatgaatcggtggtatttaggttccctcgaaaatcctgaatgtgtaatgtatctaactgaatgttgaatttgaatcgaaatttgaaagaaatgattctctggtgatcgaaatcggatcttctcaaaacttccaacagctattgattatggttttccgttgaaaccttgtaatgaaattgttaggtaagatacttttgtgtttcaattttggaatttggaactattctgtgggaagccgaggggatcggtgcagagaaattgtgtgaaatagctgggtgggcttgagatcaattttttgttttctaaattagtgcttgtgaaataagctgtttagtttgtt

SEQ ID NO: 1763 - DNA, 739 bp, Senecio madagascariensis
tggatcccccgggctgcaggcttcaattcaatggcaaacagtaatctacctcgaagaattatcaaggaaactcagcgcttactcagcgaaccagctccggggataagtgcgtcgccgtcggaagataacatgaggtattttaatgttatgatccttggtatcaacgcagtctccttatgaaggaggagtttttaagctggagttgtttttaccagaagaatatccaatggctgctcccaaggtccggtttcttacaaaaatttaccatccgaatatcgacaagcttggtaggatttgtcttgatatcctcaaagacaaatggagccctgctcttcagattcgcactgtactcctgagcattcaagctcttttaagtgctccaaacccagacgatccactctctgaaaacatagctaagcattggaaatctaatgaagctgaagctgttgaaacagcaaaagagtggacccgtttgtatgctagcggtgcctaactgagatgtgggttatcatgtcagtatgaaaaaataacaatgtactttgttaggtcttgaaatttggaaatttaaaaagttgaatgattctgctgctagtcctgaacgattagtgttgttaactttgttctataccctatgtgctttctgaatatatgagataagtaactctctttctctaattcttttgtggaacatatatcttattaaccatgtgaaatatcttagtgtcgatgattttgtata

SEQ ID NO: 1764 - DNA, 836 bp, Triticum aestivum
ctcgtgccgcaccgctttcccgttccccaccccgaccgactgctccccctcccccgcaccagcctcaagccctcaaggcctcaaggcatcgccggcgccgcaacttcgctgaggaagcccgcacccctgcccggatccgatggccaacagcaacctcccgcggcggatcatcaaggagactcagcggctgctcagcgagccagcaccggggatcagcgcgtcgccctcggaggagaacatgcgctacttcaacgttatgatccttgggccggcgcagtcgccctatgaaggtggagtttttaagcttgaactctttttacctgaggaatatccaatggctgccccaaagttaggtttctgacaaagatttatcatcccaacattgacaagcttggtaggatatgcctcgacattctcaaggacaaatggagcccagcacttcagattcgaacagttcttttgagtatacaggctctactgagtgcaccaaatccagatgaccctctctccgataacattgcaaagcactggaaatccaatgaggtagaagctgttgaaacagccaaggagtggactcgcctgtatgcgagcggtgcatgagaacgcatgctgttcttggtgtaataacccgtcatacttcagtcctaatccgttgccatttgcttgataaaaacagactggagatatttgccatggaatgaagtccctaaatgactaccactctgaattgtttggttgtacaactatggtcggttccctttacctttgggcacctttgactaatcagtatctgtggtagaacttgctgttactttaatatatttgtcacttcatgt

SEQ ID NO: 1765 - DNA, 710 bp, Ambrosia trifida
cgatggcgaacagcaatcttcctcgaagaattatcaaggaaactcagcgcctactgagtgaaccagctccgggataagtgcatctccatctgaagataatatgcggtattttaatgttatgatccttggtccaacacagtctccttatgaaggaggagttttcaagctggagtgtttttgccagaagaatatcctatggctgctcccaaggttaggtttctcacaaaaatttaccatccgaacattgacaagcttggtaggatttgtcttgatatcctcaaagacaaatggagccctgctcttcagattcgcactgtactcctgagcattcaagctcttttaagtgctccgaacccagatgacccactctctgagaacatagcaaagcactggaaatctaatgaagctgaagctgttgaaacagcgaaagagtggacccgtttgtatgccagtggcgcctaacggagatttggtcaccatgttgtttggagaaaataacatgtatttggttagatctaaaacttgaatggttccgcctgctgcaatgttgttcacttcctttttttttcagataagacactaattttcatgtgtaacattcatctggtaactatgtgaaaaagtatttctgaacacggttgttgtagccctaagacttgggtcaggtgatgcgattcctattgctacaaccgcctggttgcgtttggggt

SEQ ID NO: 1766 - DNA, 724 bp, Flaveria ramosissima
tttttctctcttcttacaaaaacgcaaaatcccctgtagcgtaaatcttccccttcgatggccaacagtaatctacctcgaagaatcatcaaggagactcagcggttactcagcgagccagctccggggattagtgcttcaccgtctgaagataatatgcggtattttaatgttatgattcttggtccaacgcagtccccgtatgaaggaggagttttcaagctggagttatttttgccagaagaatatccaatggctgctcccaaggttcggtttcttacaaaatttaccatcccaacattgacaagcttggtaggatttgtcttgacattctcaaagacaaatggagccctgctcttcagattcgcactgtactcctgagcattcaagctcttctaagtgctccaaacccagatgacccgctttctgagaacattgcaaagcactggaaaactaatgaagctgaagctgttgaaacagcaaaggaatggacccgtttgtatgctagtggggcctaacgaagatgcagattattatgtttggaaaaataacagtgtatttggttaggtcctgaaatttataacttgaatgctgcaatgttgttaactttcttgtgttttttcgagacagttttcctaattttgttatgtggaacatttatctggttaactgtgtgtcaaagggttgcgttaatcatattcgcatgaaccatataagtgatatt

SEQ ID NO: 1767 - DNA, 769 bp, Papaver somniferum
ctctaaaaatggcgaatagtaatctaccacgacgaattattaaggaaactcagcggctactcagtgaaccagctcctggcattagtgcttctccttcagaagataacatgagaatattttaatgttatgattcttggtccaacacagtctccatatgaaggtggggtttttaaattggaactatttctgcctgaagaatatccaatggctgcgcctaaggtccgctttctaactaaaatttaccatcccaacatcgacaagcttggaagaatatgtcttgatatcctgaaagacaaatggagccctgccctccagattcgtactgtgctactaagtattcaagcacttcttagtgccccaaacccagatgatcctctttctgaaaacattgccaagcactggaaggcaaatgaggcagaggcagttgaaacagccaaagaatggactaggctatatgccactggtgcatgacaatgtggcaacatggattggttgggagtgtcggtggctgttataagagaataacgtataatgctatgtaattcagatggttgataattcacctaaagtaaaagtaatcagatgcttgttctcaaatattgaaacaaagaagtttacctcaattaaccgaaaagatcaaatatcataattcaattagatatgtaatgaatttagattaaacttggttttctttttgttgcagttgtaattgccaatgtgatttaatgtctctgttgaaactccttcaggaaattgttctgtatgaaaa

SEQ ID NO: 1768 - DNA, 928 bp, Phaseolus vulgaris
ttttcagcaaagcaaaagattatataaataggggcgagagataatgggctttcattgagcattgttctgctttgtgttagtgagaaaaagttgtctctgtttctctctctttgactcaaaaccctattgcgtgctttgcaatcgaccctgattatggccaacagtaacctccctcgaagaatcatcaaggaaacgcagcgtttgctcagtgagccagcgcctggaattagtgcttccccctcggaagacaatatgagatatttcaacgttatgatccttggaccgactcagtcaccttatgaaggtggagtttttaaactagaattatttttgccagaagaatatccgatggctgctcctaaggttagatttctgacaaaaatatatcatccgaacattgataagcttggcaggatatgtcttgacattctgaaagacaagtggagtcctgcccttcagattcgcactgtacttttgagtattcaagctcttctaagtgcacccaacccagatgaccctctgtctgagaacattgccaagcattggaaaactaacgaggctgaggctgtggaaacagccaaggaatggactcggttatatgccattggcgcgtaatgctgggtggagtgggaacttctggcttcaaataactatagtggaagtgtatgctgtataactgtcaaatctaaacgcgaatttggagttatctattaaactattttggagttaatatttcccatagcttcaggttacctgtttattactttctttcacctggaaggcttgtcttggaacttgtatgaaaatatgtgatattttatctgacaaatttaaacacacttcatctcccaactcccaagtaatttgggatcctcaaacttaaatagtacaaaattttcgaataagtttgtcttgaattctatccttt

SEQ ID NO: 1769 - DNA, 590 bp, Acacia harpophylla
gagtttctattatcaatcgaaccctcgatcctttttccgctggtcttagtgagagaaaggcctctccatctctctctctcccaaaaccctattgcgtgatttgcaatcgaccttgatcatggccaatagtaatctcccccgaagaatcatcaaggaaactcagcggcttcttagcgagccagccccaggaattagtgcttcgccttcagaagacaatatgagatatttcaacgtgatgatccttggaccaacacagtcaccttatgaaggaggtgttttcaagttggaactgtttttgccggaggaatatccaatggctgcccctaaggttaggtttctgactaaaatatatcatcccaatattgataagcttgggaggatatgtcttgatattctgaaagataagtggagtcctgctcttcagatacgcactgttcttttgagcatccaagcgcttctcagtgcacccaacccagacgatccactttctgagaacattgccaagcattggaaaacaagtgaggccgaggctgttgaaactgcaaaagagtggacccgattatatgccagtggagcctaattgcaatgac

SEQ ID NO: 1770 - DNA, 852 bp, Amorphophallus konjac
gatcgcgacctccgcgttcttcgccgctgcgcccctctctctctcctcccgccatctttcctgctcgattcactcaaaggaggaggcagcggaagaaacgtgatccccgtccaagcggaatggcaaacatcaatctacctcggcgaatcatcaaggagacgcagcggctgctcagcgaaccagcaccggggatcagtgcatctccttctgaagagaacatgcgctactttaacgtcatgattcttggcccgactcagtctccctacgaaggaggggttttcaagctggagttgttcttgcctgaagagtatccaatggctgcacctaaggtgcgctttctcacaaagatttaccatcctaacattgacaagcttggaagaatatgccttgatattctcaaagacaaatggagtcccgccctccaaatccgtacagtattgcttagtattcaagcacttttgagcgccccaaacccagacgatcctctctctgacatcgttgccaagcactggaagacaaatgaagctgaagcagtagaaacagccaaggagtggacccgtctttatgccagtggagcatgatggtgccattgccaagcggccattttaaatccaaaagagtgaatgtgaggcccacggttcgttctacaacgaatggagatgatgctgattttacagtgaaatggacctctgcctgtataagcagtatgtagttggctcccgtcatgtttatacaacttattttgatctcatttggtggaaagctgatcttcataagatggggcacaattgttttaagcgacctattttaggaatcagcttgccgtgtagtattatatttatcaatacttac

SEQ ID NO: 1771 - DNA, 711 bp, Antirrhinum majus
  misc_feature (711)..(711): n is a, c, g, or t
aaactctccgatgatagcaaaaagctctacaatctcttgaatttggattcaatggctaatagcaatttgccgcggagaattatcaaggagactcagcgtcttctgagcgagccagcaccaggaataagtgcatctccatcagaagacaatatgcggtatttcaacgtaatgattctcggtccatcccaatctccttatgaaggaggtgtttttaagctggaattgtttttgcctgaagagtacccaatggctgctcccaaggttcgtttcctcacaaaaatttaccacccaaacattgataagcttggaaggatatgcctggatattcttaaagacaaatggagtcctgctcttcagataagaaccgtacttttgagcattcaagcgctgttgagtgctccaaaccctgatgacccactttctgagaatattgcgaagcattggaaatcaaatgaaactgaagctgttgaaacagctaaagagtggacacgtttatatgcaagtggcgaatgaagtgtttgtagctgggggtcaccattaataaccaaaaaatgtaatgttgtatgtcgactgatatatgaaggtttgctttgtacgatgctggaatcttctaggatctgcattattagcacatattttctgcttgaaacttaaaatgtgcgatgaaatgaaatactttttgctgccgctccgatgaaaggccgctagctn

SEQ ID NO: 1772 - DNA, 1359 bp, Aristolochia fimbriata
aaggacgccaacgcctaaagccctcacgccacggaatgatcggcgacattcatcatgaaagtgaaccgcggaccacgatacattagtcgagaaagcgctctcccattggtcacggctttcgctactaagaagtggccatttccgctcgctaagcgaatgaaaatcagaggagaaggtaacaacaagtgggcccaaggttttaatttaaaaaaatgagctaattaagtgttattaagtaactaacagtctttgcggtagcttttaaaacccggaattcgatctaacgcccgtcttttattctttctgaagagacgcccaagtcgagggtttaactcttcctccctttccctttctccaaaatcttacctccaatggccaacagcaatctacctcggaggattatcaaggagacgcaacggctcttaagcgaaccagcgcctggaattagcgcatctccctctgaggacaatatgcggtacttcaatgttatgatccttggaccaacacaatctccatatgaaggaggagttttcaagttggaattatttttgccggaagaatatccaatggctgctccaaaggttcgctttctgaccaaaatataccatccaaatattgacaagctgggaagaatatgccttgatattctgaaggacaaatggagtcctgctctccagattcgaactgtgttattgagtattcaagcccttctaagtgcacctaatccagatgacccgctttcggataacatagcgaagcattggaagacaaatgaagccgaagctgttgaaacagctaaggaatggacccgtttgtatgcaagtggagcatgatggaagctgtgaattgctgctttggcaaataacaacatgtttactaagtgtacttttgggccctgttctcgttcttttttttcccatagaaaatggaagtactgattgtcttgattatacgaagattacatcgctttaaaaatccctgttgtctgtccaatgtttccttgtactattagatagataagtgtgtcgatcatcttgttgcattttgtcctgcatcacgttggcagtttaaattccagtgtatgcgtacttggaaaacaccagacctcatctgggaaaaaacatattaaacgcaatatccagttttaggtttgtttccttccaatagggaaaaggcgttggtgacaaaagatttctcttatttgatgcgtccttgtgttgtaaataatgacaggttggaggtctgatgtttagcacaattgaagtcgttatgtaggtggatgttacatcgctgttcgtgtattttaactctctggctgctacagaggaataggaacccagggaaataatgcgaacgagg

SEQ ID NO: 1773 - DNA, 1919 bp, Musa acuminata
atcattttgctatttttgggagaatataagcgatttagtcgagtttttgatggcttcacatcggcttcttccttaaccccgtcgactcatctctcctcttccgtcctcgtgggatccgaccatcgcgtggaatggccaacagcaatcttcctcgaaggatcatcaaggagacgcagcggcttctcagcgaaccagctccgggaataagtgcttccccgtcggaagacaacatgcgctacttcaacgtgatgattctcgggccgtcccagtctccgtatgaaggaggagtattcaagcttgagttgtttttacccgaagaatatccaatggctgccccaaaggtccgcttcctcaccaaaatttatcatcctaatattgacaagcttggaagaatatgcctagacattctaaaagacaagtggagtccagctctccaaattagaacagtacttctcagtattcaagctcttctcagtgccccaaatccagatgatccactttcagacaacattgcaaagcattggaagacaaacgaagcagaagcagtggaaacagctaaggaatggacccgtctatatgcttctggggcatgaaatggacaacactatccatttcatgacagctacagtggagttttaacaaaaaggtgctggttgcttttgacaaatgaaaccgtgatcttggatgcattactaaaagctttagatatttcaatttcctctgttatcctatatggtgtatattgctctgaggctacctcatccagtttgtaagaggactctgaagtttgcaaactaataagaaccaagaagcaaattcttgcttcgcctgtgtgggactgcagaaataccatagaaggtgttttgaagtcttaaagcacacaacagattaacagtttatatgcttgccagtcatctgcaattatgcagatccaagaatcctatgagcaaatgaatactcgttagatttccaaattatatactgtagcgttttcagtaagccttttttacctcaaggctgcagattctttctggcagaacatatatgatctggcattgcaggcgtttttttttcaactttgcagttactcttagttgtgttattatattgatgcacttagcattctcattgggcctcttcagtatttgttttgctcacagcaacttccaggctaatctatggtgggcattcagtttcatcagagttagcaattgtgcccaagcatctccgagaagtaggttgcgtcagtgctacattgtatttgcttgtttgatggaggcttatggaagaacaatgaactacaatggagcatgggggatcaaagataacccagtttgtgccctgtggttcctacaaatcaacccctggttgcattttttgcgctttagctgccatcaccaaactcggcttgtaacagatgttgttctgctagtgctgttatcagcattcccacccggccttgtgcacgttggagcagcttgggcggctccattgaggccactgcaagtggttgtgagctgctctgcttattgattggatcatattattagcgaacaatgggagatcaaatgctcaggatgagctacagctcagctgtgttattgaaagggaacctgctgtgatgatgccgcagatgctggtactggtagggccaccttcttcctgaggagccaataaagtcgaatcaaagaaggtgatgaagaaagggaagcgagtgagtcgtgttctgtttgactgttgaactgagagtaatgctgaatccgtcctcaagttcttttattagtttgattgcttgttgcgacgtaatgtgcaatgatgacacatccttaacaatgaatggctcttgaaatgtgcaggctttgtgattagagatgatatttccaagtgcctgccttgaggatgcagcaggtactggggag

SEQ ID NO: 1774 - DNA, 658 bp, Ocimum basilicum
ggccaacagcaatcttccgcgtaggattatcaaggagacgcagcggcttctcagcgaaccagcacctgggataagcgcttctccatcagaagacaatatgcggtacttcaatgttatgattcttggtccaacacagtctccttatgaaggaggtgtttttaagctggaattgtttttacctgaggaatacccaatggctgctccaaaggttcgcttcctcactaagatttaccaccctaacattgacaagcttggaaggatatgcttagatattctcaaggacaaatggagtcctgctcttcaaatcagaactgtgcttttgagcattcaagcacttttgagtgctcctaatcccgatgacccactctccgaaaacattgccaagcattggaaatcaaatgaggccgaggctgtggaaacagctaaagaatggacgcgcttatatgcgactggcgcgtgatttacgtggacctgactgtattgtatcgcacatcaaaccaatttggaagattaatgaatgctcaaaacctcatgctgtcttgtatcagattcccatttcaaactctcagtttgaatgttccatgttataaaagcactttgtcattatgttctgcactttatttgtcgtacttgaatttgtccattaatattaccatcc

SEQ ID NO: 1775 - DNA, 1077 bp, Phaseolus vulgaris
ttttcagcaaagcaaaagattatataaataggggcgagagataatgggctttcattgagcattgttctgctttgtgttagtgagaaaaagttgtctctgtttctctctctttgactcaaaaccctattgcgtgctttgcaatcgaccctgattatggccaacagtaacctccctcgaagaatcatcaaggaaacgcagcgtttgctcagtgagccagcgcctggaattagtgcttccccctcggaagacaatatgagatatttcaacgttatgatccttggaccgactcagtcaccttatgaaggtggagtttttaaactagaattatttttgccagaagaatatccgatggctgctcctaaggttagatttctgacaaaaatatatcatccgaacattgataagcttggcaggatatgtcttgacattctgaaagacaagtggagtcctgcccttcagattcgcactgtacttttgagtattcaagctcttctaagtgcacccaacccagatgaccctctgtctgagaacattgccaagcattggaaaactaacgaggctgaggctgtggaaacagccaaggaatggactcggttatatgccattggcgcgtaatgctgggtggagtgggaacttctggcttcaaataactatagtggaagtgtatgctgtataactgtcaaatctaaacgcgaatttggagttatctattaaactattttggagttaatatttcccatagcttcaggttacctgtttattactttctttcacctggaaggcttgtcttggaacttgtatgaaaatatgtgatattttatctgacaaatttaaacacacttcatctcccaactcccaagtaatttgggatcctcaaacttaaatagtacaaaattttcgaataagtttgtcttgaattctatccttttccgtgagtccgtacgtgttcaatatgtttggttgtgcattcgatagcttaacgtattggcatatttgtctatctgtgttaggtgttcttatgatatcagatacaacacaagagtaacattctgaattatctttgagaatttttaaata

SEQ ID NO: 1776 - DNA, 769 bp, Beta vulgaris
gcaacacacccaaagtcgtcatcaatggcgaactccaatctacctcgcagaatcatcaaggaaactcagcgtctcctcagcgagccagctcccggaataagtgcttcaccatcagaagacaatatgcggtactttaatgttatgattcttggaccatcacagtctccttatgaagggggagtatttaagttggaactatttttgcctgaggaatatccgatggctgctcctaaggttcgatttctcaccaaaatatatcatcccaacattgacaagctagggaggatatgccttgatattctcaaagataaatggagtcctgctctccagatacggactgtactcttgagtattcaagcactgctgagtgctccaaaccctgatgatcctctgtctgagaatattgctaagcattggaaaatggatgaggcagaagctgttgaaactgcaaaagaatggactcgtctatatgcaagtggggcttaatgacatggcgagaactttttgccctcttcaaataacaattgtgtgatgtttgttatctgactgaattgtataccaagctgctggctggaaaatgaatttcaagtgataatctaggagaaatgatgatcaaatgtgagtataagatagcataagtttctgtggtcttatttatcttctctaccctgtcgaattcatcctagaaatgtataaattgacgttttgcttacatttttgtgttgcatatccggactgctttcttgttctaatagattgaaaattggaa

SEQ ID NO: 1777 - DNA, 995 bp, Beta vulgaris
tattactccatcttcttgcataaagccctcttccatttgcattctcgattccaatcttcactctttttctctctcctgatctacccccaacaccccttacccccttctcctcgcctttgtctctcctaatggcaaacagcaatcttcctcgaagaattatcaaggaaacacagcggcttctcagtgagccagctcctggaattagcgcttctccctcggaagagaatatgcggtactttaatgttatgattttgggtccttctcaatctccttatgaagggggtgtcttcaagttggagttgtttctaccagaagaatacccaatggcacctccaaaggtccgcttcttgactaagatttatcatccgaatattgataagcttggaaggatatgcttagacattcttaaagataaatggagcccagccctgcagatccgaacagtattactgagtatccaggcacttttgagtgctcccaacccagatgatcccctttcagagaacattgcaaagcactggaagagtaatgaagttgaagctgtggaaacagcaaaggaatggacgcgcttatatgcaacaggtgcttgacaatgagagcttatcacacagtgtcaattctgcattgtatctttaaagtttgaaccaaattataaaatttactgcccttttcatggaaaatggaaagagagtcgtgtttcgatgattagtatgataacccaaaggcctccaattgctggttgtagatgattctcatcacaaaattgcttcactcatgtactctcgtcaatgtttgtaatgcttatttctcaatttcaaatcatgctcatctgaaactattttaatggggttgttgagggtggtaaagggtttgggagccggacatgttgatcaatgtttgcattgcggtgtccctcatagtgctttgtctacatcgttgatcgatctcatatgaaacataaaaatgtattatgttgagaagaaaatagaagtcca

SEQ ID NO: 1778 - DNA, 708 bp, Vaccinium corymbosum
tctctctctcaacaccgtatacaacaaacttgctcttcgacctgaagtctgatagctaatcaaatggccaacagcaatttgcctcgaaggattattaaggaaacgcagcggcttctcagcgaaccagcaccaggaatcagtgcttcgccttcggaagataatatgcgatacttcaatgtgatgatacttggtccctcgcaatctccgtacgaaggaggggtattcaagttggaattgtttttgcctgaagaatatccgatggcagctcccaaggtccgcttcctgactaaaatttaccatcctaacattgacaagctgggaaggatatgcctggacattcttaaagataaatggagtcctgccctccagatacgcactgtattgttgagcatccaagctctcctgagtgctccaaatccggatgatccactttctgagaacattgcaaagcactggaagacaaacgaagctgaagctgttgaaacagcaaaggaatggacccgtttatatgcaaccggtgcatgattatcgaagttcattactagcaaatgtcatttctcctttgtatgttaagtgaattgtcgcctttggtcttgcaatgaaaatgacgaatcgtctatggactatctaaatgtaatctttgcaagaccttcagtatgtatgttgatgaatttcatgttttctaatacatgccattcactatctgac

SEQ ID NO: 1779 - DNA, 773 bp, Vaccinium corymbosum
gaactgcagaaaattctccacagtttccacaaattattgaagtcgttttccccttttgtaggtagcgtttaaacccttcgcccttttccttttcaccaaactccgccctctctctctcaacaccgtatacaacaaacttgctcttcgacctgaagtctgatagctaatcaaatggccaacagcaatttgcctcgaaggattattaaggaaacgcagcggcttctcagcgaaccagcaccaggaatcagtgcttcgccttcggaagataatatgcgatacttcaatgtgatgatacttggtccgtcgcaatctccttatgaaggaggggtattcaagttggaattgtttttgcctgaagaatatccaatggcggctcccaaggtccgcttcctgactaaaatttaccatcctaacattgacaagctgggaaggatatgcctggacattcttaaagataaatggagtcctgccctccagatacgcactgtattgttgagcatccaagctctcctgagtgctccaaatccggatgatccactttctgagaacattgcaaagcactggaagacaaatgaagctgaagctgtcgaaacagcaaaggaatggacccgtttatatgcaaccggtgcatgattattgaagttcattactagcaaatgtcatttctcctttgtatgttaagtgaattgtcgcctttggtcttgcaatgaaaatgacgaatcgtctatggactatctaaatgtaatctttgcaagaccttcagtttgtatgtt

SEQ ID NO: 1780 - DNA, 817 bp, Catharanthus roseus
cctcagaacttccctccttcccctaaggaggccgcagacccataaatcgaatcctcacacctctgatttttctcatacgaaatacacatggcgaatagcaatttacctaaacgaatcattaaggaaactcagcgccttctcagtgaaccagctccgggaattagtgcctcaccttcagaagataatatgcggtattttaatgtcatgatacttggtccggcacaatctccatatgaaggaggtgtattcaagctggaattgtttttgcctgaagaatatccaatggcaccacccaaggttcgatttttgaccaaaatataccatcctaacattgacaaactgggaaggatatgccttgacattctcaaagacaaatggagtccagcactccagatacgaaccgtattgctaagcatccaagctcttcttagtgctccaaatccagatgacccactttctgagaacattgctaaacattggaagtcaaatgaggctgaggctgttgaaacagcaaaggaatggacgaggttatatgcgactggtgcatgaggagataagattacagtctttccaaagcagaatgctgagttctgcaaatctcttttaatttggatgataatcctccatttcatgatgaagagagatgtatcatgcaaacaattaaaacgtaatcttgcaagccctagaatctattcttttcttctcttttaatgggcacgcttgaaaaattgtacaacaacatgagagtctgattttaatttatcttcatttttacctttttatgaccgcctattgttattctcgagtaaattctacc

SEQ ID NO: 1781 - DNA, 671 bp, Centaurea maculosa
gtagcgtaatttctactctttccatggcgaacagcaatctacctcgaagaatcatcaaggagacgcagaggttgctcagcgaaccagctccggggataagtgcatcgccatcagaagagaacatgcggtattttaatgtcatgatccttggtccatcacagtctccttatgaaggaggagtttttaagctggagttatttttgccagaagaatatccaatggctgcccccaaggttcggtttcttacaaaaatataccatccgaacattgataagctcggcaggatatgtctcgatatacttaaagacaaatggagccctgctcttcagatccgcactgtacttttgagcattcaagcacttttaagtgctccgaacccagatgatccgttatctgagaacgtagcaaagcactggaaaactaacgaagctgatgctgtcgaaacagcaaaggaatggacccatttgtacgctagtggcacctaaagcagggtcacgccccccgcccaccatgtttctgagaagataaacatgtattatattttagatattgatgcccgaaaaatgtgagcaactggggaaaaagattcatccctttgctgctaaccttggatgataaaattgttgttaaccttttcgatctttcgagataagttactcatgttctatttc

SEQ ID NO: 1782 - DNA, 955 bp, Centaurea maculosa
ctctttcccctttcttccttctctcaaaaagccaaaaccctctctctctgtagcgtaatttctactcttccatggcgaacagcaatctacctcgaagaatcatcaaggagacgcagaggttgctcagcgaaccagctccggggataagtgcatcgccatcagaagagaacatgcggtattttaatgtcatgatccttggtccatcacagtctccttatgaaggaggagtttttaagctggagttatttttgccagaagaatatccgatggctgcccccaaggttcggtttcttacaaaaatataccatcctaacattgataagctcggcaggatatgtctagatatacttaaagacaagtggagccctgcccttcagatccgcactgtactcctgagcattcaagcacttttaagcgctccaaacccagacgatccactatccgagaacgtagcaaagcactggaaaactaacgaagctgatgctgtcgaaacagcaaaggaatggacccatttgtacgctagtggcacctaaagcagggtcacgccccccgcccaccatgtttctgagaagataaacatgtattatattttagatattgatgcccgaaaaatgtgagcaactggggaaaaagattcatccctttgctgctagccctggatgataaaattgttgttaaccttttcgatctttcgagataagttactcatgttctatttcttttttagatattcgtcttagaacattttatttgaaactctcattgtataattgactttcataagttggatttaaatgtagaagttattgcagggaatatcttctgttgttttttcattgctttaaaaagccgtataagattataattttgtacataaattaactgatatttttcattaatattaaaaaataaaataacaaaaacttagtaaaagaattacaacatcataagtatc

SEQ ID NO: 1783 - DNA, 750 bp, Centaurea maculosa
ctctttcccctttcttccttctctcaaaaagccaaaaccttctctctgtagcgtaatttctactcttccatggcgaacagcaatctacctcgaagaatcatcaaggagacgcagcggttgctcagcgaaccagctccggggataagtgcatcgccatcagaagagaacatgcggtattttaatgtcatgatccttggtccatcacagtctccttatgaaggaggagtttttaagctggagttatttttgccagaagaatatccaatggctgcccccaaggttcggtttcttacaaaaatataccatcctaacattgataagctcggcaggatatgtctcgatatacttaaagacaaatggagccctgcccttcagatccgcactgtactcctgagcattcaagcacttttaagtgctccgaacccagacgatccgttatctgagaacgtagcaaagcactggaaaactaacgaggctgatgctgttgaaacagcaaaggaatggacccatttgtacgctagtggcacctaaagcagggtcacgccccccgcccaccatgttgcatctgagaagataaacatgtattatattttagatattgatgcctgaaaaatgtgagcaactggggaaaaagattcatccctttgctgctaacccttggatgataaattgttgttaaccttcgatctttcgagataagctactcatgttctatttcttattgttaagatttcacgaaatgtttatcta

SEQ ID NO: 1784 - DNA, 696 bp, Chelidonium majus
caattttatcagaatcttgcttgaaatggcgaatagtaatctaccaagaaggatcatcaaggaaactcagcggcttctcagcgaaccagctccaggaattagtgcttctccctcagaggataacatgcgatatttcaatgttatgattcttggtccatctcagtcaccatacgagggaggggtcttcaagttggaactatttttgcctgaagaatatccaatggctgcgcccaaggtccgctttctcaccaaaatttaccatcctaatattgacaagcttggaaggatatgtcttgatattctgaaagacaaatggagccctgctctccagatccgtaccgtacttctaagtattcaagcacttctaagtgctccaaacccagatgatccgctttctgataatattgccaagcactggaaggcaaatgaggctgaagcagttgaaacagccaaggaatggactcgtctatatgccagtggtgcatgatgataataacaaggtggtatggaagcttgtctgttagtgcgaatagcattaagtgcaaatgtaagttaaaaaccagatggtttattttcaaaatcgaaatgaatgaattgatgtgcaattatcaaaagatcaatactagctgcagctaatatttcttctctcatggaaactgtgtcttcatatatgtaatgattagataaagtttgctg

SEQ ID NO: 1785 - DNA, 708 bp, Cirsium arvense
tttcttccttctctcaaaaagccaaaacctcctttgtagcgtaatttctactcttccatggcgaacagcaatctacctcgaagaatcatcaaggagacgcagaggttgctcagcgaaccagctccggggataagtgcatcgccatcagaagagaacatgcggtattttaatgtcatgatccttggtccatcacagtctccttatgaaggaggagtttttaagctggagttatttttgccagaagaatatccaatggctgcccccaaggttcggtttcttacaaaaatataccatcctaacattgataagctcggcaggatatgtctcgatatacttaaagacaaatggagccctgcccttcagatccgcactgtactcctgagcattcaagcacttttaagtgctccgaacccagacgatccgttatctgagaacgtagcaaagcactggaaaactaacgaggctgatgctgtcgaaacagcaaaggaatggacccatttgtacgctagtggcacctaaagcagggtcacgccccccgcccaccatgttgcatctgagaagataaacatgtattatattttagatattgattcccgaaaaatgtgagcaactggggaaaaagattcatccctttgctgctaacccttggatgataaattgttgttaaccttcgatctttcgagataagctactcatgttctatttgtt

SEQ ID NO: 1786 - DNA, 719 bp, Cirsium arvense
ctctctctctctctctctaaaagggcaaaaagacccctttagcgtcaatcttccacttccatggcgaacagcaacctccctcgaagaattatcaaggaaactcagcgcctactcagcgaaccagcacctgggataagtgcatcgccatcggaagaaaacatgaggtatttcaatgtcatgattcttggtccatcgcagtcaccgtatgaaggaggagtctttaagctggaattatttctgcctgaggattatccaatggctgcccccaaggttcgattccttacaaaaatataccatccaaacatcgataagcttggtagaatatgtcttgatatcttgaaagacaaatggagccctgctcttcagattcgcaccgtacttctcagcattcaagcacttttaagtgctccaaacccagatgatcctttgtcggagaacatagccaagcactggaaatccaatgaagtagaggctgttgaaacagcaaaggagtggactcgtttgtatgcaacaggcgcgtaatcaaatcaactcgaattcactttgtaaatcaaatgccatggaagaaacaaatttctctttttttttccatttgaaggattcattactttcctttacagagagttaaaaagtgtccaaactgtgtaactcatataattcgtcctctttaaaacgctatgttgactctttaatgggtgaaggccacatgatgttttttt

SEQ ID NO: 1787 - DNA, 809 bp, Cucurbita pepo
ttggagtgtgcagaaagttgtaccttcaaacttcgttcagtctttataatctagagagaggaaagcgtctcctctccagtctctctcttcttcgtctcctaaaccctatcccgagctctgcaatccgacctcaaatggcgaacagtaatcttccccgaagaatcattaaggaaactcagcgtctcctcagtgagcctgcccctgggattagcgcctcgccgtcagaagataacatgcgatattttaacgtgatgattcttggcccgacccagtcaccctatgaaggaggagttttcaagttggaactatttttgcctgaagaatatcctatggctgctcccaaggttcgatttctcacgaagatttatcatccaaatattgataagcttggcaggatatgccttgacattctgaaagacaaatggagtccagctctacagatacgaactgtacttttgagtatccaagcacttctgagtgctccaaacccagatgatccactttccgagaatattgccaaacattggaaaacgaacgaggcagaggctgttgaaacagcaaaggaatggactcaattatacgcaagtggcgcctaaagggggaggaattacagaagccttttttaatgttgttcggtttaataacatgaatctaatgtctatggtgtacccatttggtgtggatttgaatgaaaatttggaggaatttatagtgtcaaaaaatctctaaaattgcgtctgttttagcagggagtgtatgccccccaccatactttgtatgatgaatgattagatggattatattcttat

SEQ ID NO: 1788 - DNA, 815 bp, Cynara scolymus
gcgggggatcgacatttgcgacatggtcgcggcgtgaaagaagtctcgatacgatcggttcccttcactttctctctctagaaaacttccccccctctctctctctaaaagggcaaaaaaagacccctttggcgtcaatcctccacttccatggcgaacagcaacctgcctcgaagaattatcaaggaaactcagcgcctactcagcgaaccagcaccggggataagtgcatctccatcggaagaaaacatgcggtatttcaatgtcatgattcttggcccatcacagtcaccttatgaaggaggagtctttaagctggaattatttttgcctgaggattatccaatggctgcccccaaggttcgattccttacaaaaatataccatccaaacatcgataagcttggtagaatatgtcttgatatcctaaaagacaaatggagccctgctcttcagattcgcaccgtactcctcagcattcaagcacttttaagtgctccaaacccagatgatccgttgtcggagaacatagcaaagcattggaaatccaatgaagttgaggctgttgaaacagcaaaggagtggactcgtttgtatgcaaccggtgcctaatcgaatttacgactacttccttcactttgtaaatccaatcccatggaagaaacagatttcaattgggaacaagttttctttttttcattttaaggattcatactttcctttacaaagtggttcaaactctgtaacccatatatttcctcctcaggctcgctgtgttgactaatgggtcaaagtcacatgatttttttcttttt

SEQ ID NO: 1789 - DNA, 1056 bp, Eucalyptus grandis
cgggggtcgacaccgaattactcatctccctctctctcctctctcctgtctctctctctctgtagcgtcgcgtggtctgccgtcgagctccctccgcaatggcgagcagcaatctcccccggcggatcataaaggaaactcagcgtctcctcagcgaaccggctcctggcattagtgcttcaccttcagaggacaatatgcggtattttaacgtgatgattcttggccctacgcaatctccttatgaaggaggagttttcaaattagagttgtttttgcctgaagaatatcctatggctgctcctaaggttaggtttctcacaaaaatataccatcccaacattgacaagcttggtaggatatgccttgacatcctgaaagacaagtggagtcccgcactacagattcgaactgtacttcttagcattcaagcacttttgagtgctccaaaccccgacgatccgctttctgagaatatcgctaagcattggaagacaaatgaggctgaagctgtggaaacagcaaaggaatggaccagattgtatgctagtggtgcgtgatgaagcggaggaaaaacttacctcaattgaaatgattttcacctggtgtgatcttacttactgtggacttctgatggaaatgggaagaaatgctatgccctttgatgttggatattcttgtatattcatacgcagaattaactttgttaatttctgtgttccctgctccttttgttggataattgcagctttatctttctttttaagtatcttatcggtggattagactgaaaattaggtcgttatccttttggaagatcacatagatgtctttttattttctgaaaacaaaaacttgatttgtatactttcagcttctagtagtggtcgatccgtctcagactttcgaacagctttgttgtccagggcttgtacctagaataattttgaatttgatgtacaaaccccctacgcgggcaaaaaccaagcagtgatctcagcgggcaccagaccatttgatttcaaatggccttaaaaagtgaatacaaaaataaaa

SEQ ID NO: 1790 - DNA, 788 bp, Euonymus alatus
cttggtgtatattgcctcaataacgaagaagaagaatctaagtgagttttggcttttaaaagcttttctcttcttcgtcgactgagagtcaatggcgaacagcaatcttcctcgaagaattatcaaggaaacgcagaggcttctcagtgaacctgcaccaggaatcagtgcttctccttcagaagagaatatgcggtactttaatgtcatgatccttggtccctctcagtctccatatgaaggaggggttttcaagttggaactatttttgcccgaggaatatccaatggcagctcccaaggttcgcttcttgaccaaaatttatcatcctaacattgataagcttggaagaatatgccttgatattctgaaagataaatggagccctgccctccaaattcgaacagtcttgttaagcatccaagcactattgagcgctccaaaccctgatgatccactctcggagaacattgcaaaacattggaagaccgatgaggctgaagctgtggaaacagccaaggaatggactcgtttgtacgcaactggtgcatgatgatgggagtgttggtttctcgcaatcatcatttctgctacatatcaatgccaaagcaactgtctaagttggttttaaaattagaatcgaaaaagaagaaaaaaaatgaaagacaaaaaatatcaaagtcgaatattctggagttgtaatgttgtctagctgttcaaaactgcttgctgataacggttttcatgtcttaaaagtacatcgtttgataattgtatgataaatgcgt

SEQ ID NO: 1791 - DNA, 859 bp, Fagopyrum esculentum
ggaaccaaaaccgcctttcaccagacggccacgctctctctctctccattatttcgctcgtcgtggtttttttcctctccttacctctctcctgctccaaccgtacgtccatggctaacagcaacttgcctcgaagaatcatcaaggaaacgcaacggctgctcagtgagccagccccgggaatcagtgcttcaccgtcagaagaaaacatgcggtacttcaatgtcatgatccttggccctacacaatctccatatgaaggaggggttttcaagttggagctgttcttacctgaagaatatccaatggctgctccaaaggttcggttcctcaccaaaatttatcatccaaacattgataagcttggaagaatatgtcttgatattctcaaagataagtggagtccagctctccagatacgcactgtactattgagcattcaagcattactgagtgctccaaatccggatgatcctctttctgagaatatcgccaagcactggaaaacggatgaggccgaagctgttgaaacagcaaaggaatggactcgactttatgcaagtggagaatgaagatgatggaggagaaggtagcttgcctttgatgagaaataattttccttactgacggttgattatctggaaatgttcaaaagaaagtctgaaacaacttccaatcgaaaattacctggagtgtattttattgcctaagagatctacttgaactcatgttattgaaaattgtatatcaacgatgttctgttccaatctaaatctcatttgtcagtgtgtttgatcaaagtaaataagcctgtattgaaccaatatttgttgtgttcgaattatatgtatctcttgaa

SEQ ID NO: 1792 - DNA, 844 bp, Fagopyrum esculentum
cgtcgacaactgacgcaacctcaaaaaaaccctctcagccttctcctctaccttcacaatcgtcctctgatctctcagcctcttcaatgacgaacagcaatctacctcgaaggattatcaaggagacgcaaaggcttctcagtgagccagcccctggaattagcgcttctccttctgaagagaatatgcgctacttcaacgtgatgatcttgggcccttctcagtctccttatgaaggaggtgttttcaagttggagttgtttttgccggaagagtaccctatggcacctcctaaggttcgattcttgactaagatttaccaccctaacattgacaagcttggaaggatatgccttgatatccttaaagataaatggagtccagccctccagatccgtacagtgctgttaagcatccaagctttgctgagtgctccaaatccggatgaccccctctctgagaatgttgccaagcattggaagacaaatgaagccgaagccgttgaaactgcaaaggaatggacccgtttgtacgcaacaggtgcatgaaaaatatggcttgcgacttgtccatctggacctctaaggttggaaggtgaagtttcactttctgaagatgtaaactgtgtcaaacccatcaaaacttctggcttgtagatgatgtggttcagaattgaccatatttgccgtttagttcaaaaatgacattcatttttccaatgatactagaaactgcagggaaattgccttatatttgtccccttgtgtgggttatatgtgtttccgcacaactcatacaaagtggacaaaacttgcaaattaattaatgccagaagtttagaagt

SEQ ID NO: 1793 - DNA, 787 bp, Linum usitatissimum
accgattatctcgaactgtgattcaccggactccggagaagaaaagaaacctcaatggcgaacagtgaccttcctcggagaataatcaaggaaacgcagcggctgctcagtgaaccagcccctggaattagtgcttccccttctgaagaaaacatgcgatacttcaatgttatgattcttggtccaacacaatcaccttatgaaggtggtgtttttaagttggaattgttcttgcctgaagaatacccaatggcacctcccaaggttcgcttcttgacaaaaatttatcaccctaacattgacaagcttggaagaatttgccttgatattcttaaagataaatggagccctgcactccagatccgaactgttttgctaagtatccaagctctcttgagcgcaccaaatcctgatgatcctctgtctgagaacattgcaaagcactggaagtcaaatgaagctgaagctgttgaaacagctaaagaatggagccgcttatatgcaagtggtgcatgaggaggcaagctggagcgtgcaaatgatctatgttgttacattggttaagtgaatttgaaatgtaatgtctgttggttcctaaatgggaaatatgcttcaaggtatgctctgaacactatcagatacatgaatccttaaagagtctcgagtcttgaatccaacagtactctcttttcagtatactggacatgtatcatacagcgtcattggaagcttccctttaattgacttgcgataatgactaattgaattgtgaatgccttcagagcgt

SEQ ID NO: 1794 - DNA, 661 bp, Fraxinus spp
aattcaatggcaaacagcaatttaccccggagaatcatcaaggagactcagcgtcttctcagcgaaccagcaccggggataagtgcatctccatcagaagacaatatgcggtatttcaatgttatgattcttggtccaacacagtctccttatgaaggaggtgttttcaagctggagttatttttaccagaagagtacccaatggctgctcccaaggttcggttcctcacgaaaatataccaccctaacattgataagctaggaaggatatgccttgatattcttaaagacaagtggagtcctgctcttcagattcgaacagttcttttgagcattcaagcacttttgagcgctccaaatccagatgatccactctctgaaaacattgctaagcactggaaaacaaatgaggccgaagctgttgaaacagcaaaagaatggacgcgtttatatgcaagtggcgagtgaagtacacggaactcggagctttgatataacaaaaaacatgtatttgattgaagaaattgatgatgctcaaaccaatgggaatttaaattaatgttctcaaagggtagcattactataagattattcctgcttttgaattctgtaattggagttttataacgagacgagatactcttgttagtgtcttttattc

SEQ ID NO: 1795 - DNA, 849 bp, Panax ginseng
tgcgggaaaggcgccgcctatgtgtgttggtaccccgggaaattcggccattacggccggggaccctgaagcctttccttcctttttttctcaaaactttctctcaaaatcttgttgtttgacttttttgggtaaatcttttgagaagaggaaatggcaaatagcaatctgcctcgaagaataatcaaggaaacacagcgacttctaagtgaaccagctccaggaatcagtgcttcaccttcagaagaaaacatgcgatatttcaatgtgatgatacttggtccaacacaatctccttatgaaggaggggttttcaagttggaattgtttttgcctgaagaatatccaatggcagctcctaaggttcgcttcctgaccaaaatatatcatcctaatattgacaagttgggaaggatatgcctcgatattctcaaagacaagtggagtcccgccctccaaattcgtacagtattgttgagcatccaagcacttcttagtgctccaaacccagatgatccactttctgagaacattgctaagcactggaaaacaaatgaggcagaagctgttgaaactgcaaaagaatggagccgtctgtacgcaactggtgcatgataatgggatatggtagttgccaatatcgtttctgcaaatgtatgttagctgaatgctcccatttgattttatgttgaaatataagaaccaccagcgaaaaactatgaggaatttctctaaaaagatagccctttggcattggatagttaggtcgtaatttctttaagggcatgataaattgtacaatgatgtgaaagctcaatgttcattaatctattgacttttatatgattg

SEQ ID NO: 1796 - DNA, 625 bp, Guizotia abyssinica
gaacagcaatctacctcgaagaatcatcaaggaaactcagcggttactcagcgaaccagctccggggataagcgcatcaccgtctgaagataatatgagatattttaatgtcatgatccttggtccaacacagtctccttatgaaggaggagttttcaagctggagttgtttttgccagaagaatatccaatggctgctcccaaggttcggtttcttacaaaaatctaccacccgaacattgacaagcttggtaggatttgtcttgacatcctcaaagacaaatggagccctgctcttcagattcgcactgtactcttgagcattcaagctcttctaagtgctccaaatccggatgacccgctctctgagaacatagcaaagcactggaaatctaatgaagctgaagctgttgaaacagcaaaggagtggacccgtttgtatgctagtggcgcctaacggagatgcgggtcgttatgtttgaaaaaaataacagtgtatttggttaggtcttcaaatttaagacatgaatgctgcaatgttgttcacttctttgtgttttcgagttttttttttgtattgtgaaaacattcatctgggtaactatgtgaaatagtgtggataaag

SEQ ID NO: 1797 - DNA, 744 bp, Heritiera littoralis
ttttgttttcccttttgattcatcaattgatcatcgccaatggccagtagtaatctccctcgaagaatcatcaaggaaacccagcgtctgctcagtgaaccagcaccgggaattagtgcttcaccatcagaggataatatgcgatatttcaatgtgatgatccttggtcccacacagtctccatatgaaggaggtgttttcaagttggaactatttttgcctgaagaatatccaatggctgctcccaaggttcgatttcttacaaagatatatcaccctaacattgataagcttggaagaatatgccttgatattctgaaagacaaatggagtccagctctccagatccgaactgtacttttgagcattcaggcacttttgagcgcaccaaatcccgatgatccactctctgagaatattgctaagcactggaaaactaacgaggctgaagccgttgagacagcaaaggaatggacccgtttatatgcaagcggtgcatgaagactggtgggaaagtttggccacttaaaataacatcttatgcaatgtaagctattcaatgtcaatttgatatggaaatttggcagaacggatgtttgaaagtgtttgatattcgcaaagattggagttgctaccttttaaatcgtattcctgttggaaacagtctctgaacttgtatgataatatacattgttctctaaaactctcacatgctcaactcaaatatagctattaagattctgg

SEQ ID NO: 1798 - DNA, 837 bp, Mesembryanthemum crystallinum
gctcttctaaagctcccaatcctctccattttctctctcctctctctctctctctctctctctctctctctctctcaagtctgatcgctcgcccctttcttcttccttagcggctacttttctcctccatctcacactttcaatggcgaacagcaatctacctcgaaggataatcaaggagacgcaacggcttcttagtgagccagctcctggaattagtgcctctccatctgaagaaaatatgcggtatttcaatgtcatggttttgggtccttctcaatcaccttatgaaggtggggttttcaaattagagttgtttttgcctgaagagtacccaatggcacctccaaaggttaggttcttgaccaagatttaccaccctaacattgataagcttggaagaatatgcctagacattcttaaagataaatggagcccagctctgcagatccgaaccgtactattgagcattcaagctcttttgagtgcccccaatccagatgatcccctttcagaaaacattgcaaagcattggaagactaatgaagtcgaagctgtggaaacagcaaaggaatggacacgtttatatgcaacaggtgcttgacagcggcacttacattgcttcaattgcagttctgcattgtactttaaaacctgaatgattgcctgctggatttaacggaaatggcaaaaaaaaagaaaaatggcgttttactatttggatgttaacctgaagccctccaattgctggttgtagatgattctcataaaagaaatgttgtagtcttgtactgccttcagaatttgtaatatgcttatttcccctaatttgtcttc

SEQ ID NO: 1799 - DNA, 811 bp, Ipomoea batatas
aaaaaccatagtggaactcgcgcctgcaggtttgcactagtggctccaaagaattcggcacgaggcctcgtgccgaattcggcacgaggggtaagtctccaattctcaacttcttcaccctcaccccgcttgcgtaaacattccgacccaaagaatcttgcgattcacttcaattcaatggctaacagcaatctccctcgaagaatcatcaaggaaacacagcggctccttagcgaaccagccccgggaataagtgcatctccatcagaagacaatatgcggtattttaatgtgatgattcttggtccgacacagtctccttatgaaggtggtgttttcaagctggaattgtttttgcctgaagagtacccaatggctgctccaaaggttcggttcctcaccaaaatctaccaccctaacattgataagcttggaaggatctgtcttgatattctcaaagacaagtggagtcctgctcttcagattcgtactgtacttttgagcattcaagcacttttgagtgctccaaatccagatgatccactttctgaaaacattgcaaaacattggaagacaaatgaggttgaagctgttgaaacagcaaaagaatggactcgcctttatgctagtggtgcctgaactttgccaatgaagcactttgaaataacaaaatgtgcaatgtactctattaactgttgaattaaaatggggtgccactagaaatgatcatgtttggaacaaaccaaaaatattgtttgaactatttagtcattcaagttactgctagataattgtttccccaaccctcgaa

SEQ ID NO: 1800 - DNA, 859 bp, Ipomoea nil
gaaagtttcaatcaaaccctttggtaagtctccaattctcaacttcttcttcattccgcttgcgtaaacgttccgacccaaagaatcttgcgattcacttcaactcaattcaatttcaatggctaacagcaatctccctcgaagaatcatcaaggaaacacagcggctccttagcgaaccagccccgggaataagtgcatctccatcagaagacaatatgcggtattttaatgtgatgattcttggtccgtcacagtctccttatgaaggtggtgttttcaagctggaattgtttttgcctgaagagtacccaatggctgctccaaaggttcggttcctcaccaaaatctaccaccctaacattgataagcttggaaggatctgtcttgatattctcaaagacaagtggagtcctgctcttcagattcgtactgtacttttgagcattcaagcacttttgagtgctccaaatccagatgatccactttctgaaaacattgcaaaacattggaagacaaatgaggttgaagctgttgaaacagcaaaagaatggactcgcctttatgctagtggtgcttgaactctgccgacgaagcactttgaaataacaaaatgtgcaatgtactctattaactgttgaattaaaatggggtgccaagaagtgatcatgtttggaacaaaccagaattattgtttgaactatttagtcattcaagttactgctagataattgtttccccaaccctcgaaattttattgtatcaactataatataaaggctcaccaagggttacggacccttgaaatgcgtccattttccggccggtgagtcctttgttaaatttgtaatgatgatata

SEQ ID NO: 1801 - DNA, 785 bp, Actinidia deliciosa
aagtctcaattcacaaaccatcagcttctctctccatttattctctctccatttattatctatcaaacccttagcgtactctccaatcgaaccttgtacaatggcgaacagcaatcttcctcgaagaatcattaaggaaactcaacgtctcctcagcgaacctgcaccgggaataagtgcatcaccttcggaagacaatatgcggtattttaatgtcatgattcttggtccggctcagtctccttatgaagggggcgttttcaagcttgaactgttcttgcctgaagaatacccaatggctgctcccaaggttcggtttctcaccaaaatctaccatcctaacattgataagcttggaaggatatgcctcgatattcttaaggacaaatggagtcctgcccttcagattcgaactgtacttttgagcattcaagcacttttaagcgctccaaaccctgacgatcccctctctgagaacattgcaaagcattggaagacaaatgaagctgaagccgttgaaacagcaaaggaatggactcgtctatatgcaagcgatgagtgatatgaagtggtgatggtgaagtttctccgaaatgacagaatatccaagttatcttatttaaccgttgaatttaaatcgaaatttgtaagatttgatgtggtgggatgattggaattgggtacccctcgttttgaaacctcgtcatgaaattgtatgataattagataagatgctcatgtgcttcctctaatggtagaattttaaattattcaaaaaaaaaaaa

SEQ ID NO: 1802 - DNA, 828 bp, Liriodendron tulipifera
gtttctcggtgctctctttttcaggactcttttgcagagaaaacgagggttttacctctccttttccaaatctcaaatcgaatggctaacagcaatctaccccgtcggattattaaggaaacgcagcgtctcctcagcgaacctgctcccggtatcagtgcttctccatctgaagacaatatgcgttatttcaatgtcatgattctcggccccacgcagtctccttatgaaggaggggttttcaaattagaattatttttgcctgaagaatatccaatggccgctccaaaggttcgctttctcaccaagatttaccaccctaacattgacaagcttggaagaatatgccttgatatcctgaaagacaaatggagtccagctctccagatccgaactgtgttgctgagtattcaagcactcttgagtgctccaaacccagatgaccccctctctgacaatatagctaagcattggaagacaaatgaagctgaagctgtggaaacagcaaaggaatggacccgtcaatatgcaagtggggcgtgatgtggggcacgatggactgctgttctcggctaataacatgtctactgtgtaagttacagggttccaccatctactttacagggaaatgcaagtgtgaattgaatgtcggaaatatgaactgtaaaagattgatccttagcaagctcttcagttaccttctgcctctgctttatccattttccttctctcaagccgtgtctttgctttcagtatgattagataaaggtctgctactattttctttccttaattttctactaataggaagaagctctgcttgttggt

SEQ ID NO: 1803 - DNA, 937 bp, Elaeis guineensis
cggaaagctttataaaccccaaccaattgcccaggaccggcttccttcgtactctctctttctctaaaggcattcgcttctcctcactttcgtctcgtccttcgatccccccaaacgagagaagcgaaaccctagctccggccccggatggcgaacagcaatctacctcgccgaattatcaaggaaacgcagcgcctcctcagcgagccagctcctggcataagtgcctctccatcagaggacaatatgcgctattttaatgtgatgattcttggaccgacgcagtctccatatgaaggaggggttttcaagcttgaattgttcttacctgaagagtatcctatggctgccccaaaggttcgctttctcaccaagatttaccatcccaatattgacaagcttggaagaatatgccttgatattcttaaggacaaatggagtccagctcttcagattcgaactgtactgctgagtattcaagcgcttcttagtgctccaaacccagatgacccactttctgacaacattgccaagcattggaagaccaatgaagctgaagctgtagaaacagccaaggaatggacccgtctatatgccagcggggcatgacaacattgcagcagttgtgtgctcgtaataacttgtccactttggaagttgattcagccattgcttgcttttaacaatgaaatggaagtctcggatgatgctactttcaaatgttaatccttccaagctcctattatactatatgatgtaaatcacttcgttgggctgaagccaccttttcatatatttgtatcactagtcgaagtttgttgtttttcactcttgtgtgagcgcaaagaagattaagtttcatggtgcattttaccatttttgatgttttaaaacagcagatattagaacttaaaaaggcagtttgcttgtgagtgtt

SEQ ID NO: 1804 - DNA, 816 bp, Orobanche aegyptiaca
agaaaaaacccttactgttagcgtaaaatctccgactcgagggaagaaaactagctccggcgaattcgattcaatgtctaacagcaatttaccgcgtagaatcatcaaggagacgcagcgtcttctaagcgaaccagcaccaggaataagtgcatctccatcagaagaaaatatgcggtatttcaatgttatgattcttggtccaacacagtctccttatgaaggaggcgtctttaagctggagttgtttttacccgaggaataccccatggctgccccaaaggttcgcttcctaactaaaatttatcaccctaacattgacaagcttggaaggatatgcctcgatattcttaaggacaaatggagtcctgcccttcagattagaactgtactgttgagcatacaagcacttctaagtgcgccaaatcccgatgacccgctctctgaaaacgttgcaaagcattggaaatcgaacgagtctgaagctgtggatacagctaaagagtggacgcgtttatatgcaactggtgcttgagtaactaaaatttgtattctattagtccatggagtaaacatgggaaaaaaattggaaaaatgaagactctccagggcttggttttcaaactctttttcgtgtgtgtgtgtgtgtatgtgtgttttggacttgttaaaaacgtgcacagattataattaaatgcacttaagttacggtcttgttattcggtagtctttgaattgtagattttttttctttgatgttagcaatttacttctatttcattttgggtaaagcatttctgcccgattttaaagttt

SEQ ID NO: 1805 - DNA, 1297 bp, Pinus taeda
tgcatcactttaaaacctgcctctttaacgaaaaatggtttttaagggatagcgaaggcaaaatcaaaagctcaagagatgctcgtggggaggtagcgaccgaatgtaatccatagcgtcacgggaacgcaagtatagcaaatatattcacatcacttttcgctggagtgcaaaccacttctatataggtatttataacaacacccgttgaagctctatgtagccctgccctgttctcggcgagcggtacgagttgagccgtggtctccaagcaatccagtctgtctgttcctccattccttccgccagaggaggggaatcaagaaacagccggggttcgatctttgcatctctctctcccgcttgcactcaccagcgatggccaacgccaatctacctcgcagaatcatcaaggaaactcagcgcttactcagcgagccggccccgggaatcagtgcatctccctcagaggaaaacatgcgatacttcaatgtgatgattcttggacctactcagtctccatatgaaggtggtgttttcaagctggagctattcttacctgaagaatatccaatggctgctccaaaggtccgatttttgacaaagatataccatccaaatattgacaagctaggtcggatatgtctagacattctaaaggataaatggagccctgctcttcaaattcgaacagttttgctgagcatccaagcattgttgagtgctcccaatcctgatgatccactttcagaaaacattgccaaacactggaaagcaaacgaagtcgaggctgtggaaacagccaaggaatggacaagactttatgcaagtggtgcctgacagtgtttcgaggcttgtttctttgaataacacgtttgtaatgtgcaagctgtcatcccattggtatcagacatggacttttcttaaattgttagcgaatattcgtgtatcatgttctttggtaacagagaatatggtctgacaagaccatgttgattggtatgtcagtcaaagaatgacatagcaactggcactagcaacattatgatatttgtagaatttgtttatgtaaagttcctacggtatgcgatgttaaggaaagaaatctggtataacagtagtgtggaagtttttcacgtagcagtacgtggaaccatggaacttttcttgtcacagttttctaaagttgaaagtcccctctaaaaaattcctttactcttgtttagggtgatttcttgtgaaagcgtcagtcctaattttgatgttaatttgttttgctataaagatgaatttccat

SEQ ID NO: 1806 - DNA, 888 bp, Plantago ovata
tcatttgttctgttcacccaaatcttttctactttttctccattgtcccttcttcttcaacaatcatccatggcgaatagcaatttacccagacggataatcaaggaaactcaacggctcctcagtgaaccagctcctggaatcagtgcctcaccctcggaagagaatatgcgctattttaatgtgatgatacttggcccaagccagtctccttatgaaggaggtgtattcaaactggaacttttcctaccagaagaatatccaatggcacctcccaaggtccgcttcctcactaaaatataccatccaaacattgacaagcttggtaggatatgccttgatatattgaaagataagtggagtccagccctccagataagaactgtattactgagcattcaagctcttcttagtgcaccaaaccctgatgatcctctttctgagaatattgctaagcactggaaatcaaatgaaactgaagctgtcgaaacagccaaggaatggacccgctcatatgcaaccggcgcttgatacaaaaactgtcacctttgtcatgtaaacctctcaacctttacaatgatctttctttataaggtgaaaggaagtgttggctgtatacaataagcaatctgtaggattgttcatcttgtctatgagatctttagcggtgcattctcatagagtgctcgcatagtcgcatctgtacaatattccatgtaagttttagcatgcttattcagtactactatctgcaagttctgcttctggtgttacatatttctcaagtttaatgtgaatgtatcaagatgtatatgtactcgatcggtatggattgccctattaaaacttggctaattggaagaaatgtacatagggaaaaaaaacaaa

SEQ ID NO: 1807 - DNA, 934 bp, Populus trichocarpa
ccatctaccaaacaacgccttaaaatagtttcaacgtatcgtgttccgtgagagaataagcaaaaaaaggaaaggaaagctcttctctctcgctctaaaaaacccttaagaaaagtagcgtggtttgcaatcgacctcgagaacaaaatggccagcagtaatctccctcgtagaatcatcaaggaaactcaacgtctcctcagtgaaccagctccaggaattagtgcttccccatcggaggataatatgcgatattttaatgtcatgattcttggcccaacacaatctccgtatgaaggaggggttttcaagctggaattatttctgcctgaagaatatccaatggctgcgcctaaggttcgatttctgaccaaaatataccatcctaacatcgataagcttggaaggatatgccttgacattctgaaagacaaatggagtcctgctcttcagatacgaactgtgcttttgagcatccaagcacttcttagtgctccaaaccctgatgatccactttctgagaacatcgcaaagcattggaaaacgaatgaagcagaagctgttgagacagctaaggagtggacccgtttatatgcaagtggtgcatgattgcatggtggaaacttgccttcaaatgacaggggatgtatgcttttgacttgatttgaaaggaaatttggaagaaacgatgtttgaacaagctgtagtctaatatttttcaaagcttccagatactttttgttaaattgttttgctgtcggaagcatcgtctttgtgattgtatgatcagataagatacgttattcatctcagtgtcactctgcagctatctcaatcccttagcaattggaaatttcatgaattttacctcgagaatctgaaccctggtagtcacgataaataaaaaaaccaatgtgcatgagcatagagtgtc

SEQ ID NO: 1808 - DNA, 991 bp, Populus trichocarpa
aaaatgtggaaaggcttgttataaaaagccccctctcccaagaagcaagccatctaccaaacaacgccttaaaatagtttcaacgtatcgtgttccgtgagagaataagcaaaaaaaggaaaggaaagctcttctctctcgctctaaaaaacccttaagaaaagtagcgtggtttgcaatcgacctcgagaacaaaatggccagcagtaatctccctcgtagaatcatcaaggaaactcaacgtctcctcagtgaaccagctccaggaattagtgcttccccatcggaggataatatgcgatattttaatgtcatgattcttggcccaacacaatctccgtatgaaggaggggttttcaagctggaattatttctgcctgaagaatatccaatggctgcgcctaaggttcgatttctgaccaaaatataccatcctaacatcgataagcttggaaggatatgccttgacattctgaaagacaaatggagtcctgctcttcagatacgaactgtgcttttgagcatccaagcacttcttagtgctccaaaccctgatgatccactttctgagaacatcgcaaagcattggaaaacgaatgaagcagaagctgttgagacagctaaggagtggacccgtttatatgcaagtggtgcatgattgcatggtggaaacttgccttcaaatgacaggggatgcatgcttttgacttgatttgaaaggaaatttggaagaaacgatgtttgaacaagctgtagtctaatatttttcaaagcttccagatactttttgttaaattgttttgctgtcggaagcatcgtctttgtgattgtatgatcagataagatacgttattcatctcagtgtcactctgcagctatctcaatcccttagcaattggaaatttcatgaattttacctcgagaatctgaaccctggtagtcacgataaataaaaaaaccaatgtgcatgagcatagagtgtcttggatat

SEQ ID NO: 1809 - DNA, 895 bp, Populus trichocarpa
agagtttcaatatatttttttatttcgtgtttagtgagagaatctgttaaaagaacagaatagaaaagaaaaactctttctctctctaagaaaacccttgagaagagtagcgtcgtttgcaatcgacctccacaacaaaaatggccaacagtaatctccctcgtagaatcatcaaggaaactcaacgtcttctcagtgaaccagctccgggaattagtgcttcaccttctgaggataatatgcgatattttaatgtcatgattcttggcccaacgcaatctccatatgaaggaggggttttcaagctggaattatttctgcctgaagaatatccgatggccgcaccaaaggttcgatttctgacgaaaatataccatcctaacatcgataagcttggaaggatatgccttgacattctgaaagacaaatggagtcctgctcttcagatacgaaccgtacttttgagcatccaagcacttcttagcgccccaaaccccgacgatccactttctgagaacattgcaaagcattggaaaacgaacgaggtagaagctgttgagacagctaaggagtggacccgtttatacgcaagtggtgcatgattatgtaaacttcccttcaaatgacatgggatgtatgctattgacttgatttgaatggaaatttggaagaaatgatgtttgaacaagttataatctaatatttttcaaagcttccagatgctgcatgttaaattgttctgttgttggaaacatgtctttgtgaacttgtatgatcagataagatgtgttatttgtatctccgtgtcgctctgcatctgtctcaatctctcaaatgcaaattttattaactttaccttatcttgaagaatctgaaccctggtagctatggtaaa

SEQ ID NO: 1810 - DNA, 943 bp, Populus trichocarpa
tgaaaggtatctttaaattataaaaaagcagcaacagcttgcatataaagagtttcaatatatttttttatttcgtgtttagtgagagaatctgttaaaagaacagaatagaaaagaaaaactctttctctctctaagaaaacccttgagaagagtagcgtcgtttgcaatcgacctccacaacaaaaatggccaacagtaatctccctcgtagaatcatcaaggaaactcaacgtcttctcagtgaaccagctccgggaattagtgcttcaccttctgaggataatatgcgatattttaatgtcatgattcttggcccaacgcaatctccatatgaaggaggggttttcaagctggaattatttctgcccgaagaatatccgatggccgcaccaaaggttcgatttctgacgaaaatataccatcctaacatcgataagctcggaaggatatgccttgacattctgaaagacaaatggagtcctgctcttcagatacgaaccgtacttttgagtatccaagcacttcttagcgccccaaaccccgacgatccactttctgagaacattgcaaagcattggaaaacgaacgaggtagaagctgttgagacagctaaggagtggacccgtttatacgcaagtggtgcatgattatgtaaacttcccttcaaatgacatgggatgtatgctattgacttgatttgaatggaaatttggaagaaatgatgtttgaacaagttataatctaatatttttcaaagcttccagatgctgcatgttaaattgttctgttgttggaaacatgtctttgtgaacttgtatgatcagataagatgtgttatttgtatctccgtgtcgctctgcatctgtctcaatctctcaaatgcaaattttattaactttaccttatcttgaagaatctgaaccctggtagctatggtaaa

SEQ ID NO: 1811 - DNA, 974 bp, Papaver somniferum
ctgaagctctctttccgaaaagggatacgaaatttccccaaattccattccatcgaatccaaatcaaaccctcgattttttctttctctgttacaaaacagagagagaccgaacctatttcactctctctgtctcaagcttctcaatttattctctaaaaatggcgaacagtaatctaccacgaaggattatcaaggaaactcagcggctactcagtgaaccagctcctggaattagtgcttctccttcagaagataacatgagatattttaatgttatgattcttggtccaacacagtctccatatgaaggtggggtttttaaattggaactatttctgcctgaagaatatccaatggctgcgcctaaggtccgctttctaactaaaatttaccatcccaacatcgacaagcttggaagaatatgtcttgatatcctgaaagacaaatggagccctgccctccagattcgtactgtgctactaagtattcaagcacttcttagtgccccaaacccagatgatcctctttctgaaaacattgccaagcactggaaggcaaatgaggcagaggcagttgaaacagccaaagaatggactaggctatatgccactggtgcatgacaatgtggcaacatggagttattggttttggagtgttggtggctgttataagagaataacgtataatgcaatgtcattcagatggttgataattcccaaaaaaaaaaaaaagtaatcagatgcttgttcttatattaaaacaaagaagtttaccccaattaaccgaaaagatcaaatatgacaattcaattagatatgtaatgaatttagattgtacttggttttctttttgttgcagttgtaattgccaatgtgatttaatgtctccgttgaaactccttcaggaaattgttctgtatgaaaaatgtaactgcatatgtccatcagtgattctgccaatgattcctgttta

SEQ ID NO: 1812 - DNA, 832 bp, Prunus persica
gcagaggcgagttgcaaaattgaagctttcgttcgaagttaaaaaccatattaccaatttaccagatctccgttttcttctgagtcttctgagtcttcttctcttctgcatctctgtgtttccgcgtctggaatagtaatttcccaaagagaagaagagacttgatggcgaacagtaatctccctcgaagaattatcaaggagacgcagaggcttctcagtgaaccggctccgggcattagtgcttctccttcagaagaaaacatgcgatattttaacgtaatgattcttggtccagctcaatctccttatgaaggtggggttttcaagttggaattgtttttgcccgaagaatatccaatggcacctcccaaggttcgtttcctcaccaaaatatatcatcccaacattgataagcttgggaggatatgccttgatatcctgaaggacaaatggagtccagccctccaaatccgaacagtattgctgagtgtccaagcacttctgagtgctccaaacccggatgatccactttccgagaacattgcaaagcactggaagacaaatgaagcagaagctgttgaaacagcaaaggagtggacccgtttgtatgcaagtggtgaataatgacgagagcttattgctcagaatttcatttttcgattgcatgttgaacaaaatgtatgcctttagtcttataacatatgtactactaaacatggagattttcaagcccatcagtccttgttgataatcactttcattctcctcaaaggctagcttaaactttgttcgaccataatgccaagatagatctcaattgctattttttg

SEQ ID NO: 1813 - DNA, 1055 bp, Pseudotsuga menziesii
cgtcctcttctcgtcgagctgtacgattttagccctggtatccagacagtccactctgtctgttcgtccatcattctgtctgaggaggagaaggagaatcaataacgtgttggggttcgatctttgtatttctttcttccgcttgccctcaccagcaatggccaacgccaatctacctcgcagaatcatcaaggaaactcagcgcttactcagcgagccggcccctggaatcagtgcatctccttcggaggacaacatgcgatacttcaatgtgatgattcttggacctactcagtctccatatgaaggtggtgtttacaagttggagttattcttacctgaagaatatccaatggctgctccgaaggtccgatttttgacaaagatatatcatccaaatattgacaagctaggtcggatatgcctagacattctaaaggataaatggagtcctgctcttcaaattcgaacagttttgctgagcatccaagcattgttgagtgcacccaatcctgatgatccactttctgaaaacattgctaaacactggaaatcaaatgaagctgaggctgtcgaaacagcgaaggaatggacaaggctgtatgcaagtggtgcgtgacacagttttgaggcttgtttatttgaataacacatgtgtaatgtgcaatttctcatcccattggcatcagacttggttttttcttaatttattagtgaatattcatgcatcacgtactttggtaacagagattatggtcttaccagaccatgttgattggtatgtcaatcaaagaatgacatagcaactgtcactgcaacattataatatttgtagaatttgttaatgtaaagttcctacagtatgctatgttacgaaagaaatctggtattacaatctagtgtggatgttttcacctagcgataggtggaacttttctcgtctcaattttcagaagttgaaagtccgctctttagtcatgcttagcaactgtcactgcaacattataatatttgtagaatttgttaatgtaaagttcctacagcatgctttgtta

SEQ ID NO: 1814 - DNA, 898 bp, Raphanus sativus
gaaatatacaataaactatagctagagaagtcatagcagcacgtcagaatcgaagaagacgagccgaagtgttcttctcgatcatctctctcaaaaaaaaacccgaactctgatcgatccaactcaccagcgcgagttaatggccaacggtaatctaccgagaagaatcataaaggaaactcaacgtctgctcagtgaaccggctcccggtataagtgcatcgccatctgaggataacatgaggtacttcaacgttatggttcttggtccttcacaatccccttatgaaggaggggtttttaagttggagctctttttgcctgaagaataccccatgtcagctcccaaggttaggtttctcaccaagatataccatcctaacattgataagcttggaagaatctgtcttgatattctgaaagacaaatggagccctgctctccaaatacgaacagttctcctaagtatccaagcccttctaagtgcaccaaaccctgatgatccattgtctgagaacatcgctaagcattggaaaactaatgaggccgaagctgtggagacagctaaggaatggacccgtctttacgcaagcggggcatgatggattggagagtgaaaagaagatctcattcatccaaaataacatcaaagttataaaaggcttatattttgctgcttgtcctcccctcataatggtaaaaatgtgtgttttttcggcacatggagttgtaatctctctcaaaatattgtatcattaccagtagggttaagaatcatttacctatagttgaaactttgccaagcttggttgaatcaaactatcttctctactttataaggctattgtattgtagtacataagtttggtcggaaaaagaataacaagaagagcttgaca

SEQ ID NO: 1815 - DNA, 768 bp, Carthamus tinctorius
gcgggggagcagaggtgagatccaaatcttctctttcttccttctcaaaaaaggcaaaacctcctttgtagcgtgatttctactcttccatggcgaacagcaatctacctcgcagaatcatcaaggagacgcagaggttgctcagcgaaccagctccggggataagtgcatcgccatcagaagagaacatgcggtattttaatgtcatgatccttggtccatcacagtctccttatgaaggaggagtttttaagctggagttatttttgccggaagaatatccaatggctgcccccaaggttcggtttcttacaaaaatataccatcctaacattgataagctcggcaggatatgtctcgatatacttaaagacaaatggagccctgctcttcagatccgcactgtactcctgagcattcaagcacttttaagtgctccaaacccagacgatccgctatctgagaacgtagcgaagcactggaaaactaacgaggctgatgctgtcgaaacagcaaaggaatggacccatttgtacgctagtggcacctaaagcagggtcacgcccccgcccaccatgttgcttctgagaagataacatgtattatatttacatattgatccctgaaaatgtgagcaactggggaaaaaaatttcatccctttgctgctaaccctggatgataaattgttgttaaccttcgatctttcgagataagttactcatgttctatttcttattgttaagatcacaaaatgtttatcgaaaaa

SEQ ID NO: 1816 - DNA, 774 bp, Salvia sclarea
ctactagaccttggctgtcactcaaaaagaaccattaccaattttctagtgagagaaaataaagaaaaaccctttttggttagcgtaaactctccgactataagagagccgacggaagaaaaaagttctgctgcgaattcaatccaatggccaacagcaatcttccgcgtcgaatcatcaaggagacgcagcgtcttctgagcgaaccagcaccgggaataagtgcttctccatcagaagacaatatgcgatacttcaatgttatgattcttggaccaacacagtctccttatgaaggaggagtttttaagctggagttatttttacctgaagaatacccaatggctgctccaaaggttcgcttcctcactaagatttaccaccctaacatcgataagctcgggaggatatgcctggatattctcaaggacaaatggagccctgctcttcaaattagaaccgtgcttttgagcattcaagcacttttgagtgctcctaatcctgatgaccctctctctgaaaacattgctaagcattggaaatcaaacgaggttgaagctgttgaaacagctaaagagtggacgcgtttatatgcaactggtgcttgaaattacatggacccgagtttccttaaataactcaattgtattctactgcacatcaaaggaacatggaaaatctggaagattgatgaatgctgaaaaccagtagtgtctttgtatcagtcctgtttaaactgtcgtttgaattgttcgattttataaaagcactttg

SEQ ID NO: 1817 - DNA, 807 bp, Sarracenia psittacina
aaatcgctgctttattctccctcgttgtcaaacggactgtaagccatttccccttcccaccgaacttcgcgttttggtttcttaaagctcgacgatcgcttctctttctttatccctttgaactgtgtggaaccagcgaccaatttccggcgttccttgaactccgacaacgaatcgaatggcaaacagcaatttgcctcgaaggatcatcaaggaaacacagcggcttctcagcgagccagcgccgggaatcagtgcttctccttcagaagataatatgcgttacttcaacgttatgatacttggtccaacacagtctccatatgaaggaggagtattcaagttggaattgtttttacccgaggaatatccaatggcagctcctaaggttcgcttcctgaccaaaatataccatcctaacattgataagctgggaaggatatgccttgatattcttaaagacaaatggagtccggccctccagataagaactgtactgttgagcatccaagctctcttaagtgctccaaatccagatgatccactttctgagaacattgcaaagcactggaagtccaatgaagctgaagctgttgaaacagcgaaggaatggaccagtttatatgcaactggtgcatgatgatcggactctctcacttccgaatatcgtttttctccttgtattttaaatgaatggttgcctttggccttgcaatgaatatggcaagaattgtttaggaacaatcaagatgttgcatttttcaggtatttcggttctatttctgcaattctatgaaattttagtat

SEQ ID NO: 1818 - DNA, 863 bp, Scabiosa columbaria
ggaaatttatgcaccttacctttttcgttcatctacattctattctacaccttaatattaagccaagaaaaagaagaagaagaagaatatttagagctcaagctttaaaccctcgacgatcaacctcaatctctcttaatctccacaaaactttcttctttgacttttttccaatggcgaacagtaatttacccagaaggatcatcaaggaaacacagcgacttctcagtgaaccagctcctggaattagtgcttcaccttctgaagataacatgagatattttaatgtgatgatacttggcccaagtcaatctccttatgaaggaggggttttcaagttggagttgtttttgcccgaagagtatccgatggcagctcccaaggttcgattcctgaccaaaatataccatcctaacattgataagctgggaagaatatgccttgatattctcaaggataaatggagtccagccctccaaattcgtacagtattgctgagcatccaagctcttcttagcgctccaaatcctgatgatccactttccgagaacattgcgaagcactggaagagcaatgaagctgatgctgttgaaactgcgaaagaatggacccgtttgtatgcaactggtgcttgacgatggtgtgtttgcggcttcctgaaaatgtatggcgagttcattggctgtttatgtttggtttttatactgaaaatgaaagtaatcagtgtacaagtctggttacttgatagccctttagtactgactggcaactatccttcttctcccttttaaggggcatttatatttgtacaatgatacaaagcttcatgtcaaacttatttcagcttttacttttctctgctg

SEQ ID NO: 1819 - DNA, 816 bp, Silene vulgaris
tttgtgagaacaaatccccaaaacacctcaaattctctctctagattctctcaaaatttctctcacttcgaactcgaatcttcaaacctcacaagtcgcaccttaagctctccttcaatggcgaacagcaatcttcctcgaagaatcatcaaggaaactcagcgtcttcttagcgaaccagctccgggtatcagtgcatctccatcagaagaaaatatgcgctactttaatgtaatgatccttggcccttctcaatctccttacgaaggaggagtcttcaagttggaattatttttgccagaggagtatccaatggctgctcctaaggttcgatttctcaccaaaatttatcatcccaacattgataagctaggacggatatgccttgatattctcaaagacaaatggagtccggctctccagatacgtactgtactcttgagtatccaagctctcttaagtgctccaaatcctgacgaccctctctcggagaacattgctaagcattggaaaactgatgaggctgaagctgttgaaaccgctaaggaatggactcgtctatatgcaagtggggagtaatcggatggcgaaaaacactaccctctttaaataacactggcgtgatgtttcttatgactgttaattctggaattaaccttcgggtttagttaatgaatctcaagttataatccgtagatgatatgatcgaatgtgagtaatgataatcgtctagcatcttattgtcccttttcactatcctatacatcagtgacctatggtatgctatccttgaagttgtataatctaatgagagtt

SEQ ID NO: 1820 - DNA, 1010 bp, Sorghum bicolor
cgcaaatgtcagggaccaggctgcacaccccaacccaagagcaagcaaacgacaattctcttctcatccccaccagcgccgccgccccccaatctttcgctgccgccgccgtgatccaaaggaccaccggaccctagtctgaatcccttcatccgttccccatggccaacagcaacctcccccgccgcatcatcaaggagacgcagcggttgctcagcgagccagctccaggaatcagtgcctcgccatcagaggagaacatgcgctacttcaatgtcatgatccttggaccatcgcagtcgccatacgagggaggagttttcaagctcgagttattcttgcctgaagaatatccaatggctccaccaaaggttcgttttctcacaaaaatttatcaccctaacattgacaagcttggtaggatatgccttgatattttgaaggacaagtggagtcctgcccttcagattcgaacagttttattgagcatccaggcattgcttagtgctccaaaccctgatgacccacttgccgacaatgtggcaaagcactggaaggctaatgaagctgaagctgtagaaacagctaaagagtggacccgtgtatatgcaagcggagcttgatctttgcatgaagcatgcttgcctggtaagaaatttcgttccgtggatctgcggaggtggaggtgaacttgatcaacgattggttgctgaaattggaaatcgaaatgattgagtgaattgtggatttccaaatatcctttgatgatgcgtgtcaagagtctgatgtacattactctagttgagctgtgatgatgaaccctcatgcatgtaaattgtttctttggtacgtctggttcctgagagacatcagacatatatgataataaatatcctagaatgatgtatgcctgcccttattttttttgaattaccttctgcatatttttaacatccagaaatctaaggaaattatatttaatataatatgcaatattgtggcctcctaac

SEQ ID NO: 1821 - DNA, 1288 bp, Picea glauca
ggatatatcactttaaaatctcaatacctctttaattaaaagtttgaggaccagtaaagggaaaatcaaaagctcaagagatgcccgtgcgtagcgaccgaatgtaactcatagcgtcacgggaacgcgagtcgagcaaatatattcacaccacttttctctgaagtgcaaacgacttctatatatatatatatcagaaataccggttgaagctagctcaagtagccctgccctgccctgctctgccccctcatcttctcgtcgatctgtacgattttagctgtggtttccaggcagtccagtctgtccgttcgtccattcatttcgccagaggaggtggagattcaagaacgagcaggggtttgatctttgtatctctgtctcccgcttgccctcaccagcaatggccaacgccaatctacctcgcagaatcatcaaggaaactcagcgcttactcagcgagccggcccctggaatcagtgcatctccctcggaggacaacatgcgatacttcaatgtgatgattcttggacctactcagtctccatatgaaggtggcgttttcaagttggagttattcttacctgaagaatatccaatggccgctccaaaggtccgatttttgacaaagatataccatccaaatatcgataagctaggtcggatatgtctagacattctaaaggataaatggagccctgctcttcaaattcgaacagttttgctgagcattcaagcattgttgagtgcacccaatcctgacgatccactttctgaaaacattgctaaacactggaaaacaaatgaagctgaggctgtggaaacagcaaaggaatggacaaggctgtatgcaagtggcgcgtgatagtgttttgagacttgtttctttgaataacacatttgtaatgtgcaagctgtcatcccattggtatcagacatggatttttcttaatttattagcgaatattcatgtatcatgtactttggtaacagggaatatggtctgaccagaccatgttgattggtatgtcagtcaaagaatgacatagcaactgtcactagcaacattatgatatttgtagaatttgtttatgtaaagttcctacggtatgccatgttaaggaaagaaatctggtataacaatctatagtgtagaagttttcacctagcaataggtgaaactttccttgtcacagttttcaaaagttgaaagtcccctctaaaaagtccttactctaacttagggtgatttcttgtgaaagcgtcagtcctaattttgatgtcaatt

SEQ ID NO: 1822 - DNA, 873 bp, Fragaria vesca
atggaggaaagttgaagttgaaaaccattacctgattcccgtcctcttccatcattttgggtttgtgtttttcttctctgtcttctgattccgtctctctgagtccctcgaggagaatagaagagtcttcttcatggcgaatagcaatctccctcgacgaatcatcaaggagacgcagaggctgctcagcgaaccagctccgggaattagtgcttctccttcagaagaaaacatgcgctactttaatgtaatgattcttggtccagctcagtctccatatgaaggtggggttttcaagttggagttgtttttgcctgaagaatatccaatggcacctcccaaggttcgcttcctgaccaaaatatatcatcctaacattgataagcttgggaggatatgccttgatattctgaaagacaaatggagcccagccctccaaatccgaacagtattgctgagcatccaagcacttctgagtgctccaaaccctgatgacccactttctgagaacattgcaaagcactggaagtcaaatgaaaccgaagctgttgagacagccaaggagtggacccgcttatatggaagtggtgaataatttgctcaattttttttttctattgtatgttaaacccctttcttagattatacactcaaaaacaggaatattttctggtccttcatgtttgttgataatcacttccattgctctatgatcattttctgaatcatggctttcaaagtatatacttgctgttgccaatgttgattatgctcttcacttcatgcatggtggttcccaaggggataccaagttgtgatgaggtatcctgtcaccgaaaaaaaaaaaatcaatgcttttaatccttctggaaa

SEQ ID NO: 1823 - DNA, 878 bp, Saccharum officinarum
acaccccaacccaagcaagcaaacgaccattctcttctcttctccaccagcgccgccccccaatctttcgctgcccccgccgtgatgccaaggaccaccgaaccctagtctgaaccccttcatccgttccccatggccaacagcaacctcccccgccgcatcatcaaggagacgcagcggctgctcagcgagccagctccaggaatcagtgcctcgccatcagaggagaacatgcgctacttcaatgtcatgattcttggaccatcgcagtcaccatatgagggaggagttttcaagctcgagttattcttgcctgaagaatatccaatggctccaccaaaggttcgttttctcacaaaaatatatcaccctaacattgacaagcttggtaggatatgccttgatattttgaaggacaagtggagtcctgcccttcagattcgaacagttttattgagcatccaggcattgcttagtgctccaaaccctgatgacccgcttgccgacaatgtggcgaagcactggaaggctaatgaagctgaagctgtagaaacagccaaagagtggacccgtgtatatgcaagcggagcttgacctttgcataatgcgtgcttgcctggtaagaaatttcgttcggtggagctgcggaggtgatcttgaccgatgattggtcggtgaaattggaaattgaaaggattgaggagtgaactgtggatttccaaatatcctttgatgatgtgtcaagaatctgatgtacattactgtagttgagctgtgatgatgaaccctcaaacatgtaaattgtttctttggtacctctggttcctgagagacatcaaacatatatgataataaatatcctggaatgatgtatgcct

SEQ ID NO: 1824 - DNA, 876 bp, Helianthus annuus
catggcgagcagcaaccttcctcgaagaatcatcaaggaaacgcagcgattgctcagcgaaccagcacctggaataagtgcatcaccgtcggaagataatatgcggtattttaatgtgatgattcttggccctacacagtctccttatgaaggaggtgtgttcaagctggagctatttctgcctgaggaatatccaatgtctgcccccaaggtccggttccttacaaaaatataccacccgaatatcgataagcttggcagaatatgtcttgatattcttaaagataaatggagccctgctcttcagatccgtacagtgctcttgagcattcaagcacttttaagtgctccgaacccagatgacccgctctcagagaacatagcaaagcattggaaatcaaatgaagcagaagccgttgaaacagcaaaggaatggactcgtttgtatgcaagtggcgcatgatggacatacaaaaccgccgaaaaaaaacaagtgtattatctatctatctagtacaacatattccatatcctgattatactccttttggtcccagtatatgatgtgtcctttatttttaatatgaatttagtgatggaagagtcaatgaagcacttttcaaggtcttgtcgtataatacttttttctttagttatggggaccaatcaataattgcatgttcattcgaaatggacggtttggttcggttcgctaacatgtattcgattcctgttatacccccgtttattattgagaggaggttatttgtgccccatgttaacggtcacatgcctgactgtttttggcttattgtgtgtggtaattcaaactcttgtcattgatgaaaaagcagcagaatatgttattaaaaccca

SEQ ID NO: 1825 - DNA, 976 bp, Taxus baccata
cacggatcagctatgtcgaacagtaatctgcctcgcagaatcataaaggaaacacagcgtctgctcagtgagccagcgcctggtataagtgcctctccctctgaggaaaatttgcgatacttcaatgtgatgattctcggtccttctcagtctccttatgaagggggtgttttcaagttggagttatttttgcctgaagagtacccaatggcagcaccgaaggttcgttttctgacaaagatttaccacccgaatattgacaagcttggtcgcatatgcctggatattctgaaggacaagtggagtcctgctcttcaaattcgaacagttcttctgagcattcaagccttgttgagtgcaccaaacccagatgatccactttctgaaaacattgctaaacactggaaatcgaatgaaactgaggctgtggaaacagcgaaagaatggacaaggctgtatgcaagcggggcctgacattctatatctactcactactttttacaattgtaacattaggtctttggaagtgtgcactgtgtaccaggtctctatttgcgggaacaagatttgatgtcgttcgtaatcctgttgcagcaatctaaaacttttgatgcaatcagaaaaaatctgattgtgttcacgaagttttcatttagtggttagttgggactggagccttttgatctgaattctgcatagagaagttgttgtacatggcacatttttttatggtatatctatcaaggctctacttgtaatggaaaaagacactgttacattccacttatagacaaaaatacattgatgattatatcttttgttaaatgaacaatattttgacttgcataaagtcataaattgcaggttgcacctggaaaggttctaggcttttgaattgcagtaacagttatgtatttatgtaagattttgactgattggaatttagttaaggaacagctcctttttaagactagtc

SEQ ID NO: 1826 - DNA, 641 bp, Tragopogon dubius
ttgggggtaaattaaaagacaccgttagcgtaacttttacccctctttcatggcgaacagcaatctacctcgaagaatcatcaaggagacacagcggttgctcagcgaaccagctccggggataagtgcatcgccatcggaagagaacatgcggtattttaatgtcatgatccttggaccatcacagtctccttatgaaggaggagtcttcaaattggagttgtttttgcctgaagaatatccaatggctgctcccaaggttcgatttcttacaaaaatatatcatcccaacattgataagcttggacggatatgtctcgatatactcaaggacaaatggagccctgctcttcaaattcgcactgtactccttagcattcaagcacttttaagtgctccaaatccagatgatccgttatctgagaacatagcaaaacactggaaaactaatgaagttgaagctgttgaaacagcaaaggaatggactcatttgtatgctagtggcgcgtaaagcaggtatgtttgctctgagaaaataacatgtataattaattagatattgattcctaaatttccgatgggaaattttataggaattgctaggtctgaatgattaatgttgttcactatttacttttcgt

SEQ ID NO: 1827 - DNA, 786 bp, Utricularia gibba
acagtcctcaagtgggcaaaaaatactgaaaaggaagtaaccgaattgaacttcgggaattcgcgtaaactctccgtctccgacgattggaagaaattcaacacgatggccaacgccaacttgccgcgaagaatcatcaaggaaacgcagcgtcttctgagtgaaccagcacctggaataagtgcttctccctcggaagacaatatgcgatatttcaatgttatgatacttggtccatcacagtcgccttatgaaggtggtgtttttaagctggagctatttttacctgaggaatacccgatggctgctcccaaggttcgcttcctgacgaaaatttaccacccgaacattgataagctcggtaggatatgccttgatattctcaaggacaaatggagtcctgcacttcagatcagaactgtgcttttgagcatccaagcacttctaagtgccccaaatcctgatgatccactctctgaaaacatcgccaagcactggaaaacaaacgaggctgaagcagtggaaacagcgaaagagtggactcgtttgtatgcaagtggagcatgagcctcacgcagcccatggtttgtcaaataattattggtatctgcttcttgtcgcatatatgtaacgaagctacaaactcctctagaacatgaagaaatgcttgcttcacattgtctatgagcatttgtgttgcctcaccgcacttattcatcatctcccatgactgcgggttcagcgtttcgagtctcggacagaggcactggtttcaggcaagaaaac

SEQ ID NO: 1828 - DNA, 875 bp, Utricularia gibba
aaattcgcgtgaactctccgtctccggcgatcggaaaagaattagcacgatggccaacgccaacttgccacgaagaatcatcaaggaaacgcagcgtcttctgagtgagccagcacctggaataagtgcgtccccatcggaagacaatatgcggtatttcaatgttatgattcttggcccatcacagtctccctatgaaggtggtgtttttaagttggagctatttttacctgaggaatatcccatggctgctcccaaggttcgcttcctgacaaaaatttaccaccccaacatcgataagctcgggaggatatgccttgacatcctgaaagacaaatggagtcctgcacttcagattagaactgtgcttttgagtatccaagcgcttctgagtgccccaaatcccgatgacccgctctcagaaaacattgctaagcactggaaagcaaatgaggctgaagccgtggaaacagcaaaagagtggactcgcttgtatgcaagcggagcctgagcgacacacccctgggttggttaaattattcgtatctgcatccttgctactcatgaaacatggaattcctccacaatatgtatgccatgttttaccttttctgtgatcatgtgttgctaaattcaaggtaacttctggagattggcagtgatgcaacacttgagttttagacaaaaacaagatgagtttgtttcctccacatccatttcattcccctgctgctcaatgcagcaactgtttaacctgttcaagactacagcagtctttgcctaaccatcatcacccaagactgagtccatgtggctcaaatcatcgacgacgagggcagcatttggattaatcgcctgcgccaagatgtccgatc

SEQ ID NO: 1829 - DNA, 733 bp, Valeriana officinalis
cctttcttccattaacgattcaatctcacctccttttctctctctacagatcttctttgacttttagtttttcgtaaaaatggccaacagcaacttgcccaggaggattatcaaggaaacacagcgactcctcagtgaaccagctccaggaattagtgcttctccttctgaagataatatgagatattttaatgtgatgatacttggccctagtcaatctccttatgaaggaggtgtattcaagttggaactgtttttacctgaagagtatccgatggcagcaccaaaggttcggttcctcaccaaaatataccatcctaatattgacaagttgggaagaatatgtctagacattctcaaggacaaatggagtccagctcttcaaatccgcacggttttgctcagcatccaagctcttcttagcgctccaaatccagatgatcccctttctgagaacatcgccaaacactggaagagtaacgaagctgatgctgtcgaaaccgcaaaagaatggactcgtttgtatgcaactggtgcttgacaacggcgaatttcatttctgaaaatgtatgttgagttgaaagggtattatgtattgtttttcataacgaaaatgaaaaaggaatctcttgtttgagtcttattactttaaatccctttcggtactggctggtcattgttcatcatagtcgttgtcttctatctttgaaagggtatatttgtatttgtacaa

SEQ ID NO: 1830 - DNA, 701 bp, Valeriana officinalis
aacttaaaccttgcgtaattttcaatcaaccctcttccatggcgaattccaacttacctcgaagaattattaaggaaacacagcgccttctcagcgaaccagctcctggaataagtgcttctccttcggaagacaatatgcgatatttcaatgtgatgattcttggtccatcacaatctccatatgaaggaggggttttcaagctggaattatttttgcctgaagaatatccaatggctgctcccaaggttcggttcctcaccaaaatataccacccaaacatcgataagctcggcagaatatgccttgatattcttaaagacaagtggagccctgctcttcagattcgaaccgtactacttagcattcaagcacttctaagtgctccgaaccctgatgatccgctgtctgagaacattgcaaagcattggaaatcaaacgaagcagaagctgtcgagacagcaaaggaatggactctttcatatgcaagtggagaatgaagcatgtggagattagggctttataaatataacaacatatatgcataagtgttgcggtgaccttataattagtgtcatgtgtgacgtataatgagatgtgataatgtatactctccagattgccttgctttgttggtatatgacattgttacttgttggttgcaaaccatgtaaatgcaatataaactcacagcaaaaaaa

SEQ ID NO: 1831 - DNA, 1257 bp, Phaseolus vulgaris
acaccattaaaccttccttttcttgttaatactttcttccatgctaattaagggttttctgaattgagaattaagttataatcgttctcagcgttcttcatatatctatgccagtgagagaaattctctctccctctctttagaaaccctattgcgcgctttgcaatccagctccacaatggccaacagcaatcttcctcgaagaatcatcaaggaaactcagcgtttgctcagtgagccagctcctggaattagcgcttccccttccgaagacaatatgagatatttcaatgtgatgatccttgggccaacccagtcaccttacgaaggaggagtatttaagttagaactatttttgccagaagaatatccgatggctgctccgaaggttcggtttctaacaaaaatatatcatccaaacattgataagcttggcagaatatgtcttgatattctgaaagataagtggagtcctgctcttcagattcgtactgttctattaagcattcaagctctattgagcgcaccaaacccagatgatccactttctgaaaacattgccaagcattggaaatctagtgaggtcgaagctgttgaaacagcgaaggaatggacccgattatatgctagtgacgcctgatgataaggttcaagtatggctccataataacaattgtaaccatcattttatactggaaatctagaggatctatgaattgttggagtcaatatcccttgcagcttccagttacctgttaatttcttctcttgggagctgctatatcttgaaacttgtatgaatagatgtgtttatcttttacctatctaacaatttagaacgtgcgtcaatcatcggctgtgaagtaatttgttattctcaacatcagaggccaaaatttgcgatttagtttctgttctgtttatctcaatgaaccatgtcaagattttgttgagttagtaaccaataggattggttctgaagtgtagtcatttgtgtcctgagtgtgaataattattaccagtggccacgaagtctgaattttgagggttaaagatctgaacacgggaaccagtaatcgggaccagtgggcaaatcatgttgaatgggaacatcttgagctgaattttccaaagggttttgcaaaaatattctggtgtgatgtattttttaacaataacatttgggttggtaacgaatgtcatgatgcagcatggttgatggataaatgtatatcgtcgaaagtatgtatagaaaaa

SEQ ID NO: 1832 - DNA, 840 bp, Olea europaea
agtcaaagcctcattttgcaaaatataaaacctccccgacggttacgagtaaaatgcacttttattagcgtgaactctccgacggaaaacagacgggaaaaaacatttgcaaaattcaattcaatggcaaacagcaatttaccccggagaatcatcaaggagactcagcgtcttctcagcgaaccagcaccggggataagtgcatctccatcagaagacaatatgcggtatttcaatgttatgattcttggtccaacacagtctccttatgaaggaggtgttttcaagctggagttatttttgcccgaagagtacccaatggctgctcccaaggttcggttcctcaccaaaatataccaccctaacattgataagctaggaaggatatgccttgatattcttaaagacaagtggagtcctgctctccagattcgaacagttcttttgagcattcaagcacttttgagcgctccaaaccccgatgatccactctctgaaaacattgctaagcactggaaaacaaatgaggccgaagctgttgaaacagcaaaagaatggacgcgtttatatgcaagtgctgagtgaagtacatggaactcagggctttgatataacaaaaacatgtattgattgaagaaattgacgatgctcaaaccaatgggaatttaaattaatgttctcaaagggtagcattactataagattactcctgcttttgaattctgtaattggagttttataacgagatgagatactcttcgtgttttttcttcctcgttgtctcaaattttaccttaaaactctataatttgtctggtgtactatattcaattgtaacaa

SEQ ID NO: 1833 - DNA, 976 bp, Panicum virgatum
agagtggccagggcgcacaaagcaagcaagcgaccattctcttctccaccagcgccgcctcctttatccccaatctttctccgcctccgccgcgatcccaaggaccaccaaaccctagcacgaaggcgcctcctctgtccaatcatggccaacagcaacctcccccgccgcatcatcaaggagacgcagcggctgctcagcgatccagctccaggaatcagtgcctccccatctgaagagaacatgcgctacttcaatgtcatgatccttggcccgtctcagtcgccatatgagggaggagttttcaagctcgaattattcttgcctgaagaatatccaatggctccaccaaaggttcgctttctcacaaaaatttatcaccccaacattgacaagcttggtaggatatgccttgatattttaaaggacaagtggagtcctgcccttcagatccgaacagttcttttgagcatccaggcgctgctcagtgccccaaatcctgatgacccgcttgctgataatgttgcaaagcactggaaagctaatgaggctgaagctgtagaaacagccaaagagtggacccgtgtatatgcaagcggagcatgagctttggacgatgcaatgctcgcttctttggtaataatcttcgtagtggagctcgacttgaatgactattggctggttacatttgaaactgaaggggtaataatctagtcatatgtggaaatttatcctctttattatggtgtgtacttgagtctgatgtacattagtctaactgggcatgtaaagtgtttctttcgtacgtctggtcgttgagagaacatatatcataataattatcctgaaatgatgtgtgtgcctgttattaaaaatgactaactgggcatgtaaagtgtttctttcgtactttaaaaatgatgtcaccctgcattattttaagatgacaagctctgccacacgctgcattgaatga

SEQ ID NO: 1834 - DNA, 1094 bp, Abies balsamea
gaccgattggaacaatagcgtcacgggaacgcgaatagcctaaatatattcacaccacttttctctgaagtgcgaatcactgctatacaggtatataggcaacaaaaactgggttgaagctcgagcagccctgccctttcttctcttctcgtcaagctgtacgattttagacgtggtcgccagccacactccagtctgtccgttcgtccattcaatccgccagaggaggagggaaaggagaatcaagaacgagtcggggttcgatttttgtatctctactccccgcttgccctcccttaccagcaatggccaacgccaatctacctcgcagaatcatcaaggaaacacagcgcttactgagcgagccggcccctggaatcagtgcatctccctcggaggacaacatgcgatacttcaatgtgatgattcttggacctactcagtctccatatgaaggtggtgttttcaagttggagttattcttacctgaagaatatccaatggctgctccgaaggtccgatttttgacaaagatataccatccaaatattgataagctaggtcggatatgtctagacattctaaaggataaatggagccctgctcttcaaattcgaacggttttgctgagcatccaagcattgttgagtgcaccaaatcctgatgatccactttctgaaaatattgctaaacactggaaaacaaatgaacttgaggctgtagaaacagcgaaggaatggacaaggctgtatgcaagtggcgcatgactgtcttgagacttgtttctttgaataacacatttgaatgtgcaagttgtcatcccattgctatcagacacagatttttcataatttattagtgaatattcatgcatcatgtactttggtaacaaagaatatggtccgacaagaccacgttgattggtatgtcagtcaaagaatgacatagcaactgtcactagcgacactatgatatttatagaatttgtttgtgtaaagttcctacggtatgctatgttaaggaaagaaatctggtataacaatctagtgaaagttttcacccagtaataggtggaagtttcttcttcacaattt

SEQ ID NO: 1835 - DNA, 705 bp, Ambrosia trifida
aacagcaatctacctcgaagaatcatcaaggaaacgcagcgattactcagcgaaccagcaccgggaataagcgcgtcgccttctgaagataatatgcggtattttaatgtgatgattcttggcccgagtcagtctccttatgaaggaggagtcttcaagctggagctatttctgcctgaggaatatccaatgtctgcccccaaggttcgattccttacaaaaatataccacccgaatattgataagcttggcagaatatgtcttgacattcttaaagataaatggagccctgctcttcagattcgcacagttctcctgagcattcaagcacttctaagtgctccaaacccagatgacccactgtctgagaacatagcaaagcactggaaatcaaacgaagcagaggctgttgaaacagcaaaggaatggacgcgtttgtatgcaagtggtgcataatggatatatgatacagaactgcaaaataacaaatgtattactattacaacatattccatgttctggttatactccctttcgccatcgtcttggtccctatatatgatgtgtcatttacttttatgaatttagtgatggaagagccaatcaggcacttttcaaggtgttgtcagataaacctttttcattatttatgggaccaatcaataattgcattcatatacctaatgtacaatacattaacaagta

SEQ ID NO: 1836 - DNA, 820 bp, Amorphophallus konjac
gtttgactgagctcagaagaggcagcagagggacagaggaaaccctaatccgaccccagcgggatggcgaacagcaatctacctcgaaggatcatcaaggaaacgcagcggcttctcagcgaaccagcgccaggcatcagtgcctctcctgctgaagataatatgaggtacttcaatgtcatgattcttggtccaactcagtctccatatgaaggtggggttttcaaactggaattattcttgcccgaagagtacccaatggctcctccgaaggtccgctttcttacaaaaatataccatcccaacattgacaagcttggaagaatatgccttgatattctcaaagataaatggagccctgctctccagattcgaacagtattactgagtattcaagcacttttgagtgcccctaacccagatgatcccctctctgacaacgtggcaaagcattggaagacaaacgaagcagaagctgtagaaacagcgaaggaatggacccgtctttacgctagtggagcgtaatgttgccaagctgttttgtacccaagttaacatccattgtgtataacatgcgaaactatgagtgttatataatgaagagattgctgttgctgttgatatgaaaaggaatgagagacgttactatatgaaaaatgtataccctccgttgcaggccccgctacactggtcgaaatgccggttcatgtgggtgggctctgtttgaagaacctttccgagggacaagcttgctttatatttttcggtagggtttcttggttatatttcttgggaaatgaaatggcatagacccttgttc

SEQ ID NO: 1837 - DNA, 711 bp, Arnica chamissonis
cgaacagcaacctacctcgaagaattatcaaggaaacgcagcgtttactcagcgaaccagcaccgggaataagcgcatcgccgtcggaagataatatgcggtatttcaatgtcatgattcttggcccatcacagtctccttatgaagggggagtcttcaagctggagctatttctgcctgaggaatatccaatgtctgcgcccaaggtgcgctttcttacaaaaatataccatccgaatatcgataagcttggcagaatatgtcttgatattctgaaagataaatggagtcctgctcttcagattcgcacggtgctcctgagcattcaagcacttttaagtgctccaaacccagatgacccactgtctgagaacatagcaaagcactggaaatcaaatgaagcagaagctgttgaaacggcaaaggaatggacgcgtttgtatgcaagtggcgcgtaacggacatatgtgctacaacaccgaaaaatagcataatgtatctctatttcaacatattcgatgtcctgatcatactccctttcaccatgtttttggtcccaatatatgacgtgtcctttatttttatgaatttagtgatggaggagccaatcaagcacttttcaaggtcttgtcaaataagcttttttttcattatttctggggacccgtcaataattgcactcatgtgcgaaatgtacaatacgctaacacg

SEQ ID NO: 1838 - DNA, 930 bp, Artemisia annua
aaacaaatcgttttctctttattacagagatcacaaaagttagcgtaactttgaaatccattttaatcataaaaatggcgacgaacagcaatctgccccgaagaatcatcaaggaaacacagcgattgctcagcgagccagctccggggataagtgcatcgccatccgaagagaacatgcggtatttcaatgtcatgattcttggtccatcacagtctccttatgaaggaggagtcttcaaactggagctatttttgccggaagaatacccaatggctccccccaaggttcggtttcttacgaaaatctaccatcccaacattgataagcttggcaggatatgtcttgatatacttaaagacaaatggagcccagctctccagattcgcacagtactcttgagcattcaagcgcttttgagtgctccaaatccggatgatccgctatctgagaacgtagcaaagcactggaaagcaaatgaagctgaagctgttgaaacagcaaaggaatggacgaacttgtacgccagtggcacctaaagcagacgtacactacttgcccctatgctgttgccgaaattacttgtataattggatattgatgctgaaattactgttaggatatcttagcaactgggaaaaaagtttcctgcttgctgatagtcctggatgataaatgttggttacgattgtcttcgagaatagttgttcattgcctcattgtttaggtttaatgaaacgtttatctatgcacatacagtatagtttggcttactagcctgccaacactttttttctggttttttggattgttttggattttgtatatgacagaccttttgcgtaaaaggcaaagccactgctataagagcatgtctaacattatgagcattagggatgtatctaggttatcaacattgatggagcaccc

SEQ ID NO: 1839 - DNA, 788 bp, Musa acuminata
gcggtcgctgttgttcgtctcgtctttcctcttcctctgtcgactccaagaaacgacccaaaaccctaatctccgattgggaatggcgagcagcaatctacccccgaggatcatcaaggaaacgcagagattgctcagcgaaccggctcctgggatcagtgcatctccgtcggaagaaaacatgcgctacttcaacgtgatgatccttggcccggcacagtctccttacgaaggaggtgtttttaagcttgaattgttcttgcctgaagagtacccaatggctgcccccaaggtccgctttctaacaaaaatctaccatccgaatattgacaagcttggacgtatatgccttgatatacttaaagataaatggagtccagccctacaaattcggactgtgttgctgagtattcaagcactgctaagtgctccaaacccggatgacccgctttcggagaatattgcaaaacattggaagacaaatgaagccgaagccgtagaaacagcaagagaatggactcgtctgtacgcaactggagcataacgacatacatggagagaagttttaacatgtaagtgctggaaactgatcataaattgccaacattcgcactggtgttgatcattttcgcagttgtggcacttttttatgtatcagtgtaaaccttagtttatcagattccaatggtttgctactacagtgttccccatttaatgtcggtatcaaatttatgcctgggttggtgtgtttgcttaacctggtttcagatgaaggcccgagaactgct

SEQ ID NO: 1840 - DNA, 955 bp, Cannabis sativa
tataagaaaaggggtagtaaaattatgtatatataacatacatattacagagttgaaattaccattcgatttcagctgctgtgagcctgtgaattctgtctctctctctatagctccctctctctctaaaattctctgcggttctctctgagctcttttgggaagacaatcaatggcgaatagtaatcttcctcgaagaattatcaaggagacgcagaggcttctcagtgaaccagctcctggaattagtgcttccccatccgaggaaaatatgcggtattttaatgtgatgattcttggtccatctcagtctccttatgaaggtggggttttcaagttggagttgtttctacctgaagaatatccgatggcacctcccaaggttcgctttctcacaaaaatatatcatcctaacattgacaagcttggacggatttgccttgacatcttgaaagataagtggagtccagccctacaaattcgaactgtattgctcagtattcaagctctcttgagtgctccaaatccggatgatccgctttctgagaacatcgcaaagcactggaagactaatgaaactgaagctgttgagacagcaaaagagtggaccagattgtatgctagtggcgaatgaatatgagaggcttctcaaaacttatgatggttcttgatgttaaatttcagtcttttagtcttaaaacatgtttttttagacttgaatagacatatggtgtgacaggttaaaattcgtagtgtttattctcaaatgggtagtgtaactgtgtaagaggtgattttattgtatgatgttatgataaatgtaggagttggttctcaaatttgtattctctgtttgagttcgtatttcattttatttctcaattgtggatcatatgataatacggttcgaggatcaaaataaaaaataaaataataataaaaaattatgtctaag

SEQ ID NO: 1841 - DNA, 968 bp, Cannabis sativa
aacatacatattacagagttgaaattaccattcgatttcagctgctgtgagcctgtgaattctctctctctctctctctctatatatagctccctctctctctaaaattctctgcggttctctctgagctcttttgggaagacaatcaatggcgaatagtaatcttcctcgaagaattatcaaggagacgcagaggcttctcagtgaaccagctcctggaattagtgcttccccatcagaggaaaatatgcggtattttaatgtgatgattcttggtccatctcagtctccttatgaaggtggggtttttaagttggagttgtttctacctgaagaatatccgatggcacctcccaaggttcgctttctcacaaaaatatatcatcctaacattgacaagcttggacggatttgccttgacatcttgaaagataagtggagtccagccctacaaattcgaactgtattgctcagtattcaagctctcttgagtgctccaaacccggatgatccgctttctgagaacatcgcaaagcactggaagactaatgaaaccgaagctgttgagacagcaaaagagtggacccgattgtatgctagtggcgaatgaatatgagatgcttctcaaaacttatgatggttcttgatgttaaatttcagtcttttagtcttaaaacatgtttttttagacttaaatagacatatggtgtgaccggttgaaattcgtagtgtttattctcaaatggatagtgtaagaggtgattttattgtatgatgttatgataatgtaggagttggttcccaaatttgtattctctgtttgagctcagttttcattttatttctcaattgtggatcatatgataattttctttggggccgctctacggttagactaatgggaagcaactgtagcactctcaatattgataaattaataataataataataataataataataatat

SEQ ID NO: 1842 - DNA, 887 bp, Brassica napus
gaagacatatggatgcacgatatgatgcatcttccagatttacaaacgaacagggccataatcatcgagtaattcgacagaagacaaagtgttctcttgatcatcggtgggcggatcttctccctccctctctaaaaccctaactctgatcgatcgaattcaccagcgcgagttaatggcgaacagtagtctaccacgaagaatcatcaaggaaactcaacgtctgctcagtgaaccggctcctggtataagtgcatctccatctgaggataacatgaggtacttcaacgttatggtccttggtccttcacaatcaccttatgaaggaggagtttttaagttggagctctttttgcctgaagaataccctatgtcagctcccaaggttaggtttctcaccaagatataccatcccagcattgataagcttggaagaatctgtctcgatattctgcaagacaaatggagccctgctctacaaatacgaacagtgctcctaagtattcaagctcttctgagtgcaccaaaccctgatgatcccttgtctgagaacatcgctaagcattggaagagtaatgaggctgaagctgtggagacagctaaagaatggacccgtctttacgcaagcggtgcatgatggactggagagtgaaagatctcacattcatccaaataacatttaagtttggtgaaatctatcaaacatcaaagttataaaaagcttatactttactgtttctcccctcttataatgataaaaatgtgagtttcggcacaggaagatgtatattgtatcattactagtagggtcaagactcgtgtgcctacttgagctcgtcaagtttcgttgaatcacaacatcttctctactcacaaaaaaaaaaaaa

SEQ ID NO: 1843 - DNA, 1109 bp, Cephalotaxus harringtonia
ctcacctgctcgagggtttgctttcgctccgctcgatcgagcttttatatcatcggaaggagaagagcagcgagaaataaaataacaatttcccttttcttatttatcggatcgatacacctgcacagccatgtcgaacagcaatctgcctcgcagaattatcaaggaaacacagcgtttgctcagtgaaccagcgcctggtataagtgcttctccctccgaggataatttgcgatatttcaatgtgatgattcttgggccttctcagtctccttatgaagggggtgttttcaagttggagttgtttttgcctgaagagtatccaatggcagcaccaaaggttcggtttctgacgaagatttaccaccccaatattgacaagcttggtcgcatatgcctagatattttgaaggacaagtggagtcctgctcttcaaattcgaacagttcttctgagcatacaagctttgttgagtgcaccaaatccagatgatccactctctgaaaacattgctaaacactggaaatcgaatgaaactgaggctgtggaaacagcaaaagaatggacaaggctgtatgcaagcggggcctgacattctatatttcctcactacatattacaattgtaacattaggtctttggaagtgtgcattgtgtaccaggtcttctatttgtgggaacaagatttgatgttgtttgcaatcctgttgcagaaatctgaaagttttaatgcaatcaggaaaaatctgattgtgttcactaagttttaatttagtggttagttgggactggagccttctgatctggattctgcatatagaacttgttctacatgtcacattttttatggtacatctatcaaggctctacttgtagtaaactttgtaattcatgcccggacagtgttatattccacttctagacaaagaaatacattgataattgtcattttgttaaatgaacaatattgatttggatagtcataaattgcaggttgcacctgggcaggttctaggcttttgaattgctgttgcagttatgtatttacgtaagattttgactgatgggaatttagtaagcttcttttaagattgtaaaatggtattatc

SEQ ID NO: 1844 - DNA, 621 bp, Cirsium arvense
tctctctcttaaccacccctttcgttctcaaaagacaaaagtcccctttagcgtaacttctactcttccatggcgaacagcaatctacctcgaagaatcatcaaggagacgcagcgcttactcagcgaaccagctccggggataagtgcatcgccatcagaagagaacatgcggtattttaatgtcatgatccttggtccaacacagtctccttacgaaggaggagttttcaagctggagttatttttgccagaagaatatccaatggctgcccccaaggtccgatttcttacaaaaatataccatcctaacattgataagcttggtaggatatgtctcgatatacttaaagacaaatggagccctgctcttcagatccgcactgtactcttgagcattcaagcacttttgagtgctccaaatccagatgatccgctatctgagaacatagcgaagcactggaaaactaacgaagctgatgctgtcgaaacagcaaaggaatggactaatttgtacgctagtggcacctaaagtaggggcacgcccccggccaccatgttgcccccaagaagataacatgtattataattagatattgatgcccaaaaaatgtgagcagct

SEQ ID NO: 1845 - DNA, 729 bp, Cleome gynandra
agcgccttgattatcatcagcattcgtttttcatagcccctctctttcaaaaaccctaacatctgtaagatcgatctacccaaagcgtgccacaatggcgaacaataatcttccccgaagaatcatcaaggaaactcaacgtctgctcagtgaaccggctcccgggataagcgcatctccatcagaggataatatgcgctacttcaatgtcatgattctcggccctacacaatctccttatgaaggaggagtattcaagttggagctctttttgcctgaagaatatcctatggcagctcctaaggttcggtttctcaccaagatatatcatcctaacattgacaagcttgggaggatttgccttgatatcctgaaagataagtggagtcctgcactacaaataagaacagtgctcttgagcattcaagctcttctaagtgcgccaaatccagatgacccgctgtcggagaacatcgcaaagcattggaagacaaatgaggcagaagctgtggagacagcaaaagaatggacccgcctctacgcaaacggagcatgacgggtcgaaagagaatatatatatataaagcaaagttcggaaaagtactccaattataagaaagcttatgtctgggtttctgaagaagaatctgtaacatggatctgaatatgtatgacaaggattaagactcgttttctccatatttgcaattgcagaactctttacaggtt

SEQ ID NO: 1846 - DNA, 728 bp, Gossypium hirsutum
aaacttttttttttctatcccatcgatctcgccaatggccaacactaatctccctcgaagaatcattaaggaaactcagcgtctcctcagtgaaccagcgcctggaattagtgcctcaccatcagaggataatatgcgatatttcaatgtgatgatccttggtccaacacaatctccatatgaaggaggggttttcaagttggaactatttttgcctgaagaatatcccatggctgctcctaaggttcgatttcttacaaagatatatcatcctaacatcgataagcttggaagaatatgccttgatattctcaaagacaaatggagtccagctctccagattcgaactgtacttttgagcattcaagcactcctaagtgctcctaatcctgatgatccactctcggagaacattgctaagcactggaaaacaaatgaggctgaagccgtggagacagctaaggaatggacccgtttatatgcgaccggtgcataatacaagtggcggaaccgttagtgctcttaaaataacatttttatgcaatgtaagctattcaatgttgaagttaatgtggaaattcagaagaattaatgtttgaaagagtctgatattggcaaagctttcagctgcaacctgagttggaagcagtgcagtctcatctctgaacttgtaagataatatacattgttctcaaaaactctgaaatgctcaaactaagggattattc

SEQ ID NO: 1847 - DNA, 802 bp, Gossypium hirsutum
gaaactgttttccctgtttttgttcacccatcgatccttgcaatggccaataccaacctccctcgaagaataattaaggaaactcagcgtctcctcagtgaaccagcacctggaattagtgcttcgccatcagaggataacatgcgatatttcaatgtgatgatccttggtcccacacagtctccatatgaaggaggggttttcaagttggaactatttttgcctgaagaatatcccatgactgctcccaaggttcggtttcttacaaagatatatcatccgaacattgataagcttggaagaatatgccttgatattctcaaagacaaatggagtcctgctctccaaatccgaactgtacttttgagcattcaagcactcttgagtgctccaaatcccgatgatccactctccgagaacattgctaaacactggaaaatgaatgaggctgaagctgtcgagacagcgaaggaatggacccgtttatacgcaagtggagcatgacatacgagtggcggaaacatttgccctgttaaaaataacattttgtgcaatgtaagcgattgaatgtcaattctgtaaggatatttggaagatttaaatgttacggtaagtttgatactggcagagcttcccagttgctgtctgttaaatgtttaatcgtttccccattggaagctctctgaacttgtatgataatatcaacattgttcttctaaaactctcaaaatgctgaactaagggattattcttaaatatatccatttcagattcttattaaaaaagaaaaaagtaaccgaac

SEQ ID NO: 1848 - DNA, 801 bp, Gossypium hirsutum
ttaaaaggagttctttttatctcaattccgagaaactgttttccctgtttatgttcacccatcgatccttgcaatggccaataccaatctccctcgaagaataattaaggaaactcagcgtctcctcagtgaaccagcacctggaattagtgcttcaccatcagaggataacatgcgatatttcaatgtgatgatccttggtcccacacagtctccatatgaaggaggcgttttcaagttggaactatttttgcctgaagaatatcccatgactgctcccaaggttcggtttcttacaaagatatatcatccgaacattgataagcttggaagaatatgccttgatattctcaaagacaaatggagtcctgctctccaaatccgaactgtacttttgagcattcaagcactcttgagtgctccaaatcccgatgatccactctccgagaacattgctaaacactggaaaacgaatgaggctgaagctgtcgagacagctaaggaatggacccgtctatacgcaagcggtgcatgacatacgagtggcggaaacatttgccttgtcaaaaataacattttgtgcaatgtaagcgattgaatgtcaattctgtaaggatatttggaaggtttaaacgttagggaaagtttgatattggcaaagcttcccagttgctgtctgttaaatgtttaatcgtttccccattggaagctgtctgaacttgtatgataatatcaacattgttcttccaaaactctcaaaatgctgaactaagggattattctttaatatatccatttcag

SEQ ID NO: 1849 - DNA, 1077 bp, Gossypium hirsutum
catcaggcagaggacgagacaaggctagcagtaatctccctcgaagaatcataaagctctcaatttctaaatcccaaaaaccctcttcttctttcttcttgcaatcgatctcgccaatggccaacagtaatctccctcgaagaatcataaagctctcaatttctaaatcccaaaaaccctcttcttcttttttcttgcaatcgatctcgccaatggccaacagtaatctccctcgaagaatcataaaggaaactcagcgtctcctcagtgaaccagcgcctggaattaatgcctcaccatcagaggataatatgcgatattttaatgtgatgatccttggtccaacacaatctccatatgaaggaggggttttcaagttggaactatttttgcccgaagaatatcccatggcggctcccaaggtccggtttcttacaaagatatatcatcctaacatcgataagcttggaagaatatgcctcgatattcttaaagacaaatggagtccggctctccagattcgaactgtacttttgagcattcaagcactcttgagtgctcctaatcctgatgatccactctcggaaaacattgctaagcactggaaaacaaacgaggccgaagccgtcgagacagctaaggaatggacccgtttgtatgcgaacggtgcataatacgattggtggaaatgttagctctcttgaaataacatttttatgcaacataatgcggaaattcagaagaattaatgtttgaaggagtctgatagtagcaaagcttccggttgcaacctgttataaatcatttcggtttcgagctgggaggcaagtactgtctcatctctgagcttgtaagataatatatacattgttctccaaaactctgaaacgctcaaactaagggattattctcaaatgtagcaaaatgtttaaacgacttaattaaatctaattgttatttcattaaattttgatgactaaagtaggtgattaattttattttaatttatctcgttggaatattcggaaacctctgtgttagagacaatatttggcaagttttaccaacttttatttt

SEQ ID NO: 1850 - DNA, 789 bp, Gossypium hirsutum
atctctctccatttctggatccccaaaaccctcatactttttttttccttcccatcgatctcgccaatggccaacactaatctccctcgaagaatcattaaggaaactcagcgtctcctcagtgaaccagcgcctggaattagtgcctcaccatcagaggataatatgcgatatttcaatgtgatgatccttggtccaacacaatctccatatgaaggaggggttttcaagttggaactatttttgcctgaagaatatcccatggctgctcctaaggttcgatttcttacaaagatatatcatcctaacatcgataagcttggaagaatatgccttgatattctcaaagacaaatggagtccagctctccagattcgaactgtacttttgagcattcaagcactcctgagtgctcctaatcctgatgatccactctcggagaacattgctaagcactggaaaacaaatgaggctgaagccgtggagacagctaaggaatggacccgtttatatgcgaccggtgcgtaatacaagtggcggaaccgttagtgctcttaaaataacatttttatgcaatgtaagctattcaatgttaaagttaatgtttgaaagagtctgatattcgcaaagctttcagctgcaacctgagttggaagcagtgcagtctcatctctgaacttgtaagataatatacattgttctcaaaaactctgaaatgctcaaactaagggattattctctaatatagcaaaatgtttaaacgaaataattaaatctaattgtaattga

SEQ ID NO: 1851 - DNA, 930 bp, Cycas rumphii
  misc_feature (819)..(819): n is a, c, g, or t
tggatccaaatgggagtggtgcgcctcaagtctgtagctatcacgcgagggttcgtctgtgtcctcttgattttcataaagattgaggctggtccatctgctaaatcacgcaacgcgacgttaatttcatacaagctttctgtaatcggatccattatggcaagcagtaacttgcctcgcagaatcattaaggaaactcaacgtttgcttagtgaacctgcacctggtataagtgcctctccttctgaggagaacttgcgatattttaatgtgatgattcttggacccactcaatccccttatgaagggggtgttttcaagttggaattatttttgcctgaagagtatcccatggctgcaccaaaggtccgctttttgacaaagatctaccaccccaatattgataagcttggacgcatatgcttagatattcttaaggacaagtggagtcctgctcttcaaattcgaacagttttgctgagcattcaagcattgctgagtgcacctaatcctgatgatcccctttctgagaatattgctaaacactggaaggcaaatgaagctgaggctgtagaaacagctaaagaatggacaaggctgtatgcaagtgggacctgacattgtttgtactcattcaataatacagctgcaacggctttggaagtgtattcttatttgtgggaacatgaatggatgggattcgatatgcagtttcatactgctgagctttggatgcagttgtgcagaattggtttgtctgaagtgttgaaaagatgaaccttttaatttagtattctgttggggctagcgccattttgnaatgatctggctagagccattttgaactgttgtctggtatgcctatcgaggctctgtttggaacaaatatctgattcttgtggggcattggtgcctttcatataaaatcaa

SEQ ID NO: 1852 - DNA, 703 bp, Taraxacum officinale
caatcacccacttcaccttctctccttaaaacccctctatttctcttctccaaatcaaaaagctcatttagcgtaaattttactccttccatggcgaacagcaatctacctcgaagaattatcaaggagacacagcggttgctcagcgaaccagctcctgggatcagtgcatcgccatcagaagagaacatgcggtattttaatgtcatgatccttggtccaacacaatctccttatgaaggaggagtcttcaaattggagttatttttgcctgaagaatatccaatggctgcccccaaggttcgatttcttacaaagatataccatcctaacattgacaagcttggtcgaatatgtctcggtatacttaaagataaatggagccctgctcttcaagttcgcactgtactcttgagcattcaagcacttttaagtgctccaaatccagatgatccgctatctgaaaacatagcaaaacactggaaaacaaacgaagttgaagctgttgaaacagcaaaggaatggacacatatgtatgctagtggtgcctaacacaggtataatgttactccaaaaaacaatatgtataactagatattaatttacattttcggtttgggataaaagcttcattgttattttgagataagttactctcatgttataatttttcattgggtggaacaaaaaaaaaaaaaaaaaa

SEQ ID NO: 1853 - DNA, 921 bp, Eschscholzia californica
ggtaccacgtataccatacccttcaccggctcaaacaggttcgttctggtgcttgtagtcgaaacgggtgaccggaaagtgatccgtagctagtcgcgcacacgtacctcggatcgtgaatcgactttcacgtgatgtactccttgaggtatccatttctacgtctccaaaagtcgagactgcggaatctggccggaccttacggtggtgagtatgtgacttgaagactgatcctgctccttacgttgacgcttcgaatcactactacccatctctcgtctctctcgtctctcgatcgaagctccaatggcgaacagcaatctacctagaaggattataaaggaaactcaacgtctcctcagtgaaccagctccaggaatcagtgcgtctccatctgaagacaatatgcgatatttcaatgtcatgattttgggaccaacacaatctccttatgagggaggtgtgtttaagctggaattgtttctgcctgaagaatatcctatggccgcaccgaaagtccggtttctcactaagatctaccatcctaacattgacaaacttgggaggatatgccttgatattctgaaagataagtggagtccggctcttcagatccgaacagtactgcttagcattcaagcactcttaagtgcacctaatccagatgatccactttctgaaaatattgccaagcattggaaagcagatgaggtggaagctgttgaaacagcaaaggaatggacccgtctatatgctagtggagcctgatagattgcaaaatagagtcatctcttttgaccacaacccacgtaacattttatatattgttgctgttgcaagttactacattttatgtcatttgtttaaaattgaaataccaacgaattgatatatgaaaatcttaatgatcaagggtattta

SEQ ID NO: 1854 - DNA, 747 bp, Fagopyrum esculentum
tcctcctactcccaaatctctgaatccgatctctctccttcactgtcaatggcgaacagcaatcttcctcgaaggattatcaaggaaacgcaaaggcttcttagcgagccagctcccggaataagtgcttctccatctgaagataacatgcgctacttcaatgtcatgatcctcggcccttctcagtctccttacgaaggtggtgtcttcaagttggaattgtttctgcctgaagagtatcctatggcaccaccaaaggtacggttcctgaccaagatctaccatcctaacattgacaagcttggaaggatatgccttgacattcttaaagataaatggagtcctgccctccagattcgtactgtgctgttaagcattcaagctcttttgagtgctcctaatcccgacgaccccctttccgagaacatcgccaagcattggaaaagcaatgaagtcgaagctgttgaaacggcgaaggaatggacccgtttgtatgcaacaggtgcttgataatagaggctccagaatttcatattactcatgtatgttgaaactaaattggtcatcttgatctccgataaagatcaaaaccaatgttgacttcatatgtaatttgtctcaagcagaacctaaacttgcgcttgtagatgatatgcttcaaacaaatattatgataattgtgttacaatcatttttcaaggtccctttcgtgtgaaaggatggcatagttgtagtttggatggaacg

SEQ ID NO: 1855 - DNA, 732 bp, Zingiber officinale
  misc_feature (147)..(147): n is a, c, g, or t
  misc_feature (181)..(181): n is a, c, g, or t
  misc_feature (183)..(183): n is a, c, g, or t
  misc_feature (185)..(185): n is a, c, g, or t
  misc_feature (579)..(579): n is a, c, g, or t
  misc_feature (599)..(599): n is a, c, g, or t
  misc_feature (687)..(687): n is a, c, g, or t
  misc_feature (689)..(689): n is a, c, g, or t
  misc_feature (695)..(695): n is a, c, g, or t
  misc_feature (708)..(708): n is a, c, g, or t
tttgacttgccctttaccttccgctcttattcctcgcctcctcttcttccgatcgatccgcgagagaagccttgagcgcgcagcaggcgacccgattcgtgtcgtctcgatggccaacagcaacctccctcgccggatcatcaaggnaacgcaaagactccttagcgaacccgctcccggnancngtgcatctccgtccgaggataatatgcgctacttcaatgtgatgatcctcgggccaactcagtctccttacgaaggaggagttttcaagctggagttgtttttgcctgaagaatatcccatggctgctccaaaggtccgctttctcaccaaaatataccacccaaatattgacaagcttggaagaatatgccttgacatcctgaaggacaaatggagtccagccctccaaatcagaacagtactgctcagcattcaggctcttcttagtgccccaaatccagatgaccctctctcagagaacatcgccaagcactggaagtcgaacgaagcagaagctgtggaaacagcaaaagaatggacacgtctttatgcttccggtgcataaagaattgntccagacagccgcggtgatntatttgcacttggaagtttattcatccatataaaaccttgacactgaacaaggtgcaagtgcaagtcaaggaaatgcttccttcttcntncttctnctgctgctgctgntatatatcgtgtaatcgcaaaatt

SEQ ID NO: 1856 - DNA, 947 bp, Gnetum gnemon
tagattattgcagcgtgcgctgaacgccaatatccgccgtactcaatttccgcggccgttaaactcccttggcgacggcaacgtatttattttttgttgcagaaggagcagaggaaattcatcagatttagtgtatcaatttgcatctcaaaccttgttgctctatttgcttttacttgctttcactctgtctagatcctctcacggcaatggcgaacgctaatctgcctcgtagaatcatcaaggaaacccaacgacttttgagcgagccagctcccggaattagtgcatctccttcggaagataacatgcggtatttcaatgtgatgattcttggacctactcagtctccttatgaaggaggtgtatttaaactggaactattcttgcctgaagaatatccaatggcagctccaaaggttcgatttttgacaaaaatataccatcctaatattgacaagcttgggcgtatatgcttggacattttgaaggacaaatggagccctgcacttcagatacgcactgttttactaagcattcaagcattgttaagtgcaccaaatcctgatgatccactttcagagaatattgccaaacactggaaaactaatgaatcagaggcagtggaaacagctaaggagtggactagactctatgcaagtggtgcctgaaattagcttgtatgttttatttgaataacctgctgcccatggaagttgtaaagtcataacttagaagtgctttgtctggaatcttctgataaactgtgggagtggtcttttatggtattggtttgcattgatggttattggatggcaaataccattcgatattggtcatatttagtcaactcctttttagtatgccactcctaaaaatgttttgtacttccatttagcattaatactttggtctattttgttttcaatcgactgttcatttattcg

SEQ ID NO: 1857 - DNA, 888 bp, Gossypium raimondii
cactggtatttatatacaaagaatcttaaattttattatctctctccatttctagatccccaaaaccctcatacttttttttttccttcccatcgatctcgccaatggccaacactaatctccctcgaagaatcattaaggaaactcagcgtctcctcagtgaaccagcgcctggaattagtgcctcaccatcagaggataatatgcgatatttcaatgtgatgatccttggtccaacacaatctccatatgaaggaggggttttcaagttggaactatttttgcctgaagaatatcccatggctgctcctaaggttcgatttcttacaaagatatatcatcctaacatcgataagcttggaagaatatgccttgatattctcaaagacaaatggagtccagctctccagattcgaactgtacttttgagcattcaagcactcctgagtgctcctaatcctgatgatccactctcggagaacattgctaagcactggaaaacaaatgaggctgaagccgtggagacagctaaggaatggacccgtttatatgcgaccggtgcgtaatacaagtggcggaaccgttagtgctcttaaaataacatttttatgcaatgtaagctattcaatgttaaagttaatgtttgaaagagtctgatattcgcaaagctttcagctgcaacctgagttggaagcagtgcagtctcatctctgaacttgtaagataatatacattgttctcaaaaactctgaaatgctcaaactaagggattattctctaatatagcaaaatgtttaaacgaaataattaaatctaattgtaattgattaaattttgttgactaatgtaggtgatcatttttaatttaattattccatttttggcaaa

SEQ ID NO: 1858 - DNA, 946 bp, Gossypium raimondii
attttgaacgtgggttgctgtggagtggagttaaaacgtggattataagaaaaacactaaatcaatgtgagtacatgagacttgaaaggagtcctttttatctcaattcccagaaactgttttccctgtttatgttcacccatcgatccttgcaatggccaataccaatctccctcgaagaataattaaggaaactcagcgtctcctcagtgaaccagcacctggaattagtgcttcaccatcagaggataacatgcgatatttcaatgtgatgatccttggtcccacacagtctccatatgaaggaggcgttttcaagttggaactatttttgcctgaagaatatcccatgactgctcccaaggttcggtttcttacaaagatatatcatccgaacattgataagcttggaagaatatgccttgatattctcaaagacaaatggagtcctgctctccaaatccgaactgtacttttgagcattcaagcactcttgagtgctccaaatcccgatgatccactctccgagaacattgctaaacactggaaaacgaatgaggctgaagctgtcgagacagctaaggaatggacccgtctatacgcaagcggtgcatgacatacaagtggcggaaacatttgccttgttaaaaataacattttgtgcaatgtaagcgattgaatgtcaattctgtaaggatatttggaaggtttaaacgttagggaaagtttgatattggcaaagcttcccagttgctgtctgttaaatgtttaatcgtttccccattggaagctgtctgaacttgtatgataatatcaacattgttcttctaaaactctcaaaatgctgaactaagggattattctttaatatatccatttcagattcttattactggtcggattaacgatgatgcattgtttttgtggtttggtcatcaattgaaaa

SEQ ID NO: 1859 - DNA, 1491 bp, Gossypium raimondii
gaaacccagaaatttttaactttttttcagctcataacatttaaaccgaaaaacgatagcaaacaatattcaacaagaatttcaaattttaaattaaaaagcagagtactcacctggttcactgaggagacgctgagtttcctgtttagatcaaagattaagaagaaagaattaagcaataaacatttagaaaattcacgcaaacaaactaacaagactgaaactaatttgcagaagttttggattcattaaaacccaaaccaattcagtcaccaaatcaaactccagaaacccagaaagaagaacacacaaaattaaaccaaaaaaaaaaatcttctaagaagtaaccgaaaaggatcaaagtgagatcgaaagggacctgaatgtttttttcgaacgagattactagtatatatattatttttttatatttatacataaacattatgttaagtaatttccttttaatattatttttaacgcattaaataatttcctttttattttactttttctcgcgtggcgggcatagtactaatatatacacaaaagattcttattttctttttctctcaatttctaaatcccaaaaaccctctcttttttttcttgcaatcgatctcgccaatggccaacagtaatctccctcgaagaatcataaaggaaactcagcgtctcctcagtgaaccagcgcctggaattaatgcctcaccatcagaggataatatgcgatattttaatgtgatgatccttggtccaacacaatctccatatgaaggaggggttttcaagttggaactatttttgcccgaagaatatcccatggcggctcccaaggtccggtttcttacaaagatatatcatcctaacatcgataagcttggaagaatatgcctcgatattcttaaagacaaatggagtccggctctccagattcgaactgtacttttgagcattcaagcactcttgagtgctcctaatcctgatgatccactctcggaaaacattgctaagcactggaaaacaaacgaggccgaagccgtcgagacagctaaggaatggacccgtttgtatgcgaacggtgcataatacgattggtggaaatgttagctctcttgaaataacatttttatgcaacataatgcggaaattcagaagaattaatgtttgaaggagtctgatagtagcaaagcttccggttgcaacctgttataaatcatttcggtttcgagctgggagcaagtactgtctcatctctgagcttgtaagataatatatacattgttctccaaaactctgaaacgctcaaactaagggattattctcaaatgtagcaaaatgtttaaacgacttaattaaatctaattgttatttcattaaattttgatgactaaagtaggtgattaattttatttcaatttatctcgttggaatattcggaaacccatgtgttagggacaatatttggcaagttttaccaacttttatttt

SEQ ID NO: 1860 - DNA, 826 bp, Humulus lupulus
aattaccattcgatttcagctgttgtgttctgactctctctctccaaaagtctctgcggtcttctctgagctctttcgggaagagaatcaatggcgaatagtaatcttcctcgaagaattatcaaggagacgcagaggcttctcagtgaaccagctcctggaattagtgcttctccatctgaagaaaatatgcggtattttaatgtgatggttctcggtccatctcagtctccttatgaaggtggggttttcaagttggagttgttcttacctgaagaatatccaatgacacctcccaaggttcgcttcctcacgaaaatatatcatcctaacattgacaagcttggacggatttgccttgacattttgaaagataagtggagtccagccctacaaattcgaacagtattgctcagtattcaagctctgttgagtgctccaaaccctgatgatcctctttctgagaacattgcaaagcactggaagactaatgaaactgaagctgttgagacagcaaaagaatggacccgattgtatgcaagtggggaatgatgatgcgaggcttctcgaaaaacttatgatagttgttgatgttaagtgtctgtctttggtcttaatacatgctttttagactcgaatagagacattttctgacaggtcgagattccttgtgatttttctcaaatgggtagtctgagatattattgtattttatgatatcatgataatgtaggagtgttggtcatcaagttttagtctctgttttaattcgtattccattttatctgtcaattgtggatacaaaaaaaaaaacaaaacgtccggg

SEQ ID NO: 1861 - DNA, 780 bp, Humulus lupulus
gtaaaattacagagttgaaatttccattcgatttcagctgttgtgttctgactctctctctctctaaaattctctgcggtcttctctgagctctttcgggaagagaatcaatggcgaatagtaatcttcctcgaagaattatcaaggagacgcagaggcttctcagtgaaccagctcctggaattagtgcttctccatctgaagaaaatatgcggtattttaatgtgatggttctcggtccatctcagtctccttatgaaggtggggttttcaagttggagttgttcttacctgaagaatatccaatgacacctcccaaggttcgcttcctcacgaaaatttatcatcctaacattgacaagcttggacggatttgccttgacattttgaaagataagtggagtccagccctacaaattcgaacagtattgctcagtattcaagctctgttgagtgctccaaaccctgatgatcctctttctgagaacattgcaaagcactggaagactaatgaaactgaagctgttgagacagcaaaagaatggacccgattgtatgcaagtggggaatgatgatgagaggctgctcaaaaaacttatgatagttgttgatgttaagtgtctgtctttgatcttaaaacatgtttttcagactcaaatagagacatattttctgacaggtcgagattccttgtgatttttctcaaatgggtagtctgagatattattgtattttatgatatcatgataatgtaggagtgttggttatcaagtttttagt

SEQ ID NO: 1862 - DNA, 798 bp, Humulus lupulus
acagagttgaaattaccattcgatttcagccgttgtgttctgactctctctctctctaaaattctctgcggtcttctctgagctctttcgggaagagaatcaatggcgaatagtaatcttcctcgaagaattatcaaggagacgcagaggcttctcagtgaaccagctcctggaattagtgcttctccatctgaagaaaatatgcggtattttaatgtgatggttctcggtccatctcagtctccttatgaaggtggggttttcaagttggagttgttcttacctgaagaatatccaatgacacctcccaaggttcgcttcctcacgaaaatatatcatcctaacattgacaagcttggacggatttgccttgacattttgaaagataagtggagtccagccctacaaattcgaacagtattgctcagtattcaagccctgttgagtgctccaaaccctgatgatcctctttctgagaacattgcaaagcactggaagactaatgaaactgaagctgttgagacagcaaaagaatggacccgattgtatgcaagtggggaatgatgatgagaggcttctcgaaaaacttatgatagttgttgatgttaagtgtctgtctttggtcttaaaacatgctttttagactcgaatagagacatattttctgacaggtcgagattccttgtgatttttctcaaatgggtagtctgagatattattgtattttatgatatcatgataatgtaggagtgttggttatcaagtttttagtctctgttttaattcgtattccatttt

SEQ ID NO: 1863 - DNA, 799 bp, Actinidia deliciosa
  misc_feature (35)..(35): n is a, c, g, or t
  misc_feature (56)..(56): n is a, c, g, or t
  misc_feature (64)..(64): n is a, c, g, or t
  misc_feature (430)..(430): n is a, c, g, or t
  misc_feature (547)..(547): n is a, c, g, or t
  misc_feature (628)..(628): n is a, c, g, or t
  misc_feature (677)..(677): n is a, c, g, or t
  misc_feature (686)..(686): n is a, c, g, or t
  misc_feature (693)..(693): n is a, c, g, or t
  misc_feature (764)..(764): n is a, c, g, or t
cttctcgctctagccgacgactcagactcttctcnctctgactctctctctctctntctcaacnacaaccagttcttcggcgttcggtgaggtctgacaactgatcaaatggcgaacagcaatttgcctcgaaggattatcaaggaaacgcagcggcttctcagcgaaccagcacctggaatcagtgcttcaccttcagaagataatatgcggtacttcaatgtcatgatacttggtccatcacagtctccttatgaaggaggggtattcaaattggagttgtttttgccagaagagtatcctatggcggctcccaaggttcggttcctgaccaaaatataccatcctaacattgacaagctgggaaggatatgcctcgatattcttaaagataaatggagtcctgccctccagatacgaactgtattgntgagcatccaagctctccttagtgctccaaatccagacgatccactttctgagaacattgcgaagcactggaagaccaatgaagctgaagctgttgaaacagcgaaggaatggaccngtttatatgcaaccggtgcatgatgatcggagtctattacttgaaaatatcatttctccaaatgtatgctaaatgaatggntgccttcggtcttgcattgaaaatgaagaaaactctgtatgaacagtcncatcttccnaagtccngctatacttatgttgatgaatttcatctttactaagtttatgatgccattctgcacaattctatgaaattntaatatccctttagtgatatttcttttaaaaaaaa

SEQ ID NO: 1864 - DNA, 795 bp, Liriodendron tulipifera
  misc_feature (721)..(721): n is a, c, g, or t
  misc_feature (763)..(764): n is a, c, g, or t
  misc_feature (766)..(766): n is a, c, g, or t
gttttcgagtctttggccgacccgacgagggttttacttacttctccacctctctctctcccaaaatctcaccttgaatggcgaacagcaatctgccccgtcggattatcaaggaaacgcaacgtctcctcagcgaaccagctcctggaattagtgcttctccttcagaagataatatgcgttacttcaatgtcatgattcttggtccaacacagtcaccttatgaaggaggagttttcaaactggaactatttttgcctgaagaatatccaatggctgccccaaaggtccgcttcctcaccaaaatctaccatcccaacattgacaagcttggaaggatatgccttgatatcctcaaagacaaatggagtccagctctccagatccgaacagtgctgctgagtatccaagcacttctcagcgctccaaatccagatgaccctctttctgataatattgccaagcattggaagacgaatgaagccgaagctgtggaaacagcaaaagaatggacccgtttatatgcaagtggcgtgtgatggggcaatggtgggcatctgctgcttctggcaaataacgtctactgtgtaagtttacgtgtcttgtctctgttttcacatggaaaacagaagtactgaacgtctgaattgccaggattaacttctcaagctcttcagttatatgcagcttgtcatttttcttcctccaaagggctgccttntgcatctgtatgattagatactggttgttgttccccctaatnnanttatttctattctgtaggaatctggactt

SEQ ID NO: 1865 - DNA, 1255 bp, Pinus pinaster
agggatagcgaaggcgaaatcaaaagctcaagagatgcccgtgggggagggtagcgaccgaatgtaatccatagcgtcacgggaacgcaagtatagcaaatatattcacaccacttttcgctggagtgcaaaccacttctatataggtatttataacaatacctgttgaagctctatgtagccctgccctgttctccgcgagctgtacgagtttagccgtggtctccaagcaatccagtctgtccgttcctccattcattccgccagaggaggaggggcatcaagaaagagccggggttcgatcttttgcatctctctctcccgcttgcactcaccagcgatggccaacgccaatctacctcgcagaatcatcaaggaaactcagcgcttactcagcgagccggcccctggaatcagtgcatctccctcagaggacaacatgcgatacttcaatgttatgattcttggacctactcagtctccatatgaaggtggtgttttcaagttggagttattcttacctgaagaatatccaatggctgctccaaaggttcgatttttgacaaagatataccatccaaatattgataagctaggtcggatatgtctagacattctaaaggataaatggagccctgctcttcaaattcgaacagttttgctgagcatccaagcattgttgagtgctcccaaccctgatgatccactttcggaaaacattgccaaacactggaaagcaaacgaagtcgaggctgtggaaacagccaaggaatggacaaggctttatgcaagtggtgcctgacggtgttttgaggcttgtttctttgaataacacgtttgtaatgtgcaagctgtcatcccattggtatcagacatggacttttcttaaattgttagcgaatattcatgtatcatgttctttggtaacagagaatatggtctgacaagaccatgttgattggtatgtcagtcaaagaatgacatagcaactggcactagcaacattatgatatttgtagaatttgtttatgtaaagttcctacggtatgcgatgttaaggaaagaaatctggtataacaatagtgtggaagttttcacctagcagtacgtggaaccatggaacttttcttgtcacagttttctaaagttgaaagtcttctctaaaaattcctttactgttgtttagggtgatttcttgtgaaagcgtcggtcctaattttggtgttaatttgttttgctataaagatgaatttcc

SEQ ID NO: 1866 - DNA, 881 bp, Pennisetum glaucum
agaggtttggtgacggggatggggtcgaggtgggagaggtttggtgaggcgccgcccccaatctctctccgcctccgtccaccgcgatcccaaggaacacaaaaccctagccccgaagggccccctcctcagccctccatggccaacagcaacctcccccgccgcatcatcaaggagacgcagcggctgctcagcgagccagctccaggaatcagtgcgtctccatcggaggagaacatgcgctacttcaatgtcatgatccttggcccgtcgcagtcgccatatgagggaggagttttcaagcttgaactattcttgcctgaagaatatccaatggctccaccaaaggttcgatttctcacaaaaatttatcaccctaacattgacaagcttggtaggatatgccttgatattttaaaggacaagtggagtcctgcccttcagatccgaacagtccttttgagcatccaggcgctgctcagtgccccgaatcctgacgatccacttgctgacaatgttgcaaagcactggaaatctaatgagactgaagccgtggaaacagccaaagaatggactcgtgtctatgccagtggagagtgagttttgcacgatgcaatgcttgcttggtaataatcttcgtggtggagctcaacttgaacaaccattggttatattcgaagctgaaggggtctagtgatgtgtcgaattatgtcctctttatggtgtgtgcttgagtctgatgtacattagtctagttgggctgtgacgaatcctcattaggacatgtgaagtgtttctttggcatgtctcatccttgagaggttacatggttacataatacatatgtactgtctcataataagttggtggcacttttgggc

SEQ ID NO: 1867 - DNA, 978 bp, Olea europaea
agtcaaagcctcattttgcaaaatataaaacctccccgacggttacgagtaaaatgcacttttattagcgtgaactctccgacggaaaacagacgggaaaaaacatttgcaaaattcaattcaatggcaaacagcaatttaccccggagaatcatcaaggagactcagcgtcttctcagcgaaccagcaccggggataagtgcatctccatcagaagacaatatgcggtatttcaatgttatgattcttggtccaacacagtctccttatgaaggaggtgttttcaagctggagttatttttgcccgaagagtacccaatggctgctcccaaggttcggttcctcaccaaaatataccaccctaacattgataagctaggaaggatatgccttgatattcttaaagacaagtggagtcctgctctccagattcgaacagttcttttgagcattcaagcacttttgagcgctccaaaccccgatgatccactctctgaaaacattgctaagcactggaaaacaaatgaggccgaagctgttgaaacagcaaaagaatggacgcgtttatatgcaagtgctgagtgaagtacatggaactcagggctttgatataacaaaaacatgtattgattgaagaaattgatgatgctcaaaccaatgggaatttaaattaatgttctcaaaggctagcattactataagattactcctgcttttgaattctgtaattggagttttataacgagatgagatactcttcgtgtttttcttcctcgttgtctcaaattttaccttaagactctataattggtctggtgtactatattcaattgtaacaatatcctgctgtttgggagtctgtagaattttatttatttatttatttattttacttttgtatgaagcacaaatggtaaattgacaagatattgtggaatttaaaatttaaggtctgattatattcgtcactttttttaa

SEQ ID NO: 1868 - DNA, 1004 bp, Allium cepa
tacggggtaggtaatcatgagttcatgaattctcggtacatacatggttactttatatagattcttttgctttatctatgcgaagaacggaaaaactaagcgattataataaagcgtatacagagaggaaagaacaagtaaaaaccactttttcttggcttttggtccatcagaagggaaaattatcaaaaatttagaatatcttggcatggcaaacagcaatcttcctcgaagaatcatcaaggaaacgcagagactgttgagtgaaccagctcctggaattagtgcatcgccatctgaggagaatatgcgatactttaatgttatgattctcggtccatctcagtctccatatgaaggtggggttttcaagcttgaattgtttttgcctgaagaatatccaatggctgctcctaaggttcggttccttacaaaaatatatcatcccaacattgacaagcttggaagaatatgcctggacattttgaaagacaaatggagtccagctttgcagattcgaactgtattgttaagtattcaagcacttttgagtgctccaaatccagatgatcctctttcggaaaacattgcaaagcactggaaaacaaatgaagccgaggctgtcgaaactgccaaggaatggacacacttgcatgccagtggtacttgaatattttacaattaatgtaactacaataagccagttatatgcaaatgcaagaatccttattattatcctatatatcaatgaaaaacctctgaattgagagcctctaactgtttgatcattatcctgtataacgacgctttcttcagggcagaacgatactgattatatatgtaccagcatttctgtttaaaatcttcccttgggtggatgttcaacaagaaatattcagttactttttatgctttctttctgggtaccatgtactatatcaacttgatatgaatcgctatacaaattgcttagttctgattgatcataagcaaaatcaaataat

SEQ ID NO: 1869 - DNA, 775 bp, Catharanthus roseus
cctcagaacttccctccttcccctaaggaggccgcagacccataaatcgaatcctcacacctctgatttttctcatacgaaatacacatggcgaatagcaatttacctaaacgaatcattaaggaaactcagcgccttctcagtgaaccagctccgggaattagtgcctcaccttcagaagataatatgcgggattttaatgtcatgatacttgggccggcacaatctccatatgaaggaggtgtattcaagctggaattgtttttgcctgaagaatatccaatggcaccacccaaggttcgatttttgaccaaaatataccatcctaacattgacaaactgggaaggatatgccttgacattctcaaagacaaatggagtccagcactccagatacgaaccgtattgctaagcatccaagctcttcttagtgctccaaatccagatgacccactttctgagaacattgctaaacattggaagtcaaatgaggctgaggctgttgaaacagcaaaggaatggacgaggttatatgcgactggtgcatgaggagataagattacagtctttccaaagcagaatgctgagttctgcaaatctcttttaatttggatgataatctccatttcatgatgaagagagatgtatcatgcaaacaattaaaacgtaatcttgcaagccctagaatctattcttttcttctctttaatgggcacgcttgaaaattgtacaacaacatgagagtctgatttaatatatcttcattttacctttt

SEQ ID NO: 1870 - DNA, 909 bp, Phalaenopsis aphrodite
ggtcctctcattcacctcttcagctcatcctcttatctccatcttgtttttagacgtctaactggtcccacttttgcctttcaaatccctctctctcaacccttcacttgcggaggaacaaggatggcaaacagcaatttgcctcgccggatcatcaaggaaacgcagcgtctccttagtgagccagctccagggatcagtgcgtcgccctcggaggataacatgcgctacttcaatgttatgatcctcgggccgtcacaatctccatatgaaggaggagtttttaagcttgaactttttctccccgaagaatatccaatggctgctccaaaggtccgttttcttactaaaatataccatcccaacattgacaagctaggaaggatttgtcttgatattctgaaagataagtggagtcctgctctgcaaattaggacagttctgttgagcatccaagcccttctgagtgctccgaacccagacgacccactttctgacaacattgctaaacattggaaaacaaacgaagccgaagctgttgagacagctaaggaatggactcgtttatatgcaagtgggccgtagccgcattttcagcatgagaaattatactattctcatatacccgagtatgatttaaggcaatgatgactgggaagtttgatagcttttccatcaatgagatggtggcttgaaatctgcataatgtaaactagcttttaatttcagaacgattaaatatctttatcaggagatgtttccaatacacttgcaagtctaccgtccaaattgttattatcatgcaactacatgtttttttccaatcttatttagtgagctttcggtggattttggagtgttcatttaaaatgttcttgtattgctttgatttgttccgtacgtttgatt

SEQ ID NO: 1871 - DNA, 875 bp, Phalaenopsis aphrodite
aatgatgttatgccaaaggccgtcatctgcttggagtcgctgcagctctattttcggatctgttcccagatttgctttaccttcgcggcttcactttctgctgctacaggagaaaagcagtggggatggcgaatagcaatttgccaagaagaatcattaaggaaacgcagcgccttctcagcgaaccagctccagggatcagtgcgtcaccttcggaagataacatgcgctacttcaatgttatgattcttgggccatcgcagtctccgtttgaaggaggggtttttaaacttgagctgtttcttcctgaagaatatcccatggctgctccgaaggtccgcttccttaccaaaatatatcatcccaacattgacaagcttggacgaatatgcctagatatattgaaagataagtggagtccagctctgcagattcgaacagtactgttgagtatccaagcgcttctaagtgctccaaacccagatgatccactttcagataacattgcaaaacattggaagacaaatgaagcagaagctgttgagacagccaaggagtggactcgcctgtatgccagtggagcttgaacggccttaatataatgtgaaaatctgccattactgattttctatatcatatcttgaaaaacggtgttcgtgaactgtcagagtctcttagcttcttctccttccagcttgaggtggccttaattgctctcaattttgaaagcaaatgacttcaatatggttttatctctagctattatctctgcttgctgtatgatttatgcggttctgaatgattttcggttgttttttttaaataatgaaagtattataacctcaaccagtcttaaattatgcacaagtgtgttt

SEQ ID NO: 1872 - DNA, 753 bp, Primula obconica
aaaaaccctttctgcaacaatcgagctcgttttcaatggccaacagcaatttacctcgaagaattatcaaggaaactcagcgtctcctcagcgaacctgctccgggaataagcgcttccccctcagaggaaaatatgcgttactttaatgtcatgattcttggcccgtctcaatctccatatgaaggaggagtttttaagctggaattatttctaccagaagaatacccgatggctgctcctaaggtccgcttcctcaccaaaatttatcatcccaacattgataagcttgggaggatatgccttgatatactgaaagataaatggagtcctgctcttcaaattcgaacagtgctcttgagcattcaagcactactaagtgcacctaacccagacgaccctctatctgagaacattgcaaaacactggaaaacaaatgaagccgaagctgtcgacacagcgaaggaatggactcgtgtatatgcaaatggggagtgacgaaaagggttttagaagagtaagagaatatgcattccatgtatctctaatgactttttaacttgaaatatgtttaaggggttgtgttggatgattagaaatgtacaacttttcgcaccattactgataatttctccttgctcgcttaccacattgatgcaagcaaattgggtgagttttgctacatacttgttctgaatttgtatgatacgtaacctagattatttctcctatttgtcaatgtatgaatgatatg

SEQ ID NO: 1873 - DNA, 807 bp, Raphanus sativus
  misc_feature (674)..(674): n is a, c, g, or t
gggccatcaatccacgaaagtgttctctctatcgtcgccgtgcggatctatctccaaaaccctaactccgaccgatcgaattcagcagcgcgagatcatggccaacagcagtaatctgccaaaaagaattatcaaggaaactcaacgcctgctcagtgaacctgctccagggataagtgcatctccatctgaggataacatgcgatacttcaacgtcatggttcttggtccttctcaatcaccttatgaaggaggagttttcaagttggagctctttttacctgaagattaccctatgtcagcccccaaggttaggtttctcaccaagatttaccatcctaacattgataagcttggaagaatctgtcttgatattctgaaagacaaatggagccctgctctacaaatacgaacagtgctcttgagtattcaagctcttctgagtgcaccaaaccctgatgatccattgtctgagaacatcgctaagcattggaagagtaatgaggcagaagctgtggaaacagctaaagaatggacccgtctttacgcaagcggcgcatgatggatgggagggttaaaaaatctcattcattcccaaataacattacattcggtgataatctatctcaacgtcaaagtgataaaagttatgttttgcttcttcttattgtatnattactaataggttttcaaagtttcgttgaatcaaaaggtcttctcaactgtgtctaaataatctctctgcaacttttgtgttttgcaaatgaacaaaaggttgataaatcttaaagaaacgacattaaaaac

SEQ ID NO: 1874 - DNA, 701 bp, Rosa hybrid cultivar
tctgtctctgcgtctctcgaatcttcctgaggaggagaagagaaagagtcttgttcaatggcgaatagcaatctccctcggcgaattatcaaggaaacgcagaggcttctcagcgaaccagctccgggaattagtgcttctccttctgaagaaaacatgcggtattttaatgtaatgattcttggtccagctcagtctccttatgaaggtggagttttcaagttggagttgtttttgcctgaagaatatccaatggcacctcccaaggtccgcttcctgaccaaaatatatcatcctaacattgataagcttggtaggatatgccttgatattctgaaagacaaatggagcccagccctccaaatccgaacagtattgctgagcgtccaagcacttctgagtgctccaaaccctgatgacccactttccgagaacattgcaaagcactggaagtcaaatgaaacagaagctgttgacacagccaaggagtggacccgcttatacgccagtggtgaataacgcattgaatcggtgctcaaaattttatttttctattgtatgttaaactaaatgcacccctttcttagattatatacactaaagaacaggaatattttctagtccttcatgtttgttgataatcacttccattgctcgatgatgttcattttctaaatcatggctatcaaagattcaaaagt

SEQ ID NO: 1875 - DNA, 878 bp, Sciadopitys verticillata
gggtactataattgttattcttgtcagccaatccagccatagtcctactctactcatagtgttgtagtggtcagaagggaagactactaggtggggttctattctctctgtcgctctctgaaatttcatcaatggccaacaccaatctgcctcggagaatcatcaaggaaactcagcggttactgagtgagccagctcctggaatcagtgcatctccttccgaggaaaacttgcggtacttcaatgtgatgattcttggaccctcgcagtctccctatgaaggaggtgttttcaagctagagttattcttacctgaagaatacccaatggctgcaccaaaggtacgctttctgacaaagatctaccacccaaatattgacaagctgggtcggatatgcctagacattctaaaggacaaatggagtcctgctcttcaaattagaacagttttgctgagcatccaagcattgttgagtgctcctaatcctgatgatccactttctgacaatattgcaaagcactggaagtcaaacgaagtcgaggccgtggaaacagctaaagaatggacaaggctgtatgcaagtggggcttgacattaagaggcccattccttcaaataacacgttaataatgtgttggttattatccatttggtaacacatttagggttctcgagttatgactgaatacttttgtaacagaaaaaggcgttgatgaaaattattttctctagctaggaacatgattgatatttggcatgaactaacaatcagtcttttaatcggatcatgtttttctaaaattcatacattaggctgacctgtggaaagatactagtctgttttctatttcaataactaggtaaaatctatacctta

SEQ ID NO: 1876 - DNA, 1118 bp, Sciadopitys verticillata
cctatgcaatcttattggcataagctatagtggcctttagaaaaccataagaaaatactgacctttttcatttcccagtatccttattattttcttgacgatcgagggtttgatggtatatttgtcgatcaagcttccgatcagacggcctcctgtataaatatccacctcagcgaacagccccactttttttttttttatagttgcgctctcatcggatcgtatttcggctataagctatgtcgaacagtaatttacctcgcagaatcattaaggaaacccagcgcttgcttagtgagccagcacctggaataagtgcttcaccctctgaggaaaatttgcgatatttcaatgtgatgattcttggtccgtctcaatctccttatgaagggggtgtttttaagctggagttgtttttgcctgaagagtatccaatggcagcaccgaaggttcgctttcttacaaagatttaccaccccaacattgacaagcttggtcgcatatgcctggatattcttaaggacaagtggagtccagcacttcaaattcgaacagttctactgagcatacaagcattgttgagtgcaccgaatccagatgatccactctctgacaacattgccaaacactggaaaagtaatgaaactgaggctgtggaaacagcaaaagaatggactaggctatacgcaagtggggcctgatattctatattggttcacgacatattacaattgtaactttgtcacagttaggtctttggaagcgtgcacttttgtaccagctgcctgtttgtgcgaacaagatttggtgttgtacctacttcaattgcagaaatctaaaaaattactgcaatcaggaaaaatctgattgtgttcaagaagtttataatttagtggttagttgggactggagccttgtgatctgcattctgcatatcatttttttatggtacatttcttaggctcagcttgcaatgaattttctacttcttgcctgggcactgttacattccacttgaaatcgaagaacacattgatggttctcatttggaaaatgttgacttgggtaaagtcataaatggtagattacacctggacagtatctaggattttgaattg

SEQ ID NO: 1877 - DNA, 903 bp, Panicum virgatum
gggcgcacaaagcaagcaagcgaccattctcttctccaccagcgccgcctcctttatccccaatctttctccgcctccgccgcgatcccaaggaccaccaaaccctagcacgaaggcgcctcctctgtccaatcatggccaacagcaacctcccccgccgcatcatcaaggagacgcagcggctgctcagcgatccagctccaggaatcagtgcctccccatctgaagagaacatgcgctacttcaatgtcatgatccttggcccgtctcagtcgccatatgagggaggagttttcaagctcgaattattcttgcctgaagaatatccaatggctccaccaaaggttcgctttctcacaaaaatttatcaccccaacattgacaagcttggtaggatatgccttgatattttaaaggacaagtggagtcctgcccttcagatccgaacagttcttttgagcatccaggcgctgctcagtgccccaaatcctgatgacccgcttgctgataatgttgcaaagcactggaaagctaatgaggctgaagctgtagaaacagccaaagagtggacccgtgtatatgcaagcggagcatgagctttggacgatgcaatgctcgcttctttggtaataatcttcgtagtggagctcgacttgaatgactattggctggttacatttgaaactgaaggggtaataatctagtcatatgtggaaatttatcctctttattatggtgtgtacttgagtctgatgtacattagtctaactgggcatgtaaagtgtttctttcgtacgtctggtcgttgagagaacatatatcataataattatcctgaaatgatgtgtgtgcctgttattaaaaatgactaactgggcatgtaaagtgtttctttcgtacttt

SEQ ID NO: 1878 - DNA, 815 bp, Olea europaea
caggaaaagattttactgaaatctcaccatttttctagtgagagaaacagaacagaaaagccattttagcgtaaactctccgtctgaaggaaaacttgtgcaaattcaatggccaacagcaatctaccgcgaagaatcatcaaggagactcagcgtctgctcagcgaaccagctccaggaataagtgcatctccatccgaagagaatatgcggtattttaatgtaatgattcttggtccaacgcaatctccttatgaaggaggtgttttcaagctggaattgtttttgcctgaagagtatccaatggctgctcccaaggttcgtttcctcacgaaaatttatcacccgaacattgataagcttggaaggatatgcctagatattcttaaagacaaatggagccctgctcttcagattcgaacagtacttttgagtattcaagcacttttgagtgcaccgaacccagaagatccactctctgaaaacattgctaagcattggaaaacagacgagtctgaagccgttgaaacagcaaaagaatggacacgtttatatgcaagtggggcatgaagtgcgcagagcttaaggctttcgtaaataacaaatcatgtactcattgaccgtcgaacgaacttggaaaaattgtaatatatatgttttcaatgtctggcatttctgctgttaacttcttatgtactctgttttccaattatgtaacgagatgtgataattgtataatctattgaaatgacacattttgatgaaattccatgtgggtttcccagcaaaatgaatatgtgctaaaggattttcta

SEQ ID NO: 1879 - DNA, 549 bp, Allium cepa
tttggtcagatggctaatagcaatcttcccctataaatcatcaaggaaacgcaaaggttgttgagtgaaccagctcctggaattagtgcatcgccgtcggaagaaaatatgagatattttaatgtcatgattcttggtccaactcagtctccatacgagggtggtgttttcaagctagaactttttctgcctgaagaatatccaatggccgctccaaaggtccggttcctgaccaaaatctatcatcccaacattgacaagcttggaagaatatgccttgacattctcaaagacaaatggagtccagctttgcagattcgaacagtgttgctaagtatacaagcacttttgagtgctccaaaccctgatgacccgatttcagaaaacatcgctaagcactggaaggcaaatgaagccgaggctgtcgaaaccgcaaaggagtggacacgcctatatgccagtggtgcttgagtacattgaggccaatatatggggaaaacaataacaagtctgttatgtgcatcctgcttattattctataaatgaatg

SEQ ID NO: 1880 - DNA, 899 bp, Sarracenia psittacina
aaaattctcaagactttcgccttctctctccatttcctccctctcaaaccctcaagcgtgttctgtaagctgatcttcttcaatggctaacagcaacctacctcgaagaatcatcaaggaaactcagcgtctactcagcgaacctgcaccaggaattagtgcgtcaccttcagaagataatatgcggtactttaatgtcatgattcttggtccaacacagtctccctacgaaggaggggtttttaagctggaattgttttacctgaagaatacccaatggctgctcccaaggttcgatttctcaccaaaatctaccatcccaacatcgataagcttggaaggatatgcctggatattcttaaagacaaatggagtcccgcccttcagattcgaactgtacttttgagcattcaagcgcttttgagtgctccaaacccagatgatcctctatctgagaacatagcaaagcattggaaaactagcgaagctgaggccgttgaaactgcaaaggaatggacccgactgtatgcaagtggtgcatgatgaagcggtgttcattgaaaataaccgaatatgtagtgtactttattgactatcaaatttaatggaaatttgatagatttgatgattgatgttcaaattgaatattctcaaatccttccaaatatcaatgttaattgtttcctcactttgaaactttgtgcaactgtacaattatatataagatagtttgtaccttttaatcttggagcctagaagggggtgaagttggggattattgcagaaagaattttgtgaaatagctgtgaagatttgatctgaaatttatgtgagggcaaagcagtacttgttccaggggtggaattcatctttagccttacatcatttgaataaatgtg

SEQ ID NO: 1881 - DNA, 852 bp, Sarracenia psittacina
aaaattctcaagactttcgccttctctctccatttcctccctctcaaaccctcaagcgtgttctgtaagctgatcttcttcaatggctaacagcaacctacctcgaagaatcatcaaggaaactcagcgtcttctcagcgaacctgcaccgggaattagtgcgtcaccttcagaggataatatgcggtattttaatgtcatgattcttggtccaacacagtctccctacgaaggaggggtttttaagctggaatgtttttacctgaagaatacccaatggctgctcccaaggttcgatttctcaccaaaatctaccatcccaacatcgataagcttggaaggatatgcctggatattcttaaagacaaatggagtcccgcccttcagattcgaactgtacttttgagcattcaagcgcttttgagtgctccaaacccagatgatcctctctctgagaacatagcaaagcattggaaaactagcgaagctgaggccgttgaaacagcaaaggaatggacccgactgtatgcaagtggtgcatgatgaagtggtgttcattgaaaataccgaatatgtagtgtactttattgactatcaaatttaatggaaatttgatagatttgatgattgatgttcaaattgaatattctcaaatccttccaaatatcaatgttaattgtttcctcacttcgaaactttgtgcaactgtacaattatatataagatagtttgtaccttttaatcttggagcctagaagggggtgaagttggggattattgcagaaagaattttgtgaaatagctgtgaagatttgatctgaaatttatgtgagggcaaagcagtacttgttc

SEQ ID NO: 1882 - DNA, 770 bp, Tragopogon dubius
agcatagctcacggctatagaagaaagtctcggaatcaataatctgctcattcactttctctctctagaaaacactctttctttctctttctctttccccaaaaaggcaaaagcccccttagcgtaaatcttccccttccatggcgaacagcaatctacctcgaagaattatcaaggaaactcagcgcttgctcagcgaaccagctcctgggataagcgcatcgccatcggaagataacatgaggtatttcaatgtcatgatccttggtccatcacagtctccttatgaaggaggagtgttcaagctggagttatttttgccagaagaatacccaatggctgctcccaaggttcgatttcttacaaaatttaccacccaacattgacaagcttggaaggatatgtcttgatatcctcaaagacaaatggagccctgctcttcagatccgcactgtactcctcagcattcaagctcttctaagtgctccaaacccagatgacccgctttctgaaaacatagcaaaacattggaaatccaatgaagttgaagctgttgaaacagcaaaggaatggacccgtttgtatgctagtggtgcctaacggagacgtggaaaaaataacaatgtactttgctaggttgttaaatttaaaaatttaaaacttgaatctgctgctactcctgaacgataaatgttgttcaatccttgtgtttttctgagtatatgagataagtaaactctttccctaatttcgtctctcataaatattat

SEQ ID NO: 1883 - DNA, 2325 bp, Tripterygium wilfordii
gttctcggttttaaaagctttcttcttcttcttcgactgagagtcaatggcgaacagcaatcttcctcgaagaattatcaaggaaacgcagaggcttctcagtgaacccgcgccaggaattagtgcttctccttcagaagacaatatgcggtactttaatgtaatgatccttggtccgtctcagtctccatatgaaggaggggttttcaagttggaactatttttgcctgaggaatacccaatggcagctcccaaggttcgcttcttgaccaaaatttatcatcccaacattgataagcttggaagaatatgccttgatattctgaaagataaatggagccctgccctccaaatccgaacagtcttgttaagcatccaagcactgttgagcgctccaaaccctgatgatccactctcagagaacattgcaaaacattggaagaccgatgaagctgaggctgtggaaacagccaaggaatggactcgtttgtacgcaactggcgcatgacaatgagagtgttggtttctcacaattatcgtttctgctacatatcaatgccaaagcaagtgtctatgttgggtctaaaattagaaacgaaaaagaacaaaaaaaatgaaagacaaattgtcgaagttcaatatttctggagtagacattgtcgaagttattctggagttgtaattttgtctaacagttcaaaactgctggctgataatggttttcatctcttgaaagaccatcctttgagaagggtaatggaaagaaaaaaaaaaaaaaaaaagacgataacgagaaagaaaagacagaatctcctcctgctatacgcccccttaaccacgattttgatggccataaggcctcctctgcatcaattcacaatctaccaggacctccatcgccagaagcttctttctctccttttcatttcttcgaagtccctcctcctctgtccctctcctcccacttctcaatcaatctctccggtcaatttcctccgtcggttggcttcgagcgcgccacttcctaaccatcgaagacgagccttaaagaagtcgttgtctccgccacctgacaccctggcgcagaagatcgggaaatcgattcggcgccttggcgccccatcaaaagctagggtttatcccgatgtcaacgttatccggcccaaagagtactgggactacgagtccctcacagttcaatggggagaacaggatgattacgaggtggtgaggaaggttggaagggggaaatacagcgaggtgtttgagggaattcacgccaccaataatgagaaatgtattattaagattcttaagcctgtgaagaagaagaagattaagagagagattaagatactgcagaatctatgtggagggccaaatattgtgaagttgcttgatattgtcagagatcagcaatcaaagactccaagtcttatatttgaacatgtcaataacacagacttcaaagtactgtacccaacactttcggactatgatattcgatactacatctttgagcttctgaaggcattggattattgccactcacaaggtattatgcatcgagatgtaaagccccacaatgtcatgattgatcatgaacaacggaaacttcgtcttatagattggggccttgcagagttttatcatcctggtaaagaatacaatgtccgcgttgcttcaagatattttaagggtccggagcttcttgttgatttgcaagactatgactactctctagatttgtggagccttggttgtatgtttgctggaatgatattccgcaaagagccattcttctatggtcacgataaccatgatcagctggtcaaaatagccaaggtacttgggacagatgaattgaatgcttatttaaataagtaccgtatagagttggaccctcgtcttgctgcccttgttgggaggcatagccggaaaccatggtcaaaattcattaatgttgataatcaacatttagctgtccctgaggctattgatttcgtggacaagttgctgcggtatgatcaccaagaaaggccgactgcaaaagaagcaatggcccacccttacttctacccaattagaaatgcagaaagcagcagaacgtgatcctagatttgattttcagatgctacaacatctggcatctccctgtgcatgccagggccatcatttgcaaagtgacaactttgaattactgtggtggttgggcttgcatttattaaatttccaatccattcgcatgcttcatttgttgtcaattcagatttctttgaattgtgtgtgtgctctttttaacttaggaaatgaaaaaagtttgtg

SEQ ID NO: 1884 - DNA, 480 bp, Aquilegia formosa
cttcaatggcaaatactaatctacccagaagaattatcaaggaaacccaaaggcttcttagtgaaccagcacctggaattagtgcttctccttctgaagagaatatgcgatatttcaatgtgatgatacttggtccatctcagtctccatatgaaggaggggttttcaagctggagttatttttgccggaagaatatccaatggctgcacctaaggttcgctttctcactaaaatttaccatcccaacattgacaaggcaatgcagcttggaagaatatgtcttgatattcttaaagataaatggagtccagctcttcaaatccgtactgtattgctaagtatccaggcacttctaagtgctccaaacccagatgatcctctttctgaaaacattgctaagcattggaaggctaacgaggctgaagccgttgaaacagcgaaggagtggacccggctatatgcaagtggtgcgtaatgac

SEQ ID NO: 1885 - DNA, 594 bp, Amborella trichopoda
cgtgtggggcgaacagcaatctgcccaggagaatcatcaatgagacgcagcggctcctcagcgaaccggctccaggtattagtgcttctccttctgaagaaaatatgcgttatttcaatgttatgattcttggtccaacgcaatctccttatgaaggaggggtttcaaattggaactatttttgccggaagaatatccaatggctgccccaaaggttcgttttctcacgaaaatataccatcctaatattgacaagcttggaagaatatgccttgatatcttgaaagataagtggagtcctgctcttcagattcgaacggtattactgagcatacaagcacttttgagtgctccaaaccctgatgaccctctttcagaaaacattgcaaagcattggaagacaaatgaagctgaagctgtcgaaacagcaaaggagtggacccgtctatatgcaacaggggcgtgaagcacatgatgaattgctgttgtgcaaataacctagcatggaaatggaattgttgaatgtcggacttatcaaagttaatcatctcaagccattcagtcttcagcagttaactgctgcttatgatcttc

SEQ ID NO: 1886 - DNA, 923 bp, Flaveria ramosissima
cttcactctctctctctctctctctgaaaaaacccccttttctctctctaaaaactccccctttgcgtaagtcttccttcaatggcaaacagcaatcttcctcgaagaatcatcaaggagactcagcgcttgctcagcgaaccagctccgggataagtgcgtcgccatcggagataacatgcggtatttatgtcatgatccttggtccgacacagtctccttatgaaggaggagttttcaagctggagtttttttgccagaagaatatcctatggctgctcccaaggtccggttccttacaaaaatttaccatccgaacatagacaagctcggtaggatttgtcttgatattctaaaagacaaatggagccctgctctccagattcgcaccgtgctcctgagcattcaagctcttttaagtgctccaaacccagacgatccactctctgagaacatagcaaagcactggaaatctaatgaagctgaggctgtggaaacagcaaaagagtggacccgtttgtatgccagtggcgcctaacagagatttgggtctttgcgtcgtggaaaaaataacgatgtatttggttaggtcttgaaattcaaacttgaatgattccccctgctgcaatgttgttcacttccttttcagataagattccctcctttcctaattttcttatgtgaaatattcattcggttaactatgtaaaatagtaacttccgaagttctgaacatggttgtccgtgatcgtatgcttgttgcatagatgagaaccctaagactcgggtcgggtgttgtgattcatgttgcagtaaccgcccggttgtctttaggtttgacgtcacaaaatgacatcaaatgtaactataaatattcgttaaaaaaagctataatagtggctgcaaggcaaaaaaaaaaaaaa

SEQ ID NO: 1887 - DNA, 598 bp, Fraxinus spp
aattcaatggccaacagcaatttaccgcgaagaatcatcaaggaaactcagcgtcttctcagcgaaccagctccaggaataagtgcatctccatccgaagagaatatgcggtatttcaacgtaatgattcttggtccaacgcaatctccttatgaaggaggtgttttcaagctggaattgtttttgcctgaagagtacccaatggctgctcccaaggttcgtttcctcacgaaaatttaccacccgaacattgataagcttggaaggatatgcctagatattcttaaagacaaatggagccctgctcttcagattcgaacagtacttttgagtattcaagcacttttgagtgcaccaaacccggaggatcccctctcagaaacattgctaagcattggaaaacagacgaggctgaagccgttgaaacagcaaagaatggacgcgcttgtatgcaagtggtgcatgaagtgtgtagagcgcaaggcttccgtaaataataaaccatgtactgatcgactgttgaatgaacttggaaaaattgtaatataatgttctcaatgtccagcatttccgctgtcaactttttctgtactctgtt

SEQ ID NO: 1888 - DNA, 551 bp, Olea europaea
aatggccaacagcaatctaccgcgaagaatcatcaaggagactcagcgtctgctcagcgaaccagctccaggaataagtgcatctccatccgaagagaatatgcggtattttaatgtaatgattcttggtccaacgcaatctccttatgaaggaggtgttttcaagctggaattgtttttgcctgaagagtatccaatggctgctcccaaggttcgtttcctcacgaaaatttatcacccgaacattgataagcttggaaggatatgcctagatattcttaaagacaaatggagccctgctcttcagattcgaacagtacttttgagtattcaagcacttttgagtgcaccgaacccagaagatccactctctgaaacattgctaagcattggaaaacagacgagtctgaagccgttgaaacagcaaaagaatggacacgtttatatgcaagtggggcatgaagtgcgcagagcttaaggctttcgtaaataacaaatcatgtactcattgaccgtcgaacgaacttggaaaaattgtaatatatatgttt

SEQ ID NO: 1889 - DNA, 930 bp, Panicum virgatum
attcctccacgtatccttgatctgtaaaaacagtaaagtacagggaccaggacgcacaaagcaagcaagcgaccattctcttctccaccagcgccgcctcctcccccgatctttctccgcctccgccgtgatcccaaggaccaccaaaccctagcacgaagtcgcctcctctgtccaatcatggccaacagcaacctccctcgccgcatcatcaaggagacgcagcggctgctcagcgagccagctccaggaatcagtgcctcgccatctgaagagaacatgcgctacttcaatgtcatgatccttggcccgtcgcagtcaccctatgagggaggagttttcaagcttgaattattcttgcctgaagaatatccaatggctccaccaaaggttcgctttctcacaaaaatttatcaccctaacattgacaagcttggtaggatatgccttgatattttaaaggacaagtggagtcctgcccttcagatccgaacagttcttttgagcatccaggcgctgctcagtgccccaaatcctgacgacccgcttgctgataacgttgcaaagcactggaaagctaatgagactgaagctgtaggaacagccaaagagtggacccgtgtatatgcaagcggagcatgagctttggacgatgcaaaagtggagctcaactcgaacggccattggctggttacatttcgggtctactcatatgtggaaatttatcctctttattatggtgtgtacttgagtctgatgtacattagtctagctgggcatgtaaagtgtttctttcgtacgtctggtccttgagagaacatatatatcataataattatcctgaaatgatgtgtgtgcttgttatttcttgaattatcttttgcataataacatacaatgcggcatccccactgagacttctggttgcta

SEQ ID NO: 1890 - DNA, 761 bp, Amsonia hubrichtii
gtccccaattctctctcaactttgctcttcgcagactcccctcgcgaacacagacatcaatttctcaagcctctggattttttatacgaataagttcatggcaaatagcaatttacctaaacgaatcattaaggaaacccagcggcttctgagtgagccagctccgggaattagtgcttcgccttcagaagataacatgcggtattttaatgtgatgatccttggcccggcacaatctccctatgaaggaggtgtattcaagctggaattgtttttgcctgaagaatatccaatggcaccacctaaggtccgatttttgaccaaaatataccatcctaatattgacaagctgggaaggatatgccttgatattctcaaagacaaatggagtccagcactccagatccgaacagtattgctaagcatacaagctctccttagtgccccaaatccagatgatccactttctgagaacattgcgaaacattggaagacaaatgaggccgaggctgttgaaacagcaaaggaatggacgcagttgtatgcaactggtgcatgatgaggagaatactgtctttgcactgcaaatctctgttaatttggatgtgtcctccatttcatgaatgtatcgtgcaaacaatcaaaacctaatcttgcaaggcctagaatcaattcttttcttctctttgaggggtatgcttgacattgtacaacaacatgaaagcttgatgttaatttatcttaacttctaactttaaaaa

SEQ ID NO: 1891 - DNA, 1013 bp, Musa acuminata
gcaaatgcgggtacatgaggaaaataaaaagccgaggaaccaatatgccactcgtacgggttgcgtcctccgaaagcggtcgctcttttggaagaacaaaaagccctctccagacagttttaggtgccttcctctcgactccatctcctcctccattcgtcttccccggtagttcttcgtctcctcttccctctccgccttcgttcgatcgagaatcggctgggatggccaacagcaatctccctcgtaggatcatcaaggagacgcagcggcttcttagcgaaccagctccggggataagcgcgtctccctccgaagacaacatgcgctacttcaatgtaatgattcttgggccgtcccaatctccatatgaaggaggagtattcaagcttgagctgtttctacctgaagaatatccaatggctgctccaaaggtccgctttctgaccaaaatctatcatccaaacattgacaagcttggaagaatatgcctagacattctgaaagacaaatggagtccagctctccaaattagaactgtgctcctcagtattcaagctcttctcagtgccccaaacccagacgatccactatcggacaacattgcaaggcactggaagacaaatgaagcagaagctgtggaaacagccaaagaatggacccgtctatatgctactggggcatgaaagcgaaggtggcgttctgcatgtaataacatctctactactgaacttcaattgttccaagctttaattagttcaagctcctgctgttatactatatggtgtacattggttgaaaccccctcttttttatacaatctcatccctctgagcaagtttcattgtctgcaagagaataaagaaaaaaattatgtagcaaacatgcttggagtgaattttcttctgtcacaacacttctccaatgaaaaagcttaggaacatatttggaggacaaaataatccttttatcagtctttagggcctattggtatttagattaattgttctgta

SEQ ID NO: 1892 - DNA, 651 bp, Cichorium intybus
aataaaattctcctgctgcgctacctctcctccattcatggcgaacagcaatctacctctaagaattatcaaggaaacacagcggttgcttattgaaccagctccggggataagtgcatcaccatcagaagaaaacatgcggtatttcaatgtcatgattcttggtccaacacagtctccttatgaaggcggagtcttcaaattggagttatttttgcctgaagaatacccaatggctgccccaaaggttcgatttcttacaaaaatataccatccaaatattgacaagcttggtcggatatgtcttgatatacttaaagacaaatggagccctgctcttcagattcgcaccgtactcttaagtattcaaacacttttgagtgcaccaaatccagatgatccattatctgagaacatagcaaaacactggaaaactaacgaagctgaagctgttgaaacggcaaaggaatggacacatttgtatgcgagtggcgcgtaacacaggtatcatgttgccccgaaaaaataatatgtattattaaatattaattccgtatttcaattaggataaaaaggttcattgtattttgagataagttgctctcatgttatatattttttattgggtgggataaaaaaatgtgcgacaaa

SEQ ID NO: 1893 - DNA, 647 bp, Eschscholzia californica
aaatggcgaacagcaatttacctaaaaggattattaaggaaactcagcggctcctcagcgaaccagctccaggaataagtgcatctccatcagaagacaacatgcgatatttcaatgtcatgattttgggaccatcacaatcaccttacgagggaggtgtatttaagttggaactgtttttacctgaagaatatccaatggctgcaccaaaggttcgctttctcaccaagatttaccatcctaacattgacaagcttggaagaatatgcttggatatcctcaaagacaaatggagtccagctctccagattcgaactgtgttgctaagcattcaagcacttctgagtgctccaaatccagatgatcctctttcagaaaatattgccaagcattggaaagcaaatgaggtagaggcggttgaaacagctaaggaatggacacaactatatgctagtggtgcttaacgggtggtattagcagagacttcggtggtgaaccgagatgacatttgctcttgtgtaagatgacatcttttatacttaaattggaaattaaagaactcatgtattgaatattaaagataagtcctttctaatctttcttgtttttgggtaactaatccattttgcttcatggagattaaaaaa

SEQ ID NO: 1894 - DNA, 887 bp, Ananas comosus
acgcgcatcgggagagagagagagagagagagagagatagagagagaaatatcgaaaccctagcgccctaatccgccatggccaatagcaacctccctcgccgcatcatcaaggagacgcagcgcctcctcagcgagccagcgccggggatcagtgcgtatccttcggaagagaacatgcgctacttcaatgtgatgattctagggccgtctcagtcgccttatgaaggaggggttttcaagcttgaattattcttgcctgaggaatatccaatggctgcgcccaaggttcgtttcctcaccaaaatttaccatcccaacattgacaagcttggaagaatatgccttgatattttaaaggacaaatggagtcctgcactacagatccgcacagttcttttgagtattcaagcacttctcagtgctccaaacccagatgacccgctgtctgataacatcgcaaagcactggaaggcaaatgaagcggaggccgtagagactgcgaaggaatggacacgcctatacgccagcgagggttgataaaccagcggcagcattcttatttcactatgggagtgtattcaaccatcacttggtaagattgaaatgcaagtgtttaatgtaaaactgtttacaagtgtatcgtcgtgagttgccgtgttgtattttatgttgtatattacttgttgggtatttcatacatctcctgatatctgtagttttaagttgccctttcttcgatctcttttgcgtaaacgactttgcagtgtcttaatgttataggggcaagttaacttcctttataaacggaggtggtgtttgccatggatgacatttggattgttgtattgtagtgtttctgttttaatgtaaaatccatcttatttc

SEQ ID NO: 1895 - DNA, 774 bp, Platanus occidentalis
ccgctttctccaagtctctcagcttaatggcgagcagcaatctacctcgtaggattatcaaggaaacgcagcggctccttagcgaaccagctccaggaatcagtgcgtctccttctgaagaaaacatgcgatatttcaatgtcatgattcttggccccacacagtctccttacgaaggaggggttttcaagttggaattgtttttgcctgaagaatatccaatggctgcacctaaggttcgcttcctcactaaaatatatcatcctaacattgacaagcttggaaggatatgcctcgatattcttaaagacaaatggagtcctgctctccagatccgaacagtattactgagcattcaagcgcttctaagtgctccaaacccagatgacccgctttccgacaacattgcaaagcattggaagacaaatgaggttgaagctgttgaaacagcaaaggaatggacccgtctatatgcaagtggtgagtgatgacactggtgcaaggcttttctcaaataatatttctgggattaaggcactagtgatggttgttttttttttaatggaatgataattgtaatatctgaactatcaaagattaatcccctccagctattcaggtaccatctgttctaccgtttttccttttgtggaagacgggtcaaatttgtatgattagataaagattgctgttctctctcaatctttcatgtgatcttcaatatgttttggttcaccacaccaatttaatctctgtgctttgattttggattaa

SEQ ID NO: 1896 - DNA, 939 bp, Podocarpus macrophillus
cgcaaatatttctgatcgattcttattccagatgttatactttgtttcccaaatccatcaatagtagccgccctcgatctccgacccatattcagcaagcgaagcgaaacggagaacacctgggggttggtttagtctctctttctcctctgcaaaggaaagtgaaaaccaattgcagttaaatcgtcgcaagcttcggccatggccaattccaatctgcctcgcagaatcattaaggaaactcagcgcctgctcagtgagccagctccaggcatcagcgcgtctccttccgaggaaaacttgcggtacttcaatgtgatgattcttgggcccagtcagtctccttacgaagggggtgtttttaagttggaattattcttacctgaagactatccaatggctgcaccaaaggtacgttttctgacaaaaatctaccacccaaatattgacaagttaggtcggatatgtctagacattctaaaagacaaatggagtcctgctcttcaaattcggacagttttgttgagcatccaagctctgttgagtgcacctaatcctgacgatcctctttctgacaatattgcaaagcactggaaggcaaatgaagctgaggctgtagaaacagctaaagaatggacacggctttatgcaaatggggcatgagattgagaggcccatctctttgaataacacatctataatgtggtggttatcatcaaattgataaactgcttttttatatatttgtaactgaatgcttatatacttttgcaaaagaaaatggtttcgactaaaattaatttctgtagctagcaacatgatgcaaatttagcatgaacagatatttggaatttcttcatgtttgtttaaaattcatacattgggctggcctttgtgaagataataatctgtactgtaatttgaaatttcattttcaag

SEQ ID NO: 1897 - DNA, 1429 bp, Picea glauca
gtagttagtactgtattcacgaataattattcttcctttttggtattccctaccgtttacctattattttatacgttttaactattatcatcgggttttattctttctgtaactgagggagggtttcttcataaatagaggtagaggtttggtcgattaagcttcaagcgaaggacagagttcaacgatcgattctctggaagaagaagaagaaagcctttctccgtctcccctgcagctatgtcgaacagtaatttgcctcgcagaatcataaaggaaactcaacgcttgcttactgaaccagcgcctggtataagtgcttctccgtctgaggaaaatctacggtattttaatgtgatgattcttggtccatctcaatctccatatgaagggggtgttttcaagttggagttatttctgcccgaagagtatcctatggcagcaccaaaggttcgttttttgacaaagatttaccacccaaatattgataagcttggccgcatatgccttgatattctcaaggacaagtggagtccagctctgcaaattcgaacagttttactgagtatacaagcactgttgagtgcaccaaatccagatgatcctctttctgaaaacattgcaaaacactggaagacaaatgaagttgaggccgtggaaacagcgaaagaatggacaaggctgtatgcaagtggggcctgacattctacatcaattcattcaacagtactgttctaatgccttcacagccaggtctttgcatgtgtgttcttattggcgagcactgaagtgacgacgtctcaagtccagtcgcagaaacctgaatatggtcagggaaactctgattgttccgaggaatctgttaatttagtgtttcgttggggttggagcctttcgatagacatatggtttttttcccatgtatcttatatgttttatgatacatctattaaggctctgatgtgaattttgaattcttgcctaaacactgttacctttcacatgaagttaaaaaaatgtcaatataatatgatttcaaaaataaacaacgctgacttggctaaatcgtatatttcaggttgttcctgcaaaggctttaagcttttgaattgcagttgtgtgattgattggaatttcataagaagacgctgttttgagattgtaaaaggcattttctgggctcaaatggggcactgattgtggttttcttcctttaagggcgttagcacattgcatttcaatttggttctcccattcatgtatgcctgcactgcaacatttctatgttcattgtgttgtatttttgtacttcggctatgttcattgtgttgtatttgtgtactttgaccctgtgttttatttctacgctcattgcatatttgcggtttgtaacttgttcatttttaagcctttgggatgtaaattatat

SEQ ID NO: 1898 - DNA, 1067 bp, Picea glauca
tttaactattatcatcgggttttattctttctgtaactgagggagggtttcttcataaatagaggtagaggtttggtcgattaagcttcaagcgaaggacagagttcaacgatcgattctctggaagaagaagaaagcctttctccgtctcccctgcagctatgtcgaacagtaatttgcctcgcagaatcataaaggaaactcaacgcttgcttactgaaccagcgcctggtataagtgcttctccgtctgaggaaaatctacggtattttaatgtgatgattcttggtccatctcaatctccatatgaagggggtgttttcaagttggagttatttctgcccgaagagtatcctatggcagcaccaaaggttcgttttttgacaaagatttaccacccaaatattgataagcttggccgcatatgccttgatattctcaaggacaagtggagtccagctctgcaaattcgaacagttttactgagtatacaagcactgttgagtgcaccaaatccagatgatcctctttctgaaaacattgcaaaacactggaagacaaatgaagttgaggccgtggaaacagcgaaagaatggacaaggctgtatgcaagtggggcctgacattctacatcaattcattcaacagtactgttctaatgccttcacagccaggtctttgcatgtgtgttcttatcggcgagcactgaagtgacgacgtctcaagtccagtcgcagaaacctgaatatggtcagggaaactctgattgttccgaggaatctgttaatttagtgtttcgttggggttggagcctttcgatagacatatggtttttttcccatgtatcttatatgttttatgatacatctattaaggctctgatgtgaattttgaattcttgcctaaacactgttacctttcacatgaagttaaaaaaatgtcaatataatatgatttcaaaaataaacaacgctgacttggctaaatcgtatatttcaggttgttcctgcaaaggctttaagcttttgaattgcagttgtgtgattgattggaatttcataagaaga

SEQ ID NO: 1899 - DNA, 828 bp, Panicum virgatum
ggcacaaagcaagcaagcgaccattctcttctccaccagcgccgcctcctcccccgatctttctccgcctccgccgtgatcccaaggaccaccaaaccctagcacgaagtcgcctcctctgtccaatcatggccaacagcaacctccctcgccgcatcatcaaggagacgcagcggctgctcagtgagccagctccaggaatcagtgcctcgccatctgaagagaacatgcgctacttcaatgtcatgatccttggcccgtcgcagtcaccctatgagggaggagttttcaagcttgaattattcttgcctgaagaatatccaatggctccaccaaaggttcgctttctcacaaaaatttatcaccctaacattgacaagcttggtaggatatgccttgatattttaaaggacaagtggagtcctgcccttcagatccgaacagttcttttgagcatccaggcgctgctcagtgccccaaatcctgacgacccgcttgctgataacgttgcaaagcactggaaagctaatgagactgaagctgtaggaacagccaaagagtggacccgtgtatatgcaagcggagcatgagctttggacgatgcaaaagtggagctcaactcgaacggccattggctggttacatttgaaacttaaggggtctaggggtctactcatatgtggaaatttatcctctttattatggtgtgtacttgagtctgatgtacattagtctagctgggcatgtaaagtgtttctttcgtacgtctggtccttgagagaacatatatatcataataattatcctgaaatgatgtgtgtgcttgtt

SEQ ID NO: 1900 - DNA, 683 bp, Tabernaemontana elegans
acacaggcatcgaaactctcaaagataccaaaaaattcatggcaaatagcaatttacctaagcgaatcattaaggaaacccagcgccttctcagtgaaccagccccaggaattagtgcttcgccttccgaagataacatgcggtattttaatgtgatggtacttggcccggcacaatctccctatgaaggaggcgtattcaagctggaattgtttttgccagaagaatatccaatggcaccacccaaggttcgatttttgacaaaaatataccatcctaacattgacaagctgggacggatatgtcttgatattctcaaagacaaatggagtccagctcttcagatccgaactgtattgctaagcatacaagcccttcttagtgccccaaatccagatgacccactttcggagaacattgctaaacattggaagacaaacgagacagaggctgttgaaacagcaaaagagtggacgcagttgtatgcaactggcgcatgatgaggagtggtctttgcaaagtagtgttctgcaaatctctgttaatttgggtgttgtctgtcctccatttcatgatgaaaagatgtatcatgcaaacaatcaaaacctaatcttgctagccctaggatcaattcttttcttctctttaaagggcatggttgaaaattgtacaacatgaaagct

SEQ ID NO: 1901 - DNA, 493 bp, Zinnia violacea
agtaacctacctcgaaggatcatcaaggaaacgcagcgattactcagcgaaccagctcccggaataagcgcgtcgccatcggaggataatatgcggtattttaatgtgatgattcttggtccaacacagtctccttatgaaggaggagtcttcaagctggagctgtttctgcctgaggaatatccaatgtctgctcccaaggtccgattccttacaaaaatataccacccgaatattgataagcttggcagaatatgtcttgatatactaaaagataaatggagccctgctcttcagattcgcacagtgctgttgagcattcaagcgcttttaagtgctccaaatccagatgacccactctctgagaacatagcaaagcattggaaatcaaatgaggcagaagctgttgaaacagcaaaggaatggacgcgtttgtatgcaagtggtgcgtaatgaacaattgttacaaaaccaaaaaataacaaagtgtatt

SEQ ID NO: 1902 - DNA, 1069 bp, Abies balsamea
gttgtttgaagcttgctgtgattgagggttttttcatatatagagtttgaggttttggtcgattaaacatcaaggaaactacacagttgaacgatcgattctctctggaagaagaagggctttctcagtatcccctgcagcgatgtcgaacagtaatttgcctcgtagaatcataaaggaaactcagcgcttgcttagtgaaccagcgcctggtataagtgcttctccgtctgaggacaatctacggtattttaatgtgatgattcttggaccatctcaatctccatatgaagggggtgttttcaagttggagttgtttttgcctgaagagtatcctatggcagcaccaaaggttcgttttttgacgaagatttaccaccccaatattgataagcttggccgcatatgcctcgatattctcaaggacaagtggagtccagcactgcaaattcgaacagttttactgagtatacaagcactgttgagtgcaccaaatccagatgatcctctttctgaaaacattgccaaacactggaagacaaatgaagtcgatgctgtggaaacagcgaaagaatggacaaggctgtatgcaagtggggcctgacattctacatcaattgattcaatagtagagttctaacgtcttcacagccaggtctttgcaagtgtgttgctattggcgggcactgaaatgacgacagctccagtccagtcgcagatacctgaatatagtcagggaaaccctgattgttccgaggaatctgttcctttagtgttttgttgggggctgaagccttttgatatacatatggtttccccctcatgtatcttatatgttttgtggtacatctattaaggctttgatctgaattttgaattctcgcttaaacactgttgcctttcacatgaaatacaaatttatggcaatataatatgattttaaatacgagcaacgctgacttggataaatcgtatatttcaggttgtacctgcaaaggctttaggcttttgaattgcaattatgtgattgattggaatttcataagaagacgattttaagattgtacaa

SEQ ID NO: 1903 - DNA, 910 bp, Amborella trichopoda
cctcacatataaatggatgataacaattagttggaaaccccaattggtgagagaacacctaaccatcctcaatttgttgcagagagggagagcagcaagggtttctgattgtagtcttccatggccaacaccaatcttcctcgccgtataatcaaggagacgcagaggctcctcagcgacccagctcctggcatcagtgcatcaccttctgaagacaatatgcgatatttcaatgtgatgattcttgggcctactcagtctccatatgaaggaggagtcttcaagttggagttatttctgccagaagaatatccaatggcagccccaaaggttcgctttcttacgaagatttaccacccaaatattgacaagcttggccgcatttgtctagatatcctcaaagacaaatggagtcctgcactgcagatcaggaccgtgctgctgagcatacaggcattgctgagtgctccaaacccagatgatccactctctgacaacattgcaaagcattggaaggcaaatgaagctgaagcggtggaaacagcaaaagaatggacccgcttatatgctagtggcacttgatgatgttgcaaacagctattgtagcaaataatgtgatactctttgtaagttgcgtggctgtttgttccttggaaatcgaattgatgtcctctgaaacaactaaggtcaaagtttagctaagttcctatcatatgctgcttactccattctctctactggagtttatttaacattgtgtattctaaagtttggtcctttttgatccaaatgtgaaatttatgcgctttcttgttcctcctgattgttgggtatgatacacttactaaaagattagtgaagtatggttgtttaaccattgggcttcccatccccccttccccatctcggc

SEQ ID NO: 1904 - DNA, 1086 bp, Hordeum vulgare
gaccaaactgcacaccaggaaggatcattgttcgctgacgccgcttcctttggtacttccccttcctcctcccctcccctcccctccgccgcgatcgaccacgaaaccctagccctagccccgccatggccaatagcaacctcccccgccgcatcatcaaggagacgcagcggctgctcagcgagccagctcctgggatcagcgcttcaccatcggaggagaacatgcgctacttcaatgtcatgatccttggcccaacgcagtcgccgtatgaaggaggagtattcaaacttgagttgtttttacctgaagaatatccaatggctccgccaaaggttcgctttctcacaaaaatttaccatccaaacattgacaagcttgggaggatatgccttgatatcttaaaggacaagtggagtcctgcccttcagatccgaacagttcttttgagtattcaagcactcctcagtgctccaaatcctgatgatccgcttgctgacaatgtggcaaagcactggaaagccaacgagacagaagctgtggaaacagccaaagagtggacccgtgtctatgctaatgatgcatgagctctggcatgctatgactgattgctcagtagtcttggtgaggtggaggtgaaatcgactatcatgtggtttaaaatggagaggtcctgatgaactagtgaaatgtgaagtttcctcgcattgcttgtaccgagtgtgatgtatattattaccctagttgggatgctatggacccgtgtgcatgtatattacgtgagtgatgtaccgtaataaacatcccgaagttatgtgtgccgttcgttcctggtttgtttgttccacaattgggctgtcagcatgactagtgggccatgcacggcttgcacgctgcacgggttggttcatttggggtctgtttttattaagtttttgagaatttattgtatgttctgtatgtgtatatcattgtagcgtgctagagaatagttgttttgtacttcctccgtcgcagtaaattctctggaacttgaatggttattgattgactgtgagatggattaagactattcacaatgaagag

SEQ ID NO: 1905 - DNA, 1439 bp, Distylium racemosum
cgggatcaaatcctgctgcggccatgtcgaacagtaatctgccccgcagaattataaaggaaacccagcggttgctgagtgaaccagcacctggcataagtgcttctccctctgaggataatttgcgatatttcaatgtgatgattcttggtccttctcaatctccttacgaagggggtgttttcaagttggaattatttttgccagaagagtatccaatggcagcgccgaaggttcgctttttgacaaagatttaccaccctaacattgacaagctgggtcgcatatgtctagatattctgaaggacaagtggagtccagctttgcaaattcgaacggttctactgagtatacaagcattgttgagtgcaccaaatccagatgatccactctcagacaacattgctaaacactggaaaacaaatgaatctgaggctgtggaaacagcaaaagaatggacaaggctgtatgcaagtggggcctgagtctacatcaatttattccttgctacaattatgacatgtaggcctttgggagtatgtggaatgtaccaggtgttgtgggaacaaagattggatgttgttcctaatctatttgaagaagtctagtcttgaatacaatcaggcaaatcctgattgtttttaaggaagtttataatttagtggttagttgggactggagccttttgatctggtttatgcatatataacttgcactacaattatctcattttttatatgacatctattaaggctctgcttgcaatgaactttctaattcttgcctgcgtactgttacatttcacttgaagttgaagaaatacattggttatatgtcatttggaaaactgaacattgttgacttggttaagtcagaaattgcaggttgtacctggataggatttaggcttttgaattgcagttgcagttatgtattgatgtaagattttgactaattggaatttcagtcacccaacaccgctaatgaagggttggagctgtcatttgttgttggcactcagcttattccacatccagacaaggctgaaaaaggtggagaggatgcacaatttgtcagcagtgacaatggaggtattcttgcagttgctgatggtgtttctgggtgggctgatgaaaatatagatccatcagtctttcctaaggagctaatggcaaacatatcaatttgtattggtgatgatgaggagattaaggatccccagtttctactgcaaaaggcacatgcgaaagtctgttctatcggttcagctacaataattgttgcaatgttggagaaacatgggacacttaaaattgcaaacgttggagattgtggattacgaatccttcgcaaaggccgggtaatattttctacatctccacaacaacattactttgactgcccattccagttaagctctgagagtgttggccaaacat

SEQ ID NO: 1906 - DNA, 689 bp, Fagopyrum esculentum
gaacagcaatcttcctcgaaggattatcaaggaaacgcaaaggcttcttagcgagccagctcccggaatcagtgcttctccatctgaagataacatgcgctacttcaatgtcatgatcctcggcccttctcagtctccttacgaaggtggtgtcttcaagttggaattgtttttgcctgaagagtatcctatggcaccaccaaaggtgcggttcctgaccaagatttaccatcctaacattgacaagcttggaaggatatgccttgacattcttaaagataaatggagtcctgccctccagattcgtactgtgctgttaagcattcaagctcttttgagtgctcctaaccctgacgaccccctttccgagaacattgccaagcattggaaaagcaatgaagttgaagctgttgaaactgcgaaggaatggacccgtttgtatgcaacaggtgcttgacaatagaggctccagaatttcatattactcatgtatcttgaaactaaattggtcatcttgatctctgataaagatcaaaaccaatgttgacttcatatgtaatttgtctcaagcagaacctaaacttgcgcttgtagatgatatgcttcaaacaaatgctatgatatttgggttacaatcatttttagatgatatgcttcaaaacaaatgctatgatatttgggttacaatc

SEQ ID NO: 1907 - DNA, 882 bp, Setaria italica
accagcaagcaagcgaccatttctttctccacgactccaccagcgccgcctctttgcccccaatctctctccgcctccaccgcgatcccaaggaccaccaaaccctagcccgaaggcccccctcctcagtccaccatggcccacagcaacctcccccgccgcatcatcaaggagacgcagcggctgctcagcgagccagctccaggaatcagtgcctcgccaacggaggagaacatgcgctacttcaatgtcatgatccttggcccgtcgcagtcaccatatgagggaggagttttcaagcttgaactattcttgcctgaagaatatccaatggctccaccaaaggttcgatttctcacaaaaatttatcaccctaacattgacaagcttggtaggatatgccttgatattttaaaggacaagtggagtcctgcccttcagatccgaacagttcttttgagcatccaggcgctgctcagtgccccaaatcctgacgatccacttgctgacaatgttgcaaagcactggaaatctaatgagactgaagctgtggaaacagccaaagagtggactcgtctatatgccagtggagagtgagctttgcacgatgcaatgcttgcttggtaataatcttcgtggtggagctcaacttgaacaaccattggctggttacatttgaaactgaaggggtctagtgatgtgtcgaattttatcctctttatgatgtgtcctacagtctgatgtacattaatctagctgggctgtgacgaaccctcatacatgtaaagtgttcctttggcatgtctggtacttgaccttgagaggttagatgattatacatatatcataataaatatgctgagatgatgtgtgtgcctgtta

SEQ ID NO: 1908 - DNA, 1246 bp, Pinus pinaster
ctcagaaacaagtatgtccttttctagagccatgtaccaaacacctgcacacctccacatgcgaagaggtcacgccctaaactttggggtgacgcaagcgtaacatcctttggaaatattaataatagtcaggacggatacacttgcttttaggattcctggaccattttaccattattttatacatttaattattatcgtcgggtttcactcttgctgtgacagaatgagggtttcttcataaatagagcctgaggtttggtccattaagcttcaaacgaacgataaggttcagatcgattctcttttgaagggctctctttcatctaccctgcagctatgtcgaacagtaatttgcctcgcagaatcataaaggaaactcaacgcttgcttactgaaccagcacctggtataagtgcttctccatctgaggacaatttacggtattttaatgtgatgattcttggtccatctcagtctccatatgaagggggtgttttcaagttggagttatttctgcctgaggagtatccaatggcagcaccaaaggttcgttttttgacaaagatttaccacccaaatattgataagcttggacgcatatgccttgatattctcaaggacaagtggagtccagcattgcaaattcgaacagttttactgagtatacaagcactgttaagtgcaccaaatccagatgaccctctttctgaaaacattgcaaaacactggaagacgaatgaaattgaggctgtggaaacagcaaaagaatggacaaggctgtatgcaagtggggcctgacattctacatcgattcattcaatagtactgttctaatgtccaggtctttgcatgtgtgttccaattggcgggcactgaaatgacgccgtctcaagtccaggtgcagatacctgaatttgttcagggaaaaatctgattgttccaaggaatctgttaatttagtgttatgttggggctgcagcctttcgatatacatatgggttttttcccatgtatcttatatgttttatggtacatctattaaggctctgatgtgaattttgaattcttacctagacaatcttacctttcacatttagtaatatgtcaatataatataatttcaaaaataaacaacgctgacttggataaatcgtatatttcaggttgtacctgcaaaggcttaggcttttgaattgcagttgtgtgattgattggaatttcataagaagacactgttttgaga

SEQ ID NO: 1909 - DNA, 1382 bp, Pinus taeda
tattttatacatttaattattatcgttgcgtttcactcttgctgtgacagaatgagggtttcttcataaatagagcctgaggtttggtccgttaagcttcaaacgaacatttaggttcagatcgattctcttttgaagggctttctttcatctaccctgcagctatgtcgaacagtaatttgcctcgcagaatcattaaggaaactcaacgcttgcttactgaaccagcacctggtataagtgcttctccatctgaggacaatttacggtattttaatgtgatgattcttggtccatctcagtctccatatgaagggggtgttttcaagttggagttatttctgcctgaggagtatccaatggcagcaccaaaggttcgttttttgacaaagatttaccacccaaatattgataagcttggacgcatatgccttgatatcctcaaggacaagtggagtccagcattgcaaattcgaacagttttactgagtatacaagcactgttaagtgcaccaaatccagatgaccctctttctgaaaacattgcaaaacactggaagacaaatgaaattgaggctgtggaaacagcgaaagaatggacaaggctgtatgcaagtggggcctgacattctacatcgattcattcaatagtactgttctaatgtccaggtctttgcatgtgtgttccaattggcgggcactgaaatgacgccgtctcaagttcaggtgcagatacctgaatgtgttcagggaaaaatctgactgttccgaggaatctgttaatttagtgtttcgttggggctgcagcctttcgatatacatatgggttttttttcccatgtatcttatatgttttatggtacatctattaaggctctgatgtgaattttgaattcttgcctaaacaatcttacctttcacattaagttagtaatatgtcaatataatataatttcaaaaataaacaacgctgacttggataaatcgtatatttcaggttgtacctgcaaaggcttaggcttttgaattgcagttgtgtgattgattggaatttcataagaagacactgttttgagattataaaaggcattttctgggctctaatgtggcactgattgtgattttcttccttttaagggtattagcacgttgcatttcaatttggttctgtcattcatgagtttcgattgcaatatttatatgttcattgcgctattttggtactttggctatgttcattgtgttgtatttttgtacttccgctatgttcattttgttgtatttgtggactttgaccttgtgtttcatttctacgctctttgtatattttcggcttataacctgttcatttttaagcctttgggaagtaaattatatattct

SEQ ID NO: 1910 - DNA, 789 bp, Pseudoroegneria spicata
  misc_feature (32)..(36): n is a, c, g, or t
tccttggtccttcctcccctcccctccgccgnnnnncgatccctcgaaaagaccacgaaaccctagccctagccccacccatctcctccatggccaacagcaacctccctcgccgcatcatcaaggagacgcagcggctgctcagcgagccagctcctgggatcagtgcttcaccatcagaggagaacatgcgctacttcaatgtcatgatccttggtccaactcagtcgccatatgaaggaggagtattcaaacttgagttgtttttacctgaagaatatccaatggctccgccaaaggttcgctttctcacaaaaatttaccatccaaacattgacaagcttgggaggatatgccttgatatcttaaaggacaagtggagtcctgcccttcagatccgaacagttcttttgagtattcaagcactcctcagcgctccaaatcctgacgatccgcttgctgacaatgtggcaaagcactggaaggccaacgagacagaagctgtggaaacagccaaagagtggacccgtgtctacgctaatgatgcatgagctctggcatgctacgactgattgctcagtagtcttggcgaggtggaggtgaaatcgactatcaagtggtttaaaatggagaggtcctgatgaactagtaaaatgtgaggtttccttgcatcgcttgtactgagtgtgatgtatattattaccctagttgggatgcgatggacccatgtgcgtgtatattatgttcgagtgttgtaccgtaataaacatcctgaagttatgtgtgcca

SEQ ID NO: 1911 - DNA, 878 bp, Secale cereale
gtcaacgacgagagtacgactggggacgaccacggaaggaatcgacttggttccgccgtcgtacgcccgccgtccctttcggtcccttccctcccccgaccctcctcccctcccccgccccgcccccgccccgatcgacaccacgaaaccctagccctagccccacccatctcctccatggccaacagcaacctccctcgccgcatcatcaaggagacgcagcggctgctcagcgagccagctcctgggatcagtgcttcaccatcagaggagaacatgcgctacttcaatgtcatgatccttggcccaagtcagtcgccgtatgaaggaggagtattcaaacttgagttgtttttacctgaagaatatccaatggctccgccaaaggttcgctttctcacaaaaatttaccatccaaacattgacaagcttgggaggatatgccttgatatcttgaaggacaagtggagtcctgcccttcagattcgaacagttcttttgagtattcaagcactcctcagcgctccaaatcctgatgatccgctcgctgacaatgtggcaaagcactggaaggccaatgaaacagaagctgtggaaacagccaaagagtggacccgtgtctacgctaatgatgcatgagctctgcatgctacgactgattgctcagtagtcttggcaaggtgaggtgaaatcgactatcaagtagtttaaaatggaggtccaactgatgaactagtgaaatgtgaagtttcctccttgcatcgcgtgtaccgagtgtgatgtatattattaccctagttggcatgcgagggacccatgtgcgtgtatatttcgttgaatgtttgtaccgtaataaacatcctgaagttatgtgtgcc

SEQ ID NO: 1912 - DNA, 1085 bp, Sequoia sempervirens
gtctttatattttcgcgttgctttgagagtttcttcatacatcgctctgcacgatcaaagcctttaatcaagcggcgctttgtataaaaatcgaccattctggaaagagattatttatttaaattttgtttatctgccatttttctcggatcgatacctgcgcagctatgtcgaacagtaatctgcctcgcagaatcataaaggaaacacagcgtttgctcactgagccagcgcctggtataagtgcttctgcatctgaggataatttacgatatttcaatgtgatgattcttggccctgctcagtctccatatgaagggggttgtttcaagttggaattatttttgcctgaagagtacccaatggcagcaccaaaggtccgctttctgacaaagatttaccacccgaacattgacaagcttggtcgcatatgcctggatattctgaaggacaaatggagtcctgctcttcaaattcgaactgttcttctgagcatacaagcattgttgagtgcaccaaatcccgatgatccactctctgagaacattgcaaagcactggaaatcgaatgaaactgaggctgtggaaacagcaaaagaatggacaaggctgtatgctagcggggcctgacattctataataattcacttcatatcacagttgtaacataggcttttggaagtgtgcactgtgtaccaggtctctattttatgggaacaagatttcgtgttcgcaatcctgttgcagaaatcttaaacttttaatacaatcaagcaaaaatctgattgtgttcatgagttttaatttagtggttagttggttctggagctttttgatctggattctgcatatagaacctgttctacatcacattttgaatggtacatctatcaaggctccacttgtaatgaattttcttattcttgtctggacacctgttacattccacttatagacaaagaaatacattaatgaacatggcttgataaatgaacaatattgacttgaatatagtcataaattgcaggttgcacctggacaggttctaaacttatgaattgcagtgcagttatgtattaatgtaag

SEQ ID NO: 1913 - DNA, 706 bp, Vinca minor
aacttacctcgtagaatcatcaaggaaactcagcgtcttcttagcgaacccgctcctgggataagtgcatctccgtctgaggacaatatgcggtacttcaatgtgatgattcttggcccaacacaatctccttatgaaggaggtgttttcaagttggaattattcttacctgaagaatatccaatggcagctccaaaggtcaggttcctcaccaaaatataccaccctaacattgataagctcggaaggatatgcctcgatatccttaaagacaaatggagtcctgcccttcagatcagaacggtgcttttaagcattcaagcgcttctgagtgccccaaacccagacgacccactttctgaaaacattgctaagcattggaaatcaaatgaggctgaagccgttgaaacagcaaaggagtggacacgtctatacgcaagtggtacctgaatcttatgcagattccatcttcccaaaaataacatgtgctatgtattttattgactgttgaattaatatgaaaatcatacctaattcactggaaattgagttattaaaaagcatccatcatgttatgcaggataattgttttattgctctaaacatgtttttcaaattgtaaaattaaatgaaagatctcatttcctggtgttcgtcttatttggtggtgtttgagcattttgatgtgaagttgtttaattagcag

SEQ ID NO: 1914 - DNA, 1117 bp, Triticum aestivum
cctacccctgctgctgcagctacgcgaaggcagtggtagtccaacgccgagtcgatggctgttcgctgacgccgcctcctttggtccttcctctcctcccttcccctccgccgcgatcgatcccaagagcacgaaaccctagccctagccctagccccacccatcttctccatggccaacagcaacctcccccgccgtatcatcaaggagacgcagcggctgctcagcgagccagctcctgggatcagtgcttcaccatcagaggagaacatgcgctacttcaatgtcatgatccttggcccaactcagtcgccatatgaaggaggagtattcaaacttgagttgtttttacctgaagaatatccaatggctccgccaaaggttcgctttctcacaaaaatttaccatccaaacattgacaagcttgggaggatatgtcttgatatcttaaaggacaagtggagtcctgcccttcagatccgaacagttcttttgagtattcaagcactcctcagcgctccaaatcctgacgatccgcttgctgacaatgtggcaaagcactggaaggccaacgaaacagaagctgtggaaacagccaaagagtggacccgtgtctatgctaatgatgcatgagctctgcatgctatgactgattgctcagtagtcttggaaaggtgaggtgaaatcgactatcaagtggtttaaaatggaggtccaactgatgaactagtgaaatgtgaagtttcctccttgcatcgcgtgtaccgagtgtgatgtatattattaccctagttgggatgcgatggacccatgtgcgtgtatatttcgtcgagtgttgtaccgtaataaacatcctgaagttatgtgtgccttctcttgctctacattaacttcttggcctttcctggtttgtttttatgaagtgtttgagaatttgttgtacgttctgcatgtgtgtatctttgttgtgagcgagagaatagttgtgtggtagtagtttctagatagaggttttacattgcgataccatggaacggatacatgaaagaacaaagcctacatgtggtggtctagtagtctactttttcctcgagtaatatgtagagctgcggcatag

SEQ ID NO: 1915 - DNA, 1049 bp, Triticum aestivum
cgctgacgccgcctccttggtctttcctctcctcccttcccctccgccgcgatcgaccccaagagcacgaaaccctagccctagcccaacccatcttctccatggccaacagcaacctcccccgccgcatcatcaaggagacgcagcggctgctcagcgagccagctcctggcatcagtgcttcaccatcagaggagaacatgcgctacttcaatgtcatgatccttggcccaactcagtcgccatatgaaggaggagtattcaaacttgagttgtttttacctgaagaatatccaatggctccgccaaaggttcgctttctcacaaaaatttaccatccaaacattgacaagcttgggaggatatgccttgatatcttaaaggacaagtggagtcctgcccttcagatccgaacagttcttttgagcattcaagcactcctcagcgctccaaatcctgacgatccgcttgctgacaatgtggcaaagcactggaaggccaacgagacagaagctgtggaaacagccaaagagtggacccgtgtctacgctaatgatgcatgagctctgcatgctatgactgattgctcagtagtcttggcaaggtgaggtgaaatagactatcaagtggtttaaaatggaggtccagctgatgaactagtgaaatgtgaagtttcctccttgcatcgcgtgtaccgggtgtgatgcatattattaccctagttgggatgcgaaggacccatgtgcgtgtatatttcgttgagtgttgtaccgtaataaacatcctgaagtcatgtgtgccttttcttgctctacattaacttcttggcctttcctggtttgtttttatcaagtgtttgagaatttgttgtacgttatgcatgtgtgtatctttgttgtgagcgagagaatagttgtgtggtagtagtttctagatagaggttttacattgcgataccatggaacggatacatgaaagaacaaagcctacatgtggtggtctagtagtctactttttcctcgagtaatatgtagagctgcggcatagag

SEQ ID NO: 1916 - DNA, 944 bp, Cedrus atlantica
tcttgctgtgactgagtagagggtttctttcatatatagaggttgagtttggtcgattaaacatcaagtgaacgacacagttgtaaagatcgatctctagaaggagaagaagaagggcttcgcgtttcgctgcagcgatgtcgaacagtaatttgcctcggagaatcataaaggaaactcagcgcttgcttagtgaaccagcacctggtataagtgcttctccatccgaggacaatctacggtattttaatgtgatgattctcggtccatctcaatctccatatgaagggggtgttttcaagttggagtatttttgcctgaagagtatcctatggcagcaccaaaggttcgttttttgacaaagatataccacccaaatattgataagcttggccgcatatgccttgatattctcaaagacaagtggagtccagcgctgcaaattcgaacagttttactgagtatacaagcactgttgagtgcaccaaatccagatgatcctctttctgaaaacattgccaaacactggaagacaaatgaagtcgaggctgtggaaacagcgaaagaatggacaaggctgtatgcaagtggggcctgacattctacaccgattcattcaatattacagttctaatgtcttcacagcaggtctttgcaagtgtgtttctgttggcgggcactgaaatgatgacgtctcaagtccagtcgcagatacctgaatatggtcagggaaactctgattgttccgaggaatctgttaatttagtgttttgttggggctgaagcctcttcatttacatatagttttttcttcccatgtatcttatatgtttagtggtacatctattaaggcttttatgtgaattttgaattctcttctagagactgttactttctcacatgaaagtaaaaaaaatgtcaatataagtatttagaaaaataag

SEQ ID NO: 1917 - DNA, 893 bp, Gossypium raimondii
tttctctttccatctctcaattctcaaaaccctaattctctgcttcccttttgctaatcaatcgatcctcgtcaatggccaacagtaatctccctcgaagaatcatcaggaaactcaacgtctcctcagtgaacctgcacctggaattagtgcttcaccatcagaggataacatgcggtatttcaatgtgatgatccttggtccaacacagtcaccatatgaagtggggttttcaagttggaactatctttgcctgaagaatattccatggctgctcccaaggttcgatttcttacaaagatatatcatcctaacattgacaagcttggaagaatatgccttgatattctcaaagacaaatggagtccagctctccagattcgaactgtacttttaagtattcaagcacttttgagtgctccaaatcccgatgatccactctctgaaaacattgctaagcactggaaaacgaatgaggctgaagccgttgagacggcaaaggaatggacccgtttgtatgcaagcagtgcatgaagactgtttggtatcatttgccctcttaaaatacatgttatgcagtgtaagctattccatgtcaattacatatggaaatttggaaaaattgatgtttagaaaagagtctgatattcaacaaaaagcttccagttgcgacctgtttatcgttttctggttggaagcagtcacttaagttgtatgaataaaaatacaatgttgtactaaaactctacaaatgctagaactaagagtattattctacaaaatcagcttatttcattgttctgttttattatgtattattaagttgatgcatacataacgtaagaaaaaaagtaaaacgtaccgacgtaggcgtacggccgtctcgtcgtagg

SEQ ID NO: 1918 - DNA, 991 bp, Podocarpus macrophillus
gcctgtggaggagggtttcttgatttaggggttagaggggttgagggtcgtgcaccaaggttccaaggcttctataatcttctctgatttgatccaatccgttctcctctcctcgactctcctggtcaccaggtcgaatctcaccagtgccatgtcgaacagcaatttgcctcgcagaatcatcaaggaaacccagcgtttgctgagtgaacctgcacctgggataagtgcttctccatctgaggaaaacttgcgatacttcaatgtgatgattcttggtccttctcaatctccttatgaaggggtgttttcaagttggagttatttttgcctgaagagtatcctatggcagctccaaaggttcgctttttgactaagatataccaccccaatatcgacaagcttggtcgtatatgcttggatattcttaaggacaagtggagtccagctcttcagattcgaacagttctactgagcatacaagcattgttgagtgcaccaaatccagatgatccactatctgacaatattgctaaacattggaaaacaaatgaaagtgaggctgtggaaacagcaaaagaatggacacggttgtatgcaaccggggcttgatattctatattgattgccctcaatacttcaattgtagcatgtactgttacgcaacacttgaagtcaaagaaatacgttgggttgcatgtcgtttggaaaatgatcaatgctgctgtacctgtggacaggatctaggcttttaaattgcagctgcaattatttgttgatgtaaaatctttatatattggaatttgacaaccatggagtttttaaaaattgtaaaatgttcccttcatggtgttattggctctcagacttccatttttccctacatgattgtttgaagttgtttcattctatatttctgctttgctcctttttccatacttgatgatcatgagcaagttgcatgtcgtacaggatttcttgtgctgtgtgt

SEQ ID NO: 1919 - DNA, 724 bp, Avena sativa
ttgatcccacggaaagcacaccaaaccctagaccccacccttgcacgccatggctaacagcaacctcccccgccgcatcatcaaggagacgcagcggctgctcagcgagccagctccagggattagtgcttcaccatcagaggagaacatgcgctacttcaatgtgatgattcttggcccatctcagtcgccatatgaaggaggcgtattcaagcttgagttgtttttgcccgaagaatatccaatggctccgccaaaggttcgctttcttacaaaaatttaccatccaaacattgacaagcttgggaggatatgccttgatatcttaaaggataagtggagtcctgcccttcagatccgaacagttcttttgagcatccaagcactgctgagtgctccaaatcccgacgacccgcttgctgacaacgtggcaaagcactggaaggccaacgaaacagaagctgtagaaacagccaaagagtggacccgtgtgtatgcgaatgatggatgagctttgcatgatcaagctggtaataatatccacatgatgcaggtttaaaatggaggtagaagggagtggaatgttaatttatccttgcatcgcgtgtaccgagtgtgatgtatattattagcctagttgggctgtgagggacccatgtacatgtataatgcatcctgaagttatgtgtgccttttcttgctctatgtttattttccgtcttcc

SEQ ID NO: 1920 - DNA, 692 bp, Platanus occidentalis
caatctacctcggaggattatcaaggaaacacagcggctcctcagcgaaccagctccggggatcagtgcgtctccttcggaagacaacatgcgatatttcaatgtcatgattcttggccccacacagtctccttacgaaggaggtgttttcaagttggaattatttttgcctgaggaatatccaatggctgcacccaaggttcgcttcctcactaaaatataccatcctaacattgacaagcttggaaggatatgcctcgatattctcaaagacaaatggagtccggctctacagatccgaacagtattactgagcattcaagcactactgagtgctccaaacccagatgatccactctccgaaaacattgcaaagcattggaagacaaatgaagtcgaagctgttgaaacagcaaaggaatggacccgtttatatgcgagcggtgcgtgatgacatggtggaagccttttcttgcaaataacattcctgtgatgtaagttactaggactgcgttttcaaatggaaatgaaagaattgataccaaaagtatcaaagcttagtgacctcaagctcttcggttacctgctatttttagtgttttcttccagttgaagttgtcttccgatttgtatgattagataaatattgctgttctctcttaatcttttatgtgatcaatacaatttagtac

SEQ ID NO: 1921 - DNA, 710 bp, Rhizophora mangle
gtcaagaacccttgatctgtctatccctactcgcgtagccgaattctctctactcacagagactcgaacaaacccaactctctctctctttctttctctgcggttggatcgaagagaagaatcggtgtagaaagaatggccaatagcaacttgcctcgaagaatcataaaggagacacagcgtcttctcagcgaaccagcgccaggaattagtgcctctcctgctgaagacaacatgagatactttaatgcgatgattcttggtccaacacagtctccatatgaaggtggggtattcaagttggaactgtttttgcctgaagagtatccgatggcacctcctaaggttcgctttctgacaaagatctatcatcctaacattgacaagcttggaaggatatgccttgacattctgaaagacaaatggagcccagctctccaaatccgaactgttttgctaagcatccaagctctgttaagtgcaccaaaccctgatgatcctctttccgagaacattgcaaagcactggaaaacaaacgaaactgaagctgtgggaacagcaaaggagtggacccgactatatgcaagtggtgcatgacgatgagagcagtttcacggagattccatttgtgcaatgcgtgctgaaatggtagcgttggatcttattatggaaatgatagacctgatgtatgaagcatcaaagatggatct

SEQ ID NO: 1922 - DNA, 1494 bp, Ceratodon purpureus
cttgcttggcttgcctcacaccctccctccctccccttccaaggcaacctccacaacctcctcaagctccacaaacactcaccttcttctcctcacacacagtcacaaacaaactccattttctgcttcaccttcactcaccaattgtgttccatatccatcaccatcaccatcaccagggaaaggccaacactcggggaaggtgggagccattctttgcctttgcatttgcatttgcattgccagggagcctcacaagtcatgtctgccactgccaacactaacttgcccaggcggatcatcaaggagacgcagcggttgctgagtgagccagctccaggaatcagtgcatctccatctgaggagaatttgcggtatttcaatgttatgatattggggccatcccagtctccgtatgaaggtggggtattcaagcttgaattgttcttgccagaggaatatcccatggctgcacccaaggttcggttcttgacgaaaatttatcatcccaatattgacaagttggggcgcatttgtttggatattcttaaggataaatggagtccagctcttcaaattcgcactgttctgctcagcattcaggcactcttgagtgcacctaatccagatgatcctctggctgagaatgtcgctaaacattggaaaacaaacgaggctgaggcagtggagactgccaaggagtggactcgcgtgtatgctactggggcctgattactcgtctcagatatgggcgcaccggatcggttcatgaaacacccgacaagttcaacaggatgatgggctaaagaaaacacgaaatgacatgttggtgaagggggacttccaaacctggatggtgcatacggtctcatttagcaaatatagtcatgcattgtcacggcaatccttgtccggattaccatttgtcccttaaggcgtggagaactaagtgttgcagtactgagaagtcctaccgcactgagaacttggcctattgagcttcttccctagttgtttctcttctgaatgtcatgatgtcgtagacaaggtgccattgtggtatctagcattatgagtcagtctgccgctccatcctttcaaccgtttaggctctgtttggttcttgtaatatctcagcgagggcttacatgattagtaagtcatgtgttagcatatatgggaaaacctccacctgtcttacgaatctaatttctggttgcttgtagcaatctttttgcattgtttatgtagttgggcaactccaacgatttattgggcagaatggtagttaggcctcttagtgctggaatccttgtcgttagaaccagtgactaattgtccagcaggctgaagtttagattgtaatcgatagcgtatgggacaaaatggtcattgagctcatggcttttgcggacttgcagtttatcatgaagatggcatgctgcaatgctgacaaacacccccgtcgataatccaacttgtgcaaaggtttac

SEQ ID NO: 1923 - DNA, 695 bp, Cephalotaxus harringtonia
aagaagcgagggaaatattatcaaaatagccataccactttggaagtagaaatgcaaataatatctgtttcaattcccagtatataaccaatccaagcattatagtctacaacattattcctctcgctctctttagctgcaatggccaacaccaatctgcctcgaagaatcatcaaggaaactcagcgcttactcagtgagccagctcctggtatcagcgcatctccttctgaggacaacttgcggtacttcaatgtgatgattcttggtcccacccagtctccttatgaagggggtattttcaagctggagttattcttacctgaagaatatccaatggctgcaccgaaggtgcgctttctaacaaaaatctaccacccaaatatcgacaagttaggtcggatttgcttagacattctaaaagacaaatggagtcctgctcttcaaattagaacaattttgctgagcatccaagcgctgttgagtgcgcctaatcctgatgatccactttctgataatattgcaaaacactggaaggcaaatgaagctgaggctgtggaaacagctaaagaatgggcaaggctgtatgcgagtggggcttgacattggaggcctgtctctttgagtaacacatttttattgtgttggttatcatccaattggtaacacgtttagttttttaaatttattactga

SEQ ID NO: 1924 - DNA, 1267 bp, Sequoia sempervirens
aattggaaacacatatctttttgtaactgtccagaatttatagttgtggtgtatttgtgaatcaatttaaccatagacagaagcagagtcaaggagggtattatcatcaacatcaccataggtcgctctctgcagctgaaatggccaatgcaaatctgcctcgaagaataatcaaggaaactcagcgattaatcagtgaaccagctcctggtatcagtgcttctccttctgaagacaatttgcggtacttcaatgtgatgattcttggaccctctcaatctccttatgaagggggttttttcaagttggagttattcttacctgaagaatatccaatggctgcaccaaaggtgcgctttctgacaaaaatctaccatccaaatatcgacaagttaggtcgaatatgcttagatattctcaaagataaatggagtcctgctcttcaaatccgaacagttttgctgagcattcaggcactgctgagtgcacctaatcccgatgatccactttctgaaaatattgcaaaacactggaaggcaaatgaagttgaggctgtggaaacagctaaagaatggacaaggctgtatgcaagtggaacttgacatttagaggtctgtttctttgagtaacacattaacaatgtgttggttatcatccaattggtaacacatttaacttttttctaatttattactgaatactaatgtaccatgtattttggtcaaagaaaatgatttaaattagaattattttctgtagtcaggaatatgatggatacttggaatgaagaagcatctattgtttctttgatagggcgatgtttgtcttaagattcatacataattgattatcaaaatgatactagtcttatatttaagagtgttttgtatggtgtatcaaattcttgccaaattgcaatgtatttcttggattaactgcatggttggtttgacattcctttccctgatgatgggtccagtagaggaccaaaatgtttgaacccaatcaaactatggagttgatcccagaagaatcttgcaacaagatacttgtctgttttgtaatttacatagcttaagtaaaatctaaacttctttcagaaatgagataaaataagctgatgaattgaacaacataaatatttattaaaagaactttggaagatgtcagaagttcagtcaaagaatgattaagacaacaaggtgaatatgatatagaatagtgaggccaggtgggtgcaaaaataaatttggaaggatgtaaagtc

SEQ ID NO: 1925 - DNA, 795 bp, Distylium racemosum
tagagattctcatggacatcacaaggaaaggtttggagccaaagaattagttcgcgtcttgccgacgccaattgtcagtgccaaataccggcacacttttgagctaagataaaaaattccaagcctcgatcccactcctagcctactttaattatagctaccctttagtcctggaattcttccccatacacgctgaggagtcgggttggctttctctctttttctctctatccgaagaagcagcaccaattgcgatggccaacaccaatctccctcgaagaatcatcaaggaaactcatcggttgctaagcgacccagctccaggcatcagtgcatcgccttctgaggaaaacctccggtatttcaatgtgatgattcttggaccccctcagtctccctacgaaggaggcgttttcaaattggagttatttttaccttgaagaatatccaatggctgcaccaaaggtgcgctttctgacaaaaatactaccacccaaatattgacaagttgggtcggatatgtctagatattctaaaagacaaatggagtcctgctcttcaaattcgaacagttttgttgagcatccaagcattgttgagtgcccctaatcctgatgatcccctttctgacaacattgcaaaacactggaaagcaaatgaagtggaagctgtggaaacagctaaagagtggacaaggctgcatgcaagtggggcttgactttgagaagcctatctcttttaataacacgttcatactgtgtcagttatcatccaattgtaaacacattagatttt

SEQ ID NO: 1926 - DNA, 1008 bp, Pteridium aquilinum
gtcaagggtgagggtaaagttttttcgttccaaagggaatacttactgtttggcaagtgctctacattattgggaatgagaattgtactgctcctgctgttttccgtgtctgtgcaacaatctgcttgatctgtcgaaggaaagatgtcttccaacgccaacctgccgcgacgcatcataaggaaactcaacgtcttcttagtgaaccagctcctggcattagtgcctccccatctgaagataatttgcgctattttaacgtgatgattctggggcctactcagtctccttatgaaggtggggtgtttaagttggagttatttttaccagaggagtatcctatggctgctcccaaggtccgatttttgacgaagatataccatcccaacattgataagctaggccgcatttgtctggacatcttgaaggataaatggagccctgcactgcaaattcggactgtgctcttgagcattcaggcactgttaagtgctcccaatccagaggatccactgtctgaaaacattgcaaagcattggaaaaccaatgaaaccgaggcagttgaaacagcaaaagaatggactaggatgtatgcatctggagcctagtcttggagaacacagtgatgcgcaacctcagttgcagctgaatcctcttcgcagttgaattttctgtataagtcaaaatgctggcagcaaaatgtacatttatcatatctacgcaaaagcctaaacatacctgtaggctgaaatgtcttggtggacaatctgcaggagtctttgcctttgttttgatagagtcatcagccacccaagcacatgacttgctaagacattggttagttgtgaacaatattcttgttgtgctcaaatgatctgcttaatgatttttgactatcttgctaaattgaggtcaaagacagtgtgctagtgccactttgtaattgggtgccttttgttcatttgaacttcatctctacttagtcatgcttgggctattgcgcaaaaa

SEQ ID NO: 1927 - DNA, 981 bp, Cryptomeria japonica
gggaaagaagaagaaactgaaaaagaggaattaaaataataaaataaaaaagggcagagatgctcatggacagccagccgcggtaatagcgttagaggaacgccaatagtccaaaatacccattaccacttttgaattggaaacacacgtctttttgaatgtccagaattatagtagttgtgtatctgtgaatcattttaaacataggcagaagcagaatcaagagggaattatcatcaacatcatcataggtctctctgtgcagctgcaatggccaatgcaaatctgcctcgaagaattatcaaggaaactcagcgattaatcagtgaaccggctcctggtatcagtgcatctccttccgaagacaatttgcggtacttcaatgtgatgattcttggaccctctcaatctccttatgaaggggggtttttcaagttggagttattcttacctgaagaatatccaatggctgcaccaaaggtgcgctttctgacaaaaatttaccatccaaatattgacaagttaggtcgaatatgcttagatattctaaaagataaatggagtcctgctcttcaaatccgaacagttttgctgagcattcaggcactgttgagtgcacccaatcctgatgatccactttctgacaagattgcaaaacactggaaggcaaatgaagctgaggccatggaaacagctaaagaatggacaaggatgtatgcaagtggaacttgacatttagaggtctgtttctttgagtacacattaacaatgtgttggttaccatcctattggtaacacatttaactatcttctaatttattactgaatactaatgtaccatgtattttggtcagagaaaatgattttaattagaattattttctgtagccaggaatatgataaatacttggaatgaagaagcatgcattgtttctttgatagggcgatgtttgtcttaagattcgtatataattgataccc

SEQ ID NO: 1928 - DNA, 847 bp, Picea glauca
gcagctatgtcgacagtgatttgcctcgcagaatcataaaggaaactcaacgcttgcttactgaaccagcgcctggtataagtgcttccccgtctgaggaaaatctacggtattttaatgtgatgattcttggacctactcagtctccatatgaaggtgcgttttcaagttggagttattcttacctgaagaatatccaatggccgctccaaaggtccgattttgacaaagatataccatccaaatatcgataagctaggtcggatatgtctagacattctaaaggataaatggagccctgctcttcaaattcgaacagttttgctgagcattcaagcattgttgagtgcacccaatcctgacgatccactttctgaaaacattgctaaacactggaaaacaaatgaagctgaggctgtggaaacagcaaaggaatggacaaggctgtatgcaagtggcgcgtgatagtgttttgagacttgtttctttgaataacacatttgtaatgtgcaagctgtcatcccattggtatcagacatggatttttcttaatttattagcgaatattcatgtatcatgtactttggtaacagggaatatggtctgaccagaccatgttgattggtatgtcagtcaaagaatgacatagcaactgtcactagcaacattatgatatttgtagaatttgtttatgtaaagttcctacggtatgccatgttaaggaaagaaatctggtataacaatctatagtgtagaagttttcacctagcaataggtgaaactttcctcgtcacagttttcaaaagttgaaagtcccctctaaaaagtccttactctaacttagggt

SEQ ID NO: 1929 - DNA, 607 bp, Carpinus betulus
gagaacccttctgcgtcttgcgtgctctgtaatcgaccacgaatggccaacagtaatctaccccaaaagaatcatcaaggaactcagcgtctcctaagtgaaccagcgccaggagttagtgcatcgccggtcggaggacaacatgcgattattttaatgtaatgattcttggcccgacgcagtccccatacgaagggtaggggttttcaagttggaactatttcttcctgaagaatatccaatggctgcctcccaaggtccgatttctgaaccaaaatatatcatcctaacattgacaagcttggaaggatttgccttgatattctgaaagacaaatggagcccagccctccaaataagaactgtacttttgagcattcaagcacttctgagtgccccaaaccctgacgatccactttctgaaaacattgccaagcactggaaaacaaatgaggctgaagctgttgaaacagcaaaggagtggacccgtttatatgcaagtggtgcctgatgacatggtggaagcttgtgcttccccaaaatgacattaatgaaatgtatgctattcactgtcaaattttaaatgaaatttggaacaattgatcttt

SEQ ID NO: 1930 - DNA, 611 bp, Brassica juncea
atcatcaaggaaactcaacgtctacttagcgaaccggctccggggataagtgcgtctccttcagaggaaaatatgagatatttcaatgttatgattcttggtcctacccagtctccttatgaaggaggagttttcaagttggagctctttttgcctgaagaataccctatggcagctcccaaagttaggtttctcaccaagatataccatcctaatattgacaagctgggaagaatctgtcttgatatcctgaaagacaaatggagccctgctttacaaatacgaacagtgctcttaagtattcaagctcttctgagtgcacccaaccctgatgatcccttgtctgagaacatcgctaagcactggaagagtaatgaggccgaagctgtggagacagctaaggaatggacccgtctttacgcaagcggcgaatgatgcgcagtcgagggcgaaaagatctcattcatccaaataacattacctttggtgaagtcttatcttttgttggttctttttatcattatgataaaaacgtgttttatgagacacgaagttgtaatctctctgaatgattgtttcattaactaatagggtcaagactcgttcatacc

SEQ ID NO: 1931 - DNA, 434 bp, Epimedium sagittatum
ggcgaactctaatcttcccagaaggatcatcaaggaaacccagcgtctcctcagcgaaccagctcctggaattagcgcttctccttctgaagaaaacatgcgttattttaatgtcatgatacttggcccaacacagtctccgtatgagggaggggttttcaagttggagttgtttcttcccgaagagtatccaatggctgctcccaaggtgcgttttctgactaaaatttaccaccctaacattgataagcttggtaggatatgccttgatattcttaaagataagtggagtccagccctccagatcagaaccgttcttttgagtattcaagctcttctaagtgctccaaacccagatgacccactctctgagaacattgctaagcattggaaggcaaacgaggctgaagctgttgagacagcaaaggaatcgg

SEQ ID NO: 1932 - DNA, 587 bp, Fagopyrum esculentum
gagagggaaaattaccgtgtattgccgtgtgatcgtagtagtgccctcttctctgctggaactcaaccctgcgtccatggcgaacagcagtttgccgcgaagaatcattaaggaaacccaacggctgctcagtgagccggccccgggcatcagtgcatcaccatcagaagataatatgaggtacttcaacgtcatgatccttggacctactcaatctccatatgaaggaggagttttcaagctggagttgtttttgcctgaagattatccaatggctgctccaaaggttcggttcctcaccaaaatatatcatcctaacattgataagctcggaagaatttgccttgatattctcaaagacaagtggagtccagctctccagatacgtactgtactcttaagcattcaagctttactgagtgctccaaatcctgacgatccgctttctgagaatattgctaagcactggaaagctgatgagcatgaagctgtagaaacagcaaaagaatggactcatctttatgcaactagtgaatgagtaaacatggaagggagactgcgcgtgcgcctcacggaattgactagta

SEQ ID NO: 1933 - DNA, 595 bp, Rhizophora mangle
gtggaggaaacttcctcaagaagaaccttctctttttcacgcagagaagagcctctctttttttgattgcttgcagagaatcaaaccctattctggctctcactcgctggagtggatcgtagccaagaattgaaatagaaagaatggaaaatagcaatttgcctcgaagaattataaaggaaacacagcgtcttctcagcgaaccagcgcccggaattagtgcgtccccggctgaagacaacatgcgatacttcaatgtaatgatacttggtccaactcaatctccttatgaaggtggggtattcaagttggaattgtttctacctgaagaatacccaatggctgctcccaaggttcgattcctgactaagatttatcatcctaatgttgacaagcttggaaggatatgcctcgacattctgaaagacaaatggagtccagctctccaaattcgtacggttttgctaagcatccaagctctattgagtgccccaaaccctgatgatccactgtccgagaacattgcaaggcactggaaaacaaatgaagctgaagctgtagaaacggcaaaggaatggacccatctctatgcaag

SEQ ID NO: 1934 - DNA, 1259 bp, Physcomitrella patens
ctaattgcaggcccctccctcgtcgtcgtgctcgtttgcttgttcgtacacttgcttgctcgctttgcgtttccgccgggccctgccgagctctgcagcgtgtccctcggctctgtctaagcctctttccgctccctctctctctctctcccttcattgcttgagtctccgtcctccccaccttcgctatttttttttccagtctttgtacctctccctctcggggcggacttgctgacctttgcgttgcgtagacgtttcgtttggcgcactcaccatgtctgctgctgccgccaatgcgaatctgcccaggcggatcatcaaggaaacgcaacgactgcttagtgagccagctccgggcatcagtgcatcaccatccgaggagaatttgcggtattttaatgtgatgattttgggcccatcacaatctccgtatgaaggtggagtgttcaagcttgaattgttcttgccggaggaatacccaatggctgcacccaaggttcgcttcttgacgaaaatttatcaccctaatattgataagttgggaaggatctgcttggatattcttaaggataagtggagcccagctcttcagatccgaacagttctattaagcattcaggctctattgagtgcacctaacccagatgatcctttggctgagaacatcgctaagcactggaagtctaacgaacaggaggcagttgagaccgcaagggagtggactcgttcctatgctagtggcgtctgaagactgtttaatcgtccagcccaacctttaaaaagctgagaagcataacaggagcaaatttgatgaactgtgtgtggccataggtgataggtcacctgtaggaagtatgattgtgaatgaggcactctaaaattctgaaggttatagtttgtccagttaagaatggagggtgcgagtaaccaagttcttgatttattctagatcattataaaccgtacctgtttatcttctttttcgtagtcctctcttcaaatgttgtgtccaggccagggcatcttttggtcaactcgtattaggcaggctttctttcagttttgttttaattcgactcagtcaggttctggtattgtatttgtaccatccccgaccaaggcaatgcttaatttgtagtgcatgcgttcaggataattatggactcaagagaagatatcatctacaatgaaaattctttcatgtttaacttgtacagacggcactgttgtgcatgatgcttatttcctactcaaaa

SEQ ID NO: 1935 - DNA, 1663 bp, Physcomitrella patens
tgtctgtctgtctgtatcgaactttctcttctggctctctccctttgctttctctctcgctctctctcctgctcttcctcgaattcgtagtttagtaggacccttcttcttcttcttcttcttcttcctcttcttcctcctccttgcccctcccctccatgccctaattgtaatcccgcccccatccccaagctccctcctcccctcccctccctcaattccattccattccgccctcgcccttccacgttgctgctgcttctgctgaaattcctcctcgctcgctatcccctccccctccctcctcgattccaccccgtccctcgtcttcctcccgcaggacattccgatttacagggggttgcgtgggccaggcactccatttgtcgcactcaacatgtctgccgctaccgccaacaccaacttgcccaggcggatcatcaaggaaacccaacgattacttagtgagccagctccgggaatcagtgcgtcaccgtcggaagagaatttgcggtatttcaatgtgatgattctgggcccatcacaatctccatatgaaggtggagtgtttaagcttgaattgtttttgccagaggagtatccaatggctgcacccaaggttcggttcttgacgaagatatatcacccaaacattgataagttgggacggatctgcttggatatcctcaaagataaatggagtccagctcttcagatccgcacggttcttctcagcattcaggctttgctaagtgcacctaacccagatgatcctctggctgaaaatatcgctaaacactggaagacaaacgaacaggaggctgtggagactgcgagggagtggactcgtttgtatgcaagcggcgcctgaagattgtttcgtactccggcccaactaataaaaagttgagatgctttataggagcgtgtttaggaaagaatttggtgcgactttgggggggataggtgccctggtcacctgtagcaagtaaggttgtggattagtcttctaacttctgaaagttattgctcattcattcaagtagggagagtgcacccaagttcttgtgatattccagtgcattataggatcacctgtctaacctctttttgcacacttatctcttagaatgttgtagtgtccaggcttagacctattttgttctatgccatatcaggcagccttgatttcaactttcttttcactagttgagcagattctggaaccgtgttcattctttatactatccccgacgaaggcactacttattttgtagcgcacacgttcagggcaattatgaaggactgaagagaagatactagggtgctgcgcatgaaaatttctccatgttttatctttagtttgagtgtttgtgtgcacagtagtttttttctcaccagaggcacttttgaaaagaaaagggactcatactgcaatggtgcatgaagggtacatttgtagggtagaatggactgttgcgcatctaatattagctgatttgattgaacatcaacgctagttttcatttttcatccactttgtttcgtgtactctgggtttccactagtagcctttattgattgtaggggtgtttcagctgacttgttttagagcgaattgcaatatagaacattcaaatggcggatgttacatcacttttgc

SEQ ID NO: 1936 - DNA, 1440 bp, Ceratodon purpureus
cgccatcgccatcgccatcgccatcggcaagctcgcgcacggtcgctcgctaccctaaccatcgccactccctcactcactccgacgcacgtctccactctccgcggctacctcggaccggcatcgcatcgccttgcgtgtgacctcggatcaattcagttacgaatttcgtttggaatcggaggtgctgacgggaggggcgggaggggagtgtcgcattggcaagggaagctcgcagtcatgtcttctgccgcgaccgccaacacgaacctgcccaggcggatcatcaaggaaacgcagcggttgcttagcgagccagctccagggatcagtgcatcaccgtctgaggagaatttgcggtatttcaatgtcatgatattgggaccatcccagtctccgtatgaaggtggggtatttaagctggagttgttcttaccagaagagtatccaatggctgcacctaaggttcggttcttgacgaagatataccatcctaacattgataagctggggcggatctgcctagatattcttaaagataaatggagccctgctcttcagattcgcactgtactactcagcattcaggctctcttgagtgcgccaaacccagacgatcctcttgccgaaaatgttgccaaacattggaaaacgaatgaagtggaggctgttgacactgctaagcagtggactcgtttatacgcaagcggcgcctgattattctctggcgcttcggtccaaaacatggagaggtgaggagcaggatcgaattctgagaaagaatatggaatgaccttacggtattggacggagtaccatatgggtgaatgttgccagggggggcacatataagaagtttagttgtgaatttgtcacttctatacttctgggggtcatggattgtccatccatgcagggagagggcaagcaacccagctcttggatattccagtgcgttacaagcctcccctgttcttttgcgtagtcatctcttatctttagtgtcattgtgtccaggccagggcctattttggtgttctgcatggcaggcagcctttcgttataccttctatccattcccttgattgagattctggtattgtatactttgtactaccccaatgaaggcctacataatttgtagtgcatgcgttcagggaaattacgaagggcacaaggaaaagcggccttatttgtacgcgctacagacattttttgtgtgcattgtaccaattcctcagcagtcaccatagttagcatgattagggtaaggtcagattctatcaaggttattgggaaaaaattataagtattagtagtggttcagatgcgtccgtgccgttagttatatatcaacgacttggtttcgcatgactttgaagtgaggctagacacctagaatgaagttcgtagctgttggcctgaaattggtcatcttga

SEQ ID NO: 1937 - DNA, 832 bp, Adiantum capillus-veneris
gtcatctaggaaaggctatattcgaaagtcatcttcgcgtgagatctccatagcttccttccacctgcatcaaagctcgcaagacctagtactcatcctgtccccaagtatgtctgctgcaaatacaaacagtaatttaccgcgtcgcatcatcaaggaaacgcaacgtctgctaagcgaaccagccccgggtatcagtgcctccccttcggaagacaacctgcgatatttcaatgtgatgatcctcggacctacacagtcggcctatgaaggaggagtgttcaagctggagctattcctaccagaagaatatcccatggctgcaccaaaggtgagattcctaacaaagatataccatcccaatattgacaagcttggacgaatttgcttggatattctgaaagacaaatggagcccagctctgcagattcgaactgtgcttttgagcattcaggctctccttagtgccccaaatccagatgacccactatcagagaacatagccaaacattggaagacgaatgaggcagaggctgtggagacagccaaggagtggacccgactgtatgcttctgcttgatggtgtcaattatattcgaaatattttgtttacttgatgaaggaaagttacatacacgcatgccattgtactgagctgaagcaactggtggaacttgcctctgtgttttacaaaatacgctaggctgatcataacagttaatagacagtttgcagcaatgccaaaagtctaactgacacagatgaaattacgattgtttttgctgtcagtctggctttgaaagattaaaattctaaaattactcttcctctc

SEQ ID NO: 1938 - DNA, 580 bp, Fraxinus spp
ttaccgcgaagaatcatcaaggagactcagcgtcttctcagcgaaccagctccaggataagtgcatctccatccgaagagaatatgcggtatttcaacgtaatgattcttggtccaacgcaatctccttatgaaggaggtgttttcaagctggaatgtttttgcctgaagagtacccaatggctgctcccaaggttcgtttcctcacgaaaatctaccacccaaacattgataagcttggaaggatatgcctagatattcttaaagacaaatggagccctgctcttcagattcgaacagtacttttgagtattcaagcactcttgagtgcaccaaacccagaggatcccctctcagaaaacattgctaagcactggaaaacagacgaggctgaagccgttgaaacagcaaaagaatggacacgcttgtatgcaagtagtggtgcatgaagtgtgtagagtgtaaggcttccgtaaataacaaaccatgtactgatcgactgttgaatgaacttggaaaaattgtaatataatgttctcaatgtccagcatttctgctgtcaacttttttctgtactctgt

SEQ ID NO: 1939 - DNA, 826 bp, Malus domestica
aaggaaactcaacgtctgctcagtgaacctgcaccggggattagtgcttcaccgtcagaagagaacatgcgatacttcaatgtgatgatccttggcccaacacaatctccttatgaaggaggagtcttcaagttggaactctttttgcctgaagaatacccaatggcagctccaaaggttcgatttctcactaaaatttatcatcctaacattgacaagctgggaaggatatgccttgatatattgaaagacaagtggagtcctgctctccagatccgaactgtacttttgagtattcaggcacttttgagtgccccaaaccccgacgacccgctctcagagaacatcgcaaagcattggaaatcaaatgaggctgaagctgttgaaacagccaaggaatggacccgtttatatgcaagcggcgtgtaatgacatggtgaaaactttatccttccctaaaataacattaatgcaatgtacgctattcgctgtcatttttaaaatgaaaatttggaagaattgatgtttgaaatattggaagtttaatgttcacaagctaccatttgctgcctgataacttgttccatctctttcggaagctcgtctgtgaacttgtatgatcaaggattaaggtattttctatctccactctcaaacgaccactgtgggggtttgttataggcacttcaaaatatggatttctggcaatgaatattgtgaataattatttactaattttctttctcgttttgctttgttttgaagaattgtattcccggttggttatgacaatttttggttgaattgtatttggttgcttggatta

SEQ ID NO: 1940 - DNA, 573 bp, Eschscholzia californica
tcaaggaaacacaacgactcctcagtgaaccagctcctggaattagtgcttctccttcagaagataacatgagatatttcaatgttatggttcttgggccatctcaatctccttatgaaggcggtgtcttcaagttggagctgtttttgcctgaagaatatcccatggcggcgcctaaggtccgctttctgaccaaaatttaccatccgaatattgacaagcttggaaggatatgtcttgatattctgaaagataaatggagtcctgctctccagatacgaactgtactcctcagtattcaagcacttctaagtgctccgaacccagatgatccgctctctgaaaacgtcgctaagcattggaaagctaatgaggttgaagcagttgaaacagcaaaagagtggactcgtctttatgctagtggtgcatgagagcaagatggctgtaaggaacccacatgttggtgcaaacaacgattaacgcagtataagatcagaaaaatgaagctagatgggatcgttttcaaaatcggacaaaagaacaaatgtcattattgtcaaaagatcattacta

SEQ ID NO: 1941 - DNA, 565 bp, Vinca minor
acttacctcgtcgaatcatcaggaaactcagcgtcttcttagcgaacccgctcctgggataagtgcttctccttctgaggacaatatgcgctacttcaatgtgatgattcttggtccaacacaatctccttatgaagggggtgttttcaagttggaattattcttacctgaagaatatccaatggcagctccaaaggtcaggttcctcaccaaaatataccaccctaacattgataagctaggaagaatatgtcttgatatcctcaaagacaaatggagtcctgcccttcagattagaacggtgcttttaagcattcaagcgcttctgagtgccccaaacccagacgatccactctcagaaaacattgcaaagcattggaaatcaaatgaggctgaagctgttgaaacagcaaaggagtggacacgtctatacgcaagtggtgcctaaagcatatgcagattctatggtcccaaaaatacaaatgctgtgtattttattgactgttgaattaatatgaaaatttggaagaaacattgatgcctaattcacggggtaatttagtgt

SEQ ID NO: 1942 - DNA, 1629 bp, Marchantia polymorpha
  misc_feature (1316)..(1316): n is a, c, g, or t
  misc_feature (1508)..(1508): n is a, c, g, or t
tgttgcgggtgtcgttgcaacactgttgtagctggtgctggtgtcgggcctagtgctctagtgctgggcgaaattgaagcggtcgggagctagattcctcaagattggatcggctgcagaagcgaaggattttgctgcgggatctgccagggggtgagacgagcagtacgggtgggcgggttggttggttggttggttgattgattgattgattccgagcagcacgagagaggaaggaagggagacagagagcaggacgagacggttcgaccggtggtggcagaggaagggcgaggtgcctttggtggtattgctgttgctgctgctgctgctgccgccgcctaggtgaaggagagtgacagggagtggctggcgcgctgccttgcttctggggcgagggttgagagcgaggatctttggacaagaggcgggagaagattagcgtttcgggttgggttccggggcgaccttggcgttacactgcaacatgtcgggaaccaccgccaatagcaatctacctcgcaggatcataaaggaaacgcagcgattgctaagtgaaccagcaccgggcataagtgcgtcaccttcggaggagaacctgcgttacttcaatgtcatgattttgggcccgacacaatctccatatgaagggggtgtgttcaagttggagctcttcttacctgaagagtatcctatggctgctcctaaggtgagattcttgacaaagatctatcacccaaatattgacaagttggggcgaatctgccttgatatcctgaaggacaagtggagtccagcacttcaaattcgaactgttcttctcagtatacaggcattactaagtgcacccaacccagacgatcctcttgctgagaatattgctaagcattggaagactgacgaagctcaggctgtcgcaacagcgagggagtggactcgactttacgcaactggagcgtaattcagagataatcattaaggagagcttacatggaaagtggatgcgatttagagttcccaggcaggcgcagcagtagacagagagttgatatatcacaatctatcctctgttatggctggtcacaacggaatgaagacctaacttgaagcatcatggaggttcagttgctttcagtcaaaactacacccagatactacggaggtcagaaataggcccttgaatctggaaaggacttatctatttagtgccacaaccccaaacgagcaacagacttcctcggcttcatgtccagcaacactccctgaagatgccgggccttattcatgatcatggttttgtttgctctagagttatnttcttttccaatctgatataagttagaaggtgtccaaagcgttctagacttttacttttgccacattcgaaggatgatttttctagcccgttggttctattctttcttagctggttgtggccaaagaccaggagtttgcttctcttccacatgtatatctgtgcagacgacgagtgtaaagttggtctcaanctgtcaatcaaatgctgcaccacttacagcgaactcttaaacaccacccgttgtgatgttttatgaagaagtttatacacgaggtcaagtctgaaaagtcacttcaggacatatttcaggc

SEQ ID NO: 1943 - DNA, 906 bp, Pteridium aquilinum
cgagtgacttatgaggtcttagggaaaaagcaaagcgccatattcaagcaagcaaggcgagtgagatctccatagcttcaactgcaccgaagctctagcataatcgaaaccctaaccctaatctacaacaagcatgtctgcggctaatgcaaacagcaacctacctcggcgcatcatcaaggaaactcaacggctgttgagtgagccagccccggggatcagtgcttccccctcggaagacaaccttcgctatttcaatgttatgattcttggaccctctcagtctgcctacgaaggaggagtttttaaacttgagctgtttttaccggaggagtatccaatgtctgcccctaaggttcgatttttgacaaagatataccatcccaatattgacaagctgggtcgaatttgcttagacattcttaaagacaaatggagtcctgctttgcaaattcgaactgtccttttgagtattcaggctcttttgagtgccccaaatcccgacgacccactttcggagaatatagccaaacattggaagactaatgaagcggaggctgtggagacagccaaggaatggactcaactatatgcatctgcttgaagggcctcggaacattctgttacctgatcgaaggaaaatatcatacacgttatttgtattgggcttcccttagggaaacaatgcttccaagtgagaagcaactgatggaatttacctgtgtaattttacaaataaggtaggctgattgtgacaagacattaagctaaaattgaccatcacataccatggttaattggtgtactggttttttgtcattgatttggcacctgggcaccttcaaagtggtttcttttggaccatggattcctggcatattttctgtaatgtttaccacttactta

SEQ ID NO: 1944 - DNA, 620 bp, Arnica chamissonis
ggaaactcagcggttactcagcgaaccagctccggggataagtgcatcaccatctgaagataatatgcgatattttaatgtcatgatccttggtccaacacaatccccatatgaaggaggagttttcaagctggagttatttttgccagaagaatatccaatggctgctcccaaggtgcggtttcttacaaaaatttaccatccgaatattgacaagcttggtaggatttgtctggacatcctcaaagacaaatggagccctgctcttcagattcgcactgtactcctgagcattcaagctcttctaagtgctccaaatccggatgatccgctttctgagaacatagcaaagcactggaaatctaatgaagccgaagctgttgaaacagcaaaggagtggacccgtttgtatgctagtggcgcttaacggacacatgggtgattatgttgtgtttgaaagaaaataacagtgtatttggttaggtcttgaaattcaaaacttgaatgattcagcctgttgcaatgttgttcaatttcttgtgtttttggagataattttgttattctggtcaactatgtaaaatagcgtgggtaaaagggttgtgttagatcaggttttt

SEQ ID NO: 1945 - DNA, 837 bp, Citrus clementina
gttggctgtagtttcattggtcgttggagaaaattaagtacccttcgagtgacgcaaaccttttttatcaattgagggaagcaaaggctgagtgggggacgcgaaacatccctttgattgatgttagcttaaaatctccccattcacaagtcacgagaaaaagagggagagggaaaaaaagacgatcgatttctgactcatctctgtaaaatctcttggaattccgatggctagtggcaacctccctcgcagaattgtcaaggaaacccagcggctgctcagtgaaccagctccgggcattagtgcttctcctgccgaagacaacatgcgatattttaatgtaatgattcttggtccatctcagtctccttatgaaggtggggttttcaagttggagttgtttttgcctgaagattatccaatgtccgctcctaaggttcgatttctgaccaaaatatatcatcctaacatagacaagcttggaaggatatgccttgatattttgaaagataaatggagtcccgccctgcaaatccgcacagtcctgctgagtatccaagctcttttgagtgctccgaacccagacgatccactttctgataacattgcaaagcattggaaggcagatgagactgaagctgttgaaactgcgaaggaatggacccggttatatgcaagtgatgggtgaaggctagagcttgttcgagaatatctctctacaagtttatgttaaaaacactaattgatgtatgaacagatgtgtaaaaatgtttctcaatcggtctgttatttgaatgttccacttgtatcgtcattaattgaaagtgcatgcttttt

SEQ ID NO: 1946 - DNA, 848 bp, Citrus sinensis
gttggctgtagtttcattggtcgttggagaaaattaagtacccttcgagtgacgcaaaccttttttgtcaattgagggaagcaaaggctgagtgggggacgcgaaacatccctttgattgatgttagcttaaaatctccccattcacaagtcacgagaaaaagaaagagtaaaagagggagagggaaaaaaagacggtcgatttctgactatctctgtaaaatctcttggaattccgatggctagtggcaacctccctcgcagaattgtcaaggaaacccagcggctgctcagtgaaccagctccaggcattagtgcttctcctgccgaagacaacatgcgatattttaatgtaatgattcttggtccatctcagtctccttatgaaggtggggttttcaagttggagttgtttttgcctgaagattatccaatgtccgctcctaaggttcgatttctgaccaaaatatatcatcctaacatagacaagcttggaaggatatgccttgatattttgaaagataaatggagtcccgccctgcaaatccgcacagtcctgctgagtatccaagctcttttgagtgctccgaacccagacgatccactttctgataacattgcaaagcattggaaggcagatgagactgaagctgttgaaactgcgaaggaatggacccggttatatgcaagtgatgggtgaaggctagagcttgttcgagaatatctctctacaagtttatgttaaaaacactaattgatgtatgaacagatgtgtaaaaatgtttctcaatcggtctgttatttgaatgttttacttgtatcgtcattaattcaaagtgcatgcttttt

SEQ ID NO: 1947 - DNA, 601 bp, Musa acuminata
cttccctcgttgctttttcccagccaagcattcggtcacgtttcgcctcctcacttcctccatcgatcagagagaggagtgcttcaagcgagtacgattgaagccgaggcatatcgctgtctcgatggcgaacagaaatcttccccaacggatcatcaaggaaacccagcggctccttagcgaaccagaacctggcataagtgcattgccgtccgaggacaacatgcgcagcttcagtgtgaagatcctcgggccaaatcagtctccatatgaaggaggggttttcaagcttgagttgtttttgcctgacgaatatccaatggttgccccaaaggtccgtttcctcaccaaaatttatcatcctaacattgacaagcttggaagaatatgccttgacattctgaaggacaagtggactccggccctccaaattcgaacagtactactcagtattcaagcacttcttagtgctccaaacccagatgatcctctttcagaaaatattgctaagcattggaaggcaaatgaagcagaagctctagaaacagcaaaagaatggacgcatgtttatgctagcggtgcataaaaatcattgcagaca

SEQ ID NO: 1948 - DNA, 422 bp, Raphanus sativus
  misc_feature (60)..(60): n is a, c, g, or t
  misc_feature (78)..(78): n is a, c, g, or t
  misc_feature (96)..(96): n is a, c, g, or t
  misc_feature (99)..(99): n is a, c, g, or t
  misc_feature (246)..(246): n is a, c, g, or t
  misc_feature (252)..(252): n is a, c, g, or t
  misc_feature (291)..(291): n is a, c, g, or t
  misc_feature (294)..(294): n is a, c, g, or t
  misc_feature (351)..(351): n is a, c, g, or t
  misc_feature (357)..(357): n is a, c, g, or t
  misc_feature (360)..(360): n is a, c, g, or t
  misc_feature (362)..(362): n is a, c, g, or t
  misc_feature (407)..(407): n is a, c, g, or t
agtaatcttccacgaaggatcatcaaggaaactcaacgtctgcttagtgaacctgctccngggataagtgcgtctccntcagaggaaaatatgcgntanttcaatgttatgattcttggtcctacccagtctccttatgaaggaggcgttttcaagttggagctctttttgcctgaagaatatccgatggcagctcccaaggttaggtttctcaccaagatataccatcctaacattgacaagctnggaagnatctgccttgacatactgaaagacaagtggagtcctgcnctncaaataagaactgtgctcttgagtattcaagctcttctaagtgcaccaaacccagangatccnctntntgagaacatagctaagcattggaagagtaatgaagcagaagccgnggagacagctaagga

SEQ ID NO: 1949 - DNA, 661 bp, Cirsium arvense
atcaaggaaaactcagcgcttgctcagcgaaccagcaccggggataagtgcatcgccatctgaagaaaatatgcggtatttcaatgtcatgattctaggcccatcacagtcaccttatgaaggaggagtctttaagctggagttatttctgcctgaggattatccaatggctgcccccaaggttcgattccttacgaaaatataccatccgaatatagataagcttggtagaatatgtcttgatatcctaaaagacaaatggagccccgctcttcagattcgcaccgtactcctcagcattcaagcgcttttaagcgctccaaacccagatgatcccctgtccgaaaacatagcaaagcattggaaatcaaatgaagcagaggctgtggaaacagccaaggagtggactcgtctgtatgcaactggtgcttaatcgaatgtattgctactcgtgcttctgtcactttgtaaatccaaaacggaattgccctcaaatttcaattggtttatcgatacaagttttctactaccacatttcaaggatacatacttttcgtttacaaatagtcaaaaagtggcaatgcattatcggttttagtctaaagtgtgtaattgatataattgactcgatacattttaactactatgctgactactgggt

SEQ ID NO: 1950 - DNA, 787 bp, Lippia dulcis
atgcattcagcattaaaccctcacccctttcttcctcgctccctcattcatactcatccaaatcctttctgctctaatcattaatcaattggctactgccaatttacctaggagaatcgtcaaggaaacacagcggctcctcagtgaaccagctcccgggattagtgcttcaccttcggaagataatgtgcgccatttcaatgttatgatacttggcccatcccaatctccatatgaaggtggtgtgttcaagctagaactgtttctacctgaagatatccaatggcacctccaaaggtgcggtttcttactaaaatataccatccaaatatcgacaagctcggtcgtatatgcctggatattcttaaagataagtggagtccggctctccagatacgaactgtactcataagcatacaagcacttcttagtgcgccaaatcctgatgatccacttgcagacaacattgctaagcattggaaagccaatgaaacggaagctgttgaaacagcgaaggaatggacacgcttgtatgcaagtgatgcatgaagttgttaccgataatacaacgagttcgtctggcttctttgacatgttttgatagcgaaatgagagaaccattatattcccaataaaatttgtacagtaaatgcaaaaatttctatgtgcgacatacgctccgctatgttgtagctcacaatatcaactctttgtacaacattatctgagagtcccaatcagactatttttcagcaatagatttccccttgaagcgttcaaaaaagaa

SEQ ID NO: 1951 - DNA, 1060 bp, Ceratodon purpureus
cccgcagccctaattctctggcaacgcactccactgcactgcactgcaccaccatcgccatcatcatcatcaccaccatcatcgcagtttgaggacaccgccgaggccgcctcgcgtggcacaccccgccatgtcggcccccgccaccgccaacgccgccctcccccgccgcatcatcaaggaaacgcaacgattgcttagtgagccagctccgggcattagtgcgtctccgtctgaggagaatttgcggtatttcaatgtcatgattttggggccatctcaatctccttatgaaggtggtgtctttaagctggagttgtttttgcctgaggagtatccaatggctgcaccgaaggtccggttcttgacgaagatataccaccctaatattgataagctggggcgcatctgtttggatatccttaaagacaaatggagcccagctcttcaaattcgcaccgtgctactgagcattcaggctctcttgagtgcaccgaacccagatgatccactggctgaaaatattgccaagcactggaagacgaacgaagcggaggctatggagactgcaagggagtggactaaagcatatgcaagcgcttaaagactcactggtactcgggttcaatctatgaaaagctgagaaacttagaacagggacgagattgaggaagatcttgtcctatcagcgacagtattggatgagttaccatgtgcgattggtgccagggtctcccataagaatttttattgtcgagtagtcatctccatgcttcttagggtcgtggtttgtccatttaagcaggggtagtgaaagtaatccagttcttcgacgttctggtccgttagaaacttaccctgtttaacttccttggaatagtcatctcctatccaaatgttgtgtccaggacacggcctattttgatgttctgtatagcaggcagccttttaatttgtaagaccttcgattgagtcagattctttacgccatcccagcgaaggccgaaatcatttgtagcgcatgtgatccaggaattacagtatatatgattgactcaaa

SEQ ID NO: 1952 - DNA, 506 bp, Leymus cinereus x Leymus triticoides
ccggcacgagggcatcatcaaggagacgcagcggctgctcagcgagccagctcctgggatcagtgcttcaccatcagaggagaacatgcgctacttcaatgtcatgatccttggcccttcacagtcaccatatgaaggaggagtattcaaacttgagttgtttttacctgaagaatatccaatgtctccgccaaaggttcgctttctcacaaaaatttaccatccaaacattgacaagcttgggaggatatgccttgatatcttaaaggacaagtggagtcctgcccttcagatccgaacagttcttttgagcattcaagcactcctcagcgctccaaatcctgacgatccgcttgctgacaatgtggcaaagcactggaaggccaatgaaacagaagctgtagaaacagccaaagagtggacccgtgtctacgctaatgatgcatgagctctgcatgctacgacttattgctcggtaatcttgacgaggtggaggtgaaatcgac

SEQ ID NO: 1953 - DNA, 534 bp, Primula obconica
aaaaaacaaacatcgtttgtcatttgtttttagttgagagaaagtactcgagccatcattcagctcaactttcttctctgtctctctttattacatgtatatatatatatatcagaagaaataggccaacagcaatctacctcgaagaatcatcaaggaaactcagcgtcttctcagtgaacctgcacctggaattagtgcgtctccttcggaagaaaatatgcgttactttaacgttatgattcttggtccaacacagtctccttatgaaggaggggttttcaagctggaattgtttttgccagaagaatacccaatgacggctccaaaggttcgatttctcacaaaaatctatcaccctaatattgataagctggggaggatatgccttgatattctcaaggacaaatggagccctgcccttcagattcggactgtgcttttgagcatccaagcccttctgagtgctccgaacccggacgatcctttatctgagaacattgccaaacattggaaatcaaatgaagctgaagc

SEQ ID NO: 1954 - DNA, 852 bp, Allium cepa
tatttccattaggctaggaatcatgatttcatgaattctcggacatacatggttactttatatagattcttttttgctttatctatgcgaagaacggaaaaactaagcgattataataaagcgtatacagagaggaaagaacaagtaaaaaccactttttcttggcttttggtccatcagaagggaaaattatcaaaaatttagaatatcttggcatggcaaacagcaatcttcctcgaagaatcatcaaggaaacgcagagactgttgagtgaaccagctcctggaattagtgcatcgccatctgaggagaatatgcgatactttaatgttatgattctcggtccatctcagtctccatatgaaggtggggttttcaagcttgaattgtttttgcctgaagaatatccaatggctgctcctaagcttggaagaatatgcctggacattttgaaagacaaatggagtccagctttgcagattcgaactgtattgttaagtattcaagcacttttgagtgctccaaatccagatgatcctctttcggaaaacaattgccaagcactggaaaacaaatgaagccgaggctgtcgaaactgccaaggaatggacacacttgcatgccagtggtacttgaatattttacaattaatgtaactacaataagccagttatatgcaaatgcaagaatccttattattatcctatatatcaatgaaaaacctctgaattgagagcctctaactgtttgatcattatcctgtataacgacgctttcttcagggcagaacgatactgattatatatgtaccagcatttctgtttaaaatcttcccttgggtggatgttcaac

SEQ ID NO: 1955 - DNA, 486 bp, Bupleurum chinense
tctaagcgaaccagcccctggaataagtgcatcgccatctgaagagaatatgcgatactttaatgttatgattcttggtccaacacaatctccatatgaaggtggggtttttaagctggaattgtttttgccagaagaatatccaatggcagctcctaaggttcggtttctcaccaaaatttaccatcctaacattgacaagcttggaaggatatgtcttgatattctgaaagacaaatggagtcccgcacttcaaattcgcacggtactgttaagcattcaagcacttttgagtgctcctaaccccgatgatccgctctcggagaacattgcaaagcattggaaaacaaatgaggctgaagcggttgaaaccgcaaaggaatggacccgtttatatgcaagtggcgcgtgatgaagttgtgggaaccgaaaaggggccaaaataacaatatctgcaatgtactctaatgactgtttaaatcaaat

SEQ ID NO: 1956 - DNA, 501 bp, Fagus grandifolia
aaattagctttaaaatccttccccatattatttctactttctgcgtttctctttcttcaccttcaaacctcaatctctctcccaaatcttggaagaatctatggcgaacagtaatctccctcgacgaattatcaaggaaacccagcggcttctaagtgaaccagctcccggaataagtgcttctccttcagaggaaaacatgcgatacttcaatgttatgattcttggtccagctcaatctccttacgaaggtggagtgttcaaattagaattgtttctgccggaagaatatccaatggcagctcctaaggttcgcttcctgaccaaaatatatcatcctaatattgataagcttggaaggatatgccttgatattcttaaagataagtggagtccagccctccaaatccgaacagtattgctgagcatccaagctcttttgagtgctccaaatcctgatgatccactttccgagaacattgcaaagcattggaagacaaa

SEQ ID NO: 1957 - DNA, 757 bp, Centaurea maculosa
  misc_feature (717)..(717): n is a, c, g, or t
agctcttctctctcgctcaaaaaacccttaaaagcagtagcgtgcgttttgcattctacctacggagataaatggtcagcattaatctccctcggacaatcgtcaaggaaactccgcgtctcctcggtgaaccagctccaggaattagagcttccccatcggaggataatatgcgagattttaatgtcacgattcttggcccaacacaatctccgtatgatggaggggttttcaagctggaattatttctgcctgaagaatatccaatggctgcgtctaaggttcgatttctgactaaaatataccatcctaacatcgatcagcttggaaggatatgccttgacattctgaaagacaaatggagtcctgctcttcatataccaactgtgcttttgagcatccgagcacttcttagtgctccaaaccctgatgatccactttctgagaacatcgcatagcattggaaaacgaatgaagcagaagctgttgagacagctaaggagtggacccgtttatatgcaagtggtgcatgattgcatggtggaaacttgccttctaatgacaggggatgcatgcttttgacttgatttgaaaggaaatttggaagagacgatgtttgaacaatctgtagtctaatatttttcaaagcttccagatactttttgttaaattgttttgctgtcggacgcatcgtctttgtgattgtatgaccagatnacatacgttattcatctcagtgtcactctgcagctatctc

SEQ ID NO: 1958 - DNA, 672 bp, Cyamopsis tetragonoloba
  misc_feature (1)..(1): n is a, c, g, or t
  misc_feature (37)..(37): n is a, c, g, or t
  misc_feature (59)..(59): n is a, c, g, or t
  misc_feature (109)..(109): n is a, c, g, or t
ngaaatcatgtttgtgatgctaccaaattagaattanggagtgagccagctcctggaantagtgcttccccttcagaagacaatatgcgatatttcaatgtgatgatcnttgggccaacccagtctccttatgaaggaggagtcttcaaattagaactattcttgccagaagaatatccaatggctgctccaaaggttcggttcttgacaaaaatatatcatccaaacattgataagcttggcaggatatgtcttgacattctgaaagataagtggagtcctgcccttcaaatacgcactgttcttttgagcattcaagctcttttaagtgcaccaaatccagatgatccactttctgagaacattgccaagcattggaaatctaatgaagccgaggctgtcgaaacagcgaaggaatggaccagattatatgcaactggtgcctgatgataggttttcaaactcttggtcctaaataacagtggtaacagtcaatctcaattagaaacatgaacgaattgatgtctgaactattaatattcctcgcagcttccagttacctgttaatttcctctctaggaagctgcttcttggagcttatatgaatacttgtattgtattgtattgattacaatatctcaatttagaacatgcttcagtctttctttccat

SEQ ID NO: 1959 - DNA, 473 bp, Pteridium aquilinum
  misc_feature (10)..(10): n is a, c, g, or t
acacttctcnctactgaaaaccctcactttctctctcttcgcaaaatctccggtaagcgtaaatcttccccttccatggcgaacagcaatctacctcgaagaattatcaaggaaacgcagcggttactcagcgaaccagctccggggataagcgcgtcgccgtccgaagataatatgcgttattttaatgttatgatccttggtccaacgcagtctccttatgaaggaggagttttcaagctggagttgtttttgccagaagaatatcccatggctgctcctaaggttcggtttcttacgaaaatttaccatccgaacattgacaagcttggtaggatttgtcttgacatcctcaaagacaaatggagccccgctcttcagattcgcactgtactcctgagtattcaagctcttctaagtgctccaaacccagatgatccgctctctgagaacattgcgaagcattggaaatc

SEQ ID NO: 1960 - DNA, 445 bp, Pisum sativum
tgagccagcgccgggaattagtgcgtcccttcggaagacaatatgcggtatttcaatgtgatgatcctcggcccaactcagtctccttatgaagggggggttttcaagctagaactatttttgccagaagaatatccaatggctgctcccaaggttaggttcctgacaaaaatatatcaccctaacattgataagcttggcagaatatgtcttgatattctgaaagataagtggagtcctgcccttcagattcgcactgttcttttgagtattcaagctcttttgagtgcaccaaacccagatgatccactttctgagaacattgccaagcattggaaatctaatgaggctgaggctgttgagacagccaaggagtggaccagattatatgccagtggcgcttgacaattgggtggatacttttggtctcaaataacaatagtgg

SEQ ID NO: 1961 - DNA, 417 bp, Papaver somniferum
  misc_feature (400)..(400): n is a, c, g, or t
ggatcatcaaggaaactcagcggcttctcagcgaaccagctccaggaattagtgcttctccctcagaggataacatgcgatatttcaatgttatgattcttggtccatctcagtctccatatgagggaggggtcttcaagttggaactatttttgcctgaagaatatccaatggctgcgcctaaggttcgctttctcaccaaaatttaccatcctaatattgacaagcttggaaggatatgtcttgatattctgaaagacaaatggagccctgctctccagatccgtaccgtacttctaagtattcaagcactttaagtgctccaaacccagatgatccgctttctgataatattgccaagcactggaaggcaaatgaggactggaagcagttgaaacanccgaaggaatggactcg

SEQ ID NO: 1962 - DNA, 548 bp, Carpinus betulus
ttctctttctctgttttcagcttcaatcttcgaaagaatcaatggcgaacactctacctcgaagaatcatcaaggaaacccagcggcttctcagtgaaccagctcctgggataagtgcttctccttctgaggaaaacatgcgatattttaatgttatgattcttggtccagctcaatcaccttatgaaggtggagttttcaagttagaattgtttcttcctgaagaatacccaatggcagctcccaaggttcgcttcctgacaaaaatttatcatcctaatattgataagcttggaaggatatgccttgatattctcaaagacaaatggagtccagccctccaaattcgaacagtattgctaagcatccaggctcttttgagtgctccaaaccctgatgatccactttctgagaacattgcaaagcattggaagacaaacgaagctgaagctgtggagacagcgaaggaatggacccgttttatatgcaagtggtgcatgatgatgggagttttatgctcgtatgaatttcctaaatgtatgttaaaa

SEQ ID NO: 1963 - DNA, 785 bp, Carthamus tinctorius
tcattccccttttctctctctctctaaagggcaaaaagaagacctcaaaattccacttcaatggcgaacgcaaccttcctcgaagaattatcaaggaaactcagcgcttactcagcgaaccagcaccggggataagtgcatcgccatctgaagaaaatatgcggtatttcaatgtcatgattctaggcccaacacagtcaccttatgaaggaggagtctttaagctggagttatttctgcctgaggattatccaatggctgcccccaaggttcgattccttacgaaaatataccatccgaatatagataagcttggtagaatatgtcttgatatcctaaaagacaaatggagccctgctcttcagattcgcaccgtactcctgagcattcaagcgcttttaagcgctccaaacccagacgatcccctgtccgaaaacatagcaaagcactggaaatcaaatgaagcagaggctgtggaaactgccaaggagtggactcgtctgtatgcaactggtgcttaatcgaatgtattgctactcgtgcttctgtcactttgtaaatccaagcccatggaacggagttgcccataaatttcaatcggtttatcgatataagttttctactaccacatttcaaggatacatactttcgtttacaaatagtcaaaaggtggcaatgcattatcggttttagtctaaagtgtgtaattggtataattgactcgatacgcttttaactgctatgctgactattgggtgaaggccaaatggacttttctccaaaaa

SEQ ID NO: 1964 - DNA, 523 bp, Scabiosa columbaria
tttgcctctctctaaaactctgttgtatcccaaactttgcgtagatttcaatcaaccttcttcaatggcgaacaccaatttacctcgaagaattatcaaggaaactcaacgtctcttaagcgaaccagctccaggaataagtgcatctccttcagaagataatatgagatatttcaatgtcatgattcttggtccaacacagtctccttatgaaggaggggttttcaagctggaattgtttttgcctgaagaatacccaatggctgctccgaaggttcggtttctcaccaaaatataccacccaaatatcgataagcttggtaggatatgcctcgatattcttaaagacaaatggagccctgcccttcagattcgtaccgtactactcagtattcaggcacttttaagtgctcctaaccctgatgatccactctctgaaaacatcgcaaagcattggaaaacaatgaagtcgaggctgttgaaacagcaaaggagtggacgcgtttgtatgcaagtggagctt

SEQ ID NO: 1965 - DNA, 853 bp, Prunus mume
gggattatctatacagcaccgggaattagcgcttcaccatcggaagacaatatgcgatatttcaatgtgatgatccttggcccaacacaatctccttatgaaggaggagttttcaagttggaactatttttgccagaagaatatccaatggctgctccaaaggttcgatttctcaccaaaatttatcatcctaacattgacaagctgggaaggatatgccttgacattttgaaagacaaatggagtcctgctctccagatacgaactgtacttttgagtattcaggcacttttgagtgctccaaaccccgacgatccgctctctgagaacatcgccaaacattggaaatcgaatgaggctgaagcggttgaaacagcaaaggaatggacccgtttatatgcaagtggtgtgtgatggcatggtgcaagtttatcattccctcaaataacattgttgcaatgtatgctattcactgtcattttagatgaaagaattggaagaattgatatttgaaatattggagtttaatgttctcaagctaccatttattgcctgataattgtttcatctcttggaagcttgtgtgaagatacatttatcttcggtcccaagtgtcgactggggattattataggcacacaaaatatggatttctggtaatcgatagtgtgaataattctttaccaattttctttctcgtttcctgatgtgtctttctcagaatctgcagggtgttccttgcctcgtcgttgcaaatactttggcatttttaactgagagcattttgttcttcctcctttgccttaaaacatcacgtactagtaagcctaggcactggtctgaagttaatgag

SEQ ID NO: 1966 - DNA, 1084 bp, Volvox carteri
ggatattggacgatattgatgttctatggggaagtagtatagatatccgaacggaaacagtgcccttcccgctcgctgtacctagacagggtcttcacagcttagcgtctttagcatgaacgccgatcaggcagcacaggcagcacagctgccgcgtcgaattatcaaggagactcaaaaactacttagcgagccagcaccgggcatcagcgcctcgccgtcagaggaaaaccttcgctacttcaatgtgatgatactaggccctcagcagtctccctacgagggcggtgtctttaagctggagcttttccttcccgaggactatcccatggcgcccccgaaagtgcgcttcctgaccaagatttaccatcccaacattgacaagcttggccgcatttgtctggacattttgaaagacaagtggtccccggcactccagattcgcaccgtgttgctcagcattcaagctttgttgtcggcaccgaaccctgatgacccgctggctgacaacgttgcaaagcattggaaggagaacgagaaggaggccattgcaacagctcgccaatggacttcgatgtacgcccagggctaagggcgtgaacgtaaacaggggcaggcggcaggtggcccttaggaggcagactgagagtgggttgatgaaccttaaatgttaggctttgatggggatcctggtggtgctgccgtctggtgcggttccgtggtttgccacccggagcattttttggcatctacgttctcttgggtatccattgtagcgttttagggaggtgaacttggtttgcttcttgtgagtccttaaaactcacgaatttaggacgtttagtggtgccggggcaatgcaggatgtggcgtacataggatagagactggacgtgcggcaaaagcaccatgtttacggtgtgacatggaattattgttatgttacgaaactgagacagttggctgccgcttggaagcgcggccctacagcggctggacgcaaccgtgtaacaagggtacgggatgtacgggcgcttctcgagcttttgccgcgcttactacgaaagcgggatatgttattttc

SEQ ID NO: 1967 - DNA, 555 bp, Bruguiera gymnorhiza
  misc_feature (186)..(186): n is a, c, g, or t
  misc_feature (213)..(213): n is a, c, g, or t
  misc_feature (216)..(216): n is a, c, g, or t
  misc_feature (219)..(219): n is a, c, g, or t
  misc_feature (225)..(225): n is a, c, g, or t
  misc_feature (228)..(228): n is a, c, g, or t
  misc_feature (234)..(235): n is a, c, g, or t
  misc_feature (246)..(246): n is a, c, g, or t
  misc_feature (264)..(264): n is a, c, g, or t
  misc_feature (282)..(282): n is a, c, g, or t
  misc_feature (300)..(300): n is a, c, g, or t
  misc_feature (319)..(319): n is a, c, g, or t
  misc_feature (325)..(325): n is a, c, g, or t
  misc_feature (348)..(349): n is a, c, g, or t
  misc_feature (360)..(360): n is a, c, g, or t
  misc_feature (363)..(363): n is a, c, g, or t
  misc_feature (429)..(429): n is a, c, g, or t
  misc_feature (441)..(441): n is a, c, g, or t
  misc_feature (450)..(450): n is a, c, g, or t
agaaccctcaccctctttttctcttctcgcgtagcccaattctctctgcccacagagaatcaaacaaaccctactctctctctctctctctctctctctctagcgcgctctgcggttggatagaagagaagaatcgttgtagaaagaatggccaatagcaacttgcctcgaagaatcataaagganacacagcgtcttctcagcgaaccagcnccnggnattagngcntctccnnctgaagacaanatgcgatactttaatgtnatgattcttggtccaacncagtctccttatgaaggnggggtattcaagttggaantgtttntgcctgaagaatatcctatggcnnctcctaaggtncgnttcctgactaagatttatcatcctaacattgacaagcttggaaggatatgccttgacattctgaangacaaatggagnccagctctncaaatccgaaccgttttgctaagcatccaagctctgttgagtgcgccaaaccctgatgatcctctttctgagaacattgcaaagcactggaaagtaaaatgaagc

SEQ ID NO: 1968 - DNA, 779 bp, Cannabis sativa
tttttcttttttggggattcagctccgggaattagtgcttccccatcagaagataatatgcgttattttaatgtgatgatccttggcccaacgcaatctccttacgaaggaggagttttcaagttggaactatttttgcccgaagaatatccaatggctgctcccaaggttcggtttctcaccaagatatatcatccaaacattgacaagctcggcagaatttgtctcgatatcttgaaagacaaatggagtcctgctcttcagatacgaactgtacttctgagcattcaagcacttctcagtgccccaaaccccgacgaccctctttccgagaacattgccaagcattggaaaagtaacgaagttgaggccgtcgaaacagctaaggaatggacccgtttgtatgcgagtggtgcataaaggcaaaggctggaaaactttttccatgcctggaaaataacattttattggaatgtgtatgttaatttgaaagaaaaattgggagaattaatgatgcttttgaaaatgggagcttaaaaaaatgttgggtctaaatcttcccagtcattattggatgtcaattgttttcctctctgggaaatcttttgcctctgtaacctgtataattatcaaattttactttcttctctgaaaaaaaaaaatgaattgccctttattattttgagcttctattttagttagtttacatgttttttttcttctctttcttctagtcatgagtgttttgtattttcttttttaaaaaattaatttccaag

SEQ ID NO: 1969 - DNA, 1016 bp, Volvox carteri
cgatattgatgttctatggggaagtagtatagatatccgaacggaaacagtgcccttcccgctcgctgtacctagacagggtcttcacagcttagcgtctttagcatgaacgccgatcaggcagcacaggcagcacagctgccgcgtcgaattatcaaggagactcaaaaactacttagcgagccagcaccgggcatcagcgcctcgccgtcagaggaaaaccttcgctacttcaatgtgatgatactaggccctcagcagtctccctacgagggcggtgtctttaagctggagcttttccttcccgaggactatcccatggcgcccccgaaagtgcgcttcctgaccaagatttaccatcccaacattgacaagcttggccgcatttgtctggacattttgaaagacaagtggtccccggcactccagattcgcaccgtgttgctcagcattcaagctttgttgtcggcaccgaaccctgatgacccgctggctgacaacgttgcaaagcattggaaggagaacgagaaggaggccattgcaacagctcgccaatggacttcgatgtacgcccagggctaagggcgtgaacgtaaacaggggcaggcggcaggtggcccttaggaggcagactgagagtgggttgatgaaccttaaatgttaggctttgatggggatcctggtggtgctgccgtctggtgcggttccgtggtttgccacccggagcattttttggcatctacgttctcttgggtatccattgtagcgttttagggaggtgaacttggtttgcttcttgtgagtccttaaaactcacgaatttaggacgtttagtggtgccggggcaatgcaggatgtggcgtacataggatagagactggacgtgcggcaaaagcaccatgtttacggtgtgacatggaattattgttatgttacgaaactgagacagttggctgccgcttggaagcgcggccctacagcggctggacgcaaccgtgtaacaagggtacgggatg

SEQ ID NO: 1970 - DNA, 995 bp, Chlamydomonas reinhardtii
gttttgatttgttacagtatacatcgagcatcagcttcgcgcctcctctgagacccggctttttccaagttagcgtcgcttcgtctatataggcgctagagaggaatgaacccggatcaggcagcgcaggcggcgcagctgccgcggagaattatcaaggagactcagaaacttctcagcgagcctgcgcccggcattagcgcttctccctcggaggagaacctgcgctacttcaatgtgatgattctggggcctcagcagtccccctatgagggtggcgtgtttaagctggagcttttcctgccggaggactacccaatggcgccccctaaggttcgcttcctgaccaagatttaccatcccaacatcgacaagctgggccgcatttgcctggacattttgaaagacaagtggtcgccggcgctccagattcgcaccgtgctactgagcatccaagcgttgctctcggcccccaacccggatgacccgctggccgagcacgtggcgaagcactggaaggagaacgagaaggaggccattgcgacagcgcgccaatggactgccatgcacgctcagggctaaatgctttagcgctcacaagggcttggtgcggctcaccgcagccggtcatctggtccgcggggtggcggcagcagccggcggtgttcacatttggtgtcagggctttccttgtggttgcgcagcggcgcattccatagacgttagggtttagaacaactaggcgtgcatttgcaagggtgcttgtgccgttacggctgcgtgcatcgcgcagggacgctccgcgcatgtatgcgctatgcaggtgtcttggtgtgagggttgcaccagatgttcaggcaacggtagagagcaggatgcactttagtcaggagggttagggctcaggggtgcaaggatgttacgtgcattggaccagtctactatgagttttgtaggaagaacaggatgcaaatgtaacaagcgcgtgtagttca

SEQ ID NO: 1971 - DNA, 689 bp, Lolium multiflorum
tgacgactcctttgacctctcgcgctgtcctccgccaccgtcgccgcaccaagctccaggcgtccccgctcgacccgccggcagctccagccagcgccatggccaacagcaacctcccgcgccggatcatcaaggagacgcagcggctgctcagcgaaccaggtttgtttggaattctagggggaggatttcggggcgggatttgggtatcgtgtgttgttctgattcgtgtgttgtgttgtgttggttgcgtgcgtgcagcgccggggatcagcgcgtcgccgtcggaggagaacatgcgctacttcaatgtcatggtccttggcccggcgcagtctccttacgaaggtggagtttttaagcttgaacttttcttacccgaggaatatccgatggctgctccaaaagtcaggtttctcacaaaaatataccaccccaacattgacaagctcggtagaatatgccttgacatcctcaaggacaaatggagcccagcccttcaaatacgcactgttcttttgagcattcaggcactgctgagcgctccaaacccagatgaccctctctcagaaaatgttgcaaaacactggaaatccaatgaagctgaagctgttgagacagcgaaagagtggactcgcgtgtatgccagtggtgcatgacaagctaacgctggttatggatgtaataac

SEQ ID NO: 1972 - DNA, 593 bp, Persea americana
agctccgggtattagtgcttctccttcagaagagaatatgcgatattttaacgttatgattctcggtccaacacagtctccttatgaaggaggagtttcaaattggaactatttttgcctgaagaatatccaatggctgctccaaaggttcgctttctcacgaagatttaccatcctaacattgacaagcttggcagaatatgccttgatatcttgaaagacaaatggagtccagctcttcagatccgtactgtacttctgagcattcaagctctactgagtgcaccaaacccagatgatccactttctgacaacattgcaaagcactggaagtcgaatgaaactgaagctgtggcaacagcgaaagagtggacccgtttatatgcaagtggggcatgatgaacatgaatgctgatttggcaaataacatgtgtactatgcaagttatgtggccatccttggatgtagcttggctggtttgggatgccaaacatcccctttttgggggtgagagtgtgtgagttcaagtccttcctactggaaatcaaagtgttaaatgttttaatactcaatataaatcattagaagttctt

SEQ ID NO: 1973 - DNA, 768 bp, Allium cepa
aagtgcatcgccatcggaagaaaatatgagatattttaatgtcatgattcttgggccaactcagtctccatacgagggtggtgtgttcaagcttgaactttttctgcctgaagaatacccaatggctgccccaaaggtccggttccttaccaaaatctatcatcccaacattgacaagcttggaagaatatgccttgacattctcaaagacaaatggagtcctgctttgcagattcgaacagtattgctaagcatacaagcgcttttgagtgctccaaaccctgatgacccgctttcagaaaacattgccaagcattggaaggcaaatgaggctgaggccgtcgaaaccgcgaaggaatggacacgcttatatgccagtggtgcttgaatatgttaaggtcaacatatggggaaaacaataacaaatctgttatgtgcatcctgcttattgttttataaatgaatatgaaagtgctaaaatgataactcgcaagcagttcaatcatttgatgctattatatcgtatcatactatcatgtatatcacctttttcaaattgaaaaacctttgtattagtggtctgtttgaacctgtttattcatgttttaagagtctactttgagtgggttcccaagcactaagcaccttactgtttcttaataacaagggcctttgctacttggaatgctgtgaaattatctgatttgctatgcttgttttcccactggttctttgaagatatgtagctttcaaataatacttgttttt

SEQ ID NO: 1974 - DNA, 410 bp, Pinus taeda
acgtgcgaccttggctgtcactcaatcaaggagacgcagagactcctcagcgagccagcaccggggatcagcgcttcgccctcggaggagaacatgcggtacttcaacgtcatgatccttggtccggcgcagtcgccgtacgaagggggagtttttaagctggaactctttttacccgaggaatatccgatggctgccccaaaggttaggtttctgacaaaaatataccatcccaacattgacaagcttggtaggatatgccttgacattctcaaggataaatggagtccagctcttcagattcgaacagttcttttgagtatccaggcactcctaagtgcaccaaaatccagatgacctctctctgaaaaacattgctaagcactggaaatccaacgaggcagaagctg

SEQ ID NO: 1975 - DNA, 751 bp, Pseudoroegneria spicata
  misc_feature (28)..(28): n is a, c, g, or t
  misc_feature (36)..(36): n is a, c, g, or t
  misc_feature (70)..(70): n is a, c, g, or t
  misc_feature (406)..(406): n is a, c, g, or t
cccgacctgcgccgccgcgctaccagcnaccctaanctgcgccgccgcgctcacagcaaccaatcacacngccgcaaccaccatggcagccgttctcacccgcccgacgccgggcaccgtgcagtgcttcggccggaagaagaccgccgtcgccgtggcctactgcaagcccgggcgcggcctcatcaaggtcaacggcgcgccgatcgagctcatccgccccgagatgctacgcctcaaggccttcgagccgatcctgctcgccggcaggtcccgcttcaaggacatcgacatgaggattcgcgtccgcggcggcgggaagacgagccagatctactccatccgccaggccatcgctaagtctctcgtcgcctactaccagaagtacgtcgacgaggccgccaanaaggaggtgaaggagatcttcggccgctacgaccggacgctcctcgtcgccgacccgcgccgctgcgagcccaagaagtttggcggtcgcggtgcccgcgcgcgtttccagaagtcgtaccgttgagctccggcgaggtctcttgttgggtatggcggcggtgttctactccttgcctgcctatctatctacctgttaccgcaagtagtttctcatcttttggaccaatgaattggatatgatgatctctaagaactgtgagttgtcttcaatatcctgcctagttgaagggattttgttatcataatcttatgttaatgatgaaactgaatgttctgtttcaaa

SEQ ID NO: 1976 - DNA, 893 bp, Secale cereale
acccaaaaccctaaccaagcacaccgccgcgctcacagcaaccaagcacaccgccgcagccaccatggcagccgttctcacccgcccgacgccgggcaccgtccagtgcttcggccgcaagaagaccgccgtcgccgtggcctactgcaagcccgggcgcggcctcatcaaggtcaacggcgcgccgatcgagctcatccgccccgagatgctccgtctgaaggccttcgagccgatcctgctcgccggcaggtcccgcttcaaggacatcgacatgaggattcgcgtccgcggcggagggaagacgagccagatctactccatccgccaggccatcgccaagtcgctcgtcgcctactaccagaagtacgtcgacgaggcggccaagaaggaggtgaaggagatcttcggccgctacgaccggacgctcctcgtcgccgacccgcgtcgctgcgagcccaagaagtttggcggtcgcggtgcccgcgcgcgtttccagaagtcttaccgttgatctcctgcgagatgtcctcttgggtatggtggcggttgcctactccttgccggcctatctatctacagtaccctttaccgctagtagtttctcatcctttggacaatgatgaattggatatggtgatctctaagaactgttagttgtctgcagtatcctgcctagttgaagaaggggttttgttaaacttatgttaatgacgaaactgaatgtctgtttgagcttaattgtttgtttcaactgtctcggcttgatatttagttgaataatagatagtgcagctttaaaagttttcattttgaaagtgaagcaaacatggcctctggctggtgctaccttcacagttttattatgctcatgatgctgtgatcatacagtt

SEQ ID NO: 1977 - DNA, 746 bp, Secale cereale
cgccgcgctaccagcaaccaagcacacgccgcgcccacagcaaccaagcacacgccgcaaccaccatggcagccgtcctcactcgcccgacgcctggcactgtccagtgcttcggccggaagaagaccgccgtcgccgtggcctactgcaagcccggtcgcggtctcatcaaggtcaacggcgcacccatcgagctcatccgccccgagatgctccgcctgaaggcctttgagccgatcctgctagccggtaggtcgcgcttcaaggacatcgacatgaggatccgcgtccgcggtggcgggaagacgagccagatctactccatccgccaggccatcgccaagtctctcgtcgcctactaccagaagtacgtcgacgaggcggccaagaaggaggtgaaggagatcttcggccgctacgaccgaacgctcctcgtcgccgacccgcgccgctgcgagcccaagaagttcggcggtcgcggcgcccgcgcgcgtttccagaagtcttaccgttgatctcctgcgagatgtcctcttgggtatggcagtgctcgcgtactgcttgtctacttatctatctacattttgctgctagtagtttcccatcttttggacaatgaaatggattgtgaggtgcccgtgcaatatcattttgcttcatgcctagttaaagggatcatgttttgtttatcttatgttaatgatgagactggacgttcagataaagttttcttagttgttttgacc

SEQ ID NO: 1978 - DNA, 768 bp, Secale cereale
cgcgtggcgagtcgcacggccgccaaaccccgacccgcgccgccgcgccgccgcgctaccagcaacaaagcacacgccgcgctcaccgcaaccaagcacacggccgcaaccaccatggcagccgtcctcactcgcccgacgcctggcactgtccagtgcttcggccggaagaagaccgccgtcgccgtggcctactgcaagcccggtcgcggtctcatcaaggtcaacggcgcacccatcgagctcatccgccccgagatgctccgcctgaaggcctttgagccgatcctgctcgccggtaggtcgcgcttcaaggacatcgacatgaggatccgcgtccgcggtggcgggaagacgagccagatctactccatccgccaggccatcgccaagtctctcgtcgcctactaccagaagtacgtcgacgaggcggccaagaaggaggtgaaggagatcttcggccgctacgaccgaacgctcctcgtcgccgacccgcgccgctgcgagcccaagaagttcggcggtcgcggcgcccgcgcgcgtttccagaagtcttaccgttgatctcctgcgagatgtcctcttgggtatggcggtgctcgcgtactgcttgtctacttatctatctacattttgctactagtagtttcccatcttttggacaatgaaatggattgtgaggtgcccgtgcaatatcattttgcttcatgcctagttaaagggatcatgttttgtttatcttatgttaatgatgagactggacgttca

SEQ ID NO: 1979 - DNA, 1023 bp, Triticum aestivum
caaaaccctagccaagcacaccaccgcgctcacagcaaccaagcacaccgccgcagccaccatggcagccgttctcacccgcccgacgccgggcaccgtccagtgcttcggccggaagaagaccgccgtcgccgtggcctactgcaagcccgggcgcggcctcatcaaggtcaacggcgcgcccatcgagctcatccgccccgagatgctccgcctgaaggccttcgagccgatcctgctcgccggcaggtcccgcttcaaggacatcgacatgcgcatccgcgtccgcggcggcgggaagacgagccagatctactccatccgccaggccatcgccaagtctctcgtcgcctactaccagaagtacgtcgacgaggcggccaagaaggaggtgaaggagatcttcggccgctacgaccggacgctcctcgtcgccgacccgcgccgctgcgagcccaagaagtttggcggtcgcggtgcccgcgcgcgtttccagaagtcgtaccgttgagctccggcgagatctcttgttgggtatggcggcggtggcctactgcttgcctgcctatctatctaccttttaccgctagtagtttgctatcttttggaccaatgaattggatatgatctctaagaactgtgagttgtctgcagtatcctgcctagttgacgaaggggttttgttatcataatcttatgttaatgatgaaactgaatgttctgtttgagcttaactgtttgcgatttgatatttagttgaataggtaaagtgcagctttatttagaatctgtgaatgatatgcccatcatttctagtagcaagtattgcacaaaatgttttgcatgttggaggtgaacaacgcctgatgctgtgatcgtacccgattctaagaatatggttccttatctatgtgtacttccacttccaagattaagcctccttcagctgttgtaattgttgaagaccctgcatgttgctatcagcctatcatcattgatactaatgttgtgaattttactacc

SEQ ID NO: 1980 - DNA, 1575 bp, Brachypodium distachyon
taaaaccctagccccctttgatcccctataaacacctctctccctccccgcgccgccgctctctccacaaaccctagcttcccatccctcccctccgccgccgccgcgcaacaccacaaccaccatgtcggccgtgctgacccgcccggcgccgggcacggtgcagtgcttcgggcggaagaagacggcggtcgccgtggcctactgcaagcctggccgcggcctgatcaaggtgaacggcgccccgatcgagcttatccgcccggagatgctccgcctcaaggctttcgagccgatcctgctggccggccggtctcggttcaaggacatcgacatgcggatccgcgtccgcggcggcgggaagacgtcgcagatctacgccatccgccaggccatcgccaaggggctcgtcgcctacttccagaagtacgtcgacgaggccgccaagaaggaggtcaaggagatcttcggccgctacgaccgcaccctcctcgtcgccgacccccgccgctgcgagcccaagaagttcggcggtcgcggcgcccgtgccaggttccagaagtcgtaccgttgaagaagaagaagatgcccctgcgctccctccggcggacggcgcgcctcttgggctgtctcatctatctctttactgctttttatatgcctagtgttttttgcattatgttggaacaatgaaatgggtgatggtgatcttttgcttcctgcctagatggaaggaccatgttatgttaagattatgttaaatgatgatgctagttgagaacttaattatcctgttgagtttccttgaatcgcttgatctgttcatgcttaattttggtttaagctgatctttagttaatggtttaaggatagttgggacttgagtatcctgttagcttaccttggtttggctaatctgtttgtgcataattttagttgaatgggtagtgcatccttgaaaattgatgagatctagagatgtcttgagttgcacgtaggatttggagtttgggtgactgagatgtatgtggtttgctgactctggtttgtagttgtgctctgctcaattcatttgaattggtatgaattgacattagcccatttctgttgtttcatagagtttactctcactgctggttctactgggcacttctaacattgaggtgctgtccacaaatagattggtgccacggagtgtttgaaatctacattctcatattgagatgctgtctgcaatatattagcgccagaaatgtttgaaattgcatattagtacttgtcagtatcatcgtgaagctggaaaatgagcaaccgtagatcactgaaaagttgacggcacactttggggcaaatcaaactcactagattgctcctagcagttgtctttgggtaatgtcttaaagtgtcatgtactcatgtatagggtttccactgctactgtaatgataatagtttgatcatggtttggtgtatgtcaaactgccaagatttacattttgggtttgacatcaaaccgttagagctgcttatctgttggactgatattctgaatgtgatgaattgctacctttccta

SEQ ID NO: 1981 - DNA, 688 bp, Festuca arundinacea
gcacgaggctcccggatcaagccgccgccgcgctccgcaccagccaccaccgcaaccatgtccgccgtcctcacccgcccgaccccgggcacggtccagtgcttcgggcgcaagaagacggcggtggccgtcgcctacaccaagcccgggcgcgggctcatcaaggtgaacggcgcccccatcgagctgatccgcccggagatgctccgcctcaaggccttcgagcccatcatgctcgccggccgctcccgcttcaaggacatcgacatgcggatccgcgtccgcggcggcggtaagacctcccagatctacgccatccgccaggccatcgccaaggcgctcgtcgcatactaccagaagtacgtcgacgaggccgccaagaaggaggtcaaggacatcttcggccgctacgaccgcaccctcctcgtcgccgacccacgtcgctgcgagcccaagaagttcggaggacgcggcgcccgcgcaaggttccagaagtcctaccgttgattcgccgcctgcaggtcatcgccgccaaggcgctcgtggcctactaccggaagctcgtggatggggtggttttctctgctttacctaccaagttttagactatctatccttagctacctaccttgtcaagacattgtgatatggatgtgatgtgggatgtttaagactatttagttgctgc

SEQ ID NO: 1982 - DNA, 800 bp, Lolium multiflorum
gacgccgccactcttcctcccggatcaagccgccgccgccgccgccgcgctccccaccaaccaccaccgcaaccatgtccgccgtcctcacccgcccgaccccgggcacggtccagtgcttcgggcgcaagaagacggcggtggccgtcgcctacaccaagcccgggcgcgggctcatcaaggtgaacggcgcccccatcgagctgatccgcccggagatgctccgcctcaaggccttcgagcccatcatgctcgccggccgctcccgcttcaaggacatcgacatgaggatccgcgtccgcggcggcggtaagacctcccagatctacgccatccgccaggccatcgccaaggcgctcgtcgcatactaccagaagtacgtcgacgaggccgccaagaaggaggtcaaggacatcttcggccgctacgaccgcaccctcctcgtcgccgacccacgtcgctgcgagcccaagaagttcggaggacgcggcgcccgcgcaaggttccagaagtcctaccgttgattcgccgcctgcaggccatcgccgccaaggcgctcgtggcctactaccggatgctcgtggatggggtggttttctctgctttacctaccaagttttagactatctatccttagctacctaccttgtcaagacattgtgatatggatgtgatgtgggatgtttaagactatttagttgctgcaatatcgtttttccttgttacctatcttgaggaattttgatgtggtctgttcgcattatattatatagttatgtctgatgctaaatagtttaaac

SEQ ID NO: 1983 - DNA, 633 bp, Avena sativa
aaggtaccaccgcaaccatggctgctgttctcacccgcccgacaccgggtacggtccagtgcttcgggcgcaagaagacggcggtggccgtcgcgtacaccaagcctgggcgcgggctcatcaaggtgaacggcgcccccatcgagctgatccgcccggagggtctccgcctcaaggccttcgagcccatcatgctcgccggccgctcccgcttcaaggacatcgacatgaggatccgcgtccgcggcggcgggaagacctcccagatctacgccatccgccaggccatcgccaaggcgctcgttgcctactaccagaagtacgtcgacgaggccgccaagaaggaggtcaaggacatcttcggccgctacgaccgtaccctcctcgtcgccgacccccgtcgctgcgagcccaagaagttcggtggtcgcggagcccgcgcgaggttccagaagtcctaccgttgatcagcctgcaggatcgtcgtcggttgggtggttgtctctgctttatctctaaagttttagactgtcttatccttagttgccgaccttgtcaagacattgtgatatggatgtaatgtgagatgtttaagactattgggtagttgctggaacatgctttttacttgtt

SEQ ID NO: 1984 - DNA, 816 bp, Avena sativa
tcttccaccaggatcaagcagccaccgccgccgccgccgcagggcaccaccgcaaccatggctgctgttctcacccgcccgaccccgggcacggtccagtgcttcggacgcaagaagacggctgtggccgtcgcctacaccaagcctgggcgcgggctcatcaaggtgaacggcgcccccatcgagctgatccgcccggagggtctccgcctcaaggcctttgagcccatcatgctcgccggccgctcccgcttcaaggacatcgacatgaggatccgcgtacgcggcggcggtaagacctcccagatctacgccatccgccaggccatcgccaaggcgctcgttgcctactaccagaagtacgtcgacgaggccgccaagaaggaggtcaaggacatcttcggccgctacgaccgcaccctcctcgtcgccgacccccgtcgctgcgagcccaagaagttcggtggtcgcggagcccgcgcgaggttccagaagtcctaccgttgatcagcctgcaggatcgttgtcggttggatggttgtctctgctttatctctgaagttttagactgtctatccttatttgccgaccttgtcatgacattgttatatcgatgtgatgtgagatgtttaagactattgagtagtagctgcaatatgctttttccttgttacctatgttgaggaattttgatatggtttggtcgccttatctttatgctatgtttccagtttaatgccaagtacttctgttatatctggatgtgatgtttaagttggtatgattatcatatatactgttaataatatcattgtt

SEQ ID NO: 1985 - DNA, 710 bp, Secale cereale
ctcccaccaggcaccaccgcaaacatggctgccgtcctcacgcgcccgacgccgggcacggttcagtgcttcgggcgcaagaagacggcggtggccgtcgcgtacaccaagccagggcgcgggctcatcaaggtgaacggcgcccccatcgagctgatccgcccggagatgctccgcctcaaggccttcgagcccatcctgctcgccggtcgctcccgcttcaaggacatcgacatgaggatccgcgtccgcggcggcgggaagacctcccagatctacgccatccgccaggccgtcgccaaggcgctcgtcgcctactaccagaagtatgtcgacgaggccgccaagaaggaggtcaaggacatcttcgcccgctacgaccgtaccctcctcgtcgccgacccccgtcgctgcgagcccaagaagttcggtggtcgcggcgcccgcgcgaggttccagaagtcttaccgttgattggcctgcaggatcgtcgtctattgggtggttttctctgctttacctccccagttttagactccgtatcattagttccggaccgtggcaagatattgtggtatgatgtgatgtgagatgtttaagactattgggtagttgcttgattatgttccttacttgttacctatgttgaggaattttggtatggttacgtgattgcactatatttttatgctatgtttcagctttcatgc

SEQ ID NO: 1986 - DNA, 998 bp, Hordeum vulgare
tcgcccactcttccctgatcccgccgccgccgcctctcccccctgatcccgccgccgccgccgctgccgctgccgcgctcccaccaggcaccaccgcaaacatggctgctgtcctcacccgcccgacgccgggcacggtccagtgcttcgggcgcaagaagacggcggtggccgtcgcgtacaccaagccagggcgcgggctcatcaaggtgaacggcgcccccatcgagctgatccgcccggagatgctccgcctcaaggccttcgagcccatcatgctcgccggccgctcccgcttcaaggacatcgatatgaggatccgcgtccgcggcggcgggaagacctcccagatctacgccatccgtcaggctgtcgccaaggcgctcgtcgcctactaccagaagtatgtcgacgaggccgccaagaaggaggtcaaggacatcttcgcccgctacgaccgtaccctcctcgtcgccgatccccgtcgctgcgagcccaagaagttcggtggtcgcggcgcccgagcgaggttccagaagtcttaccgttgattggcctgcaggatcgtcgactattgggtggttttctctgatttacctccccacttttagactccgtatgattagtttcgaaccttggcaagatattgtggtatgatgtgatgtgcgatgtttaaggctactcggtagttgctcgattatgttttttttttacttgttacctatgttgaggaattttgatatggttgcgtgcttgcactatattttatgctatgtttcagttttcatgctaaatgatgttgcctgatgactgatgttatgtttaagttagccggatgagtagaacggtgcgttggatctttaatacgtagtagtatataagagtatcagactaattcgtttaggatgacttttacctcacaatttgtagaatgttgatgctttgttccagctcttgtcaggatatcgtgatatggatgtgatgtgagatgtttgagg

SEQ ID NO: 1987 - DNA, 888 bp, Setaria italica
ggctatataacccttcgctcctttcgctcccctctctccgccgccccccaccccaagccgccaaagccctagcgccgccgcctgcaccgccgccgctgcgatcccagcagccagcaccgccaccatggctgccgtgctcacccgccccaccccgggcacggtccagtgcttcggccgcaagaagacggccgtggccgtggcctacaccaagccggggcgcgggctgatcaaggtgaacggcgtccccatcgagctgatccgcccggaggggctccgcctcaaggccttcgagcccatcttgctcgctgggcgctcccggttcaaggacatcgacatgaggatccgcgtccgcggcggagggaagacgtcgcagatctacgccatccgccaggccatcgccaaggccctcgtctcctactaccagaagtacgtcgacgaggccgccaagaaggaggtcaaggacatcttcggccgctacgaccgcaccctcctcgtcgccgaccccaggcgctgcgagcccaagaagttcggtggtcgtggtgcccgcgccaggttccagaagtcctaccgttgagcgattgcttgccgcatcaaaatttgccagaccgttgtgtgcggtcttggcttcatctcctataaatggagctgcttatctggttctatatctagctgctgctttaccttcaagtttagacttttaagcctagtgttgaaccgttttgacattgtgatatgaatgtgagagattttgaatagtctctgaaatatggttttgctgtttatccatgtccaggcactttgatatggcttccttgtattttgtgctatgtaagagtagtatttcaatttcaccaagtacgtgtttcattcgtttcacccatgttgctt

SEQ ID NO: 1988 - DNA, 811 bp, Triticum aestivum
ccgccgccgccgccgtgctctcgccaggcaccaccgcaaacatggctgctgtcctcacccgcccgacgccgggcacggtccagtgcttcgggcgcaagaagacggcggtggccgtcgcgtacaccaagccagggcgcggcctcatcaaggtgaacggcgctcccatcgagctgatccgcccggagatgctccgcctcaaggcgttcgagcccatcatgctcgccggccgctcccgcttcaaggacatcgacatgaggatccgcgtccgcggcggcgggaagacctcccagatctacgccatccgtcaggccgtcgccaaggcgctcgtcgcctactaccagaagtatgtcgacgaggccgccaagaaggaggtcaaggacatcttcgcccgctacgaccgtaccctcctcgtcgccgacccccgtcgctgcgagcccaagaagttcggtggtcgcggcgcccgcgcgaggttccagaagtcttaccgttgattggcctgcaggatcgtcgtctattgggtggttttctctgctttacctccccagttttagactccgtatgattagttccggaccttggcaagatattgtggtatgatgtgctgtgagatgttttaagactactactgggtagttgctcgattgtgttttttacttgttatgttaaggaattttgatatggttgcgtacttgcactatattttatgctatgtccggttttatgctaaatgatgttgtctgatgactgatgttgtgtttaagttagccggatgagttgaatggtgcaaatacaatcactttgatcttctagg

SEQ ID NO: 1989 - DNA, 821 bp, Setaria italica
ccgccgccccccaccccaagccgccaaagccctaccgccgccgctgcgatcccagcagccaccaccgccaccatgtctaccgtgctcacccgacccaccgcgggcacggtccagtgcttcggccgcaagaagacggccgtggccgtggcctacaccaagccggggcgcgggctgatcaaggtgaacggcgcccccatcgagctgatccgcccggaggggctccgcctcaaggccttcgagcccatcttgctcgctgggcgctcccggttcaaggacatcgacatgaggatccgcgtccgcggcggagggaagacgtcgcagatctacgccattcgccaggccatcgccaaggccctcgtcgcctactaccagaagtacgtcgacgaggccgccaagaaggaggtcaaggacatcttcggccgctacgaccgcaccctccttgtcgccgaccccaggcgctgcgagcccaagaagttcggtggtcgtggtgcccgcgccaggttccagaagtcctaccgttgagcgattgcttgccgcatcaaaatttgccacaccgttgtcggtgttgttggcttcatctcctatcaatcgagctgcttatctggttctatatctagctgctgctttaccttaaagtttagacttttaagcctagtgttgaaccgttttgacattgtgatatgattgtgagattttgaatagtctctgaagtatggttttgcttattatcgatgtcaagggattctgatatggtttaagttctttgtgctatgtaaaattagtatttcaattttacggggcacctgtttcatgcgtttcac

SEQ ID NO: 1990 - DNA, 710 bp, Pennisetum glaucum
cgcaggcttctcaggctaaataacaagccttccctccgccgccgcctaccccacctagcgccgccaccgccgccgctccgatcccagccagcagccaccatggctaccgtgctcacccgccctaccgcgggcacggtccagtgcttcggccgcaagaagacggccgtggccgtggcctacaccaagccggggcgcgggctgatcaaggtgaatggcgctctcatcgagctcatccgcccggaggggctccgcctcaaggccttcgagcccatcctgctcgctggacgctcccgttttaaggacatagacatgaggattcgcgtccgcggcggaggtaagacgtcgcagatctacgccatccgccaggccatcgccaaggccctcgtcgcctactaccagaagtacgtcgatgaggccgccaagaaggaggtcaaggacatctttggccgctacgaccgcaccctcctcgtcgccgaccccaggcgctgcgagcccaagaagttcggtggtcgtggtgcccgcgccaggttccagaagtcgtaccgttgagcgtttactccagatatttccttgtcttgtatcggcggtgcaagtttaggccttgtttgacattgtgatatgaatgtgatgagatgattaaactatcagaatatggtcttgcttcgtgtctattatcatatgattgccctacactctgctatgtaccattt

SEQ ID NO: 1991 - DNA, 506 bp, Pennisetum glaucum
gccctagcgccgccgctgcgtgctcacccgctcaccatgtctaccgtgctcacccgccccaccgcgggcacggtccagtgcttcggccgcaagaagacggccgtggccgtggcctacaccaagcctgggcgcgggctcatcaaggtgaacggcgcccccatcgagctcatccgcccggaggggctccgcctcaaggccttcgagcccatcctgctcgccggccggtcccgcttcaaggacatcgacatgaggatccgcgtccgcggcggagggaagacgtcccagatctacgccatcaggcaggccatcgccaaggccctcgtcgcctactaccagaagtacgtcgacgaggccgccaagaaggaggtcaaggacatcttcggccgctacgaccgcaccctcctcgtcgccgaccccaggcgctgcgagcccaagaagttcggcgggcgcggtgcccgcgccaggttccagaagtcgtacagatgagcgatcgcttgccgcatcac

SEQ ID NO: 1992 - DNA, 1002 bp, Oryza sativa
gaagcgatctctccccttcgccgccgcctctctcccgcaccaagctgcctgagccctagccgccgccgccgccgccgcgcgccaccaccgcaaccatggccgccgcgctcacccgcccgcctccaggcacggtccagtgcttcgggcgcaagaagacggcggtggccgtctcctactgcaagccggggcgcgggctgatcaaggtgaacggcgtcccgatcgagctgatcaggccggagatgctccgcctcaaggcgttcgagcccatcctgctcgcggggcgctcgcgcttcaaggacatcgacatgaggatccgcgtccgcggcggtgggaagacgtcgcagatctacgcgatccgccaggccatcgccaaggccctcgtcgcctactaccagaagtacgtcgacgaggcgtccaagaaggaggtcaaggacatctttgcccgctacgaccgcaccctcctcgtcgccgaccccaggcgctgcgagcccaagaagttcggtggtcgcggcgcccgcgcaaggttccagaagtcgtaccgctgagcgctcgccggaccgattcggagcggtgttctcttttccaccctatcaatggagctacttggcttgttctacatctatctagctactgcattactttcaagtttagtcttttaaaacttagccctgaaccttgcctttttgacattgtgaaatggatgtgattgaaatgtttaagactctactctagtctctggaatatggttttgcctgttacctatgttgagttatatttatgttgttaagatgatccatactgcaagtgttatgctatgttaagatgattctgcgagtagtgttgctgtctgctttggtaccggtactgttatgttgggattgtgacatgctcatttcaggtagttagggttttcaaatttcaattaattcccatggaaatgcttgttcagctccttagggttgcaaatttcaagtaattccaatggaaatgctcgtttgctgt

SEQ ID NO: 1993 - DNA, 3310 bp, Oryza sativa
ccacaggtctcttttaacagggtaaccatttatacatttgatatgaacagaaataacatggttcttgttcagagtacatttgggaacagggaaagcagagcaggtgatcatacagacaaccaagcctgactaacagacctctaataaccaagcttaagctagacttagtcaacctaaaagggaagtatcaagtcggtgacaaacagcgatagatcaggaacaaataatgcagaagccatcgacaacaactggtagtagaaaagattaaatgtgatcttcatgattgcatcagttttcttcaacatactcgccagctttcagttgttgcaacttcacaccaacgttcagagtcatattcagcagttatcctgctttgcttacacagcagctaaacctgcccactattaaaatttgtacaaattcaaaagatcacatcaaagtgacagtttttgcactcaaaacaagacttgttatctatgttccagatataacaacggaatgccattactccattagaatgatgatcacataaaggccgtgcatccaatagacggattgcaggcactgttgtagtgctctgcacggcttctaaaaccctacaaacttttgcaatgttgcaaaccaagaaaagatgctgagctgattcaggttgatacacaagtcaagtcatgagggcatttttttttttaactttgaacgtttatttagtaaaaaccacattgtggaagaaaaaccacgattttcaaaaggatcttgcaattagagtccgcatcaaagttcaaaaccaaggagaaattagagtccacatcagccatgcatagcaaaaaagacatggattttaacagtgcgtcttccaaatttctcaaggacacaagaaaatatttgatttgtatatcattgaagggactgtcctcaaaccatcaaggttccgtttggtccacagaatagaattctgtatatcatcctctttaagctaataattgattgatataaacctacgacatcattgaaaacatggcatgctaatatacatgacattgaactgtagtggagggatactatatggacatactcccttgtttcacaatgtaagactttctagcattgtccacatacatatagatgttaatgaatttaaacacatacatatgtctagattcattaacatctaaatgaatgtggacaatgctagaaagtcttacattgtcaaacggatgaagtattttaaaaccaaactacaaactaggatgaaaacaaggtttcaatgataaataagcaaaaattggatatgcccaaactcacaaaagtaagctcaacaagtacaatgctaacatatctatgcacatgttcaattgcaaacatttgtatactacggtactaccctaacacattctacacaaacaaaaagcgcttttacatccactattgccaaacaggatctacgaaactactccattgaatagaagaaccacgcaacacacattgactaatacgaaaacagctatgatgaataaaaatccaaataaaaaaaatcgtcaataaacaatggctgaaaaaacgcaaacgttgttatatgtttgttgtttgggtgaacccgcgcggccatcatcgcacgcgctccgaccgcgggcagtcgtcatcgctcaccgccggcgactgccacgggaaccgaacccgcctctttcccccaacaaagcgcgccaccttcccgccaaccgtacgaggacgtcggtggcggcgcgaatgtcggagaggcgactccggccgccgcggcgccgccggacggcaagctcggataagatcaagtagtgttcgtgagggtcgaaaccctagctcgccgcctcctccccccatggccttttacaagcgaaaaactagcccacaagttgggctcgcgaaggcccaactaattctagcccggcccatagtggtccactaactatcccccatggcccactagagctaaaccctaatcccctcgctataaaatcactctctcgaagcgatctctccccttcgccgccgcctctctcccgcaccaagccgcctgagccctagccgccgccgccgccgcgcgccaccaccgccgcaaccatggccgccgcgctcacccgcccgccgccaggcacggtccagtgcttcgggcgcaagaagacggcggtggccgtctcctactgcaagccggggcgcgggctgatcaaggtgaacggcgtcccgatcgagctgatcaggccggagatgctccgcctcaaggcgttcgagcccatcctgctcgcggggaggtcacgcttcaaggacatcgacatgaggatccgcgtccgcggcggagggaagacgtcgcagatctacgcgatccgccaggccatcgccaaggccctcgtcgcctactaccagaagtacgtcgacgaggcatccaagaaggaggtcaaggacatctttgcccgctatgaccgcactctactcgtcgccgaccccaggcgctgcgagcccaagaagttcggtggtcgcggcgcccgcgccaggttccagaagtcgtaccgttgagcgctcgccggatcgattcggagcggtgttctcttttccaccctatcaatggagctattttgctggttctacatctagctactgctttacttcaagtttagtctttttaagcttagtcccgaacctttttgacattgtgaaatggatgcgactgaggcgtttaagactatcgtagtctctggaatatggttttgcatgttacctatgtccagggaagttgtgatactattgccttaattaatgtttatgctatgttatgagttttattctaggtgttcttattctgtctgttatgtgcaaatggttatggtaattgctcttttgtttaatatgttgctgtgagttgttggctgcgtaggcattgtgtaatttgtaattgataggttcatttgtgttatgtgagtttttcttatattgttttccaatgttacaaaggtgaattttgatttgctataaattaagcctcgcattttgattagcctaacataaattggtagaaaagcatatattttctcattatgtctaaattttaccaccctttatacacgcttcagtttttatggtaaaatgggttttggcttgaagtttgttcaacctgagaaattggagccagcattcattggtgtcagaagctgaatgctttgttgcttttcttagcgttcaacatattttgtactggttctttcttttccaccttatcaatggagctacttggctggttcaacatctagctactgctagtttagtcttttttatgcttagccct

SEQ ID NO: 1994 - DNA, 3814 bp, Oryza sativa
ctagcattttcatagaacaaggacaagttagcaaacaactacaaccagcggaacaaaccttacagtaggctatagccctatagcctacctaaacagaggttttttttcccaatccttaagagacacacaactcccactacttgagtggtaaaaaagtttattattacaaaacaagtttatgattatgaatggcacggccattctggtagttgcgaggtatattgttagtccagagttatccacggtgcaagtatatgcctctaattgagacaaatatacatacctctaagaatgcaataaatgccacagaaatttataatgaaaatttccaattctatttcaacctataaggttagttttggtacttccttttatggggaggtatacaaggatggttgaaaacctcaaacagtaaatgtgatcgaaaaaagcattttaaaagagagctgacataggctacaatgaaaatagcacacaaactcttcgcaaatcatctgtacaagattatcacatcaatatgtgtacaactaccagaccaaataagtaaaaatatcaaaaagtagcaggccatttgtttaaatcaaattaagcatcataatctaagctcctaatctaagcaaaccataaagattaacttcaggaatgggcactgaattcagaattaagtgttcatacgcatataccagatagaattgcaacttgcatgattgttattagataagactaattaaatttatagaagtgcaactgttgatcaacagaccacatatgtgcaagtgttgatgacatattccgcataattattactcgatatatgaattgcatccgctaacttaaaacatatgcactagacacatacatgtatcaatagtattaaaactcaaactgacaataagcaacaatacagcaaacgagcatttccattggaattacttgaaatttgcaaccctaaggagctgaacaagcatttccatgggaattaattgaaatttgaaaaccctaactacctgaaatgagcatgtcacaatcacaacataacagtagcggtaccaaagcagacagcaacactactcgcagaatcatcttaacatagcataacacttgcagtatggatcatcttaacaacataaatataactcaacataggtaacaggcaaaaccatattccagagactagagtagagtcttaaacatttcaatcacatccatttcacaatgtcaaaaaggcaaggttcagggctaagttttaaaagactaaacttgaaagtaatgcagtagctagatagatgtagaacaagccaagtagctccattgatagggtggaaaagagaacaccgctccgaatcggtccggcgagcgctcagcggtacgacttctggaaccttgcgcgggcgccgcgaccaccgaacttcttgggctcgcagcgcctggggtcggcgacgaggagggtgcggtcgtagcgggcaaagatgtccttgacctccttcttggacgcctcgtcgacgtacttctggtagtaggcgacgagggccttggcgatggcctggcggatcgcgtagatctgcgacgtcttcccaccgccgcggacgcggatcctcatgtcgatgtccttgaagcgcgagcgccccgcgagcaggatgggctcgaacgccttgaggcggagcatctccggcctgatcagctcgatcgggacgccgttcaccttgatcagcccgcgccccggcttgcagtaggagacggccaccgccgtcttcttgcgcccgaagcactggaccgtgcctggaggcgggcgggtgagcgcggcggccatggttgcggtggtggcgcgcggcggcggcggcggcggctagggctcaggcagcttggtgcgggagagaggcggcggcgaaggggagagatcgcttcgagagagcgattttatagcgaggggattagggtttagctctagtgggccatgggggatagttagtgggccattatgggctgggctagaattagttgggccttcgcgagcccatttggtgggcgcgtttttcgcttgtaaaaaggccgtgggggaggaggcggcgagctagggtttcgaccctcacgaacactacttgatcttatctgagcttgccgtccggcggcgccgcggctgccggagtcgcctctccggcattcgcgccgccaccgctgtcctcgtacggttggcgggaaggtggcgcgctttgttcggggaaagaggcgggtttggtatccgtggcgctcgccggcggtgagcgatgacgactgcccgcggtcggagcgcgtgcgatgatggccgcgcgggttcaccaaaacaacaaacagatcacaatgttttgcgttttttctgccattgttttattgatgatttttttattcggagttctattcatttagttgttctcgtattagtcaatgtgcgttgggttgttagtggtttcgtagatcctgtttggcaatagtggatgtaaaagcgctttttgtttgtgtagaatgtgttaggatagtatacaaatgttttgtaattgaacatgtgcatagatatgttagcattgtacttgttgagcttactttgtaagtttgggcatatcgaattttgcttaattatcattgaaaccttgttttcatcctagttttgtagtttagtttttaaatatgtccatattacagtatcactccacttcagttcaatgtcatgtatattagcatgccatgttttcgatgatgttgtaggtttatatcaatcaattattagcttaaagaggatgatatacagaattctattctgtggaccaaacggaaccttgatggtttgaggacagtcccttcaatgatatacaaatcaaatattttcttgtgtccttgagaaatttggaagacgcactgttaaaatccatgtcttttttgctatgcatggctgatgtggactctaatttctcctcggttttgaacttttgatgcggactctaattgcaagatccttttgaaaatcgtggtttttcttccacaatgtggttttgactaaataaacgttcaaagtttaaaaaaaaagccctcatgacttgacttgtgcatttttgtatcaacctgaatcagctcagcatcttttcttggtttgcaacattgcataagtttgtagggttttagaagccgtgcagagcactacaacagtgcctacaatccgtctgttggatgcacggcctttatgtgatcattctaatggagtaatggccttccattgctatatctggaacatatagataacaagtcttgttttgagtgcaaaaactgtcactttgatgtgatcttttgaatttgtacaaattttaatagtgggcaggtttaagcaaggatgaagctgctgctgtgtaagcaaaggagggtaacttctgaatatgactctgaacgttggtgtgaagttgcaacaacgggaagatggcgagtatgttgaagaaaactgatgcagtcatgaagatcatatttaatcttttctactaccagttgttgtcgatggcttcttcattctttgttgctgatctatcgctgtttgtcaccgactcgatacttcccttttagttttaggttgactaaggctaggtttgtcaccgactcgatacttcccttttagttttaggttgactaaggctagcttaagcttgggtattttgtctgtatgatcacctgctttgctttccctgttcccaaatgtactctgaaaataagaactatgttatttctcttcatatcaaatgtataaatggttaccctgttaaaagagattaatgaactgtcatgtggttcttatttt

SEQ ID NO: 1995 - DNA, 1701 bp, Brachypodium distachyon
attataagatcgctcactcttcgcgatcacctgccaacgccgccgccgccgctttctccagcagcagaagccctagcgcctttagccgccgccgccgagctttcacccaatcatggctgccgtcctgactcgcccgacgccgggctcggtgcagtgcttcgggcggaagaagacggccgtggcggtggcctacaccaagcccggccgtggcctgatcaaggtgaacggcgccccgatcgagctgatccgcccggagatgctgcggctcaaggcgttcgagcccatcctgctcgccggccgctcccgcttcaaggacatcgacatgaggatccgcgtccgcggcggcgggaagacgtcgcagatgtacgccatccgccaggccatcgccaaggggctcgtctcctacctccagaagtacgtcgacgaggccgccaagaaggaggccaaggacatcttcgcccgctacgaccgcaccctcctcgtcgccgatccccgccgctgcgagcccaagaagttcggtggacgcggagcccgcgccaggttccagaagtcgtaccgttgatcgcatcctactggatcgtcgtcatccttgggatggttttctctgctttatacctcctcacaaagtgctagaattattatgcgtagttccgggccttgaagacattgtgatatcgaagtgatgcgagatgttcaggactgtttgagtagtcgttgctggaatatgtttttagctgttattacttgtgttcaggaattttgatatggtttgcgttatatctatgcattgttttgagttttatcttaattgttcttatatccaagaagttgttatctttatgttacccagacgattttgatgttccatacaattatcattttgccatattagaaaatgtgcatacttacctttaagactgttgtacataggtaacgagtgcaagtgttttttctgtgtctctgtctagttaggcaattgcaatattgtgtatgagtctcattatcatcacaggaacggggaaagtatgttacagtcgtgggctatattttgttgcattttgtatgtgacaatcatgggctttattttgttgcattttgcggcgagtatttttatttttatggctgtgtatcaaattgatacaaagttgttattttgccaaagctgttgtcatatgtattttctggggaggtgtggtttgattattgttcatctttttcaactagtctatatttacatgttttagctagtggaaatataattgaagaacatgccatgccacctgatatatatttttcttttttagcctataggaagtttggtatcctaattggcacgtttctggatgtccctatcctcctggcctctttggatatgctctgaagatgagttgtccatatggaaacaacacattgcattttgttttgttctagtttgtgataccgcaatagacgacactggttatatgagagtttttctttagatatggctctatgatttagatagggcatacacagtagcagtatgaaactccatctccaaacaccatttgaaatagctatcaatctcctaatgaatagtgacttcagtctactaggcactcttgcatgttttgtttctctgttaatgttttgactgacacatacgttagtttatctgtattgaatacattcatgaacagataatgcatgaacacatcaagt

SEQ ID NO: 1996 - DNA, 1085 bp, Zea mays
cctcacaagtcaccagtttttccttccttctatggccgagcacaataggttctcaccatacaattgggcctcaacaacaacaacacaggcccagacaccataaaccagacctttcggccccacatgtcattctctgagcggcgccgatccgacaatcgtaaaaccctaactctcccaatccaagctataaaagcgttcccctcctgtctgtccgctctatacgccgccatcttcgcaagccaccgcaaccgaagcccgccttcgccgccgccgcctctgcgatccccgcaaggtcgcaaacatgtctaccgtgctccagcgcccgacccccggcacggtccagtgcttcggccgcaagaagacggctgtggccgtcgcctacaccaagccggggcgcgggctgatcaaggtgaacggcgtcccgattgagctcatcaggccggagatgctccgcctcaaggccttcgagcccatcctgctggcggggcgctccaggttcaaggacatcgacatgaggatccgcgtccgaggcggcgggaagacgtcgcagatctacgccatccgccaggccgtcgccaaggggctcgtcgcctactaccagaagtacgtcgacgaggccgccaagaaggaggtcaaggacatcttcacccggtacgaccgcacccttctcgtcgccgaccccaggcgctgcgagccgaagaagttcggtggtcgcggcgcccgcgccaggttccagaagtcctaccgttgagcgctcggctgcccgcgcttgccgtaccgatgcctgtgttgtcccaacttgccagttcgatgcctgtacccgtggcttaattttctatcatcggagctacttatgtggttctataactagatgctgttttaccttcaacttgtgctgttgtaccttcatatttggactttttaagccttgtgtcggacgcctttggcattgaaatatgagagattttgaagactatctctgaagttatgtggttctatatctagatgttgtttcagcttgttacttgtgttaatgaatttatgatatgtttgtcataaatttatgatatgtactggttgttgct

SEQ ID NO: 1997 - DNA, 718 bp, Avena sativa
gcgccgccgcgctccccgcaatcaagtgcgccgccatgtccaccgttctctcccgcccggctgcgggcaccgtccagtgcttcggccggaagaagaccgccgtcgccgtggcctactgcaagcccggccgtggcctgatcaaggtgaacggcgtgcccatcgagctgatccgccccgagatgctccggctcaaggccttcgagccgatcctgctcgccggtaggtcccgcttcaaggacatcgacatgaggatccgcgtccgcggaggcgggaagacgagccagatctactccatccgccaggccatcgccaagtcgctcgtctcctacttccagaagttcgtcgacgaggccgccaagaaggaggtgaaggatatcttcggccgctacgaccggaccctcctcgtcgccgacccgcgccgctgcgagcccaagaagttcggaggacgtggagctcgcgcgcgtttccagaagtcttaccgttgatttgggtatggtggcgccgttggcgcactccttgactacctatctatcgagcagtttatgccaagtagtttcgcatctttttggacaatgaattcgatatgatgttctctaagactttaagttatctatgcaatatccttttgcttcgtgctagttggagagattatgtcatcttgagttaatgatcagactgttatgttaagttacatctttgtttctaaattatagttgaa

SEQ ID NO: 1998 - DNA, 2762 bp, Sorghum bicolor
cctcacaactcaccactttcccttcaaggcccagcccaacaagttctcaccactaaatgggcccccgataataactcaggcccagacaccataaacaaacctctcgggcccacatgtcattctctgagcagcagcgatcccacaaaaccctaacgattcgaatccaagctataaaagcgttcccctcctttcgctcccccctaagccgccgccacctccccgagccgccgccgccgcagcagccctagcgcgccgtcgccgtcgcctccgctgcgatccccgcaaccatggctgccgtgctgcagcgccccgcagcgggcacggtccagtgcttcgggcggaagaagacggccgtggccgtggcctacaccaagcctgggcgcgggctgatcaaggtgaacggcgtcccgatcgagctcatccggccggagatgctccgcctcaaggccttcgagcccatcctgctggcggggcggtccaggttcaaggacatcgacatgcggatccgcgtcaggggcggcgggaagacgtcgcagatctacgccatccgccaggccgtcgccaaggggctcgtcgcgtactaccagaagtacgttgatgaggccgccaagaaggaggtcaaggacatcttcgcccgctacgaccgtaccctcctcgtcgccgaccccaggcgctgcgagcccaagaagtttggcggtcgcggcgcccgcgccaggttccagaagtcttaccgttgagcgcttgcttgcctgcgcttgccggactgttgcctgtgtgttgtcccaatcatcggagctacttatctgcttctatatctagctgttttaccttcatctttagactttttaagttttgtcccgaacgtttttgacattgtgatatgaatgtgagaaattttgaagactacctctgaagttttgttttgttttgttttgtttgttaactgtgttaatgaatttataatatatttggcataaatttgtgatatgtactggtttcctttcagttttgcagcatgtataatttatgtactggttgcctttcagttttgcaacatgtatttgttcttatgctcatttgtgctgagtagctgtgatagtgtttagctgacttgattagatgatacgactttacagaactctgatgtcatacatattggcaatttgtaggtgtctcgggccttatttttgttttgtttatatttgtgctatataagggcaagagtagtcttaggatttacttggattactatctaattcttatttgtgtttgttttatggacggacagcatgattagtgcaattgcatgtttgtctacatattctatagatgagtgattcgtagtttaagtgatatatatttggatcaagttggggatgtatgcaggaaatgttaatcctgacactagtccatccggtattaactttttatgattctgtatctatgttgccttagtttgtacttctattgatgggatttgtgaggattcccatccctttaatctttaggctgtttgcttgagcttatcagccgaatctgctagccatttagcagtgtttttctctcacaacaaatcaacaaacagtacttgtctttgcttgatttccggttctcatggttcctgcagtgcatgtgaagtgacactgaaaatggacagtaaataattcgtgttaagtgtcaatgttttgatttgcgaaatggtttcatattgactatctagatgccttttatcatatggcctcctgtcatgaatgtggcatgcaagacattttgaattgccaaatggttacattctgattggtcaggtatcttctttccctagtttgatctgctctatcatgacacaattcatatctgttgacgtgtttaggattttgctgtatcatatatgattaggattttgttgtatcatacattttgcctacttttaccaaaaaaatgtgtgatgctttagttgtaacatattcatcttctgagatcggttaaatttctgtaagcctgtatgcaatttatcttttgctagactcaatagtggacatgagattctgtctatttaatcctgtttcattgagtttattgattgcctgcattgcctagtgatgctcttgctggtgtatccatggtggtgggtgtttgaacattttgattcaattctagccttttgtacttagtttgaaatgcccactgcttggtttaatgtcttatctgatatagctcattctgctagttggagctaaacctatattcctgagtgagttgcatcatgttgagttagtcctgaatgagttcgaccatgttgagctgtaatttattcctgaatgagtttattttgtggatatactttgattctaagcctgcaatgctaattgtctgcaatttgcaagtgttctccctatttcaatcgaattgtctgcaatttgcaagtgttctcttcccatgtatttgcaagatttcttttttcttgcgtgtccgggctacttgtgagttgcaggtggagagaattgacgaagctatgcatcatgtgagcttcctcatttctgtatggcagagaagatgcttagagaattgtctttgggaatttataggttgtttgtttctaggagtcaccaattctatatgaagtaatgcatcacgagttcattcctcgtatcgtggagtgaccccatttctcgtacttgtaaataattattggcttaagaagattgaggtggtgatagtcaatctattccatttgacaaaccaaacagaaaactgagtaataa

SEQ ID NO: 1999 - DNA, 1011 bp, Panicum virgatum
cggcccattgatccagcccataaccattcgtgtagggcccacatgccatcctcagagctcactcgaaaccctaacgcttccaggctatataaaccgttcttcccttccgctcccgtctctccgccgccccactccccaagccgccaaaccctagcgccgccgccgcaaccatggctgccgtgctcacccgcccggccgcgggcaccgtccagtgcttcggccgcaagaagacggccgtggccgtggcctacaccaagcccgggcgcgggctgatcaaggtgaacggtgtccccatcgagctcatccgcccggagatcctccgcctcaaggccttcgagcccatcatgctcgccgggcgctcccggttcaaggacatcgacatgaggatccgcgtccgcggcggagggaagacgtcgcagatctacgccatccgccaggccgtcgccaaggcgctcgtcgcctacttccagaagtacgtcgacgaggccgccaagaaggaggtcaaggacatcttcggccgctacgaccgcaccctcctcgtcgccgaccccaggcgctgcgagcccaagaagttcggtggtcgcggtgcccgcgccaggttccagaaatcgtaccgttaagcagcgattgcttgacgcgtcacaatctgccatatcactctgggtgtgtgttcttggcttcgtgttcaatcaatggatcaacttatctggttctatatctagctgctgctttaccttcatgtctagacttttaagcctagtgttgaacttttttttttgacattgtgatgtgaaatgtgagagatattcaagaagacaattcggtagtcgcttaagtattgttggttttgcttgttacctatgtccaggaattatgatatggtttccttctatctgtacctgtttcatgcttatgcttacccatgttttcaagttaagctgtcttctctgccttaaataactcggttgaatggatgctaccgctgtagacaacttgtgatggcatgacttg

SEQ ID NO: 2000 - DNA, 1017 bp, Panicum virgatum
cggcccagcgagccgtgtcaccatcccgcgcaagcccaacaacctatctctggcccattaatccagcccataacaaattccatagggtttcatttgggcccaaccatacgtttaggccccacatgtcatcctcagagccgtggcaatcactcaaaaccctaacgcttccaggctatataagccttctaccctttcgccccgtgtgtccttggcagcccccacccaaactctagcgccgccgccgctgcgatcccagcagccgccaccgcaaccatggctgccgtgctcacccgcccggccgcgggcaccgtccagtgcttcggccgcaagaagacggccgtggccgtggcctacaccaagcccgggcgcgggctgatcaaggtgaacggtgtccccatcgagctcatccgcccggagatcctccgcctcaaggccttcgagcccatcatgctcgccggccgctcccggttcaaggacatcgacatgaggatccgcgtccgcggcggagggaagacgtcgcagatctacgccatccgccaggccgtcgccaaggcgctcgtcgcctacttccagaagtacgtcgacgaggccgccaagaaggaggtcaaggatatcttcggccgctacgaccgcaccctcctcgtcgccgaccccaggcgctgcgagcccaagaaattcggtggtcgcggtgcccgcgccaggttccagaaatcgtaccgttaagcagcgattgcttgacgcgtcacaatctgccagatcactatgggagcaacttatctggttctatatctagcggctactttacctccaagtttagacttttaagcctagtgtcggaccttttttgacattgtgatatgaaatgtgagagatattcaaggctattctgtagtctcttaagtatggttttgcttggtacctatgtccaggaattatgaatttatgatatggtttccttctatttatgctatgcaagagtagtatttcaatcaattttactgtgtgcctgtttcatgc

SEQ ID NO: 2001 - DNA, 1483 bp, Sorghum bicolor
ctctctccgccgcacccctccccccaaagccgccgccgccaaaaccctagcgccgccgctgcgaacccagcagccaccaccgcaaccatgtccgtgctgagccgccctaccccgggcacggtccagtgcttcgggcggaagaagaccgccgtggccgtggcgtacacgaagccggggcgcgggctgatcaaggtgaacggcgtcccgatcgagctgatccgcccggagatgctccgcctcaaggccttcgagcccatcctgctggccggccggtcgaggttcaaggacatcgacatgcggatccgcgtccgcggcggcgggaagacgtcgcagatctacgccatccgccaggccgtcgccaaggggctcgtcgcctactaccagaagtacgtcgacgaggccgccaagaaggaggtcaaggacatcttctctcgctacgaccgcacactcctcgtcgccgaccccaggcgctgcgagcccaagaagttcggtggtcgtggagcccgcgccaggttccaaaagtcttaccgttgagcgattgctttgctgggtcgcaaatttgcaagatcgctctggttgttcgtggcttcatttcctgtccatggagctgcttatctatatctagcttctgctttacctaccttaatgttttagactggcattgtggtattaaatgtgaggagattttgaagactattaattagtctctgaagtatgtttttcttgtcattatctctgtcgagtaattatgatatggtcgcctattagtaacccctgaagtatgttttgattgttatcttatatctagcacattatttgccttctgatttttctcgttatctattttgtgtttagttcacttgtgcgactttctgtttgtttatgcctagttgaattgattgcatgaattgagagtagtgattgcattagtgctgttagattattagataatggcacattgaattttagtatgtttgtaggttgaagttgaaatgatcttacttgtagctgatgcttgaaagcactagggagtaaattgtgcatgtggtttctatatccttcgcactggagtgagctataaaatgatttataacagttttggatgatttgtttccatccattcactttaattttagggtgtcaaatgttgctttcatgattaatgtagttaatctgcctatataatcctttgtatcaacttagttgctttcatgattagtgtagttcctttttatcagacacttctgttaccacctctggtatgattatttggatgtaggtgctgctgatatagttgtgactggaatggcttgttttaaggggtgatattcatagtagtaatatagtgtttggagagaaaaaaatactgtcacttgccatagaagtattgtggtatagattgcacacgtgattgttttgatggaaaaagagggagcttgttttgcaacacgcccaataaaatcctcaatagtgctagcgctag

SEQ ID NO: 2002 - DNA, 741 bp, Saccharum officinarum
ccccaagccgccaaaaccctagcgccgccgctgcgaacccagcagcaaccaccgcaaccatgtccgtgctgagccgccctaccccgggcacggtccagtgcttcgggcggaagaagaccgccgtggccgtggcgtacacgaagccggggcgcgggctgatcaaggtgaacggcgtcccgatcgagctgatccgcccggagatgctccgcctcaaggccttcgagcccatcctgctggcggggcggtcgaggttcaaggacatcgacatgcggatccgcgtccgcggcggcggcaagacgtcgcagatctacgccatccgccaggccgtcgccaaggggctcgtcgcctactaccagaagtacgtcgacgaggccgccaagaaggaggtcaaggacatcttcgcccgctacgaccgcaccctcctcgtcgccgaccccaggcgctgcgagcccaagaagttcggtggtcgtggtgcccgcgccaggttccagaagtcgtaccgttgagcgattgcttgccggatcgcaaatttgcaaggtcgttctggttgttcgtggcttcatttcctgtccatggagctgcttatctatatctagcttctgttttacctaccttaatgttttagactggcattgtggtatcaaatgtgaggagattttgaagactattaattagtctctgaagtatgttttgcttgttattatctctgtcgaggtaatatgatatgatcgcctattagtt

SEQ ID NO: 2003 - DNA, 733 bp, Saccharum officinarum
ccctaatccgccgccacctccccgtgccgccgcagccctagcgcgccgtcgccgccgctgcgattcccgcaaccatggctaccgtgctgcagcgcccggccgcgggcacggtccagtgcttcggccggaagaagacggccgtggccgtggcctacaccaagccggggcgtgggctgatcaaggtgaacggcgtcccgatcgagctcatccggccggagatgctccgcctcaaggccttcgagcccatcctgctggcgggtcggtccaggttcaaggacatcgacatgcggatccgcgtccgcggcggcgggaagacgtcgcagatctacgccatccgccaggccgtcgccaaggggctcgtcgcgtactaccagaagtacgtcgacgaggccgccaagaaggaggtcaaggacatcttcgcccgctacgaccgcaccctcctcgtcgccgaccccaggcgctgcgagcccaagaagttcggtggtcgcggcgcccgcgccaggttccagaagtcctaccgttgagcgcttgcttgcccgcgctttccggaccgttgcctgtactgccccaacttgccagatttctgcctgtgctcttggcttaatttcctatcattggagctacttatctggtggtgctatatctaggtgttgttttgccctcatctttagactttttaagtcttgaatctttttgacattgtgatatgaaatgtgagaatttttgaagacta

SEQ ID NO: 2004 - DNA, 801 bp, Panicum virgatum
cacccaaactctagcgccgccgccgctgcgatcccagcagccgccaccgcaaccatggctgccgtgctcacccgcccggccgcgggcaccgtccagtgcttcggccgcaagaagacggccgtggccgtggcctacaccaagcccgggcgcgggctgatcaaggtgaacggtgtccccatcgagctcatccgcccggagatcctccgcctcaaggccttcgagcccatcatgctcgccggccgctcccggttcaaggacatcgacatgaggatccgcgtccgcggcggagggaagacgtcgcagatctacgccatccgccaggccgtcgccaaggcgctcgtcgcttacttccagaagtacgtcgacgaggccgccaagaaggaggtcaaggacatcttcggccgctacgaccgcaccctcctcgtcgccgaccccaggcgctgcgagcccaagaagttcggtggtcgcggtgcccgcgccaggttccagaagtcttaccgttaagcagcgatcgtttgacgcgtcacaatctgccagatcactatgggtgttcttggcttcgtgccctatcatcggagcaacttatctggttctatatctagcggctactttgcctccaagtttagacttttaagcctagtgtcggacctttttttgacattgtgatatgaaatgtgagagatattcaaggctattctgtagtctcttaagtatggttttgcttggtacctatgtccaggaattatgaatttatgatatggtttccttctatttatgctatgcaagagtagtatttcaatc

SEQ ID NO: 2005 - DNA, 796 bp, Panicum virgatum
gccgccaaaccctagcgccgccgccgcaaccatggctgccgtgctcacccgcccggccgcgggcaccgtccagtgcttcggccgcaagaagacggccgtggccgtggcctacaccaagcccgggcgcgggctgatcaaggtgaacggtgtccccatcgagctcatccgcccggagatcctccgcctcaaggccttcgagcccatcatgctcgccgggcgctcccggttcaaggacatcgacatgaggatccgcgtccgcggcggagggaagacgtcgcagatctacgccatccgccaggccgtcgccaaggcgctcgtcgcctacttccagaagtacgtcgacgaggccgccaagaaggaggtcaaggacatcttcggccgctacgaccgcaccctcctcgtcgccgaccccaggcgctgcgagcccaagaagttcggtggtcgcggtgcccgcgccaggttccagaaatcgtaccgttaagcagcgattgcttgacgcgtcacaatctgccatatcactctgggtgtgtgttcttggcttcgtgttcaatcaatggatcaacttatctggttctatatctagctgctgctttaccttcatgtctagacttttaagcctagtgttgaacttttttttttgacattgtgatgtgaaatgtgagagatattcaagaagacaattcggtagtcgcttaagtattgttggttttgcttgttacctatgtccaggaattatgatatggtttccttctatctgtacctgtttcatgcttatgcttacccatgttttcaagtt

SEQ ID NO: 2006 - DNA, 775 bp, Pennisetum glaucum
cgccccctagcgctagcgccgccgccgcccgccgaagccccaccgccgccaccgctttgatcccagcagccaccaccgccaccatggctaacgtgctcacccgccccaccgcgggcacggtccagtgcttcggccgcaagaagacggccgtggcggtcgcatacactaagccggggcgcgggctgatcaaggtgaacggctccccgattgagctgatacgcccggagggcctccgcctcaaggccttcgagccgatcctcctcgccggccgctcacgcttccaaaacatcgacatgaggatccgcgtccgtggcggagggaagacgtcccagatctacgccatccgccaggccattgcgaaggccctcgtggcctacttccagaagtacgtcgacgaggcctccaagaaggaggtgaaggacatcttcggccgctacgaccgcaccctccttgtcgcagacccgaggcggtgcgaacccaagaagtttggagggcgtggtgcccgcgccaggttccagaagtcctaccgttgatcggttgctccggatcgacttttttttttgtctcgtatcagtggtgctgctctaagctttacatttatgctgtgcaagcttagacttttaagcctagtctcgtacctttaagacattgtgatatgaatgtggtgagatgatgaaactatctggattatgcttttgcttcggacctctgatgttgaattatgataaggttcccctatatcatgctatataccatttgtctattatattcctca

SEQ ID NO: 2007 - DNA, 901 bp, Panicum virgatum
gcttccaggctatataaacgttcttcctttcgtttccctcctcaagccgcaaaagccctagcgccgccgccgctgccgctgcgatcccagcagccgccaccgcaaccatggctaccgtgctcacccgcccggccgcgggcaccgtccagtgcttcggccgcaagaagacggccgtggccgtggcctacaccaagcccgggcgcgggctgatcaaggtgaacggtgtccccatcgagctgatccgcccggagatcctccgcctcaaggccttcgagcccatcatgctcgccggccgctcccggttcaaggacatcgacatgaggatccgcgtccgcggcggaggcaagacgtcgcagatctacgccatccgccaggccgtcgccaagggtctcgtcgcctacttccagaagtacgtcgatgaggccgccaagaaggaggtcaaggacatcttcagccgctacgaccgcaccctcctcgtcgccgaccccaggcgctgcgagcccaagaagttcggtggtcgcggtgcccgcgccaggttccaaaagtcgtaccgttgagcgattgcttcccgcatcacaatctgccaggtcactgcgggtgttcttggcttcgtgttctatcaatggagcaacttatctggttctatatctagctgccgctttaccttcatgtttagatttttaagcctagtgtcgaacctttttttgacattgtgatatgaaatgtgagacagatattcaagactattctgtagtctcttatgtatggttttgcttgttacctatgtccaggagttatgatatggtttccttctgtttatgctaagagtagtatttctattttactgtgtacgcagtgctttttatttaagttgccttctccgcatatagcaacttggttg

SEQ ID NO: 2008 - DNA, 639 bp, Cenchrus ciliaris
agcagccaccaccgccaccatggcaaccgtgctcacccgccccaccgcgggcacggtccagtgcttcggccgcaagaagacagccgtggccgtggcctacacaaagccagggcgcgggctgatcaaggtcaacggcgcccctatcgagctgatacgccccgaggggctccgcctcaaggccttcgagcccatcctgctcgccggccgctcgcggttccaaaacatcgacatgcggatccgcgttcgcggcggagggaagacgtctcagatttacgccatccgccaggccatcgcgaaggccctcgtagcctacttccagaagtacgtcgacgaggccgccaagaaagaggtgaaggaccttttcggtcgctacgaccgcacgctcctcgtcgccgaccccaggcttttcgagccgaagaaattcggcggtcgtggtgcccgcgccaggttccagaagagttaccgttgagcggttgctccagatcgacttcggtgttttcgttcttttttaaagggggggctgctcgtgctggttctctacctaggtgcagctttatatttattttctcaaggtttagactcttaagcctagtctcgtaccttttttacattgcgatatgaatgtggtgagatgaacta

SEQ ID NO: 2009 - DNA, 728 bp, Zea mays
gtggctataaaggccaatccactctctctccaggcaccccgagccgccaaaaccctaccgccgccgcgaatcccgcacgaccccaaccatgaccgtgctgagccgccctaccccgggcacggcccagtgcttcgggcggaagaagaccgccgtcgcggtcgcgtacacgaagccggggcgcggcctgatcaaggtgaacggcgtcccgattgagctgatccgaccggagatgctccgcctcaaggccttcgagcccatcctgctggcggggcggtcccggttcaaggacatcgacatgcggatccgcgtccgcggcggcgggaagacgtcgcagatctacgccatccgccaggccgtcgccaaggggctcgtcgcctactaccagaagtacgtcgacgaggccgccaagaaggagatcaaggacatctttacccgctacgatcgcaccctcctcgtcgctgacccccggcgctgcgagccgaagaagttcggcggacgtggtgcccgcgccaggttccagaagtcgtaccgttgagcggctgcctgctccatctcgatttttcagatcgttgtgggtgttcttcgctttatttcctatcaatggatctgcttatctggttctatatctagctgctgctttaccataatgtttagactttaatgcctagcctgaaaccttgtttgcaatgtgaaattaatgtgagagattatgaagactattttggcta

SEQ ID NO: 2010 - DNA, 797 bp, Panicum virgatum
aaaagccctagcgccgccgccgctgccgctgcgatcccagcagccgccaccgcaaccatggctaccgtgctcacccgcccggccgcgggcaccgtccagtgcttcggccgcaagaagacggccgtggccgtggcctacaccaagcccgggcgcgggctgatcaaggtgaacggtgtccccatcgagctgatccgcccggagatcctccgcctcaaggccttcgagcccatcatgctcgccggccgctcccggttcaaggacatcgacatgaggatccgcgtccgcggcggaggcaagacgtcgcagatctacgccatccgccaggccgtcgccaagggtctcgtcgcctacttccagaagtacgtcgatgaggccgccaagaaggaggtcaaggacatcttcagccgctacgaccgcaccctcctcgtcgccgaccccaggcgctgcgagcccaagaagttcggtggtcgcggtgcccgcgccaggttccaaaagtcgtaccgttgagcgattgcttcccgcatcacaatctgccaggtcactgcgggtgttcttggcttcgtgttctatcaatggagcaacttatctggttctatatctagctgccgctttaccttcatgtttagatttttaagcctagtgtcgaacctttttttgacattgtgatatgaaatgtgagacagatattcaagactattctgtagtctcttatgtatggttttgcttgttacctatgtccaggagttatgatatggtttccttctgtttatgctatgcaagagtagtatttttatttt

SEQ ID NO: 2011 - DNA, 807 bp, Panicum virgatum
cctcctcaagccgcaaaagccctagcgccgccgccgccgccgctgcgatcccagcagccgccaccgcaaccatggctaccgtgctcacccgcccggccgcgggcaccgtccagtgcttcggccgcaagaagacggccgtggccgtggcctacaccaagcccgggcgcgggctgatcaaggtgaacggtgtccccatcgagctgatccgcccggagatcctccgcctcaaggccttcgagcccatcatgctcgccggccgctcccggttcaaggacatcgacatgaggatccgcgtccgcggcggaggcaagacgtcgcagatctacgccatccgccaggccgtcgccaagggtctcgtcgcctacttccagaagtacgtcgatgaggccgccaagaaggaggtcaaggacatcttcagccgctacgaccgcaccctcctcgtcgccgaccccaggcgctgcgagcccaagaagttcggtggtcgcggtgcccgcgccaggttccagaaatcgtaccgttaagcagcgattgcttgacgcgtcacaatctgccagatcaccatgggtggtattggcttcgtgtcctatcaatggagctacttatctggttcaatatctagttgctgctttaccttcgtgtttagacttttaagcctagtgtcgaaccttttttgacgttgtgatatgaaatgcgagagatattcaagactattctgttgtctcttaagtatggttttgcttgttgcctatgtccaggaattatgatatggtttacttctatttatgctatgcaagagtagtatttcta

SEQ ID NO: 2012 - DNA, 5169 bp, Zea mays
gattaggtatgtctcttgtcttatccgccacacacgacacgacacgcgccggccacagaaacagcgcttcactcccctccgcgccgcggcgaccatggagctcgccaccgtcgccgctgcagtcgcctccgccgctgcgcgcccgcacgggcctttctcctctccccgcgcagtctctgcctccgtctcgtggaccagtctctcgctcgcctacacctcccgctgtctctcctccacgtcctcgcgacggcggctgcgctggctccccgtcacctcggccgccgtggagctccgcgaggccactgccgggggcggagactcgctccgtgtcaccaagacgccgcagcctggatccagtgttaagttcagcgtggaggtgcctacttccatcattcacgagtgctaccaatccacgctacaggagtacgccaaacgtgttaaggttcctggatttcggcctgggaagaccattccagaaaacgttcttataaactatgtaggaccgcaacatgtacaggatgccacgattgaagctatcttaaaacatacgcttcctcaagcactgtcctcggtagaggagagggcattagaagattctgttcgcattctgactcaatttgatgatatgagaaattctttctcactcgacaatgtgtttagatatgatgttgctgtggatgttgcccctgaagtccgatggttatctgaagacaaatataggaacctcaaagttgtcgttgaaatagatgaagctgttgatgcggaaaaggcggcagagaaagagcttcagcgtcgtcataaagctctaggcttacttagaattgtggctgacagaggcctccagattggtgatctggtggtgctggatatatttgcggaaagcattaacaatgatggctctagaggtgaaaaaatttcatcggctgagagtacaggtttccacttggacactgaggaaaatagtaaccttgttcctggatttcttggttcgttgattgggattcgtgctggtgagactagatcatttcctatccagttccccgagtcatttgagcgagaaagtctacgaggtgtccgtgcacagtttactgttgtgtgtaaagagctgttctacagagagttgccagtaatggatgactcacttgctgtaaagcttcttccaggatgcactacaatagacgaggttcgagagcgtattttgaaaagatgtaaagaagtggagaagacggccatagaacaagcaacagacaacgcgatccttgaccagctcgggaagttggtcgaggtcgacgtccctcgtgccttgtttcaagagcaagggcagcagctttatggagccaagcttctgcagcttcaggcggaaaggaagctggataaagaccagctagcttcgttatcaaccaagaggtcagtgcaggcgtacctagaagatgagaaggagaacattacaagaatcattaaacagatgctggccgttggcgatattttcaaatccgagaacttacagtactcgactgatcagctcgtcaaggaagttgagaactccatagcggagttcaaacagtacaaccaagactatgatgaggacaacatcaggcagcaggtccaggatgtcctagaggcggcgaaggtgcttgaatggctcaaggagaactgctcggtcgagtatatcaggcgatgagtcccacgatgctgggtcaaggaaagctcctctgaacgtgagaaagatggtggctggtgtggcggtcggcagttttgcgagtggccttggtccttgccaatgccaaccagcctagagcagtgcagtgattaagaggtgtggctaacaaacatttgtctattgactcggttcatgatataaattcggatttggagctttagtaactagcatgttttcggtagagacaatcacatcgcattagagggcgtgtttgtttgtgtttataatctccccagattatataatccaacatatttatattttgaactttataaattcatactgtggccgattggtcgatcttgcgcaaggataatcatggaattaagaacgctatacgaagtgcataaatataaaacaccaatcggtgtatactataaactaaatttgaggaactagtcttgcacttaaataggataaacataaactaaaataaaataaaataaagcctgagaagcctacgaatcgccaaccatgttattatcagagttctgtaaagtcgtagctaaacggagccacgacagcggtccggcaggcgctggcgctcagcggtaggacttctggaacctggcgcgggcgccgcggccgccgaacttcttgggctcgcagcggcgggggtcggcgacgaggagggtgcgctcgtagcgcatgaagatgtccttgatctcctttttcgccgcctcgtcgacgtacttctggtagtatgccacgagacccttggcgacggcctggcggatggcgtagatctgcgacgtcttcccgccgccgcgcacgcggatccgcatgtcgatgtccttgaacctggaccgccccgccagcagcacgggctccatggccttgagccgcagcatctcgggacggagcagctcgatcgggacgccgttcaccttgatcatcccccggcctggcttcgtgtaggccacggccacggccgtcttcttgcgcccgaaacactgcaccgtgcccggggtcgggcgcttcagcacgggacccatggttgcgggtatagcagcaatggaggcggcggcgcggcggcctgcgaaggtgaaggtggcggcgcgctagggctgcggtggcttggaaacgttgctgcggtggaggcttttatagtacggatggatggaagcggtttccgggatcgccggcgccgacgaatgacttgttgggccgggccttagaaggaaggaaacccggtggctggtgaggcccaggtattcgttgtgataaaatggccactggtcaagggcggagaagctagggtttcggccctcacgaacactacttgatcttatccgagcgcgccgtccggcagcaccgcgggcggcggccggagtcgcctccccgtgcccgcgttgcccccgccggcctgcaagggttggtgggttggtggcgcggttcgtcgggaagaggcggcgcttgcgcccgcggtcgctgccggcgacgagcgatgacgactgcccgcggtcggagcgcgcgcgatgatggccgcgcgggttccccaaacacactacacgagatacttcgcgatgttcttttcctttgacatgttcttttcctttgacatgttcttttttcgaaaaatttgaagtattctttattaaaaaaaaaggctttttatgtgtgtttaatcccgcttgtcttctgtttgtgcttagtcgttctattagtgtggtttgattttgtatcacgctcgtcattgacaaagtgattccgttccggaatgatactaacaaagaatgtgccttctactctgttaccacgggtggtcttgggtccttacccttcagatgttcttgttaacggttcttctctcttcgtccagcacattgaactttatagtacacttagtatcattacattggtccttttaggatggagggtgaactattagagttattattaagatggtggatgttagctacgctttcatggtggatgtttactatgttttgtcatgtaaacaactgcatgtctttaaatttgtctatcagtataaatagtcactgcacatgcttaataaggttagattacaacatctggtgcagtcctctccatatctgatatttttctgttgcatcgatagccctcatggttattaaaaaatgtacttgtttgccatgtatgttgctcaatatatgatttgtgactcaccttgcttgacaagttggtatgattaagcgttttttggatcatgagggtgagatgataaacaacctttggtccacataattggattagtgaggtggaagcttcggatatagcggtgggctttacggttgccctaatagtgaacaggtccagcacatttactaccatatttttcccttcgtaatctaatcactaaggaggatcgaaattttttcatgcatagctttggttccctctcaactgattattcacttcaactgttttttaaattcgttaagatggaatgaaattgcttatttaaccacctatgctgccaatttgtccattagggtttcagtttatcctgacatttcatatatttgggacttttaagttgcccctatggctttttgctgtgcctgtgggatgaacatgtcccaacatttactccatttattcactttgtcagctaatagccatacatgttttatgtttagctgatcattaagaatgggaaatttacactttccatactgtgttatacatgttatgtttgcctgcttgaacaccccttgttttgaggtatcgtttgggagcaaaataggtgttctggtggcaacagcagtgccggtgagatgagcttttgtcccagtttaccaccaagtgtgtcacttggttgttagtgtcctatgggttctttgtagccttctgttttcctactttgtatcttgaatgtgatttcatggtcgctggttttttatcaagaggagctgggttcaatcgccacttagatcagtgttttttgtgattctctaatgcaacaacagcaaccttgtgcttggctaaagctacaataaggataatattctgaacttatttgccctggtgatgttgtaggtttacagaagagagaaattctggcagatccaattgctgttgccgtcattctgatacaacctgacttgatgactctcaatgaagctgaatgctgaaaggtgttgctgccttgcagaatgaagctttgagttcaatacatggaattcatatttggtggtggtgttttggaacttgtttatctgctaggtgttgctgccttgcagaatgaagccgtccacattgtccttgtttatctgcaagatgcatgcctgctctatttcttgctcttcagtcttgactgatgcctactgcctgagtgcagattcagtgtgatagttagattctgctgatgtgttaacatgttcattgtaaacaaatttcttgttaaacatgtgtgatctcttcaagaccatgtgtctttgacctaatatattgcgaaacattct

SEQ ID NO: 2013 - DNA, 731 bp, Zea mays
atacgccgccatcttcgcaagccaccgcaaccgaagcccgccgtgctccagcgcccgacccccggcacggtccagtgcttcggccgcaagaagacggctgtggccgtcgcctacaccaagccggggcgcgggctgatcaaggtgaacggcgtcccgattgagctcatcaggccggagatgctccgcctcaaggccttcgagcccatcctgctggcggggcgctccaggttcaaggacatcgacatgaggatccgcgtccgaggcggcgggaagacgtcgcagatctacgccatccgccaggccgtcgccaaggggctcgtcgcctactaccagaagtacgtcgacgaggccgccaagaaggaggtcaaggacatcttcacccggtacgaccgcacccttctcgtcgccgaccccaggcgctgcgagccgaagaagttcggtggtcgtggcgcccgcgccaggttccagaagtcctaccgttgagcgctcggctgcccgcgcttgccggaccgttgcctgtgttgtcccaacttgccagttcgatgcctgtacccgtggcttaattttctatcatcggagctacttatgtggttctataactagatgctgttttaccttcaacttgtgctgttgtaccttcatatttggactttttaagccttgtgtcggacgcctttggcattgaaatatgagagattttgaagactatctctgaagttatgtggttctat

SEQ ID NO: 2014 - DNA, 492 bp, Triticum aestivum
gccgccgcgaatcccgcacgaccccaaccatgaccgtgctgagccgccctaccccgggcacggcccagtgcttcgggcggaagaagaccgccgtcgcggtcgcgtacacgaagccggggcgcggcctgatcaaggtgaacggcgtcccgattgagctgatccgaccggagatgctccgcctcaaggccttcgagcccatcctgctggcggggcggtcccggttcaaggacatcgacatgcggatccgcgtccgcggcggcgggaagacgtcgcagatctacgccatccgccaggccgtcgccaaggggctcgtcgcctactacaagaagtacgtcgacgaggccgccaagaaggagatcaaggacatctttacccgctacgatcgcacctcctcgtcgctgaccccggcgctgcgagccgaagaattcggcggacgtggtgccgcgcaagttcagaagtctaccgttgagcgctgcctgctcatctcgattt

SEQ ID NO: 2015 - DNA, 602 bp, Cynodon dactylon
acggcggtggccgtggcctacaccaagcccgggcgcgggctgatcaaggtgaacggcgtccccatcgagctgatccgcccggagatgctccgcctcaaggccttcgagcccatcatgctggccgggcgcagcaggttcaaggacatcgacatgcgcatccgcgtgcgcggcggggggaagacctcgcagatctacgccatccgccaggccatcgccaaggcgctcgtcgcctactaccagaagtacgtcgacgaggccgccaagaaggaggtcaaggacatcttcgcccgctacgaccgcacgctcctcgtagccgaccccaggcgctgcgagcccaagaagttcggtggacgtggtgcccgtgcaaggttccagaagtcctaccgttaagcggtgcgcaagctgtgggttgtactgccttcgtgccctatcatcaaatggaactgctcgtcttgttctgttatatctagttgttgctttatttcaaagtttagacacttaaatcctactagttcgtacctttttgacattgtgatatgaatgggatgagatgctgaagactactgggtagtctgtggaatatggttttgtgtgttacctac

SEQ ID NO: 2016 - DNA, 769 bp, Festuca arundinacea
gcggccgaggtcccaaaaccctcacccgcgccgccgcgccgccttaaccaagccgccggagcaaccatgtccgtcctctcccgcccggccccgggcaccgtgcagtgcttcggccggaagaagaccgcggtcgcggtggcctactgcaagccgggccgcgggctgatcaaggtcgacggcgtgcccatcgagctcatccgccccgagatgctgcggctcaaggccttcgagcccatcctgctcgccggcaggtcccgcttcaaggagatcgacatgcggatccgcgtccgcggcgggggccacaccagccagatctactccatccgccaggccatcgccaagtcgctcgtcgcctactgccagaagtacgtcgacgaggccaccaagaaggaggtcaaggagatcttcgcccgctacgaccgcaccctcctcgtcgccgacccgcgccgctgcgagcccaagaagttcggaggccgtggtgcccgctcgcgtttccagaagtcgtaccgttaatttttttgtactacctatctactatccaggagtttggcccaagtagtggcgcatcttttggacaactatgaataggatatgatgttcttcaagaatcgtgagttgcatatgcaatattgttttgctttgtgcctagaaggcgggattgttttagtatttgaaaatcatgttaatgatgagactgactgtcctgttaagtttccttcattgtctcgacatgtttatgattaattgtcactaaaaaaaaacctgcccg

SEQ ID NO: 2017 - DNA, 3446 bp, Triticum aestivum
cgtctcacggatcgggagcgccgccgcttccccacctcgtctctcggcgaacccccaaggaactatattcccagtgtgatatccaaaaccagtcaagatggtgaagtttacagcggaggagctccgcggaattatggacaagaaaaataatattcgtaacatgtctgttattgctcatgtcgaccacggcaagtctacgcttacggattcccttgtggcagctgctgggattatcgcccaggaagttgctggggatgttcgcatgactgatacccgtgcagatgaggcagagcgtggtattacaatcaaatccacgggtatctctcttttctatcagatgactcctgaatcactcgagatgtacaagggcgacagggatggtgatgagtacctgatcaaccttattgattcacctggccacgttgacttttcttcagaagtcacagctgctcttcgtatcactgatggtgccttggttgttgttgactgtattgagggtgtctgtgtgcagactgaaactgtgctgcgccaagctcttggtgagaggattaggcctgtccttactgtgaacaagatggacagatgctttcttgagcttcagtttgaaggtgaggaagcataccagactttctcccgtgtcattgaaaatgccaatgtcatcatggcaacatatgaagatgtgctccttggtgatgtccaagtgtacccagagaagggtactgttgcattctctgctggtttgcatggatgggctttcacccttacaaactttgctaagatgtatgcctccaagtttggtgttgatgaggtgaagatgatggagaggctgtggggtgagaacttctttgacccagccacaaagaaatggacctccaagaacactggcacagctacctgcaagagaggttttgttcagttctgctacgagccaatcaagcaaatcatagccacctgcatgaatgatcagaaggataagttgtggcctatgttgaagaagcttggtgtgacgatgaagaatgatgagaaggacttgatgggcaaggctctcatgaagcgtgtgatgcaaacttggctgcctgccagtcgtgctctgcttgagatgatgatatttcacctcccctctccctcgaaggcacagaggtatcgtgtggagaacttgtacgagggtccccttgatgatatatatgctaatgctatcagaaactgcgaccctgatggtcctcttatgctgtatgtctccaagatgattccagcatctgacaagggtagattctttgcctttggacgcgtttttgccgggagggtcgcaactggcatgaaggtccgtatcatgggtcccaactttgttcctggccagaagaaggatctatatgtgaagagtgtccagcggactgttatctggatgggaaagaagcaagagtctgttgaggatgttccctgtggtaacactgttgctttggttggtttggatcagttcatcaccaagaatgcaaccctgacaaatgagaaggaagttgatgcctgcccaatcagggctatgaagttctctgtgtcccctgttgtgcgtgttgccgttcagtgcaaggtggcatctgatcttcctaagcttgttgagggtttgaagcgtctggccaagtctgatcctatggttctctgtaccattgaagagtctggtgagcatatcattgctggagctggagagcttcatcttgaaatctgtctgaaggatctgcaggatgacttcatgggtggtgctgaaattattgtttcccctcctgttgtttccttccgtgagactgttctggagaagtcctgccgcactgtcatgagcaagtcccccaacaagcataaccgtctttacatggaagctcgcccattggaggagggattggctgaggctatcgatgatggccgcattggcccgcgtgatgatcccaaggtgcggtccaagatcctatctgaggagtttggttgggacaaggatctcgccaagaagatttggtgctttggacctgagacgactggccccaacatggttgttgacatgtgtaagggagtgcagtatctgaatgaaatcaaggactctgttgtggctgggttccagtgggcatcaaaagagggagcattgtgtgaggagaacatgcgtggcatctgctacgaggtctgtgatgttgttctccacactgatgctattcacaggggtggtggtcaggttatcccaacggcgaggagggtcatttacgcttctcagctcaccgccaagccaaggctgctggagcccgtgtacctggttgagatccaggcccccgagaacgcacttggtggtatctatggtgtgctgaatcagaagagaggccacgtgttcgaggagatgcagaggcaaggtaccccactgtacaacatcaaggcctacctgcctgtcatcgagtccttcgggttctcgagcaccctgagggctgcgacgtccggccaggccttcccccagtgtgtgtttgaccactgggacatcatggcctccgatcctttggaccctggcacccagtcggcgacgctcgtgacggagatccgcaagaggaagggtctcaaggagcagatgactcccctatccgatttcgaggacaagctctaaatcttggggtcatgttttggtactggctcttgctgtgaagggaggcgcggtatttttctccctatgtgtcttccttactatcttgttgtttgtatgtggtgctactgagactatggttttgatgacggttgtggtgatgtaacagatgttaaaactttgatgatctatccgtcgtcagctggtggttatttttactgtgctgtgtttgcttttgtgctacatcttgctttcatttacgtatatttgattgtcgacccctcgtgccgaattcggcacgaggggcggattgggcggcccagatggaggtggacgaccgcgtggcgaaatccgggccgttgtagcgcgggcaggagatttaattttgctcttgggttgggtttggtttgtgatcgcttctgctgcttgttgttgccgtgctctaggcttagtaaatccgtgtgtgtttgtgtgtatatactgatagtattaattaggacaacacatttgtgggatcatgatatgggtttgaaaatcagacaaaattttgctagtttcctcatctgctttggctcgtttctgaattgttgcaacttcacatgttctttgacaatgtagtcctgacgtcttgtggaaatttgatgaaaatttcagaccaaatcttgaactacattatcttcgacacccaaccacttcttcttgactagaagctccagcacgctagtcttgaggagtaacgatcgaccgtcgagtcgggcagtcggacctacgacttcgtacccaaaggacctacgttccttacttacttacgtacggtccggagggtacccacaccgtaagg

SEQ ID NO: 2018 - DNA, 2978 bp, Triticum aestivum
aaagcagtcaagatggtgaagttcacagcggaggagctccgtggaattatggataaaaagaataatattcgtaacatgtctgttattgctcatgtcgaccacggcaagtctacgcttacggattcccttgtggcagctgctgggattatcgcccaggaagttgctggtgatgttcggatgaccgatacccgtgcagatgaggcagaacgtggtattacaatcaaatccacgggtatctcccttttctatcagatgactcctgaatcacttgagatgtacaagggcgacagggatggtgatgagtaccttatcaaccttattgattcacctggccacgttgacttttcttcggaagtcacagctgctcttcgtatcactgatggtgctttggtggttgttgactgcattgagggtgtctgtgtgcagactgaaactgtgctgcgccaagctcttggtgagaggattaggcctgttcttactgtgaacaagatggacagatgcttccttgagcttcagtttgaaggtgaggaagcatatcagactttctcccgtgtcatcgaaaatgccaatgtcatcatggcaacatatgaagatgtgctccttggtgatgtccaagtgtacccagagaagggtactgttgcattctctgctggtttgcatgggtgggctttcacccttacaaactttgctaagatgtatgcctccaagtttggtgttgatgaggtgaagatgatggagaggctgtggggtgagaacttctttgacccagccacaaagaaatggacctccaagaacactgggacagctacctgcaagagaggtttcgttcagttctgctatgagccaatcaagcaaatcatagcaacctgcatgaatgaccagaaggataagttgtggcctatgttgaagaagcttggtgtgaccatgaagaatgatgagaaggacttgatgggcaaggctctcatgaagcgtgtgatgcaaacttggctgcctgccagtcgtgctctgcttgagatgatgatatttcacctcccctctccttcaaaggcacagaggtatcgtgtggagaacttgtacgagggcccccttgatgacatatatgcaaatgccatcagaaactgtgaccctgaaggtcctcttatgctgtatgtctccaagatgattccagcatctgacaagggtagattctttgcctttggacgtgttttcgccgggagggtcgcaactggcatgaaggtccgtatcatgggtcccaactttgttcctggccagaagaaggatctatatgtgaagagtgtccagcggactgttatctggatgggaaagaagcaagagtctgttgaggatgttccctgtggtaacaccgttgctttggttggtttggatcagttcatcaccaagaatgcaaccctgacaaacgagaaggaagttgatgcctgcccaatcagggcaatgaagttctctgtgtcccctgttgtacgtgttgctgttcagtgcaaggtggcttctgatcttcctaagcttgttgagggtttgaagcgtctggccaagtctgatcctatggttctctgtaccattgaagagtctggtgagcatatcatcgctggagccggagagcttcatcttgaaatctgcttgaaggatctgcaggatgacttcatgggtggtgctgaaatcattgtttccccccctgtcgtctccttccgtgagactgttctggagaagtcctgccgtaccgttatgagcaagtcccccaacaagcataaccgtctttacatggaagctcgcccattggaggagggattggctgaggctattgatgatggccgcattggcccgcgtgatgatcctaaggtgcgctccaagatcctgtctgaggagtttggttgggacaaggatctcgccaagaagatttggtgctttggacctgagacgactggccccaacatggttgtggacatgtgtaagggagtgcagtacctgaatgaaatcaaggactctgttgtggctgggttccagtgggcatcaaaagaaggagcactatgtgaggagaacatgcgcggcatctgctatgaggtctgtgatgttgttctccacactgatgctattcacaggggtggtggtcaggtcatcccaacggcgaggagggtcatttacgcttctcagctcactgccaagccaaggctgctggagcccgtgtacctggttgagatccaggccccggagaacgcacttggtggtatctatggtgtgctgaatcagaagagagggcacgtgttcgaggagatgcagaggcaaggtaccccactctacaacatcaaggcctacctgcccgtcatcgagtccttcgggttctcgagcaccctgagggccgcgacgtccggccaggccttcccccagtgcgtgtttgaccactgggacatcatggcctccgatcctttggaccccggcacccagtcggcgacgctcgtgacggagatccgcaagaggaagggtctcaaggagcagatgacccccctatccgatttcgaggacaagctctaaactttgggtcatgttttgctgctggctgttgctgtgaagggaggcgcggtatttttctccctatgtgtcttccttactatcttgttgtttgtatgtggtgctactgagactgtggttttgatgatggttgtggtgatgtaacagatgttaaacttagatgatatatttctggcatcccacggtggttatttttactgtgctgtgtttgcttttgtgcaagatcttgctttcatttacatatatacgtatttgattgttgtgctagcaattgtgcgtgttgtaatgtttgtgagttccagccatggttgtataatctcttgagctgattttcctttgctccttgttgcatgttgttatgatgatttccaccagccccttgtgttcttccccggccactgtctattagctgctctgtacctgagcagtatcgtttg

SEQ ID NO: 2019 - DNA, 2814 bp, Secale cereale
ggagcgccgccgctcctcatctcccacctctcgggctcgggagccggaagcgaaaccccaaggaactacccagcgtgacattcaaaagcagtcaagatggtgaagttcacagcagaggagctccgtggaattatggataaaaagaacaatatcaggaacatgtctgttattgcgcatgttgaccatggcaagtctacccttacggattcccttgtggcagctgctggaattatcgcccaggaagttgctggtgatgtccgcatgactgatacacgtgcagatgaagcagaacgtggtattactatcaaatccacgggtatctctctgttctatcagatgactcctgaatcacttgagatgtacaagggtgacagagatggggatgagtacctgatcaaccttattgattcacctggtcacgttgacttttcttcggaagtcacagctgctcttcgtatcaccgatggtgctttggtggtggttgactgtattgagggtgtctgtgtgcagactgaaactgtgctgcgccaagctcttggtgagaggattaggcctgttcttactgtgaacaagatggacagatgcttccttgagcttcaagtggaaggtgaggaagcataccagactttctcccgtgtcatcgaaaatgccaatgtcatcatggcaacatatgaagatgtgctccttggtgatgtccaagtgtacccagagaaggggactgttgcattctctgctggtttgcatgggtgggctttcacccttacaaactttgctaagatgtatgcctccaagtttggagttgatgaggcgaagatgatggagaggctgtggggtgagaacttttttgacccagccacaaagaaatggacctccaagaacactgggacagctacctgcaagagaggttttgttcagttctgctacgagccaatcaagcaaatcatagcaacctgcatgaatgatcagaaggataagttgtggcctatgttgaagaagcttggtgtgacgatgaagaatgatgagaaggacttgatgggcaaggctctcatgaagcgtgtgatgcaaacttggctgcctgccagtcgtgctctgcttgagatgatgatatttcacctcccctctccttcaaaggcacagaggtatcgtgtggagaacttgtatgaggggcctcttgacgatatatatgcaaatgctatcagaaactgtgaccctgacggtcctcttatgctgtatgtctccaagatgattccagcatctgacaagggtagattctttgcctttggacgtggtttttgccgggagggttgcaactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcaccaagaacgcaaccctgacaaatgagaaggaagttgatgcctgcccaatcagggcaatgaagttctctgtgtcccctgttgtgcgtgttgctgttcagtgcaaggtggcttctgatcttcctaagcttgttgagggtttgaagcgtctggccaagtctgatcctatggttctctgtaccattgaagagtctggtgagcatatcattgctggagctggagagcttcaccttgaaatctgcttgaaggatctgcaggatgacttcatgggtggtgctgaaatcattgtttcccctcctgtcgtctccttccgtgagactgttcttgagaagtcctgccgcactgtcatgagcaagtcccccaacaagcataaccgtctttacatggaggctcgcccacttgaggagggattggctgaggctattgatgatggccgcattggcccgcgtgatgatcccaaggtgcgctccaagatcctatctgaggagtttggttgggacaaggacctcgccaagaagatttggtgctttggacctgagacgactggccccaacatggttgttgacatgtgtaagggagtgcagtatctgaatgaaatcaaggactctgttgtggctgggttccagtgggcatcaaaagaaggagcattgtgcgaggagaacatgcgtggtatctgctatgaggtttgtgatgttgttctccacactgatgctattcacaggggtggtggtcaggttatcccaacggcgaggagggtcatttacgcttctcagctcactgccaagccaaggctgctggagccagtctacctggttgagatccaggccccggagaacgcacttggtggtatctatggtgttctcaatcagaagagagggcacgtgttcgaggagatgcagaggcaaggtaccccactctacaacatcaaggcctacctgcctgtcatcgagtccttcgggttctcgagcaccctgagggcggcgacgtccggccaggccttcccccagtgcgtgttcgaccactgggacatcatggcttccgaccctctggaccccggcacccagtcggcgacgctggtgacggagatccgcaagaggaagggtctcaaggagcagatgacccccctatccgatttcgaggacaagctctaaattttgggggtcatgttttgctgctggctcttgctgtgaagggaggcgcggtatttttctccctatgtgtcttccttactatcttgttgtttgtatgttggtgcctactgagactatggttttgatgacggtcgtggtgatgtaacagatgttaaacttagatgatatatccgtcgtcagctggt

SEQ ID NO: 2020 - DNA, 2797 bp, Secale cereale
tcgggctcgggagccggaagcgaaaccccaaggaactacccagcgtgacattcaaaagcagtcaagatggtgaagttcacagcagaggagctccgtggaattatggataaaaagaacaatatcaggaacatgtctgttattgcgcatgttgaccatggcaagtctacccttacggattcccttgtggcagctgctggaattatcgcccaggaagttgctggtgatgtccgcatgactgatacacgtgcagatgaagcagaacgtggtattactatcaaatccacgggtatctctctgttctatcagatgactcctgaatcacttgagatgtacaagggtgacagagatggggatgagtacctgatcaaccttattgattcacctggtcacgttgacttttcttcggaagtcacagctgctcttcgtatcaccgatggtgctttggtggtggttgactgtattgagggtgtctgtgtgcagactgaaactgtgctgcgccaagctcttggtgagaggattaggcctgttcttactgtgaacaagatggacagatgcttccttgagcttcaagtggaaggtgaggaagcataccagactttctcccgtgtcatcgaaaatgccaatgtcatcatggcaacatatgaagatgtgctccttggtgatgtccaagtgtacccagagaaggggactgttgcattctctgctggtttgcatgggtgggctttcacccttacaaactttgctaagatgtatgcctccaagtttggagttgatgaggcgaagatgatggagaggctgtggggtgagaacttttttgacccagccacaaagaaatggacctccaagaacactgggacagctacctgcaagagaggttttgttcagttctgctacgagccaatcaagcaaatcatcgccacctgcatgaatgatcagaaggataagttgtggcctatgttgaagaagcttggtgtgaccatgaagaatgatgagaaggacttgatgggcaaggctctcatgaagcgtgtgatgcaaacttggctgcctgccagtcgtgctctgcttgagatgatgatatttcacctcccctctccttcaaaggcacagaggtatcgtgtggagaacttatatgagggtccccttgatgacgtatatgcaaatgctatcagaaactgtgaccctgatggtcctcttatgctgtatgtctccaagatgattccagcatctgacaagggtagattctttgcctttggacgtgtttttgccgggagggttgcaactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcaccaagaacgcaaccctgacaaatgagaaggaagttgatgcctgcccaatcagggcaatgaagttctctgtgtcccctgttgtgcgtgttgctgttcagtgcaaggtggcttctgatcttcctaagcttgttgagggtttgaagcgtctggccaagtctgatcctatggttctctgtaccatcgaagagtctggtgagcatatcattgctggagctggagagcttcaccttgaaatctgcttgaaggatctgcaggatgacttcatgggtggtgctgaaatcattgtttcccctcctgtcgtctccttccgtgagactgttctggagaagtcctgccgcactgtcatgagcaagtcccccaacaagcataaccgtctttacatggaggctcgcccacttgaggagggattggctgaggctattgatgatggccgcattggcccgcgtgatgatcccaaggtgcgctccaagatcctatctgaggagtttggttgggacaaggacctcgccaagaagatttggtgctttggacctgagacgactggccccaacatggttgttgacatgtgtaagggagtgcagtatctgaatgaaatcaaggactctgttgtggctgggttccagtgggcatcaaaggaaggagcattgtgtgaggagaacatgcgtggtatctgctatgaggtttgtgatgttgttctccacactgatgctattcacaggggtggtggtcaggttatcccaacggcgaggagggtcatttacgcttctcagctcactgccaagccaaggctgctggagccagtctacctggttgagatccaggccccggagaacgcacttggtggtatctatggtgttctcaatcagaagagagggcacgtgttcgaggagatgcagaggcaaggtaccccactctacaacatcaaggcctacctgcctgtcatcgagtccttcgggttctcgagcaccctgagggcggcgacgtccggccaggccttcccccagtgcgtgttcgaccactgggacatcatggcttccgaccctctggaccccggcacccagtcggcgacgctggtgacggagatccgcaagaggaagggtctcaaggagcagatgactcccctatccgatttcgaggacaagctctaaattttgggggtcatgttttgctgctggctcttgctgtgaagggaggcgcggtatttttctccctatgtgtcttccttactatcttgttgtttgtatgttggtgctactgagactatggttttgatgacggtcctggtgatgtaacagatgttaaacttagatgatatatccgtcgtcagctggtggttatttttattgt

SEQ ID NO: 2021 - DNA, 2866 bp, Triticum aestivum
cattctcacggatcgggagcgccgccgcttccccacctctcgtctctcggcgaacccccaaggaactatattcccagcgtgatatccaaaaccagtcaagatggtgaagtttactgcggaggagctccgcggaattatggacaagaaaaataatattcgtaacatgtctgttattgctcatgtcgaccacggcaagtctacgcttacggattcccttgtggcagctgctgggattatcgcccaggaagttgctggggatgttcgcatgaccgatacccgtgcagatgaggcagagcgtggtattacaatcaaatccacgggtatctctcttttctatcagatgactcctgaatcacttgagatgtacaagggcgacagggatggagatgaatacctgatcaaccttattgattcacctggccacgttgacttttcttcggaagtcacagctgctcttcgtatcactgatggtgctttggtggttgttgactgtattgagggtgtctgtgtgcagaccgaaactgtgctgcgccaagctcttggtgagaggattaggcccgtcctcaccgtgaacaagatggacagatgcttccttgagcttcagtttgaaggtgaggaagcatatcagactttctcccgtgtcatcgaaaatgccaatgtcatcatggcaacatatgaagatgtgctccttggtgatgtccaagtgtacccagaaaaggggactgttgcattctctgctggtttgcatgggtgggctttcacccttacaaactttgctaagatgtatgcctccaagtttggtgttgatgaggtgaagatgatggagaggctgtggggtgagaacttctttgacccagccacaaagaaatggaccaccaagaacactgggacagctacctgcaagagaggttttgttcagttctgctatgagccaatcaagcaaatcatcgccacctgcatgaatgatcagaaggataagttgtggcctatgttgaagaagcttggtgtgaccatgaagaatgatgagaaggacttgatgggaaaggctctcatgaagcgtgtgatgcagacttggctgcctgccagtcgtgctctgcttgagatgatgatatttcacctcccctctccttcaaaggcacagaggtatcgtgtggagaacttatacgagggcccccttgatgatgtatatgcaaatgctatcagaaactgtgaccctgacggtcctcttatgctgtatgtctccaagatgattccagcatctgacaagggtagattctttgcctttggacgtgtttttgccgggagggttgcaactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcaccaagaatgcaaccctgacaaatgagaaggaagttgatgcctgcccaatcagggcaatgaagttctctgtgtcccctgttgtgcgtgttgctgttcagtgcaaggtggcttctgatcttcctaagcttgttgagggtttgaagcgtctggccaagtctgatcctatggttctctgtaccattgaagagtctggtgagcatatcattgctggagctggagagcttcaccttgaaatctgtctgaaggatctgcaggatgacttcatgggtggtgctgaaattattgtttcccctcctgttgtctccttccgtgagactgttctggagaagtcctgccgtaccgttatgagcaagtcccccaacaagcacaaccgtctttacatggaagctcgcccgttggaggagggattggctgaggctatcgatgatggccgcattggcccgcgtgatgatcctaaggtgcgctccaagatcctgtctgaggagtttgggtgggacaaggatctcgccaagaagatttggtgctttggacctgagacgactggccccaacatggttgttgacatgtgtaagggagtgcagtatctgaatgaaatcaaggactctgttgtggctgggttccagtgggcatcaaaagaaggagcattgtgtgaggagaacatgcgtggtatctgctatgaggtctgtgatgttgttctccacactgatgctattcacaggggtggtggtcaggttatcccaacggcgaggagggtcatttacgcttctcagctcactgccaagccaaggctgctggagcccgtgtacctggttgagatccaggccccggagaacgcacttggtggtatctatggtgtgctgaatcagaagagaggccacgtgttcgaggagatgcagaggcaaggtaccccactctacaacatcaaggcctacctgcctgttatcgagtccttcgggttctcgagcaccctgagggccgcgacgtccggccaggccttcccccagtgtgtgtttgaccactgggacgtcatggcctccgatcctttggaccctggcacccagtcggcgacgctcgtgacggagatccgcaagaggaagggtctcaaggagcagatgacccccctatccgacttcgaggacaagctctaaattttggggcttcgaggacaagctctaaattttggggccatgttttggtactggctcttgctgtgaagggaggcgcggtatttttctccctatgtgtcttccttactatgttgttgtttgtatgtggtgctactgagactatggttttgatgatggttgtggtgatgtaacagatgttaaacttagatcatacatttctggcatcccatggtggtttatttttactgtgctgtg

SEQ ID NO: 2022 - DNA, 2821 bp, Triticum aestivum
gctcacttccttgaaccctttccattctcacggatcgggagcgccgccgcttccccacctctcatctctcggcgaacccgcaaggaactatattcccagtgtgatatccaaaaccagtcaagatggtgaagtttacagcggaggagctccgcggaattatggacaagaaaaataatattcgtaacatgtctgttattgctcatgtcgaccacggcaagtctacgcttacggattcccttgtggcagctgctgggattatcgcccaggaagttgctggggatgttcgcatgactgatacccgtgcagatgaggcagagcgtggtattacaatcaaatccacgggtatctctcttttctatcagatgactcctgaatcacttgagatgtacaagggcgacagggatggagatgaatacctgatcaaccttattgattcacctggccacgttgacttttcttcggaagtcacagctgctcttcgtatcactgatggtgctttggtggttgttgactgcattgagggtgtctgtgtgcagactgaaactgtgctgcgccaagctcttggtgagaggattaggcctgttcttactgtgaacaagatggacagatgcttccttgagcttcagtttgaaggtgaggaagcatatcagactttctcccgtgtcatcgaaaatgccaatgtcatcatggcaacatatgaagatgtgctccttggtgatgtccaagtgtacccagagaagggtactgttgcattctctgctggtttgcatgggtgggctttcacccttacaaactttgctaagatgtatgcctccaagtttggagttgacgaggcaaagatgatggagaggctgtggggtgagaacttctttgacccagccacaaagaaatggacctccaagaacactgggacagctacctgcaagagaggttttgttcagttctgctatgagccaatcaagcaaatcatagccacctgcatgaatgatcagaaggataagttgtggcctatgttgaagaagcttggtgtgaccatgaagaatgatgagaaggacttgatgggcaaggctctcatgaagcgtgtgatgcaaacttggctgcctgccagtcgtgctctgcttgagatgatgatatttcacctcccctctccttcaaaggcccagaggtatcgtgtggagaacttatatgagggcccccttgatgacatatatgcaaatgctatcagaaactgtgaccctgatggtcctcttatgctgtatgtctccaagatgattccagcatctgacaagggtagattctttgcctttggacgtgttttcgctgggagggttgccactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgcgttggttggtttggatcagttcatcacaaagaatgcaaccctgacaaatgagaaggaagttgatgcctgcccaatcagggcaatgaagttctctgtgtcccctgttgtgcgtgttgctgttcagtgcaaggtggcctctgatcttcccaagcttgttgaaggtttgaagcgtctggcaaagtctgatcctatggttctctgtaccattgaagagtctggtgagcatatcattgctggagctggagagcttcaccttgaaatctgtttgaaggatctgcaggatgacttcatgggtggtgctgaaattattgtttcccctcctgtcgtctccttccgtgagactgttctggagaagtcctgccgcactgtcatgagcaagtccccgaacaagcacaaccgtctttacatggaagctcgccccttggaggagggactggctgaggccattgatgacgggcgcattggcccgcgtgacgatcctaaggtgcgttccaagatcctgtctgaggagtttggctgggacaaggatcttgccaagaagatttggtgctttggacctgagacgactggacccaacatggtcgttgacatgtgtaagggagtgcagtatctcaatgaaatcaaggactctgttgtggctgggttccagtgggcgtcaaaggaaggcgcgttggctgaggagaacatgcgtggcatttgctttgaggtctgtgatgttgttctccacactgatgctattcacaggggtggtggtcaggtcattcccacggccaggagggtcatttatgcttcccagctcactgccaagccaaggctgctggagcctgtgtacctggttgagatccaggccccggagaatgcacttggtggcatctatggtgttctgaatcagaagagagggcacgtgttcgaggagatgcagaggcaaggtaccccgctctacaacatcaaggcctacctccctgtcatcgagtcctttgggttctcaagcaccctgagggccgcgacgtccggccaggcattcccccagtgtgtgtttgaccactgggacatcatggcttctgatcctttggaccctggcacccagtcggcgacgctcgtcacggacatccgcaagaggaagggcctcaaggagcagatgacccctctgtccgatttcgaggacaagctctaaatttttggtgctgttatcccatacctgctattgtgttgttaaagagagctgcactattttgtatcgatgagtctatcttactgtcttgctgttaatgacctatttgtcgtgatactgggaactatgttttgatgtctggtgatgtaacggatgttttacttagatta

SEQ ID NO: 2023 - DNA, 3017 bp, Triticum aestivum
ctcccattctctccgggagcgccgccgcttcctcatcccccagactctcgcctctcggctcgggaggcggaagcgaaaccccaaggaactatattcctgccgtgacattcaaacacagtcaagatggtgaagtttacagcggaggagctccgcggaatcatggacaagaagaacaatatcagaaacatgtctgttattgcccatgttgatcacggcaagtctacccttacggattcccttgtggcagctgctgggattattgcccaggaagttgctggtgatgttcggatgaccgatacccgtgcagatgaggcagagcgtggtatcacaatcaaatccacgggtatctctcttttctatcagatgactcctgaatcactcgagatgtacaagggcgatcgcgatggggacgaatacctgatcaaccttattgattcacctggccacgttgacttttcttcggaggtcacagctgctcttcgtatcactgatggagctttggtggttgttgactgtattgagggtgtctgtgtgcagactgaaactgtgctgcgccaagctcttggtgagaggattaggccagtccttactgtgaacaagatggacagatgcttccttgagcttcaggtggaaggtgaggaagcatatcagactttctcccgtgttatcgagaatgccaatgtcatcatggcaacatatgaagatgtgctccttggtgatgtccaagtgtacccagaaaaggggactgttgcattctctgctggtctgcatgggtgggctttcacccttacaaactttgctaagatgtatgcctccaagtttggagttgatgaggcaaagatgatggagaggctgtggggtgagaacttctttgacccagccacaaagaaatggacctccaagaacactgggacagctacctgcaagagaggtttcgttcagttctgctatgagccaatcaagcaaatcatagccacctgcatgaatgaccagaaggataagttgtggcctatgttgaagaagcttggagtgaccatgaagaatgacgagaaggacttgatgggcaaggctctcatgaagcgtgtgatgcaaacttggctgcctgccagtcgtgctctgcttgagatgatgatatttcacctcccctctccttcaaaggcccagaggtatcgtgtggagaacttatacgagggcccccttgatgacatatatgcaaatgctatcagaaactgtgaccctgatggtcctcttatgctgtatgtctccaagatgattccagcatctgacaagggtagattctttgcctttggacgtgtttttgccgggagggttgcaactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcacaaagaatgcaaccctgacaaatgagaaggaagttgatgcctgcccaatcagggcaatgaagttctctgtgtcccctgttgtgcgtgttgctgttcagtgcaaggtggcctctgatcttcccaagcttgttgagggtttgaagcgtctggcaaagtctgaccctatggttctctgtaccattgaagagtctggtgaacatatcattgctggagctggagagcttcaccttgaaatctgtttgaaggatctgcaggatgacttcatgggtggtgctgaaatcattgtttcccctcctgtcgtctccttccgtgagactgttctagagaagtcctgccgtacagtcatgagcaagtccccgaacaagcacaaccgtctttacatggaagctcgccccttggaggagggactggctgaggccattgatgatgggcgcattggcccacgtgacgatcctaaggtgcggtctaagatcctgtctgaggagtttggctgggacaaggatcttgccaagaagatttggtgctttggacctgagacgactggccccaacatggttgttgacatgtgtaagggagtgcagtatcttaatgaaatcaaggactctgttgtggctgggttccagtgggcgtcgaaggaaggtgcactggctgaggagaacatgcgtggcatctgcttcgaggtctgtgatgttgttctccacactgatgctattcacaggggtggtggtcaggtcattcccacggccaggagggtcatttatgcttctcagctgactgccaagccaaggctgctggagcctgtgtacctggttgaaatccaggccccggagaatgcgcttggtggcatctatggtgttctgaatcagaagagagggcacgtgttcgaggagatgcagaggcaaggtaccccgctctacaacatcaaggcctacctccccgtcatcgagtcctttgggttctcaagcaccctgagggctgcgacgtccggccaggccttcccccagtgtgtgtttgaccactgggacatcatggcttccgatcctttggaccccggcacccagtctgcgacgctcgtcacggagatccgcaagaggaaggggctcaaggagcagatgacccctctatccgatttcgaagacaagctctaaatttttggtgctgttatcccttacctggtcttgtgttgttaaagagagccgcactattttgtatcgatgagtcttgctgttaatgacctatttgtcgtgatactgggaactatgttttgagatgtctggtgatgtaacggatgttttacttagattatgtatctgttgtccactggttcttttgctcttgtgtttgatctttagatttgcctgattcttcgtcgatataatcttgctttctcatgaaaaagttgcatcttctgatcagtggtcactattctcgttcgttgacagttaagaaactgttttgtttgcattatttttgcctgctcttattattatttccttgtgcactagcctcc

SEQ ID NO: 2024 - DNA, 2701 bp, Triticum aestivum
cgaaaccccaaggaaccatatttccagcgtgacattcaaacacagtcaagatggtgaagtttacagcggaggagctccgtggaatcatggacaaaaagaacaatatccggaacatgtcggttattgctcatgtagaccacggcaagtctacgcttacggattcccttgtggcagcagctgggattattgcccaggaagtagctggtgatgttcgcatgaccgatacccgtgcagatgaggcagagcgtggtatcacaatcaaatccacgggtatctctcttttctatcagatgactcctgaatcactcgagatgtacaagggcgacagggatggggatgaatacctgatcaaccttattgattcacctggccacgttgacttttcttcggaagtcacagctgctcttcgtatcaccgatggagctttggtggttgttgactgtattgagggtgtctgtgtgcagactgaaactgtgctgcgccaagctcttggtgagaggattaggcctgtcctcaccgtgaacaagatggacagatgcttccttgagcttcaggtggaaggtgaggaagcatatcagactttctcccgtgtcattgaaaatgccaatgtcatcatggcaacatatgaagatgtgctccttggtgatgtccaagtgtacccagaaaaggggactgttgcattctctgctggtttgcatgggtgggctttcacccttacaaactttgctaagatgtatgcctccaagtttggagttgatgaggcaaagatgatggagaggctgtggggtgagaacttctttgacccagccacaaagaaatggacctccaagaacactgggacagctacctgcaagagaggtttcgttcagttctgctatgagccaatcaagcaaatcatagccacctgcatgaatgatcagaaggataagttgtggcctatgttgaagaagcttggagtgaccatgaagaatgatgagaaggacttgatgggcaaggctctcatgaagcgtgtgatgcaaacttggctgcctgccagtcgtgctctgcttgagatgatgatatttcacctcccctctccttcaaaggcccagaggtaccgtgtggagaacttatacgagggcccccttgatgacatatatgcaaatgctatcagaaactgtgaccctgatggtcctcttatgctgtatgtctccaagatgattccagcatctgacaagggtagattctttgcctttggacgtgtttttgccgggagggttgcaactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcacaaagaatgcaaccctgacaaatgagaaggaagttgatgcctgcccaatcagggcaatgaagttctctgtgtcccctgttgtgcgtgttgctgttcagtgcaaggtggcctctgatcttcccaagcttgttgagggtttgaagcgtctggcaaagtcagatcctatggttctctgtaccattgaggagtctggtgagcatatcattgctggagctggagagcttcaccttgaaatctgtttgaaggatcttcaggatgacttcatgggtggtgctgaaatcattgtttcccctcccgttgtctccttccgtgagactgttctggagaagtcctgccgtactgtcatgagcaagtccccgaacaagcacaaccgtctttacatggaagctcgccccttggaggagggactggctgaggccattgatgatggtcgcattggcccacgtgatgatcctaaggtgcggtccaagatcctgtctgaggagtttgggtgggacaaggatcttgccaagaagatttggtgctttggacctgagacgactggccccaacatggtcgtcgacatgtgtaagggagtgcagtatcttaatgaaatcaaggactctgttgtggctggtttccagtgggcgtcaaaggaaggcgcgttggctgaggagaacatgcgtggcatttgctttgaggtctgtgatgttgttctccacactgatgctatccacaggggtggtggtcaggtcattcccacggccaggagggtcatttatgcttctcagctgactgccaagccaaggctgctggagcctgtgtacctggttgagatccaggccccggagaatgcgcttggtggtatctatggtgttctgaatcagaagagagggcacgtgttcgaggagatgcagaggcaaggtaccccgctctacaacatcaaggcctacctccccgtcattgaatcctttgggttctcaagcaccctgagggccgcgacgtccggccaggccttcccccagtgtgtgtttgaccactgggacatcatggcttctgatcctttggacccaggcacccagtcggcgacgctcgtcacggatatccgcaagaggaagggcctcaaggagcagatgacccctctatccgatttcgaggacaagctctaaatttttggtgctgttatcccttacctggtcttgtgttgttaaagagagctgcactattttgtatcgatgagtcttgctgttatgacctacttgtcgtgatactgggaactatgttttga

SEQ ID NO: 2025 - DNA, 2933 bp, Triticum aestivum
acctccacccctcccattctctctgggagcgccgccgcttcctcatctctcagactctcgcctctcggctcgggaggcggaagcgaaaccccaaggaaccatatttgcagtgtgacattcaaacacagtcaagatggtgaagttcacagcggaggagctccgcggaatcatggacaaaaagaacaatatccgtaacatgtcggttattgctcatgtagaccatggcaagtctactcttacggattcccttgtggcagctgctgggattattgcccaggaagttgctggtgatgttcgcatgactgatacacgtgcagatgaggcagagcgcggtatcacaatcaaatccaccggtatctctcttttctatcagatgactcctgaatcactcgagatgtacaagggcgatcgcgatggggatgaatacctgatcaaccttattgattcacctggtcacgttgacttttcttcggaagtcacagctgctcttcgtatcactgatggagctttggtggttgttgactgtattgagggtgtgtgtgtgcagactgaaactgtgctgcgccaagctcttggtgagaggattaggccagtccttactgtgaacaagatggacagatgcttccttgagcttcaggtggaaggtgaggaagcatatcagactttctcccgtgttatcgaaaatgccaatgtcatcatggcaacatatgaagatgtgctccttggtgatgtccaagtgtacccagagaaggggactgttgcattctctgctggtctgcatgggtgggctttcacccttacaaactttgctaagatgtatgcctccaagtttggagttgacgaggcaaagatgatggagaggctgtggggtgagaacttctttgacccagccacaaagaaatggacctccaagaacactgggacagctacctgcaagagaggttttgttcagttctgctatgagccaatcaagcaaatcatagccacctgcatgaatgatcagaaggataagttgtggcctatgttgaagaagcttggtgtgaccatgaagaatgatgagaaggacttgatgggcaaggctctcatgaagcgtgtgatgcaaacttggctgcctgccagtcgtgctctgcttgagatgatgatatttcacctcccctctccttcaaaggcccagaggtatcgtgtggagaacttatacgagggcccccttgatgacatatatgcaaatgctatcagaaactgtgaccctgatggtcctcttatgctgtatgtctccaagatgattccagcatctgacaagggtagattctttgcctttggacgtgtttttgctgggagggttgccactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgcgttggttggtttggatcagttcatcacaaagaatgcaaccctgacaaatgagaaggaagttgatgcctgcccaatcagggcaatgaagttctctgtgtcccctgttgtgcgtgttgctgttcagtgcaaggtggcctctgatcttcccaagcttgttgaaggtttgaagcgtctggcaaagtctgatcctatggttctctgtaccattgaagagtctggtgagcatatcattgctggagctggagagcttcaccttgaaatctgtttgaaggatctgcaggatgacttcatgggtggtgctgaaattattgtttcccctcctgtcgtctccttccgtgagactgttctggagaagtcctgccgcactgtcatgagcaagtccccgaacaagcacaaccgtctttacatggaagctcgcccattggaggagggattggctgaggctattgatgatgggcgcattggcccgcgtgacgatcctaaggtgcgttccaagatcctgtctgaggagtttggctgggacaaggatcttgccaagaagatttggtgctttggacctgagacgactggacccaacatggtcgttgacatgtgtaagggagtgcagtatctcaatgaaatcaaggactctgttgtggctgggttccagtgggcgtcaaaggaaggcgcgttggctgaggagaacatgcgtggcatttgctttgaggtctgtgatgttgttctccacactgatgctattcacaggggtggtggtcaggtcattcccacggccaggagggtcatttatgcttcccagctcactgccaagccaaggctgctggagcctgtgtacctggttgagatccaggccctggagaatgcacttggtggcatctatggtgttctgaatcagaagagagggcacgtgttcgaggagatgcagaggcaaggtaccccgctctacaacatcaaggcctacctccctgtcatcgagtcctttgggttctcaagcaccctgagggccgcgacgtccggccaggcattcccccagtgtgtgtttgaccactgggacatcatggcttctgatcctttggaccctggcacccagtcggcgacgctcgtcacggacatccgcaagaggaagggcctcaaggagcagatgacccctctgtccgatttcgaggacaagctctaaatttttggtgctgttatcccatacctgctattgtgttgttaaagagagctgcactattttgtatcgatgagtctatcttactgtcttgctgttaatgacctatttgtcgtgatactgggaactatgttttgatgtctggtgatgtaacggatgttttacttagattatgtatctgttgtccactggttcttttgctctgggcttgatcttacatttgcctgtcacaatctcgctcgttggaactaagaaattttggttgattaaaaaa

SEQ ID NO: 2026 - DNA, 3229 bp, Triticum aestivum
ttcccatccagataacagtacatggggagggttcttccttcaccccttgttccattctcttcctccgggagcgccgccgcttcctcatctctcacctctcggctcgggagaccgaagcgaaaccccaaggaactatagtcccagtgtgacattcaaaagcagtcaagatggtgaagttcacagcggaggagctccgtggaattatggataaaaagaataatattcgcaacatgtctgttattgctcatgttgaccacggcaagtctacgcttacggattcccttgtggcagctgctgggattatcgcccaggaagttgctggtgatgttcgcatgactgatacccgtgcagatgaggcagaacgtggtattacaatcaaatccacgggtatctcccttttctatcagatgactcctgaatcacttgagatgtacaagggcgacagggatggtgatgagtaccttatcaaccttattgattcacctggccacgttgacttctcttcggaagtgacagctgctcttcgtatcactgatggtgctttggtggtggttgactgtattgagggtgtctgtgtgcagaccgaaactgtgctgcgccaagctcttggtgagaggattaggcctgtcctcaccgtgaacaagatggacagatgcttccttgagcttcaagtggaaggtgaggaagcataccagactttctcccgtgtcattgaaaatgccaatgtcatcatggcaacatatgaagatgtgctgcttggtgatgtccaagtgtacccggagaaggggactgttgcattctctgctggtttgcatgggtgggctttcacccttacaaacttcgccaagatgtatgcctccaagtttggagttgatgaggcaaagatgatggagaggctgtggggtgagaacttctttgacccagccacaaagaaatggacctccaagaacactgggacagctacctgcaagagaggtttcgttcagttctgctatgagccaatcaagcaaatcatagcaacctgcatgaatgaccagaaggataagttgtggcctatgttgaagaagcttggtgtgaccatgaagaacgatgagaaggacttgatgggcaaggctctcatgaagcgtgtgatgcaaacttggctgcctgccagtcgtgctctgcttgagatgatgatatttcatctcccttctccttcaaaggcacagaggtatcgtgtggagaacttatacgagggcccccttgatgatatatatgctaatgctatcagaaactgtgaccctgatggtcctcttatgctgtatgtctccaagatgatcccagcatctgacaagggtagattctttgcctttggacgtgttttcgctgggagggttgccactggcatgaaggtccgtatcatgggacctaactttgttcctggccagaagaaggatctgtatgtgaagagtgtccagcgtactgttatctggatgggaaagaagcaagagtctgttgaggatgttccctgtggtaacaccgttgctttggttggtttggatcagttcatcaccaagaatgcaaccctgacaaatgagaaggaagttgatgcctgcccaatcagggcaatgaagttctctgtgtcccctgttgtgcgtgttgctgttcagtgcaaggtggcttctgatcttcctaagcttgttgagggtttgaagcgtctggccaagtctgatcctatggttctctgtaccattgaagagtctggtgagcatatcatcgctggagccggagagcttcatcttgaaatctgcttgaaggatctgcaggatgacttcatgggtggtgctgaaatcattgtttccccccctgtcgtctccttccgtgagactgttctggagaagtcctgccgtaccgttatgagcaagtcccccaacaagcataaccgtctttacatggaagctcgcccattggaggagggattggctgaggctattgatgatggccgcattggcccgcgtgatgatcctaaggtgcgctccaagatcctgtctgaggagtttggttgggacaaggatctcgccaagaagatttggtgctttggacctgagacgactggccccaacatggttgtggacatgtgtaagggagtgcagtatctgaatgaaatcaaggactctgttgtggcagggttccagtgggcatcgaaagaaggtgctctggctgaggagaacatgcgtggcatttgctttgaggtctgtgatgttgttctgcacactgatgctattcacaggggtggtggtcaggtcatcccaacagccaggagggtcatttacgcttctcagctcactgctaagccaaggctgctggagcctgtgtacctggttgagatccaggccccggagaatgcactcggtggtatctatggtgttctgaatcagaagagagggcatgtgtttgaggagatgcagaggcctggtaccccgctgtacaacatcaaggcttacctcccggtcatcgagtcgttcgggttctcaagtaccctcagggcggcgacatccggccaggctttcccccagtgtgtgttcgaccattgggacatcatgtcttctgatcctttggaggccggctcccagtctgccacacttgtcacggagatccgcaagcgcaagggcctgaaggaacagatgacccctctatctgatttcgaggacaagctctgaacttttgcttctgttacatggtctagtttgcttttgctgctaagagagctgcactattatctgtctattgagtcgtcgctgtactgctattgggattcctatcggtcgtgatactggcactttgttttgatgtctgtcgatgttaaaacttagattatatatctgtcgtgatactggcacttcgttttgatgtctgtcgatgttaaagcttagattatacaagtatctgttatccattggtagttcttgttggcgtcttgtgtttgcttttgtgttgatcttgagagctctgcctggttctttattgctccagtcttgctctatatttttcatgatcttgagagctctgcttgcagtttttcgatctcattttaccttcctgatttgatgaccatcaaaatgtgttccatcttttggcagttgtaatctatgctcaaaaacttactgcacttgtttatgctgcagtttgtatacagtacacaattctccatttcatgccctacaattttgtggacacactgatgatgaga

SEQ ID NO: 2027 - DNA, 2849 bp, Triticum aestivum
cttcctcatctcatcctcccggatcgggaggcggaagccaagccccaaggaacttaaattctcggtgtgatattcaaaagcagtcaagatggtgaagtttaccgcggaggagctccgtggaattatggacaaaaagaataatatccgtaacatgtctgttattgctcatgttgaccatggcaaatctacgcttacggattcccttgtggcagcagctgggattattgcccaggaagtagctggtgatgttcgcatgaccgatacccgtgcagatgaggcagaacgtggtattacaatcaaatccacgggtatctctcttttctatcagatgactcctgaatcactcgagatgtacaagggcgacagggatggtgatgagtacctgatcaaccttattgattcacctggccacgttgacttctcttcagaagtcacagctgctcttcgtatcaccgatggtgctttggttgttgttgactgtattgagggtgtctgtgtgcagactgaaactgtgctgcgccaagctcttggtgagaggattcggcctgtcctcaccgtgaacaagatggacagatgcttccttgagcttcaagtggaaggcgaggaagcatatcagactttctcccgtgtcattgaaaatgccaatgtcatcatggcaacatatgaagatgtgctccttggtgatgtccaagtgtacccagagaaggggactgttgcattctccgctggtttgcatgggtgggctttcacccttacaaactttgctaagatgtatgcctccaagtttggagttgatgagtcgaagatgatggagaggctgtggggtgagaacttctttgacccagccacaaagaaatggacctccaagaacactgggacagctacctgcaagagaggtttcgttcagttctgctatgagccaatcaagcaaatcatagccacctgcatgaatgatcagaaggataagttgtggccaatgttgaagaagcttggtgtgacgatgaagaatgatgagaaggacttgatgggcaaggctctcatgaagcgtgtgatgcaaacttggctgcctgccagtcgtgctctgcttgagatgatgatatttcaccttccctctccctcaaaggcacagaggtatcgtgtggagaacttgtacgagggtccccttgatgatatatatgctaatgctatcagaaactgtgaccctgatggtcctcttatgctgtatgtctccaagatgattccagcatctgacaagggtaggttctttgcctttggacgtgtttttgccgggagggttgcaactggtatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcaccaagaatgcaaccctgacaaatgagaaggaagttgatgcctgcccaatcagggcaatgaagttctctgtgtcccctgttgtgcgtgttgctgttcagtgcaaggtggcttctgatcttcctaagcttgttgagggtttgaagcgtctggccaagtctgatcctatggttctctgtaccattgaagagtctggtgagcatatcatcgctggagccggagagcttcatcttgaaatctgcttgaaggatctgcaggatgacttcatgggtggtgctgaaatcattgtttcccccctgtcgtctccttccgtgagactgttctggagaagtcctgccgtaccgttatgagcaagtcccccaacaagcataaccgtctttacatggaagctcgcccattggaggagggattggctgaggctattgatgatggccgcattggcccgcgtgatgatcctaaggtgcgctccaagatcctgtctgaggagtttggttgggacaaggatctcgccaagaagatttggtgctttggacctgagacgactggccccaacatggttgtggacatgtgtaagggagtgcagtatctgaatgaaatcaaggactctgttgtggcagggttccagtgggcatcgaaagaaggtgctctggctgaggagaacatgcgtggcatttgctttgaggtctgtgatgttgttctgcacactgatgctattcacaggggtggtggtcaggtcatcccaacagccaggagggtcatttacgcttctcagctcactgctaagccaaggctgctggagcctgtgtacctggttgagatccaggccccggagaatgcactcggtggtatctatggtgttctgaatcagaagagagggcatgtgtttgaggagatgcagaggcctggtaccccgctgtacaacatcaaggcttacctcccggtcatcgagtcgttcgggttctcaagtaccctcagggcagcgacatctggccaggcattcccccagtgtgtgttcgaccactgggacatcatgtcttctgatcctttggaggccggctcccagtctgccacccttgtcacggagatccgcaagcgcaagggtctgaaggaacagatgacccctctgtctgattttgaggacaagctctaaacttttggttctgttatctcctatatggtgtagttggttttgctgctaagagagctgcactattattttctgtctattgtgtcgtggctgtattgctattgggatgtcctatctgtcgtgatactggcactttgtttttgatgtctatcgatgttaaaacttagattaaaaaaaaaaaaaaaaaaaactcgagacctcggccgcgaccacgctaatcacttagtgaattc

SEQ ID NO: 2028 - DNA, 2873 bp, Secale cereale
tatcccgcaggcaggtcccttccacccctcccgtcccctaaacccgaaggccttctccgccgccgcttcctcatctcatcctcccggatcgggaggcggaagcgaagccccaaggaacttatattctcggtgtgatattcaaaagcagtcaaaatggtgaagtttaccgcggaggagctccgtggaattatggacaaaaagaataatatacgtaacatgtctgttattgctcatgttgaccatggcaagtctacgcttacggattcccttgtggcagctgctgggattattgcccaggaagtagctggtgatgttcgcatgaccgatacccgtgcagatgaggcagaacgtggtattacaatcaaatccacgggtatctctcttttctatcagatgactcctgaatcactcgagatgtacaagggcgacagggatggtgatgagtacctgatcaaccttattgattcacctggccacgttgacttctcttcagaagtcacggctgctcttcgtatcaccgatggtgctttggtggttgttgattgtattgagggtgtctgtgtgcagactgaaactgtgctgcgccaagctcttggtgagaggattcggcctgtcctcaccgtgaacaagatggacagatgcttccttgagcttcaagtggaaggtgaggaagcatatcagactttctcccgtgtcatcgaaaatgccaacgtcatcatggcaacatatgaagatgtgctccttggtgatgtccaagtgtacccagaaaaggggactgttgcattctctgctggtttgcatgggtgggctttcacccttacaaacttcgctaagatgtatgcctccaagtttggagttgatgaggcgaagatgatggagaggctgtggggtgagaacttctttgacccagccacaaagaaatggacctccaagaacactggcacagctacctgtaagagaggttttgttcagttctgctatgagccaatcaagcaaatcatagccacctgcatgaatgatcagaaggacaagttgtggcctatgttgaagaagcttggtgtgacgatgaagaatgacgagaaggacttgatgggcaaggctctcatgaagcgtgtgatgcaaacttggctgcctgccagtcgtgctctgcttgagatgatgatatttcacctcccctctccttcaaaggcccagaggtaccgtgtggagaacttatacgaggggcctcttgacgatatatatgcaaatgctatcaggaactgtgaccctgatggtcctcttatgttgtatgtctccaagatgattccagcatctgacaagggtagattctttgcctttggacgtgtttttgctggaagggttgcaactggcatgaaggtccgtatcatgggtcctaactttgttcctggccaaaagaaggatctgtatgtgaagagtgtccagcgtactgttatctggatgggaaagaagcaagagtctgttgaggatgttccctgtggtaacactgttgctttggttggtttggatcagttcatcaccaagaatgcaaccctgacaaatgagaaggaagttgatgcctgtccaatcagggcaatgaagttctctgtgtcccctgttgtgcgtgttgctgttcagtgcaaggtggcttctgatcttcctaagcttgttgagggtttgaagcggctggcgaagtctgaccctatggttctctgtagcattgaagagtctggtgagcatatcattgctggagctggagagcttcaccttgaaatctgtttgaaggatctgcaggaggacttcatgggaggtgctgaaattattgtttcccctcctgttgtctccttccgtgagactgttcttgagaagtcctgccgcactgtcatgagcaagtcccccaacaagcataaccgtctttacatggaagctcgcccattggaggagggattggctgaggctattgatgatggccgcattggcccacgtgatgatcctaaggtgcgctctaagatcctgtctgaggagtttggttgggacaaggatctcgccaagaagatttggtgctttggacctgagacgactggccccaacatggttgttgacatgtgtaagggagtgcagtatctgaatgaaatcaaggactctgttgtggctggtttccagtgggcatcaaaggaaggtgcattggctgaggagaacatgcgtggcatttgctttgaggtctgtgatgttgttctgcacactgatgctattcacaggggtggtggtcaggtcatcccaacagccaggagggtcatttatgcttctcagctcactgctaagccaaggttgctggagcctgtctacctggttgagatccaggccccggagaatgcgctcggcggtatctatggtgttctgaatcagaagagagggcacgtgtttgaggagatgcagaggcctggtaccccgctgtacaacatcaaggcttacctcccggtcatcgagtcgttcgggttctcaagtaccctcagggccgcgacatctggccaggctttcccccagtgtgtgttcgaccactgggacatcatgtcttccgatcctttggaggccggctcccagtctgccacccttgtcacggagatccgcaagcgcaagggtctgaaggaacagatgacccctctatctgatttcgaggacaagctctaaacttctgcttctgttacatggtctagtttgcttttgctgctaagagagctgcactatatttttctgtctattgagtcgtcgatgtattgctattggaatgtcctatctgtcgtgatactggcactttgttttgatgtctatcgatgttaagacttagattatatatctgttatccactggtagttctt

SEQ ID NO: 2029 - DNA, 2825 bp, Secale cereale
tccggacgcgccgccgcttcctcatctcccacctctcgggctcgggagccggaagcgaaaccccaaggaactacccagcgtgacattcaaaagcagtcaagatggtgaagttcacagcagaggagctccgtggaattatggataagaagaacaatatcaggaacatgtctgttattgcgcatgttgaccatggcaagtctacgcttacggattcccttgtggcagctgctggaattatcgcccaggaagttgctggtgatgtccgcatgactgatacacgtgcagatgaagcagaacgtggtattactatcaaatccacgggtatctctctgttctatcagatgactcctgaatcacttgagatgtacaagggtgacagagatggggatgagtacctgatcaaccttattgattcacctggtcacgtcgacttttcttcggaagtcacagctgctcttcgtatcaccgatggtgctttggtggtggttgactgtattgagggtgtctgtgtgcagactgaaactgtgctgcgccaagctcttggtgagaggattaggcctgtcctcaccgtgaacaagatggacagatgcttccttgagcttcaagtggaaggtgaggaagcataccagactttctcccgtgtcatcgaaaatgccaatgtcatcatggcaacatatgaagatgtgctccttggtgatgtccaagtgtacccagagaaggggactgttgcattctctgctggtttgcatgggtgggctttcacccttacaaactttgctaagatgtatgcctccaagtttggagttgatgaggcgaagatgatggagaggctgtggggtgagaacttttttgacccagccacaaagaaatggacctccaagaacactgggacagctacctgcaaaagaggttttgttcagttctgctacgagccaatcaagcaaatcatagcaacctgcatgaatgatcagaaggataagttgtggcctatgttgaagaagcttggtgtgaccatgaagaatgatgagaaggacttgatgggcaaggctctcatgaagcgtgtgatgcaaacttggttgcctgccagtcgtgctctgcttgagatgatgatatttcacctcccctctccttcaaaggcacagaggtatcgtgtggagaacttgtatgaggggcctcttgacgatatatatgcaaatgctatcagaaactgtgaccctgacggtcctcttatgctgtatgtctccaagatgattccagcatctgacaagggtagattctttgcctttggacgtgtttttgccgggagggttgcaactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcaccaagaacgcaaccctgacaaatgagaaggaagttgatgcctgcccaatcagggcaatgaagttctctgtgtcccctgttgtgcgtgttgctgttcagtgcaaggtggcatctgatcttcctaagcttgttgagggtttgaagcggcttgcgaagtctgaccctatggttctctgtagcattgaggagtctggtgagcatatcattgctggagctggagagcttcaccttgaaatctgtttgaaggatctgcaggaggacttcatgggtggtgctgaaattattgtttcccctcctgttgtctccttccgtgagactgttctggagaagtcctgccgcactgtcatgagtaagtcccccaacaagcataaccgtctttacatggaggctcgcccattggaggagggattggctgaggctattgatgatggccgcattggcccacgtgatgatcctaaggtgcgctccaagatcctgtctgaggagttcgggtgggacaaggatcttgccaagaagatttggtgctttggacctgagacgactggccccaacatggttgttgacatgtgtaagggagtgcagtatctgaatgaaatcaaggactctgtcgtggctggtttccagtgggcatcaaaggaaggtgcattggctgaggagaacatgcgtggcatctgctttgaggtctgtgatgttgttctgcacactgatgctattcacaggggtggtggtcaggtcatcccaacagccaggagggtcatttatgcttctcagctcactgctaagccaaggctgctggagcctgtgtacctggttgagatccaggccccggagaatgcacttggtggtatctatggtgttctgaatcagaagagggggcatgtgtttgaggagatgcagaggcctggtaccccgctgtacaacatcaaggcttacctaccggtcatcgagtccttcggattctcaagtaccctcagggctgcgacatctggccaggccttcccccagtgtgtgttcgaccactgggacatcatgtcttctgatcctttggaggccggctcccagtctgccacccttgtcacggagatccgcaagcgcaagggtctgaaggaacagatgacccctctgtctgatttcgaggacaagctctaaacttttggttctgttacatggtctagtttgcttttgctgctaagagagctgcactatattttctgtctattgagtcgtggctgtattgctattggaatgtcgtatctgtcgtgatactcgtactttgttttgatgtctatcgatgttaaaacttagattatatatctgttatctactggtagttcttggtta

SEQ ID NO: 2030 - DNA, 2940 bp, Triticum aestivum
gcttccattctcttcctccgggagcgccgccgcttcctcatctcccacctctcggctcgggagccggaagcgaaaccccaaggtactgtagtcctggcgtgacattcaaaagcagtcaagatggtgaagttcacagcggaggagctccgtggaattatggataaaaagaataatattcgtaacatgtctgttattgctcatgttgaccacggcaagtctacgcttacggattcccttgtggcagctgctgggattatcgcccaggaagttgctggtgatgttcgcatgactgatacccgtgcagatgaggcagaacgtggtattacaatcaaatccacgggtatctctctgttctatcagatgactcctgaatcacttgagatgtacaagggcgacagggatggggatgaatacctgatcaaccttattgactcacctggtcacgttgacttctcttcggaagtgacagctgctcttcgtatcactgatggtgctttggtggtggttgactgtattgagggtgtctgtgtgcagaccgaaactgtgctgcgccaagctcttggtgagaggattaggcctgtcctcaccgtgaacaagatggacagatgcttccttgagcttcaagtggaaggtgaggaagcataccagactttctcccgtgtcattgaaaatgccaatgtcatcatggcaacatatgaagatgtgctccttggtgatgtccaagtgtacccggagaaggggactgttgcattctctgctggtttgcatgggtgggctttcacccttacaaacttcgctaagatgtatgcctccaagtttggagttgatgaggcgaagatgatggagaggctttggggtgagaacttctttgacccagccacaaagaaatggacctccaagaacactgggacagctacctgcaagagaggttttgttcagttctgctacgagccaatcaagcaaatcatcgccacctgcatgaatgatcagaaggataagttgtggcctatgttgaagaagctgggtgtgaccatgaagaatgatgagaaggacttgatgggcaaggctctcatgaagcgtgtgatgcaaacttggctgcctgccagtcgtgctctgcttgagatgatgatatttcaccttccctctccctcaaaggcacagaggtatcgtgtggagaacttgtacgagggtccccttgatgatatatatgctaatgctatcagaaactgtgaccctgatggtcctcttatgctgtatgtctccaagatgattccagcatctgacaagggtaggttctttgcctttggacgtgtttttgccgggagggttgcaactggtatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcaccaagaatgcaaccctgacaaatgagaaggaagttgatgcctgcccaatcagggcaatgaagttctctgtgtcccctgttgtgcgtgttgccgttcagtgcaaggtggcatctgatcttcctaagcttgttgagggtttgaagcggctggcgaagtctgaccctatggttctctgtagcattgaagagtctggtgagcatatcattgctggagctggagagcttcaccttgaaatctgtttgaaggatctgcaggaggacttcatgggtggtgctgaaattattgtttcccctcccgtcgtctccttccgtgagactgttcttgagaagtcctgtcgcactgtcatgagcaagtcccccaacaagcataaccgtctttacatggaagctcgcccattggaggagggattggctgaggctattgatgatggccgcattggcccgcgtgatgatcctaaggttcgctccaagatcctgtctgaggagtttgggtgggacaaggatctcgccaagaagatttggtgctttggacctgagacgactggccccaacatggttgttgacatgtgtaagggagtgcagtatctgaatgaaatcaaggactctgttgtggctgggttccaatgggcatcgaaagaaggtgctctggctgaggagaacatgcgtggcatttgctttgaggtctgtgatgttgttctgcacactgatgctattcacaggggtggtggtcaggtcatcccaacagccaggagggtcatttacgcttctcagctcactgccaagccaaggctgctggagcctgtgtacctggttgagatccaggccccggagaatgcacttggcggtatctatggtgttctgaatcagaagagagggcacgtgtttgaggagatgcagaggcctggtaccccgctgtacaacatcaaggcttacctcccggtcatcgagtcgtttgggttctcaagtaccctcagggcggcgacatctggccaggctttcccccagtgtgtgttcgaccattgggacatcatgtcttctgatcctttggaggccggctcccagtccgcgacccttgtcacagagatccgcaagcgcaagggtctcaaggaacagatgacccctctatctgatttcgaggacaagctctaaacttttgcttctgttacatggtctagtttgcttttgctgctaagagagctgcactattatctgtctattgagtcgtcgtcgctgtattgctattggaatgtactcctatctgtcgtgatactggcactttgttttgatgtctgtcgatgttaaaacttagattatatatctgtcgcgatacttttgatgtctatcaatgttaaaacttagactatatatctgttatggtagttcttgttgatgtcttgtttgcttttgtgttagatcttgagatctctgcctggttct

SEQ ID NO: 2031 - DNA, 2802 bp, Triticum aestivum
cccttgttccattctcttcctccgggagcgccgccgcttcctcatctctcacctctcggctcgggagaccgaagcgaaaccccaaggaactatagtcccagtgtgacattcaaaagcagtcaagatggtgaagttcacagcggaggagctccgtggaattatggataaaaagaataatattcgcaacatgtctgttattgctcatgttgaccacggcaagtctacgcttacggattcccttgtggcagctgctgggattatcgcccaggaagttgctggtgatgttcgcatgactgatacccgtgcagatgaggcagaacgtggtattacaatcaaatccacgggtatctcccttttctatcagatgactcctgaatcacttgagatgtacaagggcgacagggatggtgatgagtaccttatcaaccttattgattcacctggccacgttgacttctcttcggaagtgacagctgctcttcgtatcactgatggtgctttggtggtggttgactgtattgagggtgtctgtgtgcagaccgaaactgtgctgcgccaagctcttggtgagaggattaggcctgtcctcaccgtgaacaagatggacagatgcttccttgagcttcaagtggaaggtgaggaagcataccagactttctcccgtgtcattgaaaatgccaatgtcatcatggcaacatatgaagatgtgctgcttggtgatgtccaagtgtacccggagaaggggactgttgcattctctgctggtttgcatgggtgggctttcacccttacaaacttcgccaagatgtatgcctccaagtttggagttgatgaggcaaagatgatggagaggctgtggggtgagaacttctttgacccagccacaaagaaatggacctccaagaacactgggacagctacctgcaagagaggtttcgttcagttctgctatgagccaatcaagcaaatcatagcaacctgcatgaatgaccagaaggataagttgtggcctatgttgaagaagcttggtgtgaccatgaagaacgatgagaaggacttgatgggcaaggctctcatgaagcgtgtgatgcaaacttggctgcctgccagtcgtgctctgcttgagatgatgatatttcatcttccttctccttcaaaggcacagaggtatcgtgtggagaacttgtacgagggtccccttgatgatatatatgctaatgctatcagaaactgtgaccctgatggtcctcttatgctgtatgtctccaagatgattccagcatctgacaagggtagattctttgcctttggacgtgtttttgccgggagggttgcaactggcatgaaggtccgtatcatgggtcccaactttgttcctggccagaagaaggatctgtatgtgaagagtgtccagcgtactgttatctggatgggaaagaagcaagagtctgttgaggatgttccttgtggtaacactgttgctttggttggtttggatcagttcatcaccaagaatgcaaccctgacaaatgagaaggaagttgatgcctgcccaatcagggcaatgaagttctctgtgtcccctgttgtgcgtgttgccgttcagtgcaaggtggcatctgatcttcctaagcttgttgagggtttgaagcggctggcgaagtctgaccctatggttctctgtagcattgaagagtctggtgagcatatcattgctggagctggagagcttcaccttgaaatctgtttgaaggatctgcaggaggacttcatgggtggtgctgaaattattgtttcccctcccgtcgtctccttccgtgagactgttcttgagaagtcctgtcgcactgtcatgagcaagtcccccaacaagcataaccgtctttacatggaagctcgcccattggaggagggattggctgaggctattgatgatggccgcattggcccacgtgatgatcctaaggtgcgctctaagatcctatctgaggagtttggttgggacaaggatctcgccaagaagatttggtgctttggacctgagacgactgggcccaacatggttgtcgacatgtgtaagggagtgcagtatctgaatgaaatcaaggactctgttgtggctgggttccagtgggcatcgaaggaaggtgcattggctgaggagaacatgcgtggcatctgctttgaggtctgtgatgttgttctgcacactgatgctattcacaggggtggtggtcaggtcatcccaacagcccggagggtcatttatgcttctcagctcactgctaagccaaggctactggagcctgtgtacctggttgagatccaggccccggagaatgcactcggcggtatctatggtgttctgaatcagaagagagggcacgtgtttgaggagatgcagaggcctggtaccccgctgtacaacatcaaggcttacctcccggtcatcgagtcgttcgggttctcaagtaccctcagggctgcgacatctggccaggctttcccccagtgtgtgttcgaccactgggacatcatgtcttcggatcctttggaggccggctcccagtctgcgacccttgtcacggagatccgcaagcgcaagggtctgaaggaacagatgacccctctatctgatttcgaggacaagctctaaacttttagttctgttatcatatgggtctagtttgcttttgctgctaagagagctgcactattattttctgtctgttgagtcgtggctgtattgctattgggatgtcctatcactttgttttgatgtctatcgatgttaaaacttag

SEQ ID NO: 2032 - DNA, 3035 bp, Triticum aestivum
agggttcttccttcacccctgcttccattctcttcctccgggagcgccgccgcttgctcatctcccacctctcgcctcgggagccggaagcgaaaccccacggtactatagtcccggtgtgacattcaaaagcagtcaagatggtgaagttcacagcggaggagctccgtggaattatggataaaaagaataatattcgtaacatgtctgttattgctcatgttgaccatggcaagtctacgcttacggattcccttgtggcagctgccgggattatcgcccaggaagttgctggtgatgttcgcatgactgatacccgtgcagatgaggcagaacgtggtattacaatcaaatccacgggtatctctctgttctatcagatgactcctgaatcacttgagatgtacaagggtgacagggatggggacgaatacctgatcaaccttattgactcacctggtcatgttgacttctcttcggaagtgacagctgctcttcgtatcactgatggtgctttggtggtggttgactgtattgagggtgtctgtgtgcagaccgaaactgtgctgcgccaagctcttggtgagaggattaggcctgtcctcaccgtgaacaagatggacagatgcttccttgagcttcaagtggaaggtgaggaagcataccagactttctcccgtgtcattgaaaatgccaatgtcatcatggcaacatatgaagatgtgctccttggtgatgtccaagtgtacccggagaaagggactgttgcattctctgctggtttgcatgggtgggctttcacccttacaaactttgctaagatgtatgcctccaagtttggagttgatgaggcgaagatgatggagaggctttggggtgagaatttctttgacccagccacaaagaaatggacctccaagaacactgggacagctacttgcaagagaggtttcgttcagttctgctacgagccaatcaagcaaatcatcgccacctgcatgaatgatcagaaggataagttgtggcctatgttgaagaagctgggtgtgaccatgaagaatgatgagaaggacttgatgggcaaggctctcatgaagcgtgtgatgcaaacttggctgcctgccagtcgtgctctgcttgagatgatgatatttcacctcccctctccttcgaaggcacagaggtatcgtgtggagaacttatatgaggggcctcttgatgatatatatgcaaatgctatcaggaactgtgaccctgaaggtcctctgatgttgtatgtctccaagatgattccagcatctgacaagggtagattctttgcctttggacgtgtttttgctgggagggttgcaactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcaccaagaatgcaaccctgacaaatgagaaggaagttgatgcctgcccaatcagggctatgaagttctctgtgtcccctgttgtgcgtgttgccgttcagtgcaaggtggcatctgatcttcctaagcttgttgagggtttgaagcggctggcgaagtctgaccctatggttctctgtagcattgaagagtctggtgagcatatcattgctggagctggtgagcttcaccttgaaatctgtttgaaggatctgcaggaggacttcatgggtggtgctgaaattattgtctcacctcctgttgtctccttccgtgagactgttctggagaagtcctgccgcacagttatgagcaagtccccgaacaagcacaaccgtctttacatggaggctcgcccattggaggagggactggctgaggccattgatgatggccgcattggcccacgtgatgatcctaaggtgcgctctaagatcctatctgaggagtttggctgggacaaggatcttgccaagaagatttggtgctttggacctgagacgactggccccaacatggttgtcgacatgtgtaagggagtgcagtatctgaatgaaatcaaggactctgttgtggctgggttccagtgggcatcgaaagaaggtgctttggctgaggagaacatgcgtggcatctgctttgaggtctgtgatgttgttctgcacactgatgctattcacaggggtggtggccaggtcatcccaacagccaggagggtcatttatgcttctcagctcactgctaagccaaggctgctggagcctgtgtacctggttgagatccaggccccggagaatgcacttggcggtatctatggtgttctgaatcagaagagagggcacgtgtttgaggagatgcagaggcctggtaccccgctgtacaacatcaaggcttacctcccggtcatcgagtcgttcgggttctcaagtaccctcagggctgcgacatctggccaggctttcccccagtgtgtgttcgatcactgggacatcatgtcttcggatcctttggaggccggctcccagtctgccacccttgtcacggagatccgcaagcgcaagggtctgaaggaacagatgacccctctgtctgatttcgaggacaagctctaaacttttggttctgttatctcctatatagtgtagttggttttgctgctaagagagctgcactattattttgtgtctactgagtcgtggctgtattgctattggaatgtactcctatctgtcgtgatactggcactttgttttgatgtctatcgatgttaaaacttagattatatatctgttatccaccggtagttcttgttgatgtcgtgttttctttcgttttatatcgtgagagctttgcctggttatttattgctattgtcctgctctatgtttttcatgtttgtccagcaattgcatcattgatgtgttgcattagcttttctccctgctcttaacatcgttttaccttgattgatacaa

SEQ ID NO: 2033 - DNA, 2739 bp, Secale cereale
aagaccaagccccggaacttatattctcggtgtgatattcaaaagcagtcaaaatggtgaagtttaccgcggaggagctccgtggaattatggacaaaaagaataatatccgtaacatgtctgttattgctcatgttgaccatggcaagtctacgcttacggattcccttgtggcagctgctgggattattgcccaggaagtagctggtgatgttcgcatgaccgatacccgtgcagatgaggcagaacgtggtattacaatcaaatccacgggtatctctcttttctatcagatgactcctgaatcactcgagatgtacaagggcgacagggatggtgatgagtacctgatcaaccttattgattcacctggccacgttgacttctcttcagaagtcacggctgctcttcgtatcaccgatggtgctttggtggttgttgactgtattgagggtgtctgtgtgcagactgaaactgtgctgcgccaagctcttggtgagaggattaggcctgtccttactgtgaacaagatggacagatgctttcttgagcttcagtttgaaggtgaggaagcataccagactttctcccgtgtcatcgaaaatgccaatgtcatcatggcaacatatgaagatgtgctcctgggtgatgtccaagtgtacccagagaaggggactgttgcattctctgctggtttgcatgggtgggctttcacccttacaaactttgcaaagatgtatgcctccaagtttggtgttgatgaggtgaagatgatggagaggctgtggggtgagaacttctttgacccagccacaaagaaatggaccaccaagaacactggcacagctacctgcaagagaggtttgttcagttctgctacgagccaatcaagcaaatcatcgccacctgcatgaatgatcagaaggataagttgtggcctatgttgaagaagcttggtgtgaccatgaagaatgatgagaaggacttgatgggcaaggctctcatgaagcgtgtgatgcaaacttggctgcctgccagtcgtgctctgcttgagatgatgatatttcacctcccctctccttcaaaggcacagaggtatcgtgtggagaacttgtatgagggcccccttgatgacgtatatgcaaatgctatcagaaactgtgaccctgatggtcctcttatgctgtatgtctccaagatgattccagcatctgacaagggtagattctttgcctttggacgtgtttttgccgggagggtcgcaactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcaccaagaacgcaaccctgacaaatgagaaggaagttgatgcctgcccaatcagggcaatgaagttctctgtgtcccctgttgtgcgtgttgctgttcagtgcaaggtggcatctgatcttcctaagcttgttgagggtttgaagcggcttgcgaagtctgaccctatggttctctgtagcattgaggagtctggtgagcatatcattgctggagctggagagcttcaccttgaaatctgtttgaaggatctgcaggaggacttcatgggtggtgctgaaattattgtttcccctcctgttgtctccttccgtgagactgttcttgagaagtcctgccgcactgtcatgagtaagtcccccaacaagcataaccgtctttacatggaagctcgcccattggaggagggattggctgaggctattgatgatggccgcattggcccacgtgatgatcctaaggtgcgctccaagatcctgtctgaggagttcgggtgggacaaggatcttgccaagaagatttggtgctttggacctgagacgactggccccaacatggttgttgacatgtgtaagggagtgcagtatctgaatgaaatcaaggattctgttgtggctggtttccagtgggcatcaaaggaaggtgcattggctgaggagaacatgcgtggcatctgctttgaggtctgtgatgttgttctgcacactgatgctattcacaggggtggtggtcaggtcatcccaacagccaggagggtcatttatgcttctcagctcactgctaagccaaggctgctggagcctgtgtacctggttgagatccaggccccagagaacgcactcggcggcatctatggtgtgctgaatcagaagagagggcacgtgtttgaggagatgcagaggcctggtaccccgctgtacaacatcaaggcttacctccccgtcatcgagtcgttcgggttctcaagtaccctcagggctgcgacgtctggccaggctttcccccagtgtgtgttcgaccactgggacatcatgtcttcggatcctttggaggccggctcccagtctgcgaccctcgtcacggagatccgcaagcgcaagggtctgaaggaacagatgacccctctgtctgatttcgaggacaagctctaaacttttggttctgttacatggtctagtttgcttttgctgctaagagagctgcactatattttctgtttattgagtcctggctgtattgctattggaatgtcctatctgtcgtggtactggtactttgttttgatgtctatcgatgttaaaacata

SEQ ID NO: 2034 - DNA, 2832 bp, Secale cereale
ttttcttcctccgggagcgccgccgcttcctcatctcccacctctcgggctcgggagccggaagcgaaaccccaaggaactacccagcgtgacattcaaaagcagtcaagatggtgaagttcacagcagaggagctccgtggaattatggataagaagaacaatatcaggaacatgtctgttattgcgcatgttgaccatggcaagtctacgcttacggattcccttgtggcagctgctggaattatcgcccaggaagttgctggtgatgtccgcatgactgatacacgtgcagatgaagcagaacgtggtattactatcaaatccacgggtatctctctgttctatcagatgactcctgaatcacttgagatgtacaagggtgacagagatggggatgagtacctgatcaaccttattgattcacctggtcacgttgacttttcttcggaagtcacagctgctcttcgtatcaccgatggtgctttggtggtggttgactgtattgagggtgtctgtgtgcagactgaaactgtgctgcgccaagctcttggtgagaggattaggcctgtcctcaccgtgaacaagatggacagatgcttccttgagcttcaagtggaaggtgaggaagcataccagactttctcccgtgtcatcgaaaatgccaatgtcatcatggcaacatatgaagatgtgctccttggtgatgtccaagtgtacccagagaaggggactgttgcattctctgctggtttgcatgggtgggctttcacccttacaaactttgctaagatgtatgcctccaagtttggagttgatgaggcgaagatgatggagaggctgtggggtgagaacttttttgacccagccacaaagaaatggacctccaagaacactgggacagctacctgcaaaagaggttttgttcagttctgctacgagccaatcaagcaaatcatagcaacctgcatgaatgatcagaaggataagttgtggcctatgttgaagaagcttggtgtgaccatgaagaatgatgagaaggacttgatgggcaaggctctcatgaagcgtgtgatgcaaacttggttgcctgccagtcgtgctctgcttgagatgatgatatttcacctcccctctccttcaaaggcacagaggtatcgtgtggagaacttgtatgaggggcctcttgacgatatatatgcaaatgctatcagaaactgtgaccctgacggtcctcttatgctgtatgtctccaagatgattccagcatctgacaagggtagattctttgcctttggacgttgtttttgccgggagggttgcaactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcaccaagaacgcaaccctgacaaatgagaaggaagttgatgcctgcccaatcagggcaatgaagttctctgtggtccctgttgtgcgtgttgctgttcagtgcaaggtggcatctgatcttcctaagcttgttgagggtttgaagcggcttgcgaagtctgaccctatggttctctgtagcattgaggagtctggtgagcatatcattgctggagctggagagcttcaccttgaaatctgtttgaaggatctgcaggaggacttcatgggtggtgctgaaattattgtttcccctcctgttgtctccttccgtgagactgttctggagaagtcctgccgcactgtcatgagtaagtcccccaacaagcataaccgtctttacatggaagctcgcccattggaggagggattggctgaggctattgatgatggccgcattggcccacgtgatgatcctaaggtgcgctccaagatcctgtctgaggagttcgggtgggacaaggacctcgccaagaagatttggtgctttggacctgagacgactggccccaacatggttgttgacatgtgtaagggagtgcagtatctgaatgaaatcaaggactctgttgtggctgggttccagtgggcatcaaaggaaggagcattggctgaggagaacatgcgtggcatctgctttgaggtctgtgatgttgttctgcacactgatgctattcacaggggtggtggtcaggtcatcccaacagccaggagggtcatttatgcttctcagctcactgctaagccaaggctgctggagcctgtgtacctggttgagatccaggccccagagaacgcactcggcggtatctatggtgtgctgaatcagaagagaggtcacgtgtttgaggagatgcagaggcctggtaccccgctgtacaacatcaaggcttacctcccggtcatcgagtcgttcgggttctcaagtaccctcagggctgcgacgtctggccaggcttttccccagtgtgtgttcgaccactgggacatcatgtcttcggatcctttggaggctggctcccagtctgccacccttgtcacggagatccgcaagcgcaagggtctgaaggaacagatgacccctctgtctgatttcgaagacaagctctaaacttttgtttctgttacatggtctagtttgcttttgctgctaagagagctgcactatattttctgtctattgagtcctggctgtattgctattggaatgtcctatctgtcgtggtactggtactttgttttgatgtctatcgatgttaaaacttagattatatatctgttatctactggtagttcttgg

SEQ ID NO: 2035 - DNA, 2893 bp, Hordeum vulgare
gcacaggccacagggggatcgcctaggtccttctcctgcgccttcgctcggcgccgtccagggctgtcctcatctcattcctcctgaatcctgatagcgagggggatcctcaaggaatttatatttgtagtgtgataatcaaaagcagtcaagatggtgaaattcacagtagaaggactccgcatcatcatggacaagcaaaataatattcgtaacatgtctgttattgctcatgtcgaccatggaaagtctacgcttactgattctctggtggcagctgccgggattattgcacaagaagttgcaggtgacgtccgcatgactgatactcgtgcagatgaagcagagcgtggtatcacaatcaaatccacgggtatatctcttttttatgagatgactgaggaatcactcagggcttataagggcgagagagatggcaatgaatacctgatcaaccttatagattctcctgggcacgttgatttctcttcggaagtcacagctgctcttcgtattactgatggtgctttggtggtggttgactgtattgagggtgtatgtgtgcagactgaaactgtgctgcgccaagctcttggtgagaggattaggcctgtccttaccgtgaacaagatggacagatgcttccttgagcttcaggttgaaggtgaggaagcataccagactttctcccgtgtcattgaaaatgccaatgtcatcatggcaacatatgaagatgtgctccttggtgatgtccaagtgtacccagagaaggggactgttgcattctctgctggtttgcatgggtgggctttcacccttacaaactttgctaagatgtatgcctccaagtttggagttgatgaggcaaagatgatggagaggctgtggggtgagaacttctttgacccagccacaaagaaatggacctccaagaacactgggacagctacctgcaagagaggtttcgttcagttctgctatgagccaatcaagcaaatcatagccacctgcatgaatgaccagaaggataagttgtggcctatgttgaagaagcttggtgtgaccatgaagaatgatgagaaggacttgatgggcaaggctctcatgaagcgtgtgatgcaaacttggctgcctgccagtcgtgctctgcttgagatgatgatctttcacctcccctctccttcaaaggcacagaggtatcgtgtggagaacttatacgagggtccccttgatgacatatatgcaaatgctatcagaaactgtgaccctgatggtcctcttatgctgtatgtctccaagatgattccagcatctgacaagggtagattctttgcctttggacgtgtctttgccgggagggttgcaactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcacaaagaatgcaaccctgacaaatgagaaggaagttgatgcctgcccaatcagggcaatgaagttctctgtgtcccctgttgtgcgtgttgctgttcagtgcaaggtggcttctgatcttcctaagcttgttgagggtttgaagcgtctggcaaagtctgatcctatggttctctgtaccattgaagagtctggtgagcatatcattgctggagctggagagcttcaccttgaaatctgtttgaaggatctgcaggatgacttcatgggtggtgctgaaattattgtttcccctcctgtcgtctccttccgtgagactgttcttgagaagtcctgccgtacagtcatgagcaagtcccccaacaagcacaaccgtctttacatggaagctcgcccattggaggagggattggctgaggctattgatgatggccgcattggcccacgtgatgatcccaaggtgcgctccaagatcctgtctgaggagtttggctgggacaaggatctcgccaagaagatttggtgtttcggacccgaaaccactgggccgaatatggttgttgatatgtgcaagggagtgcagtatctgaacgaaatcaaggactccgttgtggccggcttccagtgggcgtcgaaagaaggggcattggcagaagaaaacatgcgtggcatttgctttgaggtctgtgacgtcgtcctccacacagatgctattcacaggggtggcggtcaggtcatcccgacggctagaagggtcatttatgcttctcagctcacggctaagccaaggttactcgagcctgtatacctagtggagatccaggcacctgagaatgcacttggtggcatctatggcgttctcaaccagaagagagggcatgtgtttgaggagatgcagaggcctggtaccccactttacaacatcaaggcttacctacctgttatcgagtcctttggtttctccagcacacttcgggctgcgacgtctggccaggccttcccgcagtgtgtgtttgatcactgggacatgatgtctgctgatcctttggaggcaggatcacaggcggcgcagctggtcttggatatccgcaagaggaaggggttgaaagaacagatgacccctctctccgaattcgaggacaagctctaagcttttgctcccatgtgatctatgatctcgcccagtttttgatctatacttggtctgttgtcaggagattagtactctttttcgtattccagttccttgggttgtcatgtactgagcctatttcggtgtcttatcagatttaacaaataatttaccttagatgatatgtttgattgagtggttgattagtattgttttgtgtctccta

SEQ ID NO: 2036 - DNA, 3489 bp, Brachypodium distachyon
ggcggcggcagggtatcagtcattttatttgttttgcttgggaaccttccctctccccggcccatctcgctgccgagcgccccgacggcccaaccccgtcgctcgtcttcctcctcgagcgagcgccgccaccccttcactccccgtcccgctgccgagcgccccagccccctcgctccgtcgcacgtcttcctcctcgtgcgagcgcctccaccgcaggaacttatattctcagcgtgatattcaaaagcagtcaagatggtgaagtttacagcggaggagctccgcaggattatggacaagaagaataacatccgtaacatgtctgttattgctcatgtcgaccatggcaagtctacacttacggattcccttgtggctgctgctgggattattgcccaggaagttgctggtgatgttcgcatgactgatacccgcgcagatgaagcagagcgtggtattacaatcaaatccaccggtatctctcttttctatgagatgactgatgagtcactccagatgtacaagggtgagagggatgggaatgaatacctgatcaaccttattgattcacctggacacgttgatttttcttcggaggtcacagctgctcttcgtatcactgatggtgctttggtggtggttgactgtattgagggtgtctgtgtgcagactgaaactgtgctccgccaagctcttggtgagaggattagacctgtccttactgtgaataagatggacaggtgcttccttgagcttcaagttgaaggtgaggaagcgtatcagactttctcccgtgtcattgaaaatgccaatgtcatcatggcaacgtatgaagacaagctccttggtgatgtccaagtgtacccagaaaaggggaccgtggctttctctgctggtttgcatggctgggctttcactctcacaaattttgctaagatgtatgcctccaagtttggagttgatgaatcaaagatgatggagaggctgtggggtgagaacttctttgacccaaccacaaagaaatggaccaccaagaatactggctcagctacttgtaagagaggttttgttcagttctgttatgagccaatcaagcaaatcatcaacacctgcatgaatgatcagaaggataagttgtggcctatgttgaagaagcttggcgtgaccatgaagaatgatgagaaggacctaatgggcaaggctctcatgaagcgtgtcatgcaaacttggctgcctgccagtcgtgctctgcttgagatgatggtgtttcatcttccctccccctcgaaggcacagaggtatcgtgtggagaacttgtacgagggaccccttgatgatatatatgcaaccgccattagaaactgtgacccggaaggccctcttatgctgtatgtttccaagatgattccagcatctgacaagggaagattctttgcctttggtcgtgtctttgctgggagggttgcaactggcatgaaggtccgtatcatgggtcccaactatgttcctggtcagaagaaggatctctatgtgaagagtgtccagcgtactgttatctggatgggaaagaaacaagagtctgttgaggatgttccatgcggtaacactgttgctttggttggtcttgaccagttcatcacaaagaatgcgaccctcacaaatgagaaggaaactgatgcttgcccaatcagagcaatgaagttctctgtgtctcctgttgtgcgtgttgctgttcagtgcaaggtggcctctgatcttcctaagcttgttgaaggtttgaagcgtctggctaagtctgatcctatggttctctgtaccattgaagagtctggcgagcacatcatcgctggagctggagagcttcatcttgaaatttgcttgaaggatctgcaggatgacttcatgggtggtgctgaaatcattgtttcccctcctgttgtctccttccgtgagactgttcttgagaagtctagccgtactgttatgagcaagtcccccaacaaacacaaccgtctgtacatggaagctcgcccgttggaagagggactagctgaggccattgatgatggccgcataggcccacgtgatgatcctaaggtgcgttccaagatcctttcggaggagtttggatgggacaaggatcttgccaagaagatttggtgctttggacctgagaccactggtccgaacatggttgttgatatgtgtaagggagtacagtatctaaatgaaatcaaggattctgttgtggctggcttccagtgggcatcaaaagaaggtgcattggctgaggagaacatgcgtggaatttgctttgaggtctgtgatgttgtgctccacactgatgccattcacagaggtggtgggcaggttattcctacggccaggagggtcatttatgcttctcagctcactgctaagccaaggctgttggagcctgtctacctggtggagatccaggcaccggagaatgcccttggtggtatttatggtgttctgaatcagaagagagggcacgtgttcgaggagatgcagaggcctggtaccccactgtacaacatcaaggcttacctccctgtcatagagtcctttggattctcaagtacgctcagggctgcaacatctggccaggcattccctcaatgtgtgttcgatcactgggatatcatgtcttctgatcctttggaggctggcacccaatctgccacccttgtcacggagatccgcaagaggaaggggctgaaggaacagatgactcctctgtctgagttcgaggacaagctctaaattttggtcatgttttgtgctattaccttacctggtcgacttgctcttattgttgagctgctttattccgtacttgcgttcagttgtcgtaacatcaagtcttatctagtgtgctgttggaactatattttaccgtttgccatgatgtatcagatatgaaacatacattatatatctgtggtgaacttggtagtttttacattggtccttggatgttccccactttattcattgttatcttgcttgtcctggttctatagttgatagtttcttatctgtcagttacattggttcgtaccctcagttgctgttttagcaggaaacttgaaaaattgctatggaggaagaaaaggaggctgaccaatggcacaggaagcgaagaagaagacgaggacggtatgcgccttggcgaccatggacataaaggctcaggtggacctcgcagtggctcagcgaacgattcctcggagacctttgcgtcgtgctgctattattgtctacctctggatttcaactatactgtgacatacggagtagttgagtaagtatttgcaccccttagccacatgtttggccttcttccctttctctctcttagttaatttttgacactttaaactagagtgcaggattaacagtattaccatcggacaactttctctttctttctctctctcctcttttaagtacattgtgcta

SEQ ID NO: 2037 - DNA, 3121 bp, Brachypodium distachyon
caaccctcgaaagtagtggctagggtttataaggcagcgggcagcgctcctcccctcctgcgccgccgcttcctcatctcatctcattcctctcaaccctctcggatcgggaggtggaagcgagacccctaggaacttctctttgttgcctgatattcagaaacagtcaagatggtgaagtttacagcagaagagcttcgccggattatggacaagaagaacaacatccgcaacatgtctgttattgctcatgtggaccatggcaaatctacgcttacggattcccttgtggcagctgctgggattattgcccaggaagttgctggtgatgttcgcatgactgatacccgtgcagatgaagcagagcgtggtattacgatcaaatccactggtatctctcttttctacgagatgactgatgagtcactccagatgtacaagggtgagagggatgggaatgaatacctgatcaaccttattgattcacctggacacgttgatttttcttcggaggtcacagccgcccttcgtatcactgatggtgctttggtggtggttgactgtattgagggtgtctgtgtgcagactgaaactgtgctccgccaagctcttggtgagaggattagacctgtccttactgtgaacaagatggacaggtgcttccttgagcttcaagttgaaggtgaggaagcctatcagactttctcccgtgtcattgaaaatgccaatgtcatcatggcaacgtatgaagacaagctccttggtgatgtccaagtgtacccagaaaaggggaccgtggctttctcagctggtttgcatggctgggctttcactctcacaaattttgctaagatgtatgcctccaagtttggagttgatgaatcaaagatgatggagaggctgtggggtgagaacttctttgacccaaccacaaagaaatggaccaccaagaacactggctcggctacttgtaagagaggttttgttcagttctgctatgagccaatcaagcaaatcatcaacacctgcatgaatgatcagaaggacaagttgtggcctatgttgaagaagcttggtgtgaccatgaagaatgatgagaaggacctaatgggcaaggctctcatgaagcgtgtcatgcaaacttggctgccagccagtcgtgctctgcttgagatgatggtgtttcatcttccctccccctcaaaggcacagaggtatcgtgtggagaacttgtatgagggacctcttgatgatgtatatgcaaccgctattagaaactgtgaccccgaaggtcctcttatgctgtatgtttctaagatgattccagcatctgacaagggaagattctttgcctttggtcgtgtcttcgccgggagggttgcaactggcatgaaggtccgtatcatgggtcccaactatgttcctggtcagaagaaggatctgtatgtgaagagtgtccagcgtactgttatctggatgggaaagaaacaagagtctgttgaggatgttccatgcggtaacactgttgctttggttggtcttgaccagttcatcacaaagaatgcgaccctcacaaatgagaaggaaactgatgcttgcccaatcagagcaatgaagttctctgtgtctcctgttgtgcgtgttgctgttcagtgcaaggtggcctctgatcttcctaagcttgttgaaggtttgaagcgtctggccaagtctgatcctatggttctctgtaccattgaagagtctggcgagcatatcattgctggagctggagagcttcatcttgaaatttgcttgaaggatctgcaggatgacttcatgggtggtgctgaaatcattgtttcccctcctgttgtctccttccgtgagactgttcttgagaagtccagccgtactgttatgagcaagtcccccaataaacataaccgtctttacatggaagctcggccgttggaagagggactagctgaggccattgatgatggccgcataggcccacgtgatgatcctaaggtgcgctccaagatcctatccgaggagtttggttgggacaaggatcttgccaagaagatttggtgctttggacctgagaccactggcccgaacatggttgttgatatgtgtaagggagtacagtatcttaatgaaatcaaggactctgttgtggctggcttccagtgggcatcaaaagaaggtgcattggctgaggagaacatgcgaggaatttgctttgaggtctgtgatgttgtgctccacactgatgccattcacagaggcggtgggcaggttatccctacggccaggagggtcatttatgcttctcagctcactgctaagccaaggctgctggagcctgtctacctggtggagatccaggccccggagaacgcacttggtggtatttatggtgttctgaatcagaagagagggcatgtgttcgaggagatgcagaggcctggtaccccactttacaacatcaaggcttacctccctgttatcgagtcctttgggttttcaagcacactaagggctgcaacatccggtcaggcattccctcagtgtgtgtttgaccactgggatatcatgtcttccgatcccttggaggccggcacccagtctgccacccttgtcacggagatccgcaagaggaaggggctcaaggaacaaatgactcctctatctgaatttgaggacaagctctaagaattttggtgctgttttatcctgctattaagagaatttgtatcttttggtactcttatttccttgagttgtctaatgcctgtcaaacgatcatattactgtctggcatgttgtaccaccgtatggttaagtcgtagtgttttctgattatgccttcattttctcgtgggtcttcagagtttcagttcactgtttgtgcttctactgcatgttggccgttttgctctttagctacggagtatatttctgtttctgccctctatttggtgctttgccaagaagagatgtgtatgttttgtttctttgttcacttgcttggggtgtgaacatgttttagaggccggtgctgagttgcttaataacctgcacgcattactgcggtttctttttccttttcattgcgtgccgttatctctta

SEQ ID NO: 2038 - DNA, 2425 bp, Triticum aestivum
cagtcaagatggtgaagtttacagcggaggagctccgtggaatcatggacaaaaagaacaatatccgtaacatgtcggttattgctcatgtagaccacggcaagtctacgcttacggattcccttgtggcagctgctgggattatcgcccaggaagttgctggggatgttcgcatgactgatacccgtgcagatgaggcagagcgtggtattacaatcaaatccacgggtatctctcttttctatcagatgactcctgaatcactcgagatgtacaagggcgacagggatggtgatgagtacctgatcaaccttattgattcacctggccacgttgacttttcttcagaagtcacagctgctcttcgtatcactgatggtgccttggttgttgttgactgtattgagggtgtctgtgtgcagactgaaactgtgctgcgccaagctcttggtgagaggattaggcctgtccttactgtgaacaagatggacagatgctttcttgagcttcagtttgaaggtgaggaagcataccagactttctcccgtgtcattgaaaatgccaatgtcatcatggcaacatatgaagatgtgctccttggtgatgtccaagtgtacccagagaagggtactgttgcattctctgctggtttgcatggatgggctttcacccttacaaactttgctaagatgtatgcctccaagtttggtgttgatgaggtgaagatgatggagaggctgtggggtgagaacttctttgacccagccacaaagaaatggacctccaagaacactggcacagctacctgcaagagaggttttgttcagttctgctacgagccaatcaagcaaatcatagccacctgcatgaatgatcagaaggataagttgtggcctatgttgaagaagcttggtgtgacgatgaagaatgatgagaaggacttgatgggcaaggctctcatgaagcgtgtgatgcaaacttggctgcctgccagtcgtgctctgcttgagatgatgatatttcacctcccctctccctcgaaggcacagaggtatcgtgtggagaacttgtacgagggtccccttgatgatatatatgctaatgctatcagaaactgcgaccctgatggtcctcttatgctgtatgtctccaagatgattccagcatctgacaagggtagattctttgcctttggacgcgtttttgccgggagggtcgcaactggcatgaaggtccgtatcatgggtcccaactttgttcctggccagaagaaggatctatatgtgaagagtgtccagcggactgttatctggatgggaaagaagcaagagtctgttgaggatgttccctgtggtaacactgttgctttggttggtttggatcagttcatcaccaagaatgcaaccctgacaaatgagaaggaagttgatgcctgcccaatcagggctatgaagttctctgtgtcccctgttgtgcgtgttgccgttcagtgcaaggtggcatctgatcttcctaagcttgttgagggtttgaagcgtctggccaagtctgatcctatggttctctgtaccattgaagagtctggtgagcatatcattgctggagctggagagcttcatcttgaaatctgtctgaaggatctgcaggatgacttcatgggtggtgctgaaattattgtttcccctcctgttgtttccttccgtgagactgttctggagaagtcctgccgcactgtcatgagcaagtcccccaacaagcataaccgtctttacatggaagctcgcccattggaggagggattggctgaggctatcgatgatggccgcattggcccgcgtgatgatcccaaggtgcggtccaagatcctatctgaggagtttggttgggacaaggatctcgccaagaagatttggtgctttggacctgagacgactggccccaacatggttgttgacatgtgtaagggagtgcagtatctgaatgaaatcaaggactctgttgtggctgggttccagtgggcatcaaaagagggagcattgtgtgaggagaacatgcgtggcatctgctacgaggtctgtgatgttgttctccacactgatgctattcacaggggtggtggtcaggttatcccaacggcgaggagggtcatttacgcttctcagctcaccgccaagccaaggctgctggagcccgtgtacctggttgagatccaggcccccgagaacgcacttggtggtatctatggtgtgctgaatcagaagagaggccacgtgttcgaggagatgcagaggcaaggtaccccactgtacaacatcaaggcctacctgcctgtcatcgagtccttcgggttctcgagcaccctgagggctgcgacgtccggccaggccttcccccagtgtgtgtttgaccactgggacatcatggc

SEQ ID NO: 2039 - DNA, 2943 bp, Brachypodium distachyon
ggaattatattcatagacagatactcaaaagcagtcgagatggtgaagttcacagcagatgacttccgtgggattatggacaagaagaataacatccgtaacatgtctgttattgctcatgtggaccatggcaagtctacgcttacagattcccttgtggctgctgctggcattattgcacaggaggttgctggtgacgttcgcatgactgatactcgtgcagatgaagcagagcgtggtattacaatcaaatcgactggcatctctctttactatgagatgactgctgaatcactccgggcatacaagggtgagagagatgggaatgaatacctgatcaaccttattgattcacctgggcatgttgatttctcatctgaagtcacagctgctcttcgtataactgatggtgctttggtggtggttgactgtattgagggtgtttgtgtgcaaactgaaactgtgctgcgccaagcacttggtgagaggattaggcctgtccttactgtgaacaagatggaccggtgcttccttgagcttcaagttgaaggtgaggaagcctaccagaccttctcccgtgtcatcgagaatgccaatgtcattatggcaacatatgaagatgcgctccttggtgatgtccaagtctaccctgagaagggaactgttgctttctctgctggtttacatggctgggcatttactctcacgaactttgctaagatgtatgcctctaagtttggagttgatgaatctaagatgatggagaggctctggggtgagaacttctttgacccaaccacaaaaaaatggaccagcaagaacactggctctcctacttgtaagagaggctttgttcaattctgctatgatccgatcaagcaaatcatcaacacctgcatgaatgaccagaaggataaattgtggccaatgttgcagaagcttggtgtgaccatgaagactgatgaaaaggagttaatgggcaaggctctcatgaagcgcgttatgcaaacttggctgccagctagtactgctctgcttgagatgatgatattccacctcccctccccttccaaagcacagaaatatcgtgtggagaacttgtatgagggcccccttgatgatatctacgcaactgcgattagaaactgtgacccagatggtcctcttatgctatatgtttccaagatgattccagcatctgacaggggcagattctttgcgtttggtcgggtcttctctgggaaggttgcaactggcatgaaggtccggatcatgggccccaactatgtccctggccagaagaaggatctgtatgtgaagagtgtccagcgtactgttatatggatgggaaagaagcaagaatctgttgaggatgttccttgtggtaatactgttgctatggttggtttggatcagttcatcacaaagaatgctaccctgacaaatgagaaggaggttgatgcatgccccattagagcaatgaaattctctgtatcccctgttgtacgtgtcgcggttcagtgcaaggttgcctcagatcttcccaaacttgttgaaggtttgaagcgtctcgcaaagtctgatcctatggttctctgtaccatggaagagtctggtgagcatattattgctggagctggagaactgcaccttgaaatttgcttgaaggatctgcaggaggacttcatgggtggtgctgaaattattgtttctcctcctgttgtctctttccgtgagaccgttcttgagaagtcctgccgtactgttatgagcaagtctcccaacaagcacaaccgtctatatatggaagctcgccccctggaggagggactggctgaggccatcgatgatggccgcattggccctcgtgatgatcctaaggtgcgctccaagatcctgtccgaggagtttggttgggacaaggaccttgccaagaagatttggtgttttggacctgagaccactggcccaaatatggttgttgacatgtgcaagggagttcaatatctcaatgaaatcaaggattccgttgtggctggattccagtgggcatcgaaagaaggtgcattggcagaggaaaacatgcgaggcatttgctttgaggtctgtgatgtcgttctccacactgatgctattcataggggtggtggtcaggtcatcccaacagccaggagagtcatatatgcttctcagctcacagccaagccaaggctgctagagcctgtatatcttgtggagatccaggcccctgagaatgcacttggtggtatctatggtgttcttaaccagaagagagggcacgtgtttgaggagatgcagaggcctggtaccccactgtacaatatcaaggcttacctccctgttatcgagtccttcggtttctccagcacacttagggctgcaacctctggccaggccttcccgcagtgtgtgtttgatcactgggacactatgtcttctgatcctttggatgcaggatcccaagcggcgcagctggtcgtggatatccgcaagaggaagggactgaaggaacagatgactcctctctccgacttcgaggacaagctctaaatttttgctctcatatgatctgctatcaccccatttttggtctacttagtttgttaggagaaattaccttttgttcggattcagctctttaggttgtcagatgaaccagttttgtgcgtcctgtatggtagcgtgctaccgaatattttcctatccgtcttcttatgtttggttcattggtacattttcctgagtgctgctttccgtctcgtctaatttccggttgaactttgagaactggccccgtagtttcatgttaagttagtcaattgttcatctaaccatgatggggtgtgttgaacacttgatcatcacgccaagtcaccaatttaagttttttatatattatatactctcatgtcgttagaattg

SEQ ID NO: 2040 - DNA, 2826 bp, Avena sativa
ccccaatcccctaaacccgccgccgccgccgcttcctcgtctcttccctccgatccggaggcggacgcgaaggaacttgtatttccagagtgattttcagaagtagtcaagatggtgaagtttactgcggaggagctccgcaggattatggacaaaaagaataacatcaggaacatgtctgttattgctcatgttgaccatggaaagtctacccttaccgactcccttgtggccgctgctgggattattgcccaggaagttgctggtgatgtccgcatgactgatacccgtgcagatgaggcagaacgtggtattacaatcaaatccactggtatctctcttttctatgagatgactgatgaatcacttgcaagctacaagggtgagagggatgggaacgagtacttgatcaacctgattgattcacctggccacgttgatttttcttctgaagtcacagctgctcttcgtattactgatggtgctttggtggtggttgactgtattgagggtgtctgtgtgcagaccgaaactgttctgcgccaggctcttggtgagaggattagacctgtccttactgtcaacaagatggacaggtgtttccttgagcttcaagtggatggtgaggaagcttatcagactttctcccgtgtcattgagaatgccaatgtcatcatggcaacatatgaagatgttctccttggtgatgtccaagtctacccggagaaggggactgttgctttctctgctggtttgcatgggtgggcttttacccttacaaactttgctaagatgtatgcctccaagtttggtgttgatgaatcaaaaatgatggagaggctgtggggtgagaacttctttgacccagccacaaagaaatggacgacaaagagcactggcacagctacctgcaagagaggttttgttcagttctgctatgagccaatcaagcaaatcatcgagatctgtatgaatgatcagaaggataagttgtggcctatgttgaagaagcttggtattgtcatgaagaatgatgagaaggacctaatgggcaagcctctgatgaagcgtgtcatgcaaacttggcttcctgccagtcgtgctctgcttgagatgatggtgtatcacctgccctctccctcgaaggcccagaggtatcgtgttgagaacctgtacgagggcccccttgatgatatatatgcaaatgctatcagaaactgtgaccctgatggtcctcttatgctgtacgtttccaagatgattccagcatctgacaagggcagattctttgcctttggtcgtgtttttgctgggaaggttgcaactggcatgaaggtccgtatcatgggtcccaactatgttcctggccagaagaaagatctctacaccaagagtgtccagcgtactgttatctggatgggaaagaagcaagagtctgttgaggatgttccctgcggtaacactgttgctttggttggtttggatcagttcatcacgaagaatgctaccctgacaaatgagaaggaagttgatgcctgcccaatcagagccatgaagttctctgtgtctcctgttgtgcgtgttgctgttcagtgcaaggtggcctctgatcttcctaagcttgttgaaggcttgaagcgtctggccaagtctgatcctatggtcctctgctccatcgaggagtctggtgagcatatcattgctggagctggtgagcttcaccttgagatttgcttgaaggatctgcaggatgacttcatgggaggtgctgaaattattgtttcccctcctgttgtctccttccgtgagactgtcctggacaagtcatgccgtactgttatgagcaagtccccgaacaagcacaaccgtctctacatggaggctcgcccgttggaggaaaatctgccagaggccattgatgatggacgcattggcccacgtgatgaccctaaggtgcgctccaagatcctatctgaggagtttggttgggacaaggatctcgccaagaagatttggtgctttggacccgagaccactggccccaacatggttgttgatatgtgtaagggagtgcagtacctgaatgagatcaaggactctgttgtggccgggttccagtgggcttccaaggaaggtgcactggctgacgagaacatgcgtggcatctgttttgaagtctgtgatgttgtcctccacactgatgctattcacaggggtggtggtcaggttattccaacggccaggagggtcatatttgcctctcagctcactgccaagccaaggctgctggagcctgtctaccttgttgagatccaggcaccagagaacgcacttggtggaatctatggtgtgctgaaccagaagagagggcacgtgtttgaggagatgcagaggccaggtaccccactgtacaacatcaaggcttacctccctgtcattgagtctttcggtttctctgccaccctcagggctgccacatcgggccaggctttcccccagtgtgtgtttgaccattgggacgtcatgaactctgatcctctggaggttggctctcagtctcatgccctcgtcctggacatccgcaagaggaaggggctcaaggaacagatgactcccctgtctgaattcgaggacaagctctaagttctgggtcggtgttttgctactcagctctttctctttcagagagctctactttatttctatgagttggtcttgtatcgtaatgaacctatctgtcgtgatattggtagtgtgctgagactatgttttgctatatctgtcgtggtgtaacagattttaaacttagatatgtctgtcgtaagt

SEQ ID NO: 2041 - DNA, 2834 bp, Avena sativa
ttccttcctcccccaatcccctaaacccgccgccgccgccgcttcctcgtctcttccctccgatccggaggcggacgcgaaggaacttgtatttccagagtgattttcagaagtagtcaagatggtgaagtttactgcggaggagctccgcaggattatggacaaaaagaataacatcaggaacatgtctgttattgctcatgttgaccatggaaagtctacccttaccgactcccttgtggccgctgctgggattattgcccaggaagttgctggtgatgtccgcatgactgatacccgtgcagatgaggcagaacgtggtattacaatcaaatccactggtatctctcttttctatgagatgactgatgaatcacttgcaagctacaagggtgagagagatgggaacgagtacttgatcaacctgattgattcacctggccacgttgatttttcttctgaagtcacagctgctcttcgtattactgatggtgctttggtggtggttgactgtattgagggtgtctgtgtgcagactgagactgttctgcgccaggctcttggtgagaggattaggcctgtccttactgtcaacaagatggacaggtgtttccttgagctacaagtggatggcgaggaagcttatcagactttctcccgtgtcattgagaatgccaatgtcatcatggcaacatatgaagatgttctccttggtgatgtccaagtctacccagagaaggggactgttgctttctctgctggtttgcatgggtgggcttttacccttacaaactttgcgaagatgtatgcctccaagtttggtgttgatgaatcaaagatgatggagaggctttggggtgagaacttctttgacccagccacaaagaaatggacgacaaagagcactggcacagctacctgcaagagaggttttgttcagttctgctatgagccaatcaagcaaatcattgagatctgtatgaatgatcagaaggataagttgtggcctatgttgaagaagcttggtattgtcatgaagaatgatgagaaggacctaatgggcaagcctctgatgaagcgtgtcatgcaaacttggcttcctgccagtcgtgctctgcttgagatgatggtgtatcacctgccctctccctcgaaggcccagaggtatcgtgttgagaacctgtacgagggcccccttgatgatatatatgcaaatgctatcagaaactgtgaccctgatggtcctcttatgctgtatgtttccaagatgattccagcatctgacaagggcagattctttgcctttggtcgtgtttttgctgggaaggttgcaactggcatgaaggtccgtatcatgggtcccaactatgttcctggccagaagaaagatctctacaccaagagtgtccagcgtactgttatctggatgggaaagaagcaagagtctgttgaggatgttccctgcggtaacactgttgctttggttggtttggatcagttcatcacgaagaatgctaccctgacaaatgagaaggaagttgatgcctgcccaatcagagccatgaagttctctgtgtctcctgttgtgcgtgttgctgttcagtgcaaggtggcctctgatcttcctaagcttgttgaaggcttgaagcgtctggccaagtctgatcctatggtcctctgctccatcgaggagtctggtgagcatatcattgctggagctggtgagcttcaccttgagatttgcttgaaggatctgcaggatgacttcatgggaggtgctgaaattattgtttcccctcctgttgtctccttccgtgagactgtcctggacaagtcatgccgtactgttatgagcaagtccccgaacaagcacaaccgtctctacatggaggctcgcccgttggaggaaaatctgccagaggccattgatgatggacgcattggcccacgtgatgaccctaaggtgcgctccaagatcctatctgaggagtttggttgggacaaggatctcgccaagaagatttggtgctttggacccgagaccactggccccaacatggttgttgatatgtgtaagggagtgcagtacctgaatgagatcaaggactctgttgtggctgggttccagtgggcttccaaggaaggtgcactggctgacgagaacatgcgtggcatctgttttgaagtctgtgatgttgtcctccacactgatgctattcacaggggtggtggtcaggttattccaacggccaggagggtcatatttgcctctcagctcactgccaagccaaggctgctggagcctgtctaccttgttgagatccaggcaccagagaacgcacttggtggaatctatggtgtgctgaaccagaagagagggcacgtgtttgaggagatgcagaggccaggtaccccactgtacaacatcaaggcttacctccctgtcattgagtctttcggtttctctgccaccctcagggctgccacatcgggccaggctttcccccagtgtgtgtttgaccattgggacgtcatgaactctgatcctctggaggttggctctcagtctcatgccctcgtcctggacatccgcaagaggaaggggctcaaggaacagatgactcccctgtctgaattcgaggacaagctctaagttctgggccggtgttttgctactcagctctttctctttcagagagctctactttatttctatgagttggtcttgtatcgtaatgaacctatctgtcgtgatattggtagtgtgctgagactatgttttgctatatctgtcgtggtgtaacagatgttaaacttagatatgtctgtcgtaa

SEQ ID NO: 2042 - DNA, 3305 bp, Oryza sativa
gcgagatatttcctctcccccggtgggccgagccgccacgccacaccgccccctgtatcgctcactcgcttactatatagccagaggggagggagcgggtagggttttacctcctcccccccgcagcgccgccgccgccacacactcccccacatctccccttcccttccactcctcctcctcctcggatcgggaggcggagcgagcaatcccccaaggaatttgtatttgtagcgtgatttgcaaagctagtcaagatggtgaagttcacagtagaagagctccgccggatcatggacaagaagaataacatccgtaatatgtccgtcattgctcatgtggaccacggaaagtctacacttacggattctcttgtggcggctgctggtattattgcccaggaagttgcgggtgatgttcgcatgactgatacccgtgcagatgaagctgagcgtggtattacaatcaaatccactggtatctctcttttctatgagatgagtgatgaatcactcaagttgtacaagggtgagagagatggaaatgagtacctgatcaaccttattgattcacctgggcacgttgatttttcttcggaggtcactgctgctcttcgtattactgatggtgctttggtggttgttgactgtattgagggtgtctgtgtgcaaactgaaactgtgcttcgccaagcccttggtgagaggattaggcctgtccttactgtgaacaagatggacaggtgcttccttgagcttcaagttgaaggtgaggaggcctatcagaccttctcccgtgtcattgagaatgccaatgtcattatggcaacatatgaagacacactccttggtgatgtccaagtctaccctgagaagggaactgttgctttctctgctggtctgcatggctgggctttcacactctcgagctttgctaagatgtatgcttccaagtttggagttgatgaatttaagatgatggagaggctttggggtgagaacttctttgacccagccacaaagaaatggaccaacaagaacactggctcagctacctgcaaaagaggtttcgttcagttctgttatgagccgatcaagcaaatcatcaacacttgcatgaatgatcagaaggataagttgtggcctatgttgcagaagcttggtgtggtcatgaaggctgatgagaaggagcttatgggcaaggctctcatgaagcgtgttatgcaaacatggctgccagccagtaatgctcttcttgagatgatgatataccaccttccatctccgtccaaggcccagaggtaccgtgtggagaatttgtatgagggtcctcttgatgatgtctacgcaactgctatcagaaactgtgatccagaaggtcctcttatgctgtatgtttccaagatgattcccgcatcagacaaaggtaggttctttgcctttggtcgtgtcttctctgggagggttgcaactggcatgaaggtgcgtatcatgggtcccaactatgtccctggccagaagaaggatctgtatgtgaagagtgtccagcgtactgtcatctggatgggaaagaaacaagagtctgttgaggatgttccctgtggtaacactgttgctatggttggtttggatcagttcatcaccaagaatgccaccctgactaatgagaaggagtcagatgcctgcccaatcagagcaatgaagttctcagtgtcccctgttgtgcgtgttgctgttcagtgcaaggttgcctctgatctgcccaagcttgttgagggtttgaagcgtctggcgaagtctgatcctatggtgctctgtactattgaggagtctggtgagcatatcattgctggtgctggagagcttcaccttgaaatttgcttgaaggatctgcaggaagatttcatgggtggtgctgaaatcattgtttccccacctgttgtttctttccgtgagactgtccttgagaagtcgtgccgtactgttatgagcaagtccccgaacaagcacaaccgtctctacatggaagctcgccccttggaggagggattggctgaggccattgatgacggtcgtattggcccacgtgatgatcccaaggtgcgctccaagatcctgtctgaggagttcggctgggacaaggatcttgcaaagaagatttggtgttttggacctgagacaactggccccaacatggtggttgatatgtgtaagggagttcagtatctgaatgaaatcaaggattccgttgtggctggtttccagtgggcatcaaaggagggtgctctggctgaggagaacatgcgtggtatctgctttgaggtgtgcgatgttgttctccatgctgatgctattcacagaggtggtggccaggtcattcccacggccaggagggtcatctatgcttctcagctcacagcaaagcccaggcttcttgagcccgtctacctggtggagatccaggcccctgagaatgcccttggtggtatctatggtgttctgaaccagaagagaggacatgtgttcgaggagatgcagaggcctggtacccctctgtacaacatcaaggcttacctccctgtcatcgagtcctttgggttctcaagccagcttagggctgcgacatctggccaggccttcccccagtgtgtgttcgaccattgggacatgatgacctctgatcctcttgaagctggctcgcaggcttcaaccctggtgcaggatatccgcaagaggaagggtctcaaggagcagatgactcccctctccgatttcgaggacaagctctaaatttttggccgccgcatgtgttgtgccgttacccttacatgttctagttggtctactgctaagagaactgctttcgttgtcgtatttcatttcccttttgtcgaatgcatgtgtttcacatcaacaatcctatgttcgcgtgctactgagaaactatttttactctgtcgtgatgtaacggatgtggaacctggatcatctttttgctgtctaagttatagtgttcacattcttgttgcgtttctgttgagtggtatttattgtttcctttggcttgccgttgtaagtccgcttatttttgttccgttcttcctagtttgtagttgttacttggtagaacctattctgttgtgtgttcttctagtttgtacctggcacttggtactaccagttctgttgttctagtttgtaggtacttcatactatgacgtatctagtttgtaggtacttggtactatgacgtatcttgcctgttctagtttgtaggttactacgacgtatgttgccgtttgatca

SEQ ID NO: 2043 - DNA, 2623 bp, Secale cereale
cttacggtttcccttgtggcagctgctggaattatcgcccaggaagttgctggtgatgtccgcatgactgatacacgtgcagatgaagcagaacgtggtattactatcaaatccacgggtatctctctgttctatcagatgactcctgaatcacttgagatgtacaagggtgacagagatggggatgagtacctgatcaaccttattgattcacctggtcacgttgacttttcttcggaagtcacagctgctcttcgtatcaccgatggtgctttggtggtggttgactgtattgagggtgtctgtgtgcagactgaaactgtgctgcgccaagctcttggtgagaggattaggcctgtcctcaccgttaacaagatggacagatgcttccttgagcttcaagtggaaggtgaggaagcataccagactttctcccgtgtcatcgaaaatgccaatgtcatcatggcaacatatgaagatgtgctccttggtgatgtccaagtgtacccagagaaggggactgttgcattctctgctggtttgcatgggtgggctttcacccttacaaactttgctaagatgtatgcctccaagtttggagttgatgaggcgaagatgatggagaggctgtggggtgagaacttttttgacccagccacaaagaaatggacctccaagaacactgggacagctacctgcaagagaggttttgttcagttctgctacgagccaatcaagcaaatcatagcaacctgcatgaatgatcagaaggataagttgtggcctatgttgaagaagcttggtgtgaccatgaagaatgatgagaaggacttgatgggcaaggctctcatgaagcgtgtgatgcaaacttggctgcctgccagtcgtgctctgcttgagatgatgatatttcacctcccctctccttcaaaggcacagaggtatcgtgtggagaacttgtatgagggggcctcttgacgatatatatgcaaatgctatcagaaactgtgaccctgacggtcctcttatgctgtatgtctccaagatgattccagcatctgacaagggtagattctttgcctttggacgtgtttttgccgggagggttgcaactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcacgaagaatgcaaccctgacaaatgagaaggaagttgatgcctgcccaatcagggcaatgaagttctctgtgtcccctgttgtgcgtgttgctgttcagtgcaaggtggcatctgatcttcctaagcttgttgagggtttgaagcggctggcgaagtctgaccctatggttctctgtagcattgaggagtctggtgagcatatcattgctggagctggagagcttcaccttgaaatctgtttgaaggatctgcaggaggacttcatgggtggtgctgaaattattgtttccccctcctgttgtctccttccgtgagactgttctggagaagtcctgccgcactgtcatgagcaagtcccccaacaagcataaccgtctttacatggaagctcgcccattggaggagggattggctgaggctattgatgatggccgcattggcccacgtgatgatcctaaggtgcgctccaagatcctgtctgaggagttcgggtgggacaaggatcttgccaagaagatttggtgctttggacctgagacgactggccccaacatggttgttgacatgtgtaagggagtgcagtatctgaatgaaatcaaggattctgttgtggctggtttccagtgggcatcaaaggaaggtgcattggctgaggagaacatgcgtggcatctgctttgaggtctgtgatgttgttctgcacactgatgctattcacaggggtggtggtcaggtcatcccaacagccaggagggtcatttatgcttctcagctcactgctaagccaaggctgctggagcctgtgtacctggttgagatccaggccccagagaacgcactcggcggtatctatggtgtgctgaatcagaagagagggcacgtgtttgaggagatgcagaggcctggtaccccgctgtacaacatcaaggcttacctccccgtcatcgagtcgttcgggttctcaagtaccctcagggctgcgacgtctggccaggctttcccccagtgtgtgttcgaccactgggacatcatgtcttctgatcctttggaggccggctcccagtctgcgaccctcgtcacggagatccgcaagcgcaagggtctgaaggaacagatgacccctctgtctgatttcgaggacaagctctaaacttttggttctgttacatggtctagtttgcttttgctgctaagagagctgcactatattttctgtttattgagtcctggctgtattgctattggaatgtcctatctgtcgtggtactggtactttgttttgatgtctatcgatgttaaaacatagattatatatctgttatctactggtagttcttatgt

SEQ ID NO: 2044 - DNA, 3085 bp, Panicum virgatum
aaaaaaaactagcgtgtttttttttctttagtcccggccggcgtgagccttgcggcgaccgacggcctggatcgcccgtgggatatttcttgcccggtgcggcaactccgcagctataaatattctcactgggcggcggctagggttactgcttctctcccggcggcgcctccacatctcgtctctcagatcgggaggcgaaaccaagcaggaaaatatatatttgtagtgtgatcctcaaaagaagtcaagatggtgaagttcacggcagaggagctccgtgccatcatggacaaaaagaacaacatccgtaatatgtctgttattgcccatgtggaccacggcaagtctacccttacagactcccttgtggcagctgctgggattattgcccaggaagttgctggtgatgttcgcatgactgatacccgcgcagatgaagcagagcgtggtattacaatcaaatccaccggtatctctctttactatgagatgactgcagagtcactgaagaactacaagggtgagagagatggtaatgagtacttgatcaaccttattgactcacctggccatgtcgatttttcttcggaagtgacagctgcccttcgtatcaccgatggtgctctagtggtggttgactgtattgaaggtgtctgtgtgcaaactgagactgtgctccgccaggctcttggtgagaggattaggccagtccttactgtgaacaagatggacaggtgcttccttgagcttcaggttgagggggaggaagcctaccagactttctcccgtgtgattgagaatgccaacgtcattatggcaacatatgaagataagctcctcggtgatgtccaagtctacccggagaagggaactgttgctttctctgctggtctgcacggctgggccttcaccctcaccaactttgccaagatgtatgcatccaagtttggagttgatgaatctaagatgatggagaggctctggggtgagaacttctttgacccggccacgaagaagtggacaaccaagaacacaggctcggctacctgcaagagaggatttgttcagttctgctatgagcccatcaagcaaatcatcaacacctgcatgaacgaccagaaggataagttgtggcccatgcttcaaaagcttaatgttaccatgaaggctgatgagaaggagttggttggcaaggctttgatgaagcgtgttatgcaaacctggcttccagctagtaccgcattgcttgagatgatgatattccaccttccttccccagcaaaggcacagaagtatcgtgtggagaatctgtacgagggaccccttgatgatatctatgctactgccatcagaaactgtgatccggagggtcctctcatgctgtatgtttcaaagatgattccagcatctgacaaagggcggttctttgccttcggtcgtgtcttctctggcaaggttgctaccggtatgaaggttcggatcatgggtcccaactatgtgcctggccagaagaaggatctgtacgtcaagagtgtccagcgtactgttatctggatgggaaagaaacaagagtctgttgaggatgttccctgtggtaacactgttgctatggtcggtctggatcagttcatcacgaagaatgctacactcaccaatgagaaggaagtcgatgcatgcccaatcagagcaatgaagttctcagtgtcccctgttgtgcgtgttgctgttcagtgcaaggttgcctctgacctgccgaagctagttgaaggtttgaagcgtctggccaagtctgatcctatggtcctctgtaccattgaagaatctggtgagcatattatttctggagctggtgagcttcaccttgagatctgcctgaaggatctgcaggaagacttcatgggtggtgctgaaattattgtttcccctcctgttgtctctttccgtgaaactgttcttgagaaatcctgcagaactgtcatgagcaagtctcccaacaagcacaaccgtctctacatggaagcccgcccgttggaagagggtcttgctgaggctattgatgagggacgcattggtccacgtgatgatcccaaggtgcgctcaaagatcctctctgaggagtttgggtgggacaaggatcttgccaagaagatttggtgctttggacctgagaccaccggccctaacatggttgttgatatgtgtaagggagtgcagtatctcaatgaaatcaaggattctgttgtggctggcttccagtgggcctcgaaggagggagcacttgctgaggagaacatgcgtggcatttgctttgaggtctgtgatgttgttcttcatgctgatgccattcacaggggtggtggccaggtcattccaactgccaggagggtcatctatgcttctcagctcacggccaagccaaggctgctggagccagtgtaccttgtggagatccaggctcctgagaatgcacttggtggtatctacggtgttctgaaccagaagagagggcacgtgtttgaggagatgcagaggccgggtaccccgctctacaacatcaaggcttacctccctgtcattgagtcctttgggttctccagccagctgagggctgcaacctctggtcaggcgttccctcagtgtgtgtttgaccactgggacatgatgggctctgatcctttggaggctggctcccaggctgctcagctggtgttagacatccgcaagaggaagggtctcaaggagcagatgaccccgctttccgagttcgaggacaagctctaaatttttggccttttgtggtactgttacccccctgctggtttaatcgtccattcgtctactgtaatggaactatttttgtatttcatttcctttagtggtcaaatgcttctgtttctgaacatcattagccatatggtagtgccctgctaaaactgtttttatgctttgtgatgtaacagattaaacagaattggtatttgtggtttatgcggtggtatttgtggtataatcttgtttcaactgtctcgtgaatattttcctttgatatcttgttgatagaatttcactgtttgttgcctta

SEQ ID NO: 2045 - DNA, 2993 bp, Setaria italica
tctctcccggcggcgcctccacatctcgtctctcagatcgggaggcgaaacccagcaggaaattatatacatatttgtagtgtgatcttcataagaagtcaagatggtgaagttcacagcggaagagctccgtgccatcatggacaaaaagaacaacattcgtaatatgtccgttattgctcatgtggaccacggcaagtctacccttacagattcccttgtggcagctgctgggattattgcccaggaagttgctggtgatgtccgcatgactgatacacgtgcagatgaagcagagcgtggtattacaatcaaatccaccggtatttctctgtactatgagatgactgatgagtcactgaagagttacaagggtgagagagatggtaaccagtacttgatcaaccttatcgactcacctgggcatgttgatttttcttcggaagtcacagctgcccttcgtatcaccgatggtgctctagtggtggttgactgtattgaaggtgtctgtgtgcaaactgaaactgtgctccgccaggctcttggtgagaggattaggccagtgcttactgtgaacaagatggacaggtgtttccttgagcttcaggttgagggtgaggaagcctaccagactttctcccgtgtcattgagaatgccaatgtcattatggcaacatatgaagataagctccttggtgatgtccaagtctacccggagaagggaactgttgctttctctgctggtctgcacggctgggcctttaccctcaccaactttgccaagatgtatgcttcgaagtttggagttgatgaaactaagatgatggagaggctctggggtgagaacttctttgacccagcgacaaagaagtggaccaccaagaacacaggctctgctacctgcaagagaggatttgttcagttctgctatgagccaatcaagcaaatcatcaacacctgcatgaatgaccagaaggataagttgtggcccatgcttcaaaagcttaatgttaccatgaagtctgatgagaaggaattggttggcaaggctttgatgaagcgtgttatgcaaacttggcttccagctagtactgcactgcttgagatgatgatattccaccttccttccccatcaaaggcacaaaagtatcgtgtggagaacttgtacgagggaccccttgatgatatctatgctactgctatcaggaactgtgatccggagggtcctcttatgctgtatgtttctaagatgattccagcatctgacaagggcaggttctttgcctttggtcgtgtcttctctgggaaggttgctactggtatgaaggttaggatcatgggtcccaactatgtccctggccagaagaaggatctgtacgtcaagagtgtccagcgtactgttatctggatgggaaagaaacaagagtctgttgaggatgttccttgtggtaacactgttgctatggttggtctggatcagttcatcacgaagaatgctacactcaccaatgagaaggaggttgatgcatgcccaatcagagcaatgaagttctctgtctcccctgttgtgcgcgttgctgttcagtgcaaggttgcctctgacctacccaagctcgttgaaggtttgaagcgtctggcaaagtctgatcctatggtcctctgtacaattgaagaatctggtgagcatattattgctggagctggtgagcttcaccttgagatttgcctgaaggatctgcaggaagacttcatgggtggtgctgaaattattgtttctcctcctgttgtctctttccgtgaaactgttcttgagaaatcctgccgaacagtcatgagcaagtcccccaacaagcacaaccgtctttacatggaagcccgtcccttggaagagggtctccctgaggctattgatgagggccgcattggtccacgtgatgatcccaaggtacgctccaagatcctctctgaggagtttggttgggacaaggatcttgccaagaagatttggtgctttggacctgagaccactggcccgaacatggttgttgatatgtgtaagggagtgcagtacctcaatgaaatcaaggattctgttgtggctggcttccagtgggcctcaaaggagggtgcactggccgaggagaacatgcgtggcatctgctttgaggtctgtgatgttgttcttcatgctgatgcaattcacaggggtggtggccaggtcattccaactgccaggagggttatttatgcttctcagctcactgccaagccaaggctgctcgagccagtttaccttgtggagatccaggccccagaaaatgcacttggtggtatctatggtgttctgaaccagaagagagggcacgtgtttgaggagatgcagaggcctggtaccccgctctacaacatcaaggcttacctccctgtcatcgagtccttcgggttctccagccaactgagggctgcaacctctggccaggcgttccctcagtgtgtgtttgaccactgggacatgatgggctctgatcctctggaggccggctcccaggctgctcagctggtgttggatatccgcaagaggaagggtctcaaggagcagatgacccctctttctgagttcgaggacaagctctaaattttggtggtttgtgctgctgttacccatgctggtttcatggccaattcgtctactgtaacgggaactactttcatgtttcatttcctttagttgtcagatgcatctgtttttgaacatcattggccatatggcattgtgctgctaagactgtattttgttatccggttgtgatgtaacagatgaaatagagttcgtatctgtggtttaagtggtagtatttgcggtataatgcttgtttctactgccttctgaaagcctttcttttgcctaacggtagagcggattaactaagggtgttgtatcatttgattcatttgatccttcatcaaggatgaagccatctcctcatgggaac

SEQ ID NO: 2046 - DNA, 2944 bp, Setaria italica
ggatatttcttgcccggtgcgtcaactccgccgctataaataccctcatagggcggccgctagggttttagtgcttctctcccggcggcgcctccacatatcgtctctcagatcgggaggcgaaaccaaggaaattatatacatatttgtagtgtgatcttcataagaagtcaagatggtgaagttcacagcggaagagctccgtgccatcatggacaaaaagaacaacattcgtaatatgtccgttattgctcatgtggaccacggcaagtctacccttacagattcccttgtggcagctgctgggattattgcccaggaagttgctggtgatgtccgcatgactgatacacgtgcagatgaagcagagcgtggtattacaatcaaatccaccggtatttctctgtactatgagatgactgatgagtcactgaagagttacaagggtgagagagatggtaaccagtacttgatcaaccttatcgactcacctgggcatgttgatttttcttcggaagtcacagctgcccttcgtatcaccgatggtgctctagtggtggttgactgtattgaaggtgtctgtgtgcaaactgaaactgtgctccgccaggctcttggtgagaggattaggccagtgcttactgtgaacaagatggacaggtgtttccttgagcttcaggttgagggtgaggaagcctaccagactttctcccgtgtcattgagaatgccaatgtcattatggcaacatatgaagataagctccttggtgatgtccaagtctacccggagaagggaactgttgctttctctgctggtctgcacggctgggcctttaccctcaccaactttgccaagatgtatgcttcgaagtttggagttgatgaaactaagatgatggagaggctctggggtgagaacttctttgacccagcgacaaagaagtggaccaccaagaacacaggctctgctacctgcaagagaggatttgttcagttctgctatgagccaatcaagcaaatcatcaacacctgcatgaatgaccagaaggataagttgtggcccatgcttcaaaagcttaatgttaccatgaagtctgatgagaaggaattggttggcaaggctttgatgaagcgtgttatgcaaacttggcttccagctagtactgcactgcttgagatgatgatattccaccttccttccccatcaaaggcacaaaagtatcgtgtggagaacttgtacgagggaccccttgatgatatctatgctactgctatcaggaactgtgatccggagggtcctcttatgctgtatgtttctaagatgattccagcatctgacaagggcaggttctttgcctttggtcgtgtcttctctgggaaggttgctactggtatgaaggttaggatcatgggtcccaactatgtccctggccagaagaaggatctgtacgtcaagagtgtccagcgtactgttatctggatgggaaagaaacaagagtctgttgaggatgttccttgtggtaacactgttgctatggttggtctggatcagttcatcacgaagaatgctacactcaccaatgagaaggaggttgatgcatgcccaatcagagcaatgaagttctctgtctcccctgttgtgcgcgttgctgttcagtgcaaggttgcctctgacctacccaagctcgttgaaggtttgaagcgtctggcaaagtctgatcctatggtcctctgtacaattgaagaatctggtgagcatattattgctggagctggtgagcttcaccttgagatttgcctgaaggatctgcaggaagacttcatgggtggtgctgaaattattgtttctcctcctgttgtctctttccgtgaaactgttcttgagaaatcctgccgaacagtcatgagcaagtcccccaacaagcacaaccgtctttacatggaagcccgtcccttggaagagggtctccctgaggctattgatgagggccgcattggtccacgtgatgatcccaaggtacgctccaagatcctctctgaggagtttggttgggacaaggatcttgccaagaagatttggtgctttggacctgagaccactggcccgaacatggttgttgatatgtgtaagggagtgcagtacctcaatgaaatcaaggattctgttgtggctggcttccagtgggcctcaaaggagggtgcactggccgaggagaacatgcgtggcatctgctttgaggtctgtgatgttgttcttcatgctgatgcaattcacaggggtggtggccaggtcattccaactgccaggagggttatttatgcttctcagctcactgccaagccaaggctgctcgagccagtttaccttgtggagatccaggccccagaaaatgcacttggtggtatctatggtgttctgaaccagaagagagggcacgtgtttgaggagatgcagaggcctggtaccccgctctacaacatcaaggcttacctccctgtcatcgagtccttcgggttctccagccaactgagggctgcaacctctggccaggcgttccctcagtgtgtgtttgaccactgggacatgatgggctctgatcctctggaggccggctcccaggctgctcagctggtgttggatatccgcaagaggaagggtctcaaggagcagatgacccctctttctgagttcgaggacaagctctaaattttggtggtttgtgctgctgttacccatgctggtttcatggccaattcgtctactgtaacgggaactactttcatgtttcatttcctttagttgtcagatgcatctgtttttgaacatcattggccatatggcattgtgctgctaagactgtattttgttatccggttgtgatgtaacagatgaaatagagttcgtatctgtggtttaagtggtagtatttgcggtataatgctt

SEQ ID NO: 2047 - DNA, 3176 bp, Panicum virgatum
cggaccgcacaggcgcagcacttccccaactgccccaagaaattgcgagatcggacggccaagcgccacgcaacgcccgcgaattccccgaattgaccctgcttttcccattgccagcctcacctgccgccggtctggatcgacaggaccaacggtccaggcgccgaatattcgcccgcgggatatttcttgcccggtgcggcaactccgccactataaatatcctcactgggcggcggctagggttttagtgcttctctcccggcggcgcctccacatctcgtctctcagatcgagaggcgaaaccaagcaggaaaatatatatttgtagtgtgatcttcaaaagaagtcaagatggtgaagttcacggcagaggagctccgtgccatcatggacaaaaagaacaacatccgtaatatgtctgttattgcccatgtggaccatggcaagtctacccttacagactcccttgtggcagctgctgggattattgcccaggaagttgctggtgatgttcgcatgactgatacccgcgcagatgaagcagagcgtggtattacaatcaaatccaccggtatctctctttattatgagatgactccagagtcactgaagaattacaagggtgagagagatggtaaccagtacttgatcaaccttattgactcacctgggcacgtcgatttttcttcggaagtgacagctgcccttcgtatcaccgatggtgctctagtggttgttgactgtattgaaggtgtctgtgtgcaaactgagactgtgctccgccaggctcttggtgagaggattaggccagtccttactgtgaacaagatggacaggtgcttccttgagcttcaggttgagggtgaggaagcctaccagactttctcccgtgtgattgagaatgccaacgtcattatggcaacatatgaagataagctcctcggtgatgtccaagtctacccggagaagggaactgttgctttctctgctggtctgcacggctgggcctttaccctcaccaactttgccaagatgtatgcatccaagtttggagttgatgaatctaagatgatggagaggctctggggtgagaacttctttgacccagccacgaagaagtggaccacgaagaacacaggctcggctacctgcaagagaggatttgttcagttctgctatgagcccatcaagcaaatcatcaacacctgcatgaacgaccagaaggataagttgtggcccatgcttcaaaagcttaatgttaccatgaaggctgatgagaaggagttggttggcaaggctttgatgaagcgtgttatgcaaacctggcttccagctagtactgcactgcttgagatgatgatattccaccttccttccccagcaaaggcacagaagtatcgtgtggagaatctgtacgagggaccccttgatgatgtctatgctactgccatcagaaactgtgatccggagggtcctctcatgctgtatgtttcaaagatgattccagcatctgacaaagggcggttctttgccttcggtcgtgtcttctctgggaaggttgctaccggtatgaaggttcggatcatgggtcccaactatgtgcctggccagaagaaggatctgtacgtgaagagtgtccagcgtactgttatctggatgggaaagaaacaagagtcagttgaggatgttccctgtggtaacaccgttgctatggtcggtctggatcagttcatcacgaagaatgctacactgaccaatgagaaggaagtcgatgcatgcccaatcagagcaatgaagttctctgtgtcccctgttgtgcgtgttgctgttcagtgcaaggttgcctctgacctgccgaagctagttgaaggtttgaagcgtctggccaagtctgatcctatggtcctctgtaccattgaagaatctggtgagcatattatttctggagctggtgagcttcaccttgagatctgcctgaaggatctgcaggaggacttcatgggtggtgctgaaattattgtttcccctcctgttgtctctttccgtgaaactgttcttgagaaatcctgcagaactgtcatgagcaagtctcccaacaagcacaaccgtctctacatggaagcccgcccgttggaagagggtcttgctgaggctattgatgagggacgcattggtccacgtgatgatcccaaggtgcgctccaagatcctctctgaggagtttggatgggacaaggatcttgccaagaagatttggtgctttggacctgagaccaccggcccgaacatggttgttgatatgtgtaagggagtgcagtatctcaatgaaatcaaggattctgttgtggccggcttccagtgggcctcgaaggagggagcacttgctgaggagaacatgcgtggcatttgctttgaggtctgtgatgttgttcttcatgctgatgccattcacaggggtggtggtcaggtcattccaactgccaggagggtcatctatgcttctcagctcacggccaagccaagactgctggagccagtgtaccttgtggagatccaggctcctgagaatgcacttggtggtatctacggtgttctgaaccagaagagagggcacgtgtttgaggagatgcagaggccgggtaccccgctctacaacatcaaggcttacctccctgtcattgagtcctttgggttctccagccagctgagggctgcaacctctggtcaggcgttccctcagtgtgtgttcgaccactgggacatgatgggctctgatcctttggaggctggctcccaggctgctcagctggtgttggacatccgcaagaggaagggtctcaaggagcagatgaccccgctttctgagttcgaggacaagctctaaatttttggccttttgtggtactgttaccccctgatggtttaatcgtccattcgtctgctgtaatggaactatttttgtatttcatttcctttagtggtcaaatgcttctgtttctgaacatcattagccatatggtagtgccctgctaaaactgttgttatcctttgtgatgtaacagatgaaacagagttggtatttgtagcataatcttgtttctactgtttattgattttttttcctttgatatctggttgatagaatttcactgtttgcttcttgccttgagctta

SEQ ID NO: 2048 - DNA, 2929 bp, Panicum virgatum
ggcggctagggttttagtgcttctctcccggcggcgcctccacatctcgtctctcagatcgagaggcgaaaccaagcaggaaaatatatatttgtagtgtgatcttcaaaagaagtcaagatggtgaagttcacggcagaggagctccgtgccatcatggacaaaaagaacaacatccgtaatatgtctgttattgcccatgtggaccacggcaagtctacccttacagactcccttgtggcagctgctgggattattgcccaggaagttgctggtgatgttcgcatgactgatacccgcgcagatgaagcagagcgtggtattacaatcaaatccaccggtatctctctttattatgagatgactccagagtcactgaagaattacaagggtgagagagatggtaaccagtacttgatcaaccttattgactcacctgggcacgtcgatttttcttcggaagtgacagctgcccttcgtatcaccgatggtgctctagtggtggttgactgtattgaaggtgtctgtgtgcaaactgagactgtgctccgccaggctcttggtgagaggattaggccagtccttactgtgaacaagatggacaggtgcttccttgagcttcaggttgagggtgaggaagcctaccagactttctcccgtgtgattgagaatgccaacgtcattatggcaacatatgaagataagctcctcggtgatgtccaagtctacccggagaagggaactgttgctttctctgctggtctgcacggctgggcctttaccctcaccaactttgccaagatgtatgcatccaagtttggagttgatgaatctaagatgatggagaggctctggggtgagaacttctttgacccagccacgaagaagtggaccacgaagaacacaggctcggctacctgcaagagaggatttgttcagttctgctatgagcccatcaagcaaatcatcaacacctgcatgaacgaccagaaggataagttgtggcccatgcttcaaaagcttaatgttaccatgaaggctgatgagaaggagttggttggcaaggctttgatgaagcgtgttatgcaaacctggcttccagctagtactgcactgcttgagatgatgatattccaccttccttccccagcaaaggcacagaagtatcgtgtggagaatctgtacgagggaccccttgatgatgtctatgctactgccatcagaaactgtgatccggagggtcctctcatgctgtatgtttcaaagatgattccagcatctgacaaagggcggttctttgccttcggtcgtgtcttctctgggaaggttgctaccggtatgaaggttcggatcatgggtcccaactatgtgcctggccagaagaaggatctgtacgtgaagagtgtccagcgtactgttatctggatgggaaagaaacaagagtcagttgaggatgttccctgtggtaacaccgttgctatggtcggtctggatcagttcatcacgaagaatgctacactgaccaatgagaaggaagtcgatgcatgcccaatcagagcaatgaagttctctgtgtcccctgttgtgcgtgttgctgttcagtgcaaggttgcctctgacctgccgaagctagttgaaggtttgaagcgtctggccaagtctgatcctatggtcctctgtaccattgaagaatctggtgagcatattatttctggagctggtgagcttcaccttgagatctgcctgaaggatctgcaggaggacttcatgggtggtgctgaaattattgtttcccctcctgttgtctctttccgtgaaactgttcttgagaaatcctgcagaactgtcatgagcaagtctcccaacaagcacaaccgtctctacatggaagcccgcccgttggaagagggtcttgctgaggctattgatgagggacgcattggtccacgtgatgatcccaaggtgcgctccaagatcctctctgaggagtttggatgggacaaggatcttgccaagaagatttggtgctttggacctgagaccaccggcccgaacatggttgttgatatgtgtaagggagtgcagtatctcaatgaaatcaaggattctgttgtggctggcttccagtgggcctcgaaggagggagcacttgctgaggagaacatgcgtggcatttgctttgaggtctgtgatgttgttcttcatgctgatgccattcacaggggtggtggtcaggtcattccaactgccaggagggtcatctatgcttctcagctcacggccaagccaagactgctggagccagtgtaccttgtggagatccaggctcctgagaatgcacttggtggtatctacggtgttctgaaccagaagagagggcacgtgtttgaggagatgcagaggccgggtaccccgctctacaacatcaaggcttacctccctgtcattgagtcctttgggttctccagccagctgagggctgcaacctctggtcaggcgttccctcagtgtgtgttcgaccactgggacatgatgggctctgatcctttggaggctggctcccaggctgctcagctggtgttggacatccgcaagaggaagggtctcaaggagcagatgaccccgctttctgagttcgaggacaagctctaaatttttggccttttgtggtactgttaccccctgatggtttaatcgtccattcgtctgctgtaatggaactatttttgtatttcatttcctttagtggtcaaatgcttctgtttctgaacatcattagccatatggtagtgccctgctaaaactgttgttatcctttgtgatgtaacagatgaaacagagttggtatttgtagcataatcttgtttctactgtttcttgaatttttttcctttgatatctggttgatagaatttcactgtttgcttct

SEQ ID NO: 2049 - DNA, 3044 bp, Oryza sativa
gatgaggaaagcccattagacccaaagtaccagcaccataaaaaccctagccgccctcctccccttcctcacagccgcctccactcctctcctcttctctcctagccctagccctagccctagggcgcgcgttcgctcaccgccgctgccgcctcggcaggaatttgcatccgtagcgtgatcttcaaaggctgccaagatggtgaagttcacggttgaagagctgcgcaggattatggacaagaagaataacattcgtaacatgtctgtcattgctcatgtcgaccatggcaagtccacgcttacagattcccttgtggcagctgctgggattattgcccaggaagttgctggtgatgttcgcatgactgatacccgtgcagatgaagctgagcgtggtattacaatcaagtccactggcatctctcttttctacgagatgagtgatgaatcactcaagttatacaagggcgagagagacggaaatgagtacctgatcaaccttattgattcacctgggcacgttgatttttcttcggaggtcactgctgctcttcgtattactgatggtgctttggtggttgttgactgtattgagggtgtctgtgtgcaaactgaaactgtgctccgccaagctcttggtgagaggattaggcctgtccttactgtgaacaagatggacaggtgcttccttgagcttcaagtcgaaggtgaggaggcgtatcagaccttttcccgtgtcattgagaatgccaatgtcattatggcaacatatgaagacacgctccttggtgatgtccaagtttaccctgagaagggaactgttgctttctctgctggtttgcatggctgggctttcacactctcaagctttgctaagatgtatgcttccaagtttggagttgatgaatctaagatgatggagaggctttggggtgagaacttctttgacccggccacaaagaagtggaccaacaagagcactggctcagctacctgcaaaagaggtttcgttcagttctgttatgagccaatcaagcaaatcatcaacacttgcatgaatgaccagaaggacaagttgtggcctatgctgcagaagcttggtgtggtcatgaaggctgatgagaaggatcttatgggcaaggctctcatgaagcgtgttatgcaaacttggctgccagccagtaatgcacttcttgagatgatgatataccaccttccatctccttcgaaggcccagaagtaccgtgtggagaatctgtacgagggtcctcttgatgatgtctatgcaactgctatcaggaactgtgatccggaaggtcctctcatgctgtatgtttccaagatgattccagcatcagacaaaggtagattctttgcctttggccgtgtcttctctgggagggttgcaactggcatgaaggtgcgtattatgggtcccaactatgtccctggccagaagaaggatctgtatgtgaagagtgtccagcgtactgttatctggatgggaaagaaacaagagtctgttgaggatgttccttgtggtaacactgtcgctatggtcggtctggatcagttcatcacaaagaatgccaccctaacaaatgagaaggaagctgatgcctgcccaatcagagcaatgaagttctcagtgtccccagttgtgcgtgttgctgttcagtgcaaggttgcatctgatcttcccaagcttgttgaaggtttaaagcgtctggcaaagtctgatcctatggtcctctgtaccattgaggagtccggtgagcatatcattgctggagctggagagcttcaccttgaaatctgcttgaaggatctacaggaagacttcatgggtggtgctgagattattgtttcccctcctgttgtctccttccgtgagactgttcttgagaagtcctgccgtacagttatgagcaaatccccaaacaagcacaaccgtctttacatggaagctcgccccttggaggagggactggccgaggccatcgacgatggacgtattggcccacgtgacgatcccaaggtgcggtccaagatcctgtctgaggagtttgggtgggacaaggacctcgccaagaagatttggtgctttggacctgagaccactggccccaacatggtggtcgacatgtgtaagggagttcagtatcttaatgaaatcaaggactctgttgtggctgggttccagtgggcatcaaaagaaggtgcattggctgaggagaacatgcgcggcatctgcttcgaggtatgtgatgtggttctccacgctgatgctattcacaggggcggtggccaggtcattccgacagcgaggagggtcatctatgcttctcagctcaccgcgaagccaaggctgctggagccagtctacctggtggagatccaggcccctgagaatgcccttggcggtatctatggcgttctgaaccagaagagaggccatgtgttcgaggagatgcagaggcccggtaccccgctgtacaacatcaaggcttacctccccgtcatcgagtcgtttgggttctcgagccagctccgtgccgcaacatcgggccaggccttccctcagtgtgtctttgatcactgggacatgatgacttctgatcctctggaggtgagctcgcaggcgaaccagctggtgctggacatccgcaagaggaagggtctcaaggagcagatgacccctctctcggatttcgaggacaagctctaagaaaaaacccttttggtctcgcatatgtttttgccattaatttacctgttctaatagctgttctactattgttaaagagttataagacaagtcagaaatatgatgtgtttgttacacatcaagtatcggtgttggtagtgttgtgctgtggaactatatattttgctgtctggtgatatgcaacagatatggaactttgataatgtatctgttgatagtttttacggttttctgaatcagtttcagtttgatatatcatatccatatagtacctttcactttcgtttctgccgaaatcaaatctaaaccctcc

SEQ ID NO: 2050 - DNA, 2848 bp, Cenchrus ciliaris
ccacatctcgtctctcagatcgggaggcgaaacccagcaggaaattatatacatatttgtagtgtgaacttcataagaagacaagatggtgaagttcacggcggaagagctccgtgccatcatggacaaaaagaacaacattcgtaatatgtctgttattgctcatgtggaccacggcaagtctacccttacagattcccttgtggcagctgctgggattattgcccaggaagttgctggtgatgtccgcatgactgacacacgtgcagatgaggcagagcgtggtattacaatcaagtccacgggtatttctctgtactatgagatgactgatgagtcactgaagaattacaagggtgagagagatggcaaccagtacttgatcaacctcattgactcacctgggcacgttgatttttcttcggaagtcacagctgcccttcgtatcaccgatggtgctctagtggtggttgactgtattgaaggtgtctgtgtgcaaactgaaactgtgctccgccaggctcttggtgagaggattaggccagtgcttactgtgaacaagatggacaggtgcttccttgagcttcaggttgagggtgaggaagcctaccagactttctcccgtgtcattgagaacgccaatgtcatcatggcaacatatgaagacaagctccttggtgatgtccaagtctacccggagaagggaactgttgctttctctgccggtctgcacggctgggcctttaccctcaccaacttcgccaagatgtatgcgtcgaagtttggagttgatgaaactaagatgatggagaggctctggggcgagaacttctttgaccctgccacaaagaagtggaccaccaagagcacaggctctgctacctgcaagaggggatttgttcagttctgctatgagccaatcaagcaaatcatcaacacctgcatgaacgaccagaaggataagctgtggcccatgcttcaaaagcttaatgttaccatgaagtctgatgagaaggaattggttggcaaggctttgatgaagcgtgttatgcaaacttggcttccagctagcactgccctgcttgagatgatgatattccaccttccttccccagcaaaggcacaaaggtatcgtgtggagaacttgtacgagggaccccttgatgatgtctacgccactgctatcaggaactgtgatccggagggtcctcttatgctttatgtctctaagatgattccagcatctgataaaggcaggttctttgccttcggtcgtgtcttctctgggaaggtctctactggtatgaaggttaggatcatgggtcccaactatgtcccgggccagaagaaggatctgtacgtcaagagtgtccagcgtactgttatctggatgggaaagaaacaagagtcagttgaggacgttccttgtggtaacactgttgctatggttggtctggatcagttcatcacgaagaatgctacactcaccaacgagaaggaggttgatgcctgccccatcagagcgatgaagttctctgtctcccctgttgtgcgtgttgctgttcagtgcaaggttgcctctgacctacccaagcttgttgaaggtttgaagcgtctggcaaagtctgatcctatggtcctctgtacaattgaagaatctggtgagcatattattgctggagctggtgagcttcaccttgagatttgcctgaaggatctgcaggaagacttcatgggtggtgctgaaattattgtttcccctcctgttgtctccttccgtgaaactgtgcttgagaaatcctgccggacagtcatgagcaagtcccccaacaagcacaaccgtctttacatggaagctcgtcctttggaagagggtctccccgaggctattgatgagggccgcattggtccacgtgatgatcccaaggttcgctccaagatcctctctgaggagtttggttgggacaaggatcttgccaagaagatttggtgctttggacctgagaccactggcccgaacatggttgtggatatgtgtaagggagtgcagtatctcaatgaaatcaaggattctgttgtggcaggcttccagtgggcctcgaaggagggtgcactggctgaggagaacatgcgtggcatttgctttgaggtctgtgatgttgttcttcatgctgatgctattcacaggggtggtggccaggtcattccaactgccaggagggtcatttatgcgtctcagctcaccgccaagccaaggctgctcgagccagtttacctcgtggagatccaggccccagaaaatgcacttggtggtatctatggtgttctgaaccagaagagagggcacgtgtttgaggagatgcagaggcctggtaccccactctacaacatcaaggcttaccttcctgtcatcgagtcctttgggttctccagccaactgagggctgcaacctctggccaggcgttccctcagtgtgtgtttgaccactgggacatgatgggctccgatcctttggaggctggctcccaggctgctcagctggtgttggatatccgcaagaggaagggtctcaaggagcagatgacccctctttctgagtttgaggacaagctctaaatttttgcttgcttctgctgctgttacctctgcttgtttaattgccaattcgcatactgtagcggaactattatgtttcatttccttttagttctcatggatctgtttctgaacatcattggtcatgtggtagtgtgctgctaagacagtattttgttatcgggttgtgatgtaatagatgaaacagagttcgtatctgtggttttagtggtagtatttgtgtttacagtt

SEQ ID NO: 2051 - DNA, 2843 bp, Pennisetum glaucum
ggcgccgcctccacatctcgtctctcagatcgggaggcgaaacccaggaaacaatattcatatttgtggtccgatcttcataagaagtcaagatggtgaagttcacggcggaagagctccgtgctatcatggacaaaaagaacaacattcgtaatatgtctgttattgctcatgtggaccacggcaagtctaccctgacagattcccttgtggcagctgctggtattattgcccaggaagttgctggggatgtccgcatgactgacacacgtgcagatgaagcagagcgtggtattacaatcaagtccactggtatttctctgtactatgagatgactgacgagtcgctgaagaattacaagggtcagagagatggcaacgagtacttaatcaaccttatcgactcacctgggcacgttgacttttcttcggaagtcacagccgcccttcgtatcactgatggtgctctggtggtggttgactgtattgaaggtgtctgtgtgcaaactgaaactgtgctccgccaggctcttggtgagaggatcaggccagtgcttactgtgaacaagatggacaggtgcttccttgagcttcaggtcgagggtgaggaagcctaccagactttctcccgtgtcattgagaatgccaatgtcattatggcaacatatgaagacaagcttcttggtgatgtccaagtgtacccggagaagggaactgttgctttctctgctggtctgcacggctgggccttcaccctcaccaactttgccaagatgtacgcatcgaagtttggagttgatgaaactaagatgatggagaggctctggggtgagaacttctttgacccagccacaaagaagtggaccaccaagagcacaggctctgctacctgcaagagaggatttgttcagttctgctatgagccgatcaagcaaatcatcaaaacctgcatgaatgaccagaaggataagttgtggcccatgcttcagaagcttaatgttaccatgaagtctgatgagaaggaattgattggcaaggctttgatgaagcgtgttatgcaaacttggcttccagccagtactgcactgcttgagatgatgatattccaccttccttccccggcaacagcacaaaagtatcgtgtggagaacttgtacgagggtccccttgatgatatctacgctactgccatcaggaactgtgatccggagggtcctcttatgctgtatgtttctaagatgattccagcatctgacaaaggcaggttctttgcctttggtcgtgtcttctctgggaaggttgctactggtatgaaggtcaggatcatgggtcccaactatgtccctggccaaaagaaggatctgtatgtcaagagtgtccagcgtactgttatctggatgggaaagaaacaagagtcagttgaggatgttccttgtggtaacaccgttgctatggttggtctggatcagttcatcacgaagaatgctacactcaccaatgagaaggaggttgatgcatgcccaatcagagcaatgaagttctctgtctcccctgttgtgcgtgttgctgttcagtgcaaggttgcctctgacctgcccaagctagttgaaggtttgaagcgtctggcaaagtctgatcctatggtcctctgtacaatggaagaatctggtgagcacattattgctggagctggtgagcttcaccttgagatctgcctgaaggatctgcaggaagacttcatgggtggtgctgaaattattgtttcaccacctgtggtctccttccgtgagactgttcttgagaaatcctgccggacagtcatgagcaagtcccccaacaagcacaaccgtctttacatggaagctcgtcccttggaagagggtctccctgaggctattgacgagggccgcattggtccacgtgatgatcccaaggttcgctccaagatcctctctgaggagttcggttgggacaaggatcttgccaaaagatttggtgctttggacctgagaccactggcccgaacatggttgtcgatatgtgtaagggagtgcagtatctcaatgaaatcaaggattctgttgtggctggcttccagtgggcctcgaaagagggtgcgctggctgaggagaacatgcgtggcatttgctttgaggtctgtgatgtcgtcctccatgctgatgcaattcacaggggtggtggccaggtcattccaactgccaggagggtcatttatgcttctcagctcactgccaagccaaggctgctcgagccagtttaccttgtggagatccaggccccagaaaatgcactgggtggtatctatggtgttctgaaccagaagagaggtcacgtgtttgaggagatgcagaggcctggtaccccgctctacaacatcaaggcttacctccctgtcatcgagtcctttgggttctccagccagctaagggctgcaacctctggccaggcgttccctcagtgtgtgtttgaccactgggacatgatgggctctgatcctttggaagcaggctcccaggctgctacgctggtgttggatatccgcaagaggaagggtctcaaggagcagatgacccctctttctgagtttgaggacaagctctaaattttgctcgcttgtgctgtctgctggtttaatcgccattttgtctgctgtagtggaattactctaatgtttcatttccttttagctgtcatgcatctgtctcgaacatcattggccatatggtattgtgctgctaagactgaattttgttatctggttgtgatgtctgagatgaaacagagtttgtatctgtggtctaagtggtattatttttgtggta

SEQ ID NO: 2052 - DNA, 3194 bp, Sorghum bicolor
ggatatttcttgcccggtgcgcaactccgctgctatagatagatatcctcacaggcggccgctagggttttagtgcttctctcccggcggcgcctccacatctcgtctctcagatcgggaggcgaaaccaaggaatacatatacatatttgtagttggatcttcaaaaaaagtcaagatggtgaagttcacggctgaagagctccgtggcatcatggacaaaaagaacaacattcgcaatatgtctgttattgctcatgtggaccatggaaagtccacgcttacagattcccttgtggcagctgctggtattatagcccaggaagttgctggtgatgttcgcatgactgatactcgtgcagatgaagcagagcgtggtattacaatcaaatccactggtatctctctttactatgagatgactgatgagtcactgaagaactacaagggtgagagggatggtaaccaatatttgatcaaccttattgactcgcctgggcacgtcgatttttcttcggaagttacagctgctcttcgcatcaccgatggtgctctggtggtggttgactgtattgaaggtgtctgtgtgcaaactgaaactgtactccgccaagcccttggtgagaggattaggccagtccttactgtgaacaagatggacaggtgcttccttgagcttcaggttgagggtgaggaagcttatcagacattctcccgtgtcattgagaatgccaacgtcatcatggcaacatatgaagataagctcctaggtgatgtccaagtctacccagagaaggggactgttgctttttctgctggcctgcacggatgggcctttaccctcactaactttgccaagatgtatgcatctaagtttggagttgatgaatctaagatgatggagaggctttggggtgagaacttctttgaccctgccacaaagaagtggactaccaagaacacaggttctcctacctgcaagagaggattcgttcagttctgctatgagccaatcaagcaaatcatcaacacctgcatgaacgatcagaaggagaaattgtggcccatgctgcaaaagctcaatgttaccatgaaggctgatgagaaggaattgattggcaaagctttgatgaagcgtgttatgcaaacgtggcttccagctagcaccgcactgcttgagatgatgatattccaccttccttcccctgcaaaggctcaaaagtatcgtgtggagaacttgtatgagggaccccttgatgatgtctatgcaactgctatcagaaactgtgatccggagggacctcttatgctgtatgtttcaaagatgattccagcatctgacaagggcaggttctttgcctttggtcgtgtcttctcagggaaggttgctactggtatgaaggttcggatcatgggtcccaactatgtccctggccagaagaaggatctgtatgtcaagagcgtccagcgtactgttatctggatgggaaagaaacaagagtctgtcgaggatgttccttgtggtaacactgttgcaatggttggtctggatcagtttatcacgaagaatgctacactcactaatgagaaggaggttgatgcatgcccaatcagagcaatgaagttctctgtctcccctgttgtgcgtgttgctgttcagtgcaaggttgcctctgaccttcccaagctagttgaaggtttgaagcgtctggcaaagtctgatcctatggttctctgtacaattgaagaatctggtgagcatatcattgctggagctggtgagcttcatcttgagatctgcctgaaggatctgcaggaggacttcatgggtggtgctgaaattatcgtttcccctcctgttgtgtccttccgtgaaactgttcttgagaagtcctgccgtactgtcatgagcaagtcacccaacaagcacaaccgtctgtacatggaagcgcgccccttggaggagggtcttgctgaggccattgatgagggccgcattggcccacgtgatgatcctaaggtgcgctcccagatcctctctcaggagtttggttgggacaaggaccttgccaagaagatttggtgttttggacctgagaccactggtccaaacatggttgttgatatgtgtaagggagttcagtatctcaatgaaatcaaggattctgttgtggctggtttccagtgggcatcaaaggagggtgcactggcagaggagaacatgcgtgggatttgctttgaggtctgtgatgtcgttcttcatgctgatgctatccacaggggtggtggccaggtcattcctactgctaggagggtcatctatgcttctcagctcacggccaagccaaggctgctggagccagtgtacctggtggagattcaggccccagaaaatgcacttggtggtatctatggtgttctgaatcagaagagagggcatgtcttcgaggagatgcagaggccgggtacccctctatacaacatcaaggcttacctccctgtcatcgagtcctttgggttctccagccaactgagggctgcaacctctggtcaggctttcccccagtgtgtgtttgaccattgggacatgatgggctctgatcctttggaggcgggctcccaggctgctcagctggtgctggatatccgcaagaggaagggtctcaaggaacagatgacccctctttctgagtttgaggacaagctctaattttctcgttttgctactgttacctggtttaattgtcggttcaactcctgtactgggaactactatcttgtttccttttagttgtcaaatgcatgtttctgaacatcattggtcatactgtagatggtagtgtgctgctgaggcactttttgctatccatcgtggtgtaacagatgaaacagttggtatatgctttgttaagtggaagtgttgcagtaaatgcttgtgccatcctgatttaatgcttgtttcctttctgttggaaaatgcttgcttttaagataatttcactcttgttgcatgctctttctttgccttcacattacggctttgagttgtccgataaaatgatttgcgttttctcgtgtggttagaatttcatcgtctttgaatgaatcggtgtctggatctggtagctgctgctatttatctgtaattgctgattacttatttgcaataagagattgaggactggaatgatggtt

SEQ ID NO: 2053 - DNA, 3119 bp, Sorghum bicolor
ccctatctctggccacctcccccagtcatccatctctcccacaccgcagccgccgcctgcccgccaccgcgcctgcgacgagatccggcgccggcagcgagctctagcacccgcgacgagcagcagctgccagcgacgcgcgcagcccagcaggaataaatattgttattggtagtgtgatatttataagaagtcaagatggtgaagttcacggctgaagagctccgtggcatcatggacaaaaagaacaacattcgtaacatgtctgttattgctcatgtggaccatggcaagtctacgcttacagattcccttgtggcagctgctgggattattgcccaggaagttgctggtgatgttcgcatgactgatactcgtgcagatgaagcagagcgtggtattacaatcaaatctaccggtatctctctttactatgagatgactgacgagtcactgaagaattacaagggtgagagagatggtaaccaatacctgatcaaccttattgactcgcctgggcacgttgatttttcttcggaagtcacagctgctcttcgcatcaccgatggtgctcttgtggtggttgactgtattgaaggtgtctgtgtgcaaactgaaactgtgcttcgccaagcccttggtgagaggattaggccagttcttaccgtgaacaagatggacaggtgcttccttgagcttcaggttgagggcgaggaagcttaccagaccttctcccgtgtcattgagaatgccaatgtcatcatggcaacatacgaagataagctccttggtgacgtccaagtgtacccagagaaggggactgttgctttttctgctggtctgcacggatgggcctttaccctcactaactttgccaagatgtatgcatctaagtttggagttgatgaatctaagatgatggagaggctttggggtgagaacttctttgaccctgccaccaagaaatggacaaccaagaacacaggctcccctacctgcaagagaggatttgttcagttctgctatgagccaatcaagcaaatcatcaacacctgcatgaacgaccagaaggagaaattgtggcccatgctgcaaaagctcaatgttaccatgaagtctgatgagaaggaattgattggcaaagctttgatgaagcgtgttatgcaaacgtggctaccagcaagcactgcactgctcgagatgatgatattccaccttccttccccggcaaaggctcaaaagtatcgtgtggagaacttgtatgaggggccccttgatgatgtctatgcaactgccatcagaaactgtgatccggagggccctcttatgctgtatgtttcgaagatgattccagcatccgacaagggcaggttctttgccttcggtcgtgtcttctcagggaaggttgctactggtatgaaggttcggatcatgggtcccaactatgtccctgggcagaagaaggatctgtatgtgaagagtgtccagcgtaccgttatctggatgggaaagaaacaagagtcagttgaggatgttccttgtggcaacactgttgctatggttggtctggaccagttcatcacgaagaacgctacactcactaatgagaaggaggttgatgcatgcccgatcagagcaatgaagttctctgtctcccctgttgtgcgtgttgctgttcagtgcaaggttgcctctgaccttcccaagctagtcgaaggtttgaagcgtctggcgaagtctgatcctatggttctctgtacaatcgaagagtctggtgagcatatcattgctggagctggtgagcttcatcttgagatttgcctgaaggatctgcaggaggacttcatgggtggtgctgaaattattgtttcccctcctgttgtgtccttccgggaaaccgttcttgagaagtcctgccgtactgtcatgagcaagtctcccaacaagcacaaccgtctgtacatggaagcacgcccctggaggagggtctcgctgaggccatcgatgatggccgcattggcccacgtgatgatcctaaggtgcgctcccagatcctctctcaggagtttgggtgggacaaggatctcgccaagaagatttggtgttttggacctgagaccactggcccaaacatggttgttgatatgtgtaagggagtgcagtatctcaatgaaatcaaggattctgtcgtggctggtttccagtgggcatcaaaggagggtgcactggctgaggagaacatgcgcggaatttgctttgaggtctgtgatgtcgttcttcatgctgatgctatccacaggggtggtggccaggtcatcccaactgccaggagggtcatctatgcttctcagctcacggccaagccaaggctgctggagccagtgtacctggtggagattcaggccccagaaaatgcacttggtggtatctacggtgttctgaaccagaagagagggcatgtgtttgaggagatgcagaggccgggtaccccgctctacaacatcaaggcttacctccctgtcatcgagtcgtttgggttctccagccaactgagggctgcaacctctggtcaggcgttcccccagtgtgtctttgaccattgggacatgatgggctctgatcctttggaggctggctcccaggctgctcagctggtgctggatatccgcaagaggaagggtctcaaggaacagatgacccctctctctgagtttgaggacaagctctaaatttttggttgtttgttctactgttactactgctggtttaatcgtcaattcgtgtactgtaatgggaacgacttgaatattttgcttcgttttagttgtcgaatgcacctgtctctgaactatattggtcatcatgtagtttgtcaatctgtgctgagagcctgagacactattttgatatccgttttgatgtagcagatgaaacagaggtggtatctttggtttagtaattggttatatacttattttccgggtgtatttcttatatccactgtcttattaacgctgtgcatgatctgtcagacagttaacccttttgctcgttgtttccttgccttttctttgtgaagtatatagtcattttttgcagctcttgattcttgtattgtt

SEQ ID NO: 2054 - DNA, 2858 bp, Oryza sativa
gaaccaaaataagcggacttacaacggcaagccaaaggggacaataaataccactccacagaaacgcaacaagaatgtgaacactataacttagacagcaaaaagatgatccaggttccacatccgttacatcacgacagagtaaaaatagtttctcagtagcacgcgaacataggattgttgatgtgaaacacatgcattcgacaaaagggaaatgaaatacgacaacgaaagcagttctcttagcagtagaccaactagaacatgtaagggtaacggcacaacacatgcggcggccaaaaatttagagcttgtcctcgaaatcggagaggggagtcatctgctccttgagacccttcctcttgcggatatcctgcaccagggttgaagcctgcgagccagcttcaagaggatcagaggtcatcatgtcccaatggtcgaacacacactgggggaaggcctggccagatgtcgcagccctaagctggcttgagaacccaaaggactcgatgacagggaggtaagccttgatgttgtacagaggggtaccaggcctctgcatctcctcgaacacatgtcctctcttctggttcagaacaccatagataccaccaagggcattctcaggggcctggatctccaccaggtagacgggctcaagaagcctgggctttgctgtgagctgagaagcatagatgaccctcctggccgtgggaatgacctggccaccacctctgtgaatagcatcagcatggagaacaacatcgcacacctcaaagcagataccacgcatgttctcctcagccagagcaccctcctttgatgcccactggaaaccagccacaacggaatccttgatttcattcagatactgaactcccttacacatatcaaccaccatgttggggccagttgtctcaggtccaaaacaccaaatcttctttgcaagatccttgtcccagccgaactcctcagacaggatcttggagcgcaccttgggatcatcacgtgggccaatacgaccgtcatcaatggcctcagccaatccctcctccaaggggcgagcttccatgtagagacggttgtgcttgttcggggacttgctcataacagtacggcacgacttctcaaggacagtctcacggaaagaaacaacaggtggggaaacaatgatttcagcaccacccatgaaatcttcctgcagatccttcaagcaaatttcaaggtgaagctctccagcaccagcaatgatatgctcaccagactcctcaatagtacagagcaccataggatcagacttcgccagacgcttcaaaccctcaacaagcttgggcagatcagaggcaaccttgcactgaacagcaacacgcacaacaggggacactgagaacttcattgctctgattgggcaggcatctgactccttctcattagtcagggtggcattcttggtgatgaactgatccaaaccaaccatagcaacagtgttaccacagggaacatcctcaacagactcttgtttctttcccatccagatgacagtacgctggacactcttcacatacagatccttcttctggccagggacatagttgggacccatgatacgcaccttcatgccagttgcaaccctcccagagaagacacgaccaaaggcaaagaacctacctttgtctgatgcgggaatcatcttggaaacatacagcataagaggaccttctggatcacagtttctgatagcagttgcgtagacatcatcaagaggaccctcatacaaattctccacacggtacctctgggccttggacggagatggaaggtggtatatcatcatctcaagaagagcattactggctggcagccatgtttgcataacacgcttcatgagagccttgcccataagctccttctcatcagccttcatgaccacaccaagcttctgcaacataggccacaacttatccttctgatcattcatgcaagtgttgatgatttgcttgatcggctcataacagaactgaacgaaacctcttttgcaggtagctgagccagtgttcttgttggtccatttctttgtggctgggtcaaagaagttctcaccccaaagcctctccatcatcttaaattcatcaactccaaacttggaagcatacatcttagcaaagctcgagagtgtgaaagcccagccatgcagaccagcagagaaagcaacagttcccttctcagggtagacttggacatcaccaaggagtgtgtcttcatatgttgccataatgacattggcattctcaatgacacgggagaaggtctgataggcctcctcaccttcaacttgaagctcaaggaagcacctgtccatcttgttcacagtaaggacaggcctaatcctctcaccaagggcttggcgaagcacagtttcagtttgcacacagacaccctcaatacagtcaacaaccaccaaagcaccatcagtaatacgaagagcagcagtgacctccgaagaaaaatcaacgtgcccaggtgaatcaataaggttgatcaggtactcatttccatctctctcacccttgtacaacttgagtgattcatcactcatctcatagaaaagagagataccagtggatttgattgtaataccacgctcagcttcatctgcacgggtatcagtcatgcgaacatcacccgcaacttcctgggcaataataccagcagccgccacaagagaatccgtaatcataactattctggcacataccgtggtccacatgagcaatgacggacatattacggatgttattcttcttgtccatgatccggcggagctcttctactgtgaacttcaccatcttgactagctt

SEQ ID NO: 2055 - DNA, 2926 bp, Zea mays
atagatatatctttacaggctgccactagggttttagtgcttctctcccggcggcgcctccacatctcgtctctcagatcgggaggcgaaaccaaggcatacatatacatatttgtagtgggaccatcataacaagtaaagatggtgaagttcacggctgaagagctccgtgccatcatggacaaaaagaacaacattcgtaatatgtctgttattgctcatgtggaccatggcaagtctacacttacagattcccttgtggcagctgctgggattattgcccaggaagttgctggtgatgttcgcatgactgatactcgtgcagatgaagccgagcgtggcatcacaatcaaatctactggtatctctctttattatgagatgactgatgagtcactgaagaactacaagggtgagagggatggtaaccaatacttgataaaccttattgactcacccgggcacgtcgatttttcttcggaagtcacagctgctcttcgcatcaccgatggtgctctggttgtggttgattgtattgaaggtgtctgtgtgcaaactgaaactgtgcttcgccaagcccttggtgagaggattaggccagttctgaccgtgaacaagatggacaggtgcttccttgagcttcaggttgagggtgaggaagcttatcagactttctcccgtgttattgagaatgccaatgtcatcatggcaacatatgaagataagctccttggtgatgtccaagtatacccagagaaggggacagttgccttttctgctggtctgcatggatgggcctttacactcactaactttgcgaagatgtatgcatctaagtttggagttgatgaatctaagatgatggagaggctatggggtgagaatttctttgaccctgccacaaagaaatggaccaccaagaacacaggttctcctacctgcaagagaggatttgttcagttctgctacgagccaatcaagcaaatcatcaaaacctgcatgaatgaccaaaaggagaaattgtggcccatgttgcaaaagcttaatgttaccatgaaggctgatgagaaggagttgattggcaaagctttgatgaagcgtgttatgcaaacgtggcttccagccagcactgcacttcttgagatgatgatattccaccttccttccccggcaaaggctcaaaagtatcgtgtggagaacttgtatgagggaccccttgatgatgtttatgcaactgctatcagaaactgtgatccggagggccctcttatgctgtatgtttcaaagatgattccagcatctgacaagggcaggttctttgcctttggtcgtgtcttctcagggaaggttgctactggtatgaaagttcggatcatgggtcccaactatgtccctggccagaagaaggacctgtatgtcaagagtgttcagcgtactgttatctggatgggaaagaaacaagagtcagttgaggatgttccttgtggtaacactgttgctatggttggtctggatcagttcatcacgaagaacgctacactcactaatgagaaggaggttgatgcatgcccaatcagagcaatgaagttctctgtctcccctgttgtgcgtgttgctgttcagtgcaaggttgcttccgaccttcccaagctagtagaaggtttgaagcgtctggcgaagtccgatcctatggttctgtgtacaatggaagaatctggtgagcatatcattgctggagctggtgagcttcatcttgagatttgcctgaaggatctgcaagaggacttcatgggaggtgctgaaattattgtttctcctcctgttgtgtccttccgtgaaaccgttcttgagaagtcctgccgcactgtcatgagcaagtcacctaacaagcacaaccgtctgtacatggaagcgcgccccctggaggagggtcttgctgaggcaattgatgatggccgcattggcccacgtgatgatcctaaggtgcgctcccagatcctctctcaagagtttgggtgggacaaggatcttgccaagaagatttggtgcttcggacctgagaccaccggcccaaacatggttgttgatatgtgcaagggagtgcagtatctcaatgaaatcaaggattctgttgtggctggtttccagtgggcatcgaaggagggtgcactggctgaagagaacatgcgcgggatttgcttcgaggtctgtgatgtcgttcttcatgccgatgctatccacaggggtggtggccaggtcattccaactgccaggagggtcatttatgcttctcagctcacagccaagccgaggctgctggaaccagtttacctggtggagatccaggccccagaaaatgcactgggtggcatatacggtgttctgaaccagaagagaggacatgtattcgaggagatgcaaaggcctggtaccccgctctacaacatcaaggctttcctccctgtcatcgagtcctttgggttctcaagccagctgagggctgcaacctctggtcaggcgttcccccagtgtgtgtttgaccactgggacatgatgggctcggatcctttggaggctggctcccaggctgcccagctggtgctggatatccgcaagaggaagggtctgaaagaacagatgactcctctttctgagtttgaggacaagctctaatcttttcgtttttgctactgttactggttttaattgtcactcggagtctgggaactatttatatcttgtttccttttagttgtcaagtgcatgtttctgaacatcattggtcatactgtactatccaagtgctgttgagacacttttttctatcaatcgtgatgtaacagttggtatatgctggcttggtggaagtgtttgtagtaaatgcttgtgctatcttgatttaattcttgttcccttacattgctta

SEQ ID NO: 2056 - DNA, 2937 bp, Zea mays
atctttgtccacaccgcagccgccgcccgctcgctcgcctccgctccggcagcgagctctatctcccgcgacgagcagcagctgccaccgacgcacgcagaccgggcaataaatattggtattggtagtgtgatatctataagaagtcaagatggtgaagttcacagctgaagagctccgcgctatcatggacaaaaagaacaacattcgtaacatgtctgtcattgctcatgtggaccatggcaagtctacgcttacagattcccttgtggcagctgctgggattattgcccaggaagttgctggtgatgttcgcatgactgatactcgggcagatgaagcagagcgtggcattacaatcaaatctactggtatctctctttactatgagatgactgacgagtcactgaagaactacaagggtgagagagatggtaaccaatacttgatcaaccttattgactcgcctggacacgttgatttttcttcggaagtcacagctgctcttcgcatcaccgatggtgctctggttgtggttgactgtattgaaggtgtctgtgtgcaaactgaaactgtgcttcgccaagcccttggtgagaggattaggccagttctcacggtgaacaagatggacaggtgcttccttgagcttcaggttgagggtgaggaagcgtatcagactttctcccgtgtcattgagaatgccaatgtcatcatggcaacatatgaagataagctccttggtgatgtccaagtatacccagagaaggggacagttgctttttctgctggtctgcacggatgggccttcaccctcactaacttcgcaaagatgtatgcatctaagtttggagttgatgaaactaagatgatggagaggctatggggtgagaacttctttgaccctgccacaaagaagtggaccaccaagaacacaggttctcctacctgcaagagaggatttgttcagttctgctatgagccaatcaagcaaatcatcaagacctgcatgaatgaccagaaggagaaattgtggcccatgctgcaaaagctcaatgttaccatgaaggctgatgagaaggagttgattggcaaagctttgatgaagcgtgttatgcaaacgtggcttccagctagcactgctctgcttgagatgatgatattccaccttccttccccagcaaaggctcaaaagtatcgtgtggagaacttgtacgagggaccccttgatgatgtgtatgcaactgctatcagaaactgtgatccagagggtcctcttatgctgtatgtttcaaagatgattcctgcatctgacaagggcaggttctttgccttcggtcgtgtcttctcagggaaggttgctactggtatgaaggttcggatcatgggtcccaactatgtccccgggcagaagaaggatctgtatgtcaagagtgtccagcgtactgttatctggatgggaaagaagcaagagtcggttgaggatgttccgtgtggtaacactgttgctatggttggtctggatcagttcatcacgaagaatgctacactcactaatgagaaggagactgacgcttgcccaatcagagcaatgaagttctccgtctctcctgttgtgcgtgttgctgttcagtgcaaggttgcctctgaccttcccaagctagtcgaaggtttgaagcgtctagcaaagtccgatcctatggttctctgtacaatggaagaatctggtgagcatatcattgctggagctggtgagcttcatcttgagatttgcctgaaggatctgcaggaggacttcatgggtggtgctgaaattattgtttcccctcccgtcgtctccttccgtgaaacggttcttgagaagtcctgccgtactgtcatgagcaagtctcccaacaagcacaaccgtctgtacatggaagcgcgccccttggaggagggtctcgctgaggccatcgatgacggccgtattggcccacgtgatgatccgaaggtgcgctcccagatcctctctcaggagtttgggtgggacaaggacctggccaagaagatttggtgttttggacctgagaccactggcccgaacatggttgtagatatgtgcaagggagtgcagtatctcaatgaaatcaaggattctgttgtggctggtttccagtgggcatcaaaggagggtgcactggctgaggagaacatgcgtggaatttgctttgaggtatgtgatgtcgttcttcatgctgatgctatccacaggggtggtggtcaggtcattcccactgccaggagggtcatctatgcctctcagctcacggccaagccaaggctgctggagccagtctacctggtggagatccaggccccagaaaatgcacttggtggtatctacggtgttctgaaccagaagagaggtcatgtctttgaggagatgcagaggccgggtaccccgctctacaacatcaaggctttcctccctgtcatcgagtcctttggtttctccagccaactgagggccgcaacctctggtcaggcgttcccccagtgtgtctttgaccattgggacatgatgggctcagatcctttggaggccggctcccaggctgctcagctggtgctggatatccgcaagaggaagggtctcaaggaacagatgacccctctttctgagtttgaggacaagctctaaaatttttggctgttggtgatactgtttcatctgccggtttaatcatcaattcgtctactgtaatagcagcgacttcaatattttattttgttttagttgtcaaatgcacctgtttttgaacaatatttgtgatgtagtgccctgccgcgcttagagtctgagactattttgttatctgctgtgatgtttcagatgaaacagagttgatgtctggtttagtaaatggttatattcttagtgtattgctcttttgt

SEQ ID NO: 2057 - DNA, 3010 bp, Zea mays
atctttgtccacaccgcagccgccgcccgctcgctcgcctccgctccggcagcgagctctatctcccgcgacgagcagcagctgccaccgacgcacgcagaccggggaataaatattggtattggtagtgtgatatctataagaagtcaagatggtgaagttcacagctgaagagctccgtgctatcatggacaaaaagaacaacattcgtaacatgtctgtcattgctcatgtggaccatggcaagtctacgcttacagattcccttgtggcagctgctgggattattgcccaggaagttgctggtgatgttcgcatgactgatactcgggcagatgaagcagagcgtggcattacaatcaaatctactggtatctctctttactatgagatgactgacgagtcactgaagaactacaagggtgagagagatggtaaccaatacttgatcaaccttattgactcgcctggacacgttgatttttcttcggaagtcacagctgctcttcgcatcaccgatggtgctctggttgtggttgactgtattgaaggtgtctgtgtgcaaactgaaactgtgcttcgccaagcccttggtgagaggattaggccagttctcacggtgaacaagatggacaggtgcttccttgagcttcaggttgagggtgaggaagcgtatcagactttctcccgtgtcattgagaatgccaatgtcatcatggcaacatatgaagataagctccttggtgatgtccaagtatacccagagaaggggacagttgctttttctgctggtctgcacggatgggccttcaccctcactaacttcgcaaagatgtatgcatctaagtttggagttgatgaaactaagatgatggagaggctatggggtgagaacttctttgaccctgccacaaagaagtggaccaccaagaacacaggttctcctacctgcaagagaggatttgttcagttctgctatgagccaatcaagcaaatcatcaagacctgcatgaatgaccagaaggagaaattgtggcccatgctgcaaaagctcaatgttaccatgaaggctgatgagaaggagttgattggcaaagctttgatgaagcgtgttatgcaaacgtggcttccagctagcactgctctgcttgagatgatgatattccaccttccttccccagcaaaggctcaaaagtatcgtgtggagaacttgtacgagggaccccttgatgatgtgtatgcaactgctatcagaaactgtgatccagagggtcctcttatgctgtatgtttcaaagatgattcctgcatctgacaagggcaggttctttgccttcggtcgtgtcttctcagggaaggttgctactggtatgaaggttcggatcatgggtcccaactatgtccccgggcagaagaaggatctgtatgtcaagagtgtccagcgtactgttatctggatgggaaagaagcaagagtcggttgaggatgttccgtgtggtaacactgttgctatggttggtctggatcagttcatcacgaagaatgctacactcactaatgagaaggagactgacgcttgcccaatcagagcaatgaagttctccgtctctcctgttgtgcgtgttgctgttcagtgcaaggttgcctctgaccttcccaagctagtcgaaggtttgaagcgtctagcaaagtccgatcctatggttctctgtacaatggaagaatctggtgagcatatcattgctggagctggtgagcttcatcttgagatttgcctgaaggatctgcaggaggacttcatgggtggtgctgaaattattgtttcccctcccgtcgtctccttccgtgaaacggttcttgagaagtcctgccgtactgtcatgagcaagtctcccaacaagcacaaccgtctgtacatggaagcgcgccccttggaggagggtctcgctgaggccatcgatgacggccgtattggcccacgtgatgatccgaaggtgcgctcccagatcctctctcaggagtttgggtgggacaaggacctggccaagaagatttggtgttttggacctgagaccactggcccgaacatggttgtagatatgtgcaagggagtgcagtatctcaatgaaatcaaggattctgttgtggctggtttccagtgggcatcaaaggagggtgcactggctgaggagaacatgcgtggaatttgctttgaggtatgtgatgtcgttcttcatgctgatgctatccacaggggtggtggtcaggtcattcccactgccaggagggtcatctatgcctctcagctcacggccaagccaaggctgctggagccagtctacctggtggagatccaggccccagaaaatgcacttggtggtatctacggtgttctgaaccagaagagaggtcatgtctttgaggagatgcagaggccgggtaccccgctctacaacatcaaggctttcctccctgtcatcgagtcctttggtttctccagccaactgagggccgcaacctctggtcaggcgttcccccagtgtgtctttgaccattgggacatgatgggctcagatcctttggaggccggctcccaggctgctcagctggtgctggatatccgcaagaggaagggtctcaaggaacagatgacccctctttctgagtttgaggacaagctctaaaatttttggctgttggtgatactgtttcatctgccggtttaatcatcaattcgtctactgtaatagcagcgacttcaatattttattttgttttagttgtcaaatgcacctgtttttgaacaatatttgtgatgtagtgccctgccgcgcttagagtctgagactattttgttatctgctgtgatgtttcagatgaaacagagttgatgtctggtttagtaaatggttatattcttagtgtattgctcttttgtattgtcttgtcttattaagacctgtttgtggaaaatgaagtggcattcaaacaggtgccaagaggttccatta

SEQ ID NO: 2058 - DNA, 3024 bp, Zea mays
ccctcccccagtcatccatcactccgcagcagctgcctgcccgcctccgcgtctgcgacgagatccggcgccggcagcgagctctggcagcccagcaggaataaatattggtattggtagtgtgatcttcataaggagtcaagatggtgaagttcacagctgaagagctccgtgccatcatggacaaaaagaacaacattcgtaacatgtctgttattgctcatgtggaccatggcaagtctacacttacagattcccttgtggcagctgctgggattattgcccaggaagttgctggcgatgttcgcatgactgatactcgtgcagatgaagcagagcgtggcattacgatcaaatctactggtatctctctttactatgagatgactgacgagtcactgaagaactacaagggtgagagagatggtaatcaatacttgatcaaccttattgactcgcctgggcacgttgatttttcttcggaagtcacagctgctcttcgcatcaccgatggtgctctggtggtggttgactgtattgaaggtgtatgtgtgcaaacggaaacagtgcttcgccaagcccttggtgagaggattaggccagttcttaccgtgaacaagatggacaggtgcttccttgagcttcaggttgagggcgaggaagcttatcagactttctcccgtgtgattgagaatgccaatgtcattatggcaacgtatgaagataagctccttggtgatgtccaagtctacccagagaaggggactgttgccttttctgctggcctgcatggttgggcatttaccctcactaactttgccaagatgtatgcatctaagtttggagttgatgaatctaagatgatggagaggctttggggtgagaacttctttgaccctgccacaaagaagtggaccaccaagaacacaggttctcctacctgcaagagaggatttgttcagttctgctatgagccaatcaagcaaatcatcaagacctgcatgaatgaccagaaggagaaattgtggcccatgctgcaaaagctcaatgttaccatgaaggctgatgagaaggagttgattggcaaagctttgatgaagcgtgttatgcaaacgtggcttccagctagcactgctctgcttgagatgatgatattccaccttccttccccagcaaaggctcaaaagtatcgtgtggagaacttgtacgagggaccccttgatgatgtgtatgcaactgctatcagaaactgtgatccagagggtcctcttatgctgtatgtttcaaagatgattcctgcatctgacaagggcaggttctttgccttcggtcgtgtcttctcagggaaggttgctactggtatgaaggttcggatcatgggtcccaactatgtccccgggcagaagaaggatctgtatgtcaagagtgtccagcgtactgttatctggatgggaaagaagcaagagtcggttgaggatgttccgtgtggtaacactgttgctatggttggtctggatcagttcatcacgaagaatgctacactcactaatgagaaggagactgacgcttgcccaatcagagcaatgaagttctccgtctctcctgttgtgcgtgttgctgttcagtgcaaggttgcctctgaccttcccaagctagtcgaaggtttgaagcgtctagcaaagtccgatcctatggttctctgtacaatggaagaatctggtgagcatatcattgctggagctggtgagcttcatcttgagatttgcctgaaggatctgcaggaggacttcatgggtggtgctgaaattattgtttccccacccgtcgtctccttccgtgaaacggttcttgagaagtcctgccgtactgtcatgagcaagtctcccaacaagcacaaccgtctgtacatggaagcgcgccccttggaggagggtctcgctgaggccatcgatgacggccgtattggcccacgtgatgatccgaaggtgcgctcccagatcctctctcaggagtttgggtgggacaaggacctggccaagaagatttggtgttttggacctgagaccactggcccgaacatggttgtcgatatgtgtaagggagtgcagtatctcaatgaaatcaaggattctgttgtggccggtttccagtgggcatcaaaggagggtgcactggctgaggagaacatgcgtggaatttgctttgaggtatgtgatgtcgttcttcatgctgatgctatccacaggggtggtggacaggtcattcccactgccaggagggtcatctatgcttctcagctcacggccaagccaaggctgctggagccagtgtacctggtggagatccaggccccagaaaatgcactcggtggtatctacggtgttctgaaccagaagagaggtcatgtctttgaggagatgcagaggccgggcaccccgctctacaacatcaaggcttacctccctgtcatcgagtcctttgggttctccagccagctgagggctgcaacctctggtcaggcgttcccccaggctgtctttgaccattgggacatgatgggctctgatcctttggaggctggctcccaggctgctcagctggtgctggatatccgcaagaggaagggtctcaaggaacagatgatcccactttctgagtttgaggacaagctctaaatttgtggttgttggtgacactgttacagctgccggttcaatcgtcaattggttttactgtaaatgcagtgtgtgctgctgtgcggacagtctgatgctctattttaatatctgttaagctatctccagcagcttactcatcccacccgttatcttaaactccatgctgatgagacagttggtatatgtggtcttgtaagtggttgtatacttattcccagtgtgttgctcacttctaatgctctgcctgatctgtccgagaatttcacccttttgttggtttgtttccttgccttttccatgtgaagtgtgtagtcatttttgcagcactattggtttatgtatcgat

SEQ ID NO: 2059 - DNA, 3097 bp, Triticum aestivum
tttacccctccccgttcggttcggtcgttccggttcggccgtacgtccgtcaaacgggaacggaggccggccgacgcgtaggttgtactacacgacagacggtacggcgggacccccacacgcccgtcggccaacggggggatcgcctaggtccttctcctgcgccttcgctcggcgccgccgcctcttcatcctccagggctgtcctcatctcattcctcctgatagcgagggggatcctcaaggaatttatatttgtagtgtgataatcaaaagcagtcaagatggtgaaattcacagtagaaggactccgcatcatcatggacaagcaaaataatattcgcaacatgtctgttattgctcatgtggaccatggcaagtctacgcttactgattctctggtggcagctgctgggattattgcacaagaagttgcaggtgacgtccgcatgactgatactcgtgcagatgaagcagaacgtggtatcacaatcaaatccacgggtatatctcttttctatgagatgactgatgaatcactcagggcttataagggcgagagagatgggaatgaatacctgatcaaccttatagattcgcctgggcacgttgatttctcttcagaagtcacagctgctcttcgtattactgatggtgctttggtggtggttgactgtattgagggtgtctgtgtgcaaactgaaactgtgcttcgccaagcccttggtgagaggattaggcccgtccttactgtgaacaagatggacagatgcttccttgagcttcaggttgatggcgaggaagcttaccagactttctcccgtgtcattgagaacgccaatgtcattatggcaacatatgaagatgcaaaacttggtgatgtccaagtctacccagagaagggaactgttgctttctctgctggtttacatggatgggcatttactctcaccaactttgctaagatgtatgcctccaagtttggagttgatgaaactaaaatgatggagaggctttggggtgagaacttctttgacacagccacgaaaaagtggaccaacaagaacacgggctctcctacttgcaagagaggttttgttcagttctgctatgatccaatcaagcaaataatcaacacctgcatgaatgaccagaaggataaattgtggcctatgttacagaagcttggtgtgaccatgaaggctgatgagaaggagctaatgggcaagcctttaatgaagcgtgttatgcagacttggctgccagcaagtacagctctacttgagatgatgatattccaccttccttctccttccaaagcacagaagtatcgtgtagagaacttgtatgaggggccccttgacgatgtctatgcaactgctataagaaactgtgacccagaaggtcctcttatgctctatgtttccaagatgattccagcatctgacaagggcagattctttgcgtttggccgtgtcttctctgggagaattgcaactggcatgaaggtccggatcatgggcccaaactatgttcctggccagaagaaggatctgtacgtgaagagtgtccagcgtacagttatttggatgggaaagaagcaagagtctgttgacgatgttccttgtggtaatactgttgctatggttggcttggatcagttcatcacaaagaatgctaccctgacaaacgagaaggaggttgatgcatgcccaatcagggcaatgaaattctctgtatcccctgttgtacgcgttgctgtccagtgcaaggttgcctctgatcttcccaaacttgtggaaggcttgaagcgcctggcgaagtctgaccctatggttgtgtgttccatggaagagtctggcgagcatatcattgctggagctggagagctgcaccttgaaatttgtttgaaggatctgcaggaggatttcatgggtggtgctgagattattgtttcccctcctgttgtctctttccgtgagaccgttcttgagaagtcctgccgcaccgtgatgagcaagtccccgaacaagcacaaccgtctctacatggaagctcgtcccatggaggaagggctggccgaggccattgacgatggccgcatcggcccacgcgatgatcccaaggtgcgctccaaggttctgtctgaggagtttggttgggacaaggatcttgccaagaagatttggtgttttggacccgagaccactgggccgaacatggttgttgatatgtgcaagggagtgcagtatctgaatgaaatcaaggactccgttgtggctggcttccagtgggcgtcgaaagaaggggcattggcagaggaaaacatgcgtggtatttgctttgaggtctgtgacgtcgttctccatacagatgctattcacaggggtggcggtcaggtcatcccgacggctagaagggtcatttatgcttctcagctcacagctaagccaaggttactcgagcctgtgtacctggtggagatccaggcgcctgagaatgcacttggtggcatctatggtgttcttaaccagaagagagggcacgtgtttgaggagatgcagaggcctggtaccccactttacaacatcaaggcgtacctccctgttatcgagtcctttggtttctccggcacacttagggctgcgacatctggccaggccttcccgcagtgtgtgtttgatcactgggacatgatgtctgctgatcctttggaggcaggatcacaggcggcgcagctggttttggatatccgcaagaggaaagggttgaaagaacagatgacccctctctccgaatttgaggacaagctctaaatttttgctcccatgttatctgttatctcagccaatttttgatctatgcttggtctgtgtcaagagatgtactctttcgtattccagttccttgggttgtgttgtactgaacctatttcggtctcttatcagatttagcaaataatttaccttatatgatagcttgattgagtggttgattttagcaagtgttgctttgcatctcctaattgcattttcttcttatgtttgagaaccttggctagtttttccaatgtttccttgcgtctgataagacgccc

SEQ ID NO: 2060 - DNA, 2812 bp, Zostera marina
ttaatccattacattacgaaacctgtctcgtgaatatacaaaaaggaaaatggtgaagtttacagcagaagagcttcggaggattatggacttgaagcataacattcgtaacatgtctgttattgcccatgttgaccatgggaagtccactctaactgattctcttgtggctgctgcgggtatcattgctcaagaggttgccggtgatgttaggatgactgatacccgtgctgatgaagctgagcgtggaatcacgatcaaatctactggtatatctctgtactatgagatgactgatgcatccttgaagagcttcacaggggagagggtgggaaatgagtatctcatcaaccttatcgattctcccggtcatgtcgatttctcttctgaggttacagcagcccttcgtattactgatggagccttggtcgtcgttgattgtattgagggtgtttgcgttcagactgagactgtcctccgacaagctcttggagaaagaatcaggcccgtcctgacagtcaacaagatggatcgttgttttcttgaacttcaggtagatggtgaggaggcttatcagacgttccagagggtcattgagaatgccaatgtcatcatggccacttatgaagacgtacttcttggggatgtacaggtctaccccgaaaagggaaccgtcgccttttctgctggtttgcacggatgggctttcactttgacaaactttgcaaagatgtatgcgtcgaaatttggtgttgatgagtctaaaatgatggaacgactctggggtgagaacttctttgaccctgctacgaagaagtggaccactaagaacactgggtctgcaacctgcaagagaggatttgtacagttctgttacgagcctatcaagcagatcatcaacacctgcatgaatgaccagaaagataaactttggcccatgttgaagaaactcggagttgtcatgaaatctgatgaaaaagatcttatggccaagccgttgatgaagcgtgtcatgcaaaattggcttccagcgagtactgctcttcttgagatgatgattttccatctaccttcccctcacactgcacagaggtatcgtgtggagaatctgtacgagggcccacttgatgatatctatgctaatgccatcaggaattgtgatcctaacggtcctctcatgctctatgtttccaagatgattccagcatccgacaaaggtagattctttgcctttggccgtgtattttctggcaaggtttcaactggtgttaaggttagaattatggggccaaactatgtacctggacagaagaaggatctgtatgtgaagagtgttcagaggactgtcatctggatgggtaagaaacaggagtctgtagaggatgttccttgtggaaatactgttgctttggtcggattggatcagttcatcaccaagaatgccacactcaccaacgagaaagaagtggatgctcatcccatccgtgccatgaagttctcagtttctcctgttgtccgcgttgcagtacagtgcaagactgcctctgaccttcccaagctggtggagggtttgaagcgtcttgcgaagtctgatcctatggtcatgtgtatgattgaggaatctggcgagcatatcattgcgggagctggtgaacttcatcttgaaatctgtcttaaggatcttcaagatgatttcatgggaggcgctgagattgttgtgtctgacccagttgtttctttccgtgaaactgttatggataaatcatccaggactgtgatgagcaagtcccccaacaagcacaaccgtctctacatggaggcccgtccgttggaagatggtctagccgaagccatagatgatggacgaattggtcctcgtgatgatcccaaggtccgttccaagatccttgcggaggagtttggttgggacaaggatcttgccaagaagatctggtgcttcggaccggaaacaaccggacctaacatggtggttgatatgtgtaagggagtccagtaccttaatgaaatcaaggattctgtcgttgctggtttccaatgggcttccaaggaaggtgctttggctgaggagaacatgcgtggtatctgttttgaggtatgtgatgttgttcttcacgctgatgcaattcacagaggtggtgggcaggtgattcccacagcgaggagggtgatatacgcctctcagattactgcaaagccaaggttattggaaccagtctaccttgttgagatccaggcacctgagggtgctcttggaggtatctacggagttctgaatcagaagagagggcatgtctttgaggagatgcagaggccaggaacacccctttacaacatcaaggcttatcttccagtcgttgagtcgtttggattctccagtacacttcgagcggcaacctctggtcaagccttccctcagtgcgtgtttgatcattgggacatcatgtcatctgatccgttggatccaacctcccagtcagccattctcgtgaaggatatccgtaagaggaagggtttgaaggaacagatgacccctctctcggattttgaagacaagctttgatttgtccttagttttgggtggaaactgttatcctgcttgtaatttgcttgctagtttgttttttctgttgagaattgtgacacttacctgccgccaaacatgtttttcgttctgttttatttattccatcatgttttaagttatttatcatctcttcttgtttgtgcctacctgttttttcttctactgattgtaaaatttcaaataaaaatagatatctttaaatacaaa

SEQ ID NO: 2061 - DNA, 2850 bp, Zostera marina
ctgcgagattttgagagaagagatctagccgcttttctcattaatccattacattacgaaacctgtctcgtgaatatacaaaaaaggaaaaatggtgaagtttacagcagaagagcttcggaggattatggacttgaagcataacattcgtaacatgtctgttattgcccatgttgaccatgggaagtccactctaactgattctcttgtggctgctgcgggtatcattgctcaagaggttgccggtgatgttaggatgactgatacccgtgctgatgaagctgagcgtggaatcacgatcaaatctactggtatatctctgtactatgagatgactgatgcatccttgaagagcttcacaggggagagggtgggaaatgagtatctcatcaaccttatcgattctcccggtcatgtcgatttctcttctgaggttacagcagcccttcgtattactgatggagccttggtcgtcgttgattgtattgagggtgtttgcgttcagactgagactgtcctccgacaagctcttggagaaagaatcaggcccgtcctgacagtcaacaagatggatcgttgttttcttgaacttcaggtagatggtgaggaggcttatcagacgttccagagggtcattgagaatgccaatgtcatcatggccacttatgaagacgtacttcttggggatgtacaggtctaccccgaaaagggaaccgtcgccttttctgctggtttgcacggatgggctttcactttgacaaactttgcaaagatgtatgcgtcgaaatttggtgttgatgagtctaaaatgatggaacgactctggggtgagaacttctttgaccctgctacgaagaagtggaccactaagaacactgggtctgcaacctgcaagagaggatttgtacagttctgttacgagcctatcaagcagatcatcaacacctgcatgaatgaccagaaagataaactttggcccatgttgaagaaactcggagttgtcatgaaatctgatgaaaaagatcttatggccaagccgttgatgaagcgtgtcatgcaaaattggcttccagcgagtactgctcttcttgagatgatgattttccatctaccttcccctcacactgcacagaggtatcgtgtggagaatctgtacgagggcccacttgatgatatctatgctaatgccatcaggaattgtgatcctaacggtcctctcatgctctatgtttccaagatgattccagcatccgacaaaggtagattctttgcctttggccgtgtattttctggcaaggtttcaactggtgttaaggttagaattatggggccaaactatgtacctggacagaagaaggatctgtatgtgaagagtgttcagaggactgtcatctggatgggtaagaaacaggagtctgtagaggatgttccttgtggaaatactgttgctttggtcggattggatcagttcatcaccaagaatgccacactcaccaacgagaaagaagtggatgctcatcccatccgtgccatgaagttctcagtttctcctgttgtccgcgttgcagtacagtgcaagactgcctctgaccttcccaagctggtggagggtttgaagcgtcttgcgaagtctgatcctatggtcatgtgtatgattgaggaatctggcgagcatatcattgcgggagctggtgaacttcatcttgaaatctgtcttaaggatcttcaagatgatttcatgggaggcgctgagattgttgtgtctgacccagttgtttctttccgtgaaactgttatggataaatcatccaggactgtgatgagcaagtcccccaacaagcacaaccgtctctacatggaggcccgtccgttggaagatggtctagccgaagccatagatgatggacgaattggtcctcgtgatgatcccaaggtccgttccaagatccttgcggaggagtttggttgggacaaggatcttgccaagaagatctggtgcttcggaccggaaacaaccggacctaacatggtggttgatatgtgtaagggagtccagtaccttaatgaaatcaaggattctgtcgttgctggtttccaatgggcttccaaggaaggtgctttggctgaggagaacatgcgtggtatctgttttgaggtatgtgatgttgttcttcacgctgatgcaattcacagaggtggtgggcaggtgattcccacagcgaggagggtgatatacgcctctcagattactgcaaagccaaggttattggaaccagtctaccttgttgagatccaggcacctgagggtgctcttggaggtatctacggagttctgaatcagaagagagggcatgtctttgaggagatgcagaggccaggaacacccctttacaacatcaaggcttatcttccagtcgttgagtcgtttggattctccagtacacttcgagcggcaacctctggtcaagccttccctcagtgcgtgtttgatcattgggacatcatgtcatctgatccgttggatccaacctcccagtcagccattctcgtgaaggatatccgtaagaggaagggtttgaaggaacagatgacccctctctcggattttgaagacaagctttgatttgtccttagttttgggtggaaactgttatcctgcttgtaatttgcttgctagtttgttttttctgttgagaattgtgacacttacctgccgccaaacatgtttttcgttctgttttatttattccatcatgttttaagttatttatcatctcttctgttgtgctacctgtttttttcttctactgatttgtaaaatttcaaataaaaaatagatatcttaaattc

SEQ ID NO: 2062 - DNA, 3478 bp, Quercus alba
acatttgcaaactgctgagctgaggctgcgctatctcccaaaccctctcttgctctctctctctctgcgttccttaacagagcaatatcactttccttctcttttgctccaaacccctggttttttttaaggtgttctttgattcttcaagaaatttttgattgtgtcatttaaagactagtcaagatggtgaagttcacagctgatgagctccgcagaattatggactacaaacataacatccgtaacatgtctgtcattgcccatgttgatcatgggaagtcaacacttaccgattctcttgtggctgctgctggtatcattgctcaagaagttgctggtgatgtccgtatgacagatacccgtgcagatgaggcagagcgtggaattaccatcaaatccacgggtatctccctctattatgagatgagtactgagtctctaaagagctacaagggagagcgtaatggaaatgagtacctgatcaatctcatcgattcccccggacacgttgacttctcatccgaggtcacagctgctcttcgtattactgatggtgcactcgtggtcgttgactgtgttgaaggtgtttgtgtccaaacagaaactgtgctccgacaagccttgggtgaaaggattaggcctgtcttgactgttaacaagatggacaggtgtttccttgagctccaggttgatggagaggaggcttaccaaacattccagagggttattgagaatgctaatgtcattatggctacctatgaagatcccctccttggtgatgtccaggtctaccccgagaaaggaactgttgctttctctgctggtttgcacggctgggcttttactctaaccaattttgccaagatgtatgcttccaagtttggagttgatgagtccaagatgatggagcgcctctggggcgagaacttctttgaccctgctaccaagaagtggacaactaagaacactggctctgctacctgcaagcgtggtttcgttcagttctgttatgaacccatcaagcagattatcaacacttgcatgaatgatcagaaggacaaactgtggcccatgctgacaaagcttggtgttaccatgaagtctgaagagaaggacttaatggggaaggcattgatgaagcgtgtcatgcagacctggctcccagcaagtagtgctctcttggaaatgatgatctttcaccttccatccccttccacggcccaaaggtatcgtgttgaaaacttgtatgagggtccccttgatgatgcttatgctactgctatccggaactgcgatccagatgggcctctcatgctctacgtatcaaaaatgattcctgcctctgataagggtaggttctttgcttttggccgtgtctttgctggcagggtctctacaggtttgaaggttagaattatgggtccaaacttcgtccctggtgaaaagaaggacctttatgttaaaagtgtgcagaggactgttatctggatggggaagaagcaggaaactgttgaggatgtgccttgtggtaacacagttgctttggttggattggatcaatatatcaccaagaatgctactttgacaaatgagaaggaggttgatgcacacccaatccgagccatgaagttttctgtgtcacctgttgtccgtgtggctgttcaatgcaaggttgcatctgaccttcccaagcttgttgaaggtctgaaacgtttggccaagtcagatcctatggttgtatgttctattgaagagtctggagagcacatcattgctggtgcaggagaactccaccttgaaatctgtttgaaggatttgcaggatgatttcatgggtggagcagaaattattaagtctgaccctgttgtgtccttccgtgagacagtccttgagaagtcttcccgtactgtaatgagcaagtcacccaacaagcataaccgtctgtacatggaagcacgtcccttggaagatgggcttgcagaggccattgatgacggccgtattggtccaagggatgatcctaaagttcgttccaaaatcttggctgaggaatttggctgggataaggatcttgcaaagaaaatctggtgttttggccctgagaccactggacctaatatggtggttgatatgtgtaagggagtccagtacctcaatgaaatcaaggattctgttgttgctgggtttcagtgggcttctaaggaaggtgcactggctgaagaaaacatgagaggtatctgttttgaagtctgtgatgtcgtgcttcatgctgatgccatccacagaggtggtggtcaggtaattcctactgccaggagggttatttatgcttcccagctgactgccaagcccaggcttcttgagcctgtgtatctggtggagattcaagctcctgagcaggcactcggtggtatctacagtgttcttaatcagaaacgtggacatgtgtttgaggaaatgcagaggcctggtactccactctacaacatcaaggcatatttacccgtcgttgagtcttttggattctcaagcactttgagagctgcaacctcagggcaggctttcccacaatgtgtctttgatcactgggacatgatgtcttctgatccgttggaagctggtacacaggcttcgcagcttgtaatagacatccgcaagaggaagggtttgaaggagcagatgacaccgttgtctgagtttgaggacaagctataaacatttaatcttagtattgttgatcatgttggtttacttgagcaagacatcaacacacatcagcagacaggtaagattgcatggggttgtccccctgcctcgtttttgttttctgtttttgaaatgtcatcatgttttagtagttcctggatccctatgggaataaacactcagttttattattatgtttggttgtaatgttccattcgaggacaatatgtaacgttttattgtgttagatcgttctgttaaactattccatttgacggtggttgaggttttctatttctgttttagaaatggtggtgtaagttattttttttattaggcgtgataaataggtgtttcttggatgcaaattgacttatatttggttgagtacgccatattttcattcaaccttgtcattgatggggagcattattaggctgattaatactgttcatgtttgtgattgacaccctttttaagtttaactatcctctgcactgatggattctttgatgttgttaccgactatttttgaagactacaaattagtttcttggatttcttttctttgttagtctttgttgtgatttcaaataattgttggttatgtaatttttgcttttggctacttgcttttgttggaacttaatctataaattctgtgagttacagttgaatatgagtaatgtgaatctgattgttttgatttgaaattgtcagtggtagaaaaagccattgctggatttatttattggttgagttagggtag

SEQ ID NO: 2063 - DNA, 5262 bp, Malus domestica
cgcttttattttattctctcacctcaaaccctcctgcccttttaaaggagaggtctaacgttctagctccatttccttcgcctgccgcctctctcgcaccttgtcacctggtattaatagtaattttgaaggtgacatttgaagaaaagacaagatggtgaagttcacagcagaggagctccgtaggattatggactacaaacataacatccgtaatatgtctgttattgcgcacgtcgaccatgggaagtcaacccttacagactctcttgttgctgctgctggtatcattgcacaagaagtcgccggtgatgtccgtatgacggatacccgtgccgatgaagctgagcgtggtatcacaattaaatctaccggtatctctctgtactatgagatgactgatgagtctttgcagaggttcaagggagagagaaacggaaatgagtacctcatcaatctcattgattcccctgggcacgttgacttttcatctgaggtcacagctgctctgcgtattactgatggtgcacttgtggtggtggattgtattgagggtgtgtgtgtccagactgagactgtgctccgtcaagccttgggagagaggatcaggcctgttttgaccgttaacaagatggacaggtgcttcctcgagctccaggttgatggagaggaggcttaccagacattccaaagggttattgagaatgccaatgtcattatggctacatatgaagatccacttcttggtgatgttcaggtctacccagagaaaggaacagtcgccttctcagctggtttgcacggttgggctttcactctgaccaacttcgctaagatgtatgcttccaagtttggagttgatgagtcaaagatgatggaaaggctctggggtgagaactattttgacccagctacgaagaaatggaccagcaagaacaccggaactgcaacctgcaagcgtggtttcgttcagttctgttatgagcccatcaagcagatcatcaacacgtgcatgaatgatcagaaggataagttgtggcccatgttgacaaagcttggtgtcaccatgaagagtgatgagaaggacctgatggggaaggcgttgatgaagcgtgttatgcagacctggctaccagctagcactgctctattggaaatgatgatctttcaccttccatctccctccacggctcaaaggtaccgtgttgagaatttgtacgagggtccccttgatgatcaatatgccaatgccatcaggaattgtgaccccgaaggacctcttatgctttatgtgtctaagatgattcctgcttctgataagggtagattctttgcctttggccgtgtctttgctggtaaagttcagacaggtttgaaggttagaatcatgggtccaaattttgttcctggagaaaagaaggatttgtatgtcaagaacgtacagaggacggttatttggatgggaaagagacaagaaactgttgaggatgttccttgtggtaacactgttgctttggtcggtttggatcagtttatcaccaagaatgctactttaacaaatgagaaggaagtggatgctcaccctattcgtgctatgaagttctcagtttcacccgtcgtgcgtgttgctgtccagtgcaaggttgcatctgaccttcccaaacttgttgaaggtctcaagcgtttggccaagtctgatcctatggttgtctgctccattgaggagtcgggagagcacattattgctggtgctggtgaactgcatcttgagatctgtttgaaggatctgcaagatgattttatgggtggtgctgagattataaagtctgaccctgttgtgtccttccgtgagactgtccttgataagtcctgccgtacagtgatgagcaagtctccaaacaagcataaccgtctgtacatggaagcaaggccccttgaggaaggtcttcccgaggctattgatgaaggtcgcattggcccaagagatgatcccaagattcgttccaagatcttggctgaggagtttggttgggacaaggatcttgctaagaaaatctggtgttttggtcccgagaccactggtcctaacatggtggtcgacatgtgtaagggagttcagtaccttaatgaaatcaaggattctgttgttgctgggttccagtgggcctcaaaggaaggtgcattggcagaagaaaacatgagaggtatttgctttgaagtctgtgatgtggttcttcacgctgatgctatccacagagggggaggtcaggtcattccaactgctcggagggtcatctatgcctctcagctcacagccaagccaaggcttctcgaaccagtgtatctcgttgaaattcaagctccagagggggctcttggcggtatctacagtgttctgaatcagaaacgtggacacgtgtttgaggagatgcagaggccgggaactccactttacaacatcaaggcatacctccccgtgaagtttacagcagaagaactccgtaggattatggactacaagcacaacattcgcaatatgtctgttattgctcatgttgatcacgggaagtcaactcttacagactcgcttgttgctgctgcgggtatcattgcacaagaagttgctggtgatgttcggatgactgatactcgcgcagatgaggcagagcgtggtatcacaattaaatctaccggtatctctctgtactatgagatgactgatgagtctttgcagaggtacaagggagagaggaacggaaatgagtacctcatcaatctcattgattcccccgggcacgttgacttttcatctgaagtcacagctgctctgcgtattactgatggagcacttgtggtggtggattgtattgagggtgtgtgtgtccagactgagactgtgctccgtcaagcattgggagagaggatcaggcctgttttgaccgttaacaagatggacagatgcttccttgagctccaggttgatggagaggaagcttaccagacattccaaagggttattgagaatgctaatgtcattatggctacatatgaagatccacttcttggtgatgtccaagtgtacccagagaaaggaacagtcgccttctcagctggtttgcacggttgggctttcactctgaccaacttcgctaagatgtatgcttccaagtttggagttgatgagtcaaagatgatggaaaggctctggggtgagaacttttttgacccagctacgaagaaatggaccagcaagagcaccggcactgctacctgcaagcgtggttttgttcagttctgttacgaacccatcaagcagatcatcaacacctgcatgaatgatcagaaggataagttgtggcccatgttgacaaagcttggtgtcaccatgaagagtgatgagaaggacctgatggggaaggctctgatgaagcgtgttatgcagacctggttaccagctagcactgctttattggaaatgatgatttttcaccttccatctccgtcaacagctcaaaagtaccgtgttgagaatttgtacgagggtcctcttgatgatcaatatgccaatgccatcaggaactgtgaccccgatggacctcttatgctctatgtgtccaagatgattcccgcttctgataagggtagattctttgcctttggccgtgtctttgctggtagagttcagacaggattgaaggttagaatcatgggtccaaattttgttcccggagagaagaaggatttgtacgttaagaacgtacagaggactgttatttggatgggaaagagacaagaaactgttgaggatgttccttgcggtaacactgtggcattggtcggtctggatcagtttattaccaagaatgcaactttaactaatgagaaggaagtggatgctcaccctatccgtgctatgaagttctctgtttcacctgtcgtgcgtgttgctgtccagtgcaaggttgcatctgaccttcccaaacttgttgaaggtctcaaacgtttggccaagtctgatcctatggttgtctgctccattgaggagtctggagagcacattattgctggtgctggtgaactgcatcttgagatctgtttgaaggatctgcaagatgattttatgggtggtgctgagattataaagtctgaccctgttgtgtccttccgtgagactgtccttgataagtcctgccgtacagtgatgagcaagtctccaaacaagcataaccgtctgtacatggaagcaaggccccttgaggaaggtcttcctgaggctattgatgaaggtcgcattggcccaagagatgatcccaagattcgttccaagatcttggctgaggagtttggttgggacaaggatcttgctaagaaaatctggtgttttggtcccgagaccactggtcctaacatggtggtcgacatgtgtaagggagttcagtaccttaatgaaatcaaggattctgttgttgctgggttccagtgggcctcaaaggaaggtgcattggcagaagaaaacatgagaggtatttgctttgaagtctgtgatgtggttcttcatgctgatgctatccacagagggggtggtcaggtcattccaaccgctcgaagggtcatctatgcctctcagctcacagccaagccaaggcttctcgaaccagtgtatctcgttgaaattcaagctccagagggggctcttggcggtatctacagtgttctgaatcagaaacgtgggcacgtgtttgaggagatgcagaggccaggaactccactttacaacatcaaggcatacctccccgtcgttgagtcctttggattctctggtcaactgagggctgcaacttccgggcaggccttcccacaatgcgtgtttgatcattgggagatgatgtcgtctgatccattggaagctggatcccaggctgcaacacttgtcaccgacatccgtaagaggaagggtttgaaggagcagatgaccccgctctctgagttcgaggacaagctataaactatttactatatattcggtgtcttgccaatttgctcgattagggatggatatagcatcaccggactggattgcggaacaatattttttggtctcaagctattttaattgtttggtattcggttttctggtattgattatgtcatttgggagatcaatgttgctttcgtcaacaattttattagtcttatattaatttctactcatggtttgagaaatataacaattgggagatcaatgttgcatctggactctct

SEQ ID NO: 2064 - DNA, 2961 bp, Nicotiana benthamiana
attgtaaggtctcacaatagcaatagtcgccgcctacttctctctatactcagaacataaataattctgtagctgttacagttaacgagtattcaagatggtgaagttcacagctgaagagcttagacacattatggactacaagcataacattcgtaatatgtctgttattgctcatgtggaccatggaaaatctacccttactgactctctggtggcggctgctggtattattgctcaggaagttgcaggtgatgtcagaatgacagatacacgtgcagatgaagctgagcgtggtatcaccatcaagtccactggtatttcactatattatcagatgactgatgaatccttgaagaacttcaagggagagagaaatgggaacgagtacctcatcaacctcattgattcacctgggcacgttgacttctcatctgaagtgactgctgcccttcgtattactgatggtgcacttgttgtggttgactgtgtagaaggtgtctgtgtccagacagagactgtgctccgtcaggccctcggtgaaaggattcgtcctgtcttgacagttaacaagatggacaggtgtttccttgaacttcaggttgatggagaggaggcttatcagacattttccagggttattgagaatgctaatgtcatcatggctacatatgaggatccccttcttggtgatgtacaggtctatcccgagaaaggtactgttgctttctctgctggattgcacggctgggcttttactctcaccaactttgccaatatgtatgcttccaagtttggagttgacgagtctaagatgatggaaaggctgtggggtgaaaacttctttgaccctgccaccaaaaagtggaccaccaaaagcactggatctgctacatgcaagcgtggatttgttcaattctgttatgagccaatcaagcagattattaacacttgcatgaatgatcaaaaagataagctctggccaatgttgcagaagcttggtgtaaccatgaagtctgaggagaaagagttgatgggcaaggcactgatgaagcgtgtgatgcagacctggcttcctgcaagtactgctcttctggaaatgatgatctttcatctgccatctccttccacagctcaaaaataccgtgtggaaaacctgtacgagggacctctggatgatcaatatgccaatgccatcaggaactgtgacccagaagggccacttatgctttatgtatccaaaatgattccagcatcggacaagggtaggttctttgcttttggtcgtgtgtttgctggtaaggtttgtactggtatgaaggtcagaatcatgggtcccaactatgtacccggtgaaaagaaggatttgtatgttaagaatgtgcagagaactgttatttggatgggtaagaagcaagaaacagttgaggatgtcccttgtggtaacactgttgccatggtcggtctggatcaatttattaccaagaatgcaacattgaccaatgagaaggaagtcgaggcccatccaatcagggcaatgaagttttctgtctcaccagttgtgcgtgttgctgttcagtgcaagcttgcatctgaccttcccaagcttgttgaagggttgaagcgcctggctaagtctgatcctatggttctttgttctattgaagagtctggagagcatatcattgctggtgctggggaactccaccttgagatctgcttgaaggacttgcaggatgatttcatgggcggtgctgagattatagtgtctgatcctgttgtgtccttccgtgagactgtacttgagaagtcttctcggactgtgatgagcaagtctcctaacaagcataaccgtttgtacatggaagccagacccctggaagaagggcttgctgaggctattgacgatggacgcattggccctagggatgatcccaaagttcgttccaagatcttgtctgaggagtttggttgggacaaggatcttgcaaagaaaatttggtgctttggtccagagacaactggtccaaacatggtggtagatatgtgtaagggagttcagtacctgaatgagattaaggattctgttgttgctggtttccagtgggcttccaaggaaggtgcattggctgaagagaacatgagaggtatttgctttgaagtctgtgatgttgttcttcatgctgatgctattcacaggggtggtggccaagttattcccactgctaggagggttatctatgcttctcagcttaccgccaagcctcgcctgttggagccggtttaccttgtggagattcaggctccagagcaagcccttggtggcatttatggtgttctgaaccagaaacgtggacatgtgttcgaggagatgcagaggccaggaacccctctttacaacatcaaggcataccttcctgtcattgagtcttttggattctcaggtacattgagggcagctacttctggtcaagctttcccacaatgtgtgttcgatcattgggacatgatgtcatccgatccattggacgctggtacacaagctcatcaactcgtccttgatatccgcaagaggaagggtttgaagcagacagtgactcctctgtctgagtttgaggataagctgtaagcatgcagatggttcagcttggcgggtggttttgatggaaacatgcttagtccggatctgcataagttttgttttacatttatctgtgttttgacgtactttttatcattttccatgatataggagtttaaatcgtaagtcagctattgcagaacttatttgtcatctaaatggacgagaatgttgctatgattttgtttttgaagtgtcttattttttgctcattgcttttgttgcttcggtagatctcccctcccatgctaatctttcttactctccttgtgtcatttcaatagaatgttgaagtggaactgtttccatttgtttgttta

SEQ ID NO: 2065 - DNA, 3191 bp, Unknown
  Sequence found in Organisms: Citrus clementina, Citrus sinensis
tgcctcgtctatcgagagctctcaagactaaacagagccctctcgttttcttttggttataccccttgcaagctaaacgaacaaacaaaagcttgccagtttttcttaacaagtcaagatggtgaagtttacagctgagggactccgtaggattatggacttcaaacataacatccgtaatatgtctgtgattgctcatgtcgatcatgggaaatcaactcttacagactctcttgtggctgctgcgggtatcattgcacaagaggttgctggtgatgtgcgtatgacagatactcgtgctgatgaagctgagcgtggtattacaatcaagtctactggtatctctctctactatgagatgactgatgatgccctgaagagctacaagggagaacgtaatgggaatgagtacctgatcaatcttattgattcccctgggcacgttgacttctcatctgaggtgacagctgctcttcgtataactgatggtgcccttgttgtggtggattgtattgagggtgtctgtgtgcaaacggaaactgtgcttagacaagccttgggtgagaggattaggccagtcttgactgtgaataagatggataggtgctttcttgagctccaggttgatggagaggaggcttaccagactttctccagagtggttgagaatgctaatgtcattatggctacctatgaagatccactcctgggggatgttcaagtataccctgagaaaggaaccgttgctttctcagctggtttgcatggctgggcttttactttgaccaactttgctaagatgtatgcatcaaaatttggagtcgatgagtctaagatgatggagaggctctggggtgagaatttctttgacccggccacaaagaagtggacaaccaagaacactggtagtgcgacatgcaagcgtggttttgttcagttttgctatgaaccgattaagcagattatcaacacttgcatgaatgatcagaaagataagctgtggcccatgttgcaaaagcttggtgtcacgatgaagtcagaagagaaggatttgatgggcaaggcattgatgaagcgtgtcatgcagacctggcttcctgcaagtagtgcacttttggaaatgatgatctttcaccttccctctccttccacggcccaaaaatatcgtgttgagaacttgtatgagggtcctcttgatgatcaatatgctaatgctattcggaactgtgatcctaatggtcctcttatgctctatgtatctaagatgattcctgcatctgataagggtaggttctttgctttcggtcgtgtgttttctggtaaggtgtcaacaggtttgaaggtcaggatcatgggtccaaactatgttcctggtgagaagaaagatttgtatgttaagagcgtccaaaggactgttatttggatgggaaagaagcaggaaaccgttgaggatgtgccttgtggtaacactgtggctatggttggtctcgatcaattcatcactaaaaatgctaccttgactaatgagaaggaagttgatgcccatcccatccgtgctatgaagttctctgtctcacctgttgttcgtgtggctgtccagtgcaaagtcgcttctgatctccctaagcttgttgaaggtcttaagcgtttggccaagtcagatcctatggttgtctgtacaattgaggagtctggcgagcacattgttgctggtgcgggagaacttcaccttgagatctgtttgaaggatctgcaggacgatttcatgggaggtgctgaaattattaaatctgatcctgttgtgtccttccgtgaaactgtccttgagaagtcttgccgcactgtgatgagtaagtctcccaacaagcataatcgtctctacatggaagcccgacctctggaagaaggtcttgctgaggccatagatgatggccgcattggtccaagggatgatcccaaggctcgatctaagatcttgtctgaggagttcggctgggacaaggatcttgcgaagaagatttggtgttttggtcctgagaccactggccctaacatggtcgttgatatgtgtaagggagttcaatacttgaatgaaattaaggattctgttgttgctggtttccagtgggcatcgaaagaaggtgcgctggctgaagagaacatgagaggtatctgctttgaagtatgtgatgttgttcttcacgctgatgccattcacagaggtggtggtcaagtcattcctactgctaggagggtcatatatgcttcccagctcacagccaagcccaggcttcttgagcctgtctacatggtcgaaatacaggctcccgagcaggcccttggtggtatttacagtgttctcaatcagaaacgtggtcacgtgttcgaggaaatgcagagacctggtacccccctttacaacatcaaggcttaccttcccgtcatcgagtcctttggattctcaggcactttgagggctgcaacgtcaggacaggccttcccacaatgtgtgtttgatcactgggacatgatgtcatccgatccactggagcctggtacacaggctgcacagcttgttgctgatatcaggaagaggaagggcttgaaggagcaaatgacaccactatctgagtttgaggacaagctgtaaacatttcgtcttgacatcaagggtgagattgcgcagcttgttgctgatatcaggaagagggagcaaatgacaccgctatccgagtagaggacgagctgtaaacatttcatcttgacatcaagggtgagattgcgcagcaatattttttgctgatgcttatttttgtttcaaagtttttcaatatcctcattgtgtttagtaaagtaatattactgttgattgggtttagtaaccctgtctctgtcatctaggttttaaattttacaattcacagcttttaaggtttgatgttctgtcatgtgtttaaactaattctggccgacgttggttgatatattattattattattatgatatttttcttgttcagtgttgtgttgttagctatttaggtgtctataatgttttctgtggatgtgtctctttgtgatctgatgtggtggattatttttgttccttgatatattgtattgagaggaatggatatacaaaatattggttcgattcttttggaaccctaatggtatgagagttatgtgac

SEQ ID NO: 2066 - DNA, 3241 bp, Gossypium raimondii
aaaaaaccaactgcactaacagcccatgcccaataagcaaaagagaggagaaaaaccctagctgacatacgttaatgctcactcactcaaacgcactgcttgtatctcatcgactataaatccctcatttgctccaccctcaaaatcttcgtctctttattttctttcgccgcctttctctcccagtttgattctttgttcggggcaatttaaagacaagtcaagatggtgaagtttacagctgaggagctccgtgccattatggaccggaaacacaacatccgtaacatgtctgttattgcccatgtggatcacgggaaatcaactcttaccgattctcttgttgctgctgctggtatcattgcacaagaagttgctggtgatgttcgtatgacagatacccgtgcagatgaggctgagcgtggtatcacaatcaagtctactggaatctctttgtactatgaaatgagtgaggattctttgaagagctacaagggcgagaggcatgggaatgagtacctcatcaatcttattgattcccctgggcatgttgacttttcatcggaggtcacagctgctcttcgaattactgatggtgcccttgtggttgttgattgtattgaaggtgtctgtgtgcaaacagagactgtcctccgtcaggcgcttggtgaaaggatcaggcctgtcttgactgttaacaagatggacaggtgcttccttgagctccaggttgatggagaggaggcttaccagacatttcagagagtgatcgaaaatgctaatgtcatcatggccacatacgaagatcctcttcttggtgatgttcaagtctaccctgagaaggggacagttgccttctctgcaggtttgcatggttgggcttttaccttgaccaactttgcaaaaatgtatgcctcaaagtttggagttgatgagtcaaaaatgatggaaagactttggggtgagaacttcttcgatccagctaccaagaagtggaccaccaagaacactggttctgccacctgcaagcgtggatttgttcagttctgctacgaacccatcaagcagatcatcaacacttgtatgaatgaccagaaggataaactctggccaatgttgcaaaagcttggtgtcaccatgaagtctgatgagaaggacttgatggggaagtccctaatgaagcgtgtgatgcagacctggcttcctgcaagcaatgctctcctggaaatgatgatctttcaccttccctcacctagcaaggctcagaagtatcgtgttgagaacttgtacgagggtcctcttgatgatatctatgccaatgctatcagaaactgtgatcctgagggtcctcttatgctctatgtttcaaagatgattcctgcttctgataagggcagattctttgcttttggtcgtgtcttttctggcaaagtctcaactggattgaaggttaggatcatgggtccgaactatgtccctggtgagaagaaagacttgtatgttaagagtgtgcaaagaactgtcatttggatgggaaagaagcaggagactgttgaagatgtaccttgtggtaacacagttgccatggttggtttggatcagtttatcaccaagaatgctactttgacaaacgagaaggaagttgatgcccacccaattcgtgcaatgaagttttccgtctcccctgttgtccgtgttgctgttcagtgcaaggttgcatctgatcttcccaaacttgttgaagggcttaagcgtttggccaagtctgatcctatggttctctgtaccattgaagagtccggagagcacattgttgctggtgctggtgaactccaccttgagatctgtctcaaggatttacaagaagatttcatgggtggtgctgagattattaaatcagaccctgttgtgtcattccgtgagactgtccttgagaggtcttgcaggacagtgatgagcaaatctcctaacaagcacaaccgtctgtacatggaggctcgacccttggaggaaggtcttgctgaggctattgacgatggacgcattggtccaagagatgatcctaaggttcgttccaagatcctggctgaggagtttggttgggacaaagatctcgctaagaagatttggtgttttggccctgagaccactggccctaacatggtggtcgatatgtgtaagggagttcaatatctgaatgaaattaaggattcagttgttgctgggttccagtgggcatcaaaggaaggtgccctggctgaagaaaacatgagaggcatctgcttcgaagtctgtgacgtggtcctccatgctgatgccatccacagaggtggtgggcagatcattccaacagctaggagggttttctatgcttctcagctcacagccaagccaaggcttctcgaacctgtttacttggtcgagatccaagccccggagcaggcacttggtggtatttacagtgttcttaaccagaagcgtggacatgtattcgaggaaatgcaaagacctggcactccactttacaacatcaaggcataccttcctgtcattgagtcctttggattctctagcactttgagggctgcaacatcaggacaagctttcccacaatgtgtgtttgatcactgggatatgatgtcatcagacccattggaacctggctctcaggcagcagcccatgtcgccgaaatccgcaagaggaaaggattgaaggaacagatgaccccactttccgagtacgaggacaaactgtaagctaagagagagtaactgtgattgtgcggcataaccttcgctgcaatttagttttgttttctgtctggttatattttgttagcatggatgctttttcacccatatgatgtacgttcgtttttagacgtttgtgttttgatgatgatcatgatgtactacaatcgacattacgttgaacttttatatctcttaatcttcatatgccaacttcatttagaggtttttgtgcgagtacaatacttaaatccttttagagagtttttaagcttgcttgtgcatcaagtaaatcgactatttattataccatttaggcttttacttaaatcttttagacgaacttgcctctagtttggatctggttcaatggaactaccctttatgtccttttaattccagaaaatacagctcacttttgttaattttatagggtatttcaagacttatttttttacatgaaaaccttaaatccatccttcaatttccc

SEQ ID NO: 2067 - DNA, 2707 bp, Saccharum officinarum
cagtcacccatctctcccgcaccgcagccgccgcccgcccgcctccgcgcctgcgacgcgatccggcgccggcagcgagctctatctcccgcgacgagcagcagttgccaccgacgcacgcagcccacggaataaatatcggtattggtagtgtgatcttcataagaagtcaagatggtgaagttcacagctgaagagctccgtgccattatggacaaaaagaacaacatccgtaacatgtctgttattgctcatgtggaccatggaaagtctacgcttacagattcccttgtggcagctgctgggattattgcccaggaagttgctggcgatgttcgcatgactgatactcgtgcagatgaagcagagcgtggtattacaatcaaatctactggtatctctctttactatgagatgactgatgagtcactgaagaattacaagggcgagagagatggcaaccaatacctgatcaaccttattgactcgcctgggcacgttgatttttcttcggaagtcacagctgctcttcgcatcaccgatggtgctctggtggtggttgactgtattgaaggtgtctgtgtgcaaactgaaactgtgcttcgccaagcccttggtgagaggattaggccagttcttaccgtgaacaagatggacaggtgcttccttgagcttcaggttgagggcgaggaagcttaccagactttctcccgtgtcattgagaatgccaatgtcatcatggcaacatatgaagataagctccttggtgatgtccaagtgtacccagagaaggggactgttgctttttctgctggcctgcacggatgggcctttaccctcactaactttgccaagatgtatgcatctaagtttggagttgatgaagctaagatgatggagaggctttggggtgagaacttctttgaccctgccaccaagaaatggaccaccaagaacacaggctctcctacctgcaagagaggatttgttcagttctgctatgagccaatcaagcaaatcatcaacacctgcatgaatgaccagaaggagaaattgtggcccatgctgcaaaagctcaatgttaccatgaaggctgatgagaaggaattgattggcaaagctttgatgaagcgtgttatgcaaacgtggctaccagctagcactgcactgctcgagatgatgatattccaccttccttccccggcaaaggctcaaaagtatcgtgtggagaacttgtacgagggacctcttgatgatgtctatgcaactgctatcagaaactgtgatccggagggtcctcttatgctgtatgtttcgaagatgattccagcatctgacaagggcaggttctttgcctttggtcgtgtcttctcagggaaggttgctactggtatgaaggttcggatcatgggtcccaactatgtccctggccagaagaaggatctgtatgtcaagagtgtccagcgtaccgttatctggatgggaaagaaacaagagtcagttgaggatgtcccttgtggtaacactgttgctatggttggtctggatcagttcatcacgaagaatgctacactcactaatgagaaggaggttgatgcatgcccaatcagagcaatgaagttctctgtctctcctgttgtgcgtgttgctgttcagtgcaaggttgcctctgaccttcccaagctagtcgaaggtttgaagcgtctggcgaagtctgatcctatggttctctgtacaatggaagagtctggtgagcatatcattgctggagctggcgagcttcatcttgagatttgcctgaaggatctgcaggaggacttcatgggtggtgctgaaattattgtttcccctcctgttgtgtccttccgtgaaaccgttcttgagaagtcctgccgtactgtgatgagcaagtctcccaacaagcacaaccgtctgtacatggaggcgcgccccttggaggagggtcttgctgaggccatcgatgagggccgcattggcccacgtgatgatcctaaggtgcgctcccagatcctctctcaggagtttgggtgggacaaggatctcgccaagaagatttggtgctttggacctgagaccaccggcccgaacatggttgttgatatgtgtaagggagtgcagtatctcaatgaaatcaaggattctgtcgtggctggtttccagtgggcatcaaaggagggtgcactggctgaggagaacatgcgcggaatttgctttgaggtctgtgatgtcgttcttcatgctgatgctatccacaggggtggtggccaggtcattccaactgccaggagggtaatctatgcttctcagctcacggccaagccaaggctgctggaaccagtgtacctggtggagattcaggctccagaaaatgcacttggtggtatctacggtgttctgaaccagaagagagggcacgtctttgaggagatgcagaggcccggtaccccgctgtacaacatcaaggcttacctccctgtcatcgagtcctttgggttctccagccaactgagggctgcaacctctggtcaggctttcccccagtgtgtctttgaccattgggacatgatgggctctgatcctttggaggcttgctcccaggctgctcaactggtgctggatatccgcaagaggaagggtcttaaggaacaaatgaccccttctttctgagtttgaagacaagctctaa

SEQ ID NO: 2068 - DNA, 3011 bp, Ricinus communis
agggttatcccaatacgcaatatctctctctcgctctctaaaatatatcaactaaaaggaagtggctctcgttttcatataatcgataattactgaagcgagagttggctttctgaaaaaaaatcctctcttctatagccgcctcactcttctgctagctttcgctttcaaccggtcttgtgctatagttaatcggtggtgaattttgaaggctaatcaagatggtgaagttcacagctgaggagcttcgtcgtattatggactataagcacaacattcgtaatatgtctgttattgcccatgttgatcatgggaaatcaacacttacagattctcttgtggctgctgctggtatcatagcacaagaagttgctggtgatgtccgtatgactgatactcgtcaggatgaggcggagcgtggtattacaattaaatctactggtatctcactctactatgagatgactgacgaggcccttaagagcttcaagggagagagacaagggaatgaatatcttatcaatctcattgattctcctggacatgttgacttctcctctgaagtcactgctgctcttcgtattactgatggtgcactcgtcgtggtcgactgtattgagggtgtttgtgttcaaactgaaactgtgcttcgccaagctttgggtgaaaggatcaggcctgttttgacagtcaacaagatggataggtgtttccttgagcttcaggttgatggtgaggaggcttatcaaacattttcaagggtcatcgaaaatgctaatgtcataatggctacatatgaggatcctcttcttggagattgccaggtctaccctgagaaaggaactgttgcattctcagctggtttgcatggttgggcttttactttgacaaactttgccaaaatgtatgcctcaaagtttggagtggatgagtctaagatgatggaaagactatggggtgagaacttctttgatcctgccaccaagaagtggaccagcaagaacactggctctccgacttgcaagcgtggttttgttcagttctgctatgagcctatcaagcagatcatcaacacttgcatgaatgaccagaaggacaaattgtggccgatgttgcaaaagcttggtgttaccatgaagtctgacgagaaggaattgatggggaaggctctgatgaagcgtgtgatgcagacctggcttcctgccagcagtgctctcctggaaatgatgatctttcaccttccctctcctgccaaggcccagaggtatcgtgttgagaacttgtacgagggtcccttagatgatccttatgcaactgcaattaggaattgtgatcctgaaggtcctcttatgctttatgtgtccaagatgattcctgcttctgataagggtagattctttgcctttggtcgtgtgtttgctggaaaagtctcaactggtctgaaggtgaggatcatgggtccaaactatgttcctggtgagaagaaagatttgtatgttaagagtgtgcaaagaactgttatttggatggggaagaagcaggaaactgttgaggatgtgccttgtggtaacactgttgccctggttggtttggatcaatttatcactaagaatgccactttgaccaatgagaaggaagttgatgcccatcctattcgtgctatgaaattctccgtgtcaccagttgtgcgtgtggcggttcaatgtaaagttgcatctgatttacctaagctcgttgaaggtcttaagcgtttggccaagtcagatcctatggttgtctgtactattgaggagtctggtgaacacatcattgctggtgctggagagctgcatcttgaaatctgtttgaaggatctgcaggacgattttatgggtggagctgagatcatcaaatcagaccctgttgtgtcattccgagagactgtccttgagaagtcatgccgtgtggtaatgagcaaatctccaaacaagcacaaccgtctttacatggaggcacgacctatggaggaaggtcttgctgaggctattgatgagggtcgtattggcccaagggatgatcctaaggctcgtgcaaagatcttatctgaagagtttggctgggacaaggatctggctaagaaaatttggtgttttggtcctgaaactactggtccaaacatggttgttgacatgtgtaagggagtacaatacctgaatgaaattaaagattcagttgttgctggattccagtgggcatcaaaggagggtgctttggctgaagaaaacatgaggggtatctgctttgaagtctgtgatgttgttctccatgctgatgctattcacaggggtgggggtcaggtcattccaacggcaaggagggtaatttatgcctcacagctaacagccaagcccaggcttcttgagcccgtttacctggttgagatccaggctccagagcaggctctgggtggtatttatagtgttcttaatcagaagcgtggtcatgtgtttgaggaattgcagaggcctggtactcctctgtataacattaaggcataccttccagttatcgagtcgtttggtttctctggcacattgagggctgctacatcaggacaagcgttcccacagtgtgtgtttgatcactgggatatgatgtcttctgatccaatggaaccaggttctcaggcagccaatcttgtaacagaaatccgcaagaggaaaggcttgaaggaacagatgacaccgctgtctgagtttgaggacaagctataatcaattgttatgagcgaaagatgataaacagaaaatgtttttgttgcattttacctttttgttttcatttcaggttttaatttatgttacaatgtagtaggtactatgttctgttgagagaatgttttgttttaatatcaggtatccgagtgtactatgtcctgaattgcaaccattattggtttattttattgctgatctgtctttgtttcagatttttcatttttgttttccgcctgcgttcattaacagatgtct

SEQ ID NO: 2069 - DNA, 2897 bp, Aquilegia formosa
tgagaagtgagaagtgagaagagaagaataataagaagaaagaaagaaagaagcagagtgaagcaaaagaaggaagaaggaagaaaacttgttattttctgctccttttgaggagctcttctttgtccagtgcattgctgtgatacacacaagcagcaaaaatggtgaagtttacagcagaggaacttcgcaggattatggacctgaaacataacatccgaaatatgtctgtgattgcccacgttgaccatggaaaatctactctcaccgactctctggtggctgctgccggtatcattgcccaggaagtggctggagatgtgaggatgactgatacacgtgcggatgaagctgagcgtggtatcacaatcaaatctactggcatctctctgtactacgagatgactgacgagtctcttaagagcttcaagggagaaagaatgggaaacgaatatctcatcaatctgattgattctcctgggcacgtcgacttctcatctgaagttactgctgctctccgaatcactgatggtgcccttgtggtggttgactgcattgaaggtgtctgtgtccagactgaaactgttctgcgccaagctctaggtgaaagaatcaggcctgtcttgacagtgaataagatggaccgttgcttccttgagctccaggttgatggggaggaggcttaccagacattccaacgggtgattgagaatgcgaatgttatcatggctacatacgaagaccctctacttggtgatgtccaggtttatcctgaaaagggaaccgttgccttctctgctggtttgcatggttgggctttcactcttaccaactttgctaagatgtatgcatctaagtttggagttgacgagtccaagatgatggaaaggctttggggtgagaattactttgatccagctaccaaaaaatggacaagcaagaacactggttcttcgagctgcaagagaggctttgttcagttctgttatgaacccattaagcagatcattaatacttgtatgaatgaccagaaggacaagctgtggcctatgcttcaaaagcttggtgtcaccatgaagggagaggagaaggagttactcgggaaagctttgatgaagcgtgtgatgcaaacctggctccctgctagcaccgccctattggaaatgatgatctttcacctgccctctccttccacagctcagaggtaccgtgtcgagaacttgtatgagggtcctctggatgatcagtatgctaacgccatcagaaactgtgatcctgaagggcctctcatgttgtacgtgtcaaagatgattccagcatctgacaagggtagattctttgcttttgggcgtgtttttgctggaaaggtctcaactggaatgaaggtcagaattatgggacctaactatgttcctggccagaagaaagacctttatactaagagtgttcagagaactgttatctggatggggaagaggcaagagtcggtggaggatgtgccgtgcggtaatacagtcgcaatggttggtttggatcagttcataaccaagaatgcaacccttacaaatgagaaagaagttgatgcccatcctatccgagccatgaagttctctgtctcccctgttgttcgtgttgctgttcagtgtaaggttgcctctgacctacccaagcttgttgaaggtctcaagcgtcttgccaagtccgatcctatggtggtgtgctcgattgaggagtcgggtgagcacatcatagctggggcaggggagctccatcttgagatctgcattaaagacttggtggatgatttcatgggaggggcagaaattgtacaatctcctccagttgtatcattccgtgaaactgttcttgagaagtctgtcagaactgtgatgagcaagtcaccaaataagcacaaccggttgtacatggaagcacgtcctctggaggagggtcttgctgaggcaattgatgaaggccgcattggcccaagagatgatcctaagttccgctccaagatcttgtctgaagagtttggatgggacaaggatcttgccaagaagatctggtgttttggtcctgagaccactggacctaacatggttgtggatatgtgcaagggagttcagtacctgaatgaaatcaaggactcagttgtggctggtttccaatgggcctctaaagagggtgcgttgtgtgaggagaatatgaggggtatttgctttgaggtatgtgatgttgtacttcatgctgatgctattcacagaggaggtggtcaggtcattcctactgcaaggagggtcatctatgcatcacagctcactgcgaagcctagactcttggaacctgtctacttggtagaaatccaagctccggagcaggcacttggtggcatctacggtgttctgaatcagaagagaggacatgtgtttgaggaaatgcagaggcctggtaccccattgtacaacatcaaagcgtacttgccggtcgttgagtcattcgggttctctagccaacttagagctgcaacctctgggcaagcttttccccagtgtgtgtttgaccactgggacatgatgtcctctgatccactggagtcaggctctcaagcttcaacactggttactgaaattcgtaagaggaagggtttgaaagagcaaatgaccccactttctgaatttgaggacaagctttaatttcacagtaatggaattttgatctgttttgttttgatatctcttgtcacggcctttatttgcgcgcagatgtagattcctgtccaatattatactctttatgtttacttttgtcgttggtttgatcttggtcatgtactcatgtaggagctttatgcatgataacaattggcagaggttatatgatagttttaaatttcgcat

SEQ ID NO: 2070 - DNA, 2709 bp, Gossypium hirsutum
aagatggtgaagtttacagctgaggagctccgtgccattatggaccggaaacacaacatccgtaacatgtctgttattgcccatgtggatcacgggaaatcaactcttaccgattctcttgtggctgctgctggtatcattgcacaagaagttgctggtgatgttcgtatgacagatacccgtgcagatgaggctgagcgtggtattacaatcaagtctactggaatctctttgtactatgaaatgagtgaggattctttgaagagctacaagggcgagaggcatgggaatgagtacctcatcaatcttattgattcccctgggcacgttgacttttcatctgaggtcacagctgctcttcgaattactgatggtgcccttgtggttgttgattgtattgaaggtgtctgtgtgcaaacagagactgtcctccgccaggctctcggtgaaaggatcaggcctgtcttgactgttaacaagatggacaggtgcttccttgagctccaggttgatggagaggaggcttaccagacatttcagagagtgatcgaaaatgctaatgtcatcatggccacatacgaagatcctcttcttggtgatgttcaagtctaccctgagaaggggacagttgccttctctgcaggtttgcatggttgggcttttaccttgaccaactttgcaaaaatgtatgcctcaaagtttggagttgatgagtcaaaaatgatggaaagactttggggtgagaacttcttcgatccagctaccaagaagtggaccaccaagaacactggttctgccacctgcaagcgtggatttgttcagttctgttacgaacccatcaagcagatcatcaacacttgtatgaatgaccagaaggataaactctggccaatgttgcaaaagcttggtgtcaccatgaagtctgatgagaaggacttgatggggaaggccctaatgaagcgtgtgatgcagacgtggcttcctgcaagcgatgctctcctggaaatgatggtctttcaccttccctcacctagcaaggctcagaagtatcgtgttgagaacttgtacgagggtcctcttgatgatatctatgccaatgctatcagaaactgtgatcctgagggtcctcttatgctctatgtttcaaagatgattcctgcttctgataagggcagattctttgcttttggtcgtgtcttttctggcaaagtctcaactggattgaaggttaggatcatgggcccgaactatgtccctggtgagaagaaagacttgtatgttaagagtgtgcaaagaactgtcatttggatgggaaagaagcaggagactgttgaagatgtaccttgtggtaacacagttgccatggttggtttggatcagtttatcaccaagaatgctactttgacaaacgagaaggaagttgatgcccacccaattcgtgcaatgaagttttccgtctcccctgttgtccgtgttgctgttcagtgcaaggttgcatctgatcttcccaaacttgttgaagggcttaagcgtttggccaagtctgatcctatggttctctgtaccattgaagagtccggagagcacattgttgctggtgctggtgaactccaccttgagatctgtctcaaggatttacaagaagatttcatgggtggtgctgagattattaaatcagaccctgttgtgtcattccgtgagactgtccttgagaggtcttgcaggacagtgatgagcaaatctcctaacaagcacaatcgtctgtacatggaagctcgacccttggaggaaggtcttgctgaggctattgacgatggacgcattggtccaagagatgatcctaaggttcgttccaagatcctggctgaggagtttggttgggacaaagatctcgctaagaagatttggtgttttggccctgagaccactggccctaacatggtggttgatatgtgtaagggagttcaatatctgaatgaaattaaggattcagttgttgctgggttccagtgggcatcaaaggaaggtgccctggctgaagaaaacatgagagccatctgcttcgaagtctgtgacgtggtcctccatgctgatgccatccacagaggtggtgggcagatcattccaacagctaggagggttttctatgcttctcagctcacagccaagccaaggcttctcgaacctgtttacttggtcgagatccaagccccggagcaggcacttggtggtatttacagtgttcttaaccagaagcgtggacacgtatttgaggaaatgcaaagacctggcactccactttacaacatcaaggcataccttcctgtcattgagtcctttggattctctagcactttgagggctgcaacatcaggacaagctttcccacaatgtgtgtttgatcactgggatatgatgtcatcagacccattggaacctggctctcaggcagcagcccatgtcgccgaaatccgcaagaggaaaggattgaaggaacagatgaccccactttccgagtacgaggacaaactgtaagctaagagagagtaactgtgattgtgcggcataaccttcgctgcaatttagtttgttttctgtctggttatattttgttagcatggatgctttttcacccatatgatgtacgttcgtttttagacgtttgtgttttgatgatgatcatgatgtactacaatcgacattgcgttg

SEQ ID NO: 2071 - DNA, 2907 bp, Actinidia deliciosa
  misc_feature (1195)..(1195): n is a, c, g, or t
  misc_feature (1453)..(1453): n is a, c, g, or t
  misc_feature (1484)..(1484): n is a, c, g, or t
  misc_feature (1537)..(1537): n is a, c, g, or t
  misc_feature (1831)..(1831): n is a, c, g, or t
  misc_feature (1843)..(1843): n is a, c, g, or t
  misc_feature (2278)..(2278): n is a, c, g, or t
  misc_feature (2825)..(2825): n is a, c, g, or t
cacatcctctcagtgcaacctaaggtgactgagagagccgcctcttccttctctcttcggtgttcttcgacaggcatctttcatattgaaatttcatttttgtagcatttaagaagacgtcaaaatggtgaagttcacagctgatgagcttcgtaggattatggacttaaaacataacattcgcaacatgtctgttattgcacatgttgatcatgggaaatccacactcactgattctcttgtggctgctgctggtatcattgctcaagaagttgctggtgatgttcggatgacagatacccgcgctgatgaagcagagcgtggcatcaccatcaaatctactggtatctctctctactatgagatgtctgatgaatcactgaagaactacactggagagcggcatgggaatgagtacctcatcaatctgattgattctcctgggcacgttgacttctcatctgaggtcacagctgctcttcgcattactgacggtgcacttgttgtggttgattgtgttgagggtgtctgtgtccagacagaaactgtcctccgacaggccttgggtgaaaggatccggccagttttaactgttaacaagatggacaggtgcttccttgagctacaagttgatggggaggaggcttatcaaacattccaaagggtaattgagaacgcgaatgtcatcatggccacatacgaagatcccctcctaggtgatgttcaggtgtaccctgagaaaggaactgttgccttttctgctggtttgcatgggtgggctttcactctaaccaactttgccaagatgtatgcttctaaatttggtgttggtgagtctaagatgatggaaaggctatggggtgagaacttttttgaccctgccactaaaaagtggactagcaagaacactggctctgctacttgcaagcgtggtttcgtacagttctgctacgaacccatcaagcagatcattaacacttgcatgaatgatcaaaaagataaattgtggccaatgttgcagaagcttggtgtcaccatgaagtctgacgaaaaggacttgatggggaaggcattgatgaagcgtgtcatgcagacatggcttccagcaagcagggctctcctggaaatgatgatcttccatctcccatctcctgccaaggctcaaagataccgtgtggagaacttgtacgagggnccccttgatgatcagtatgctaatgctgtaaggaactgtgatcctgagggtcctctcatgctctatgtgtccaagatgattcccgcatctgataagggacggttctttgcctttggtcgtgttttctccggtaaagtgtcaacaggtttgaaggttagaatcatgggtccaaactatgtccctggggagaaaaaggacttgtacgtgaagagtgtgcaaagaactgttatttggatgggaaagaggcaggaaacagtngaggatgtaccatgtgggaatacggttgctntggttggtctggatcaatttatcaccaagaatgctaccttgacaaatgagaangaagttgatgcccacccaatccgagcaatgaagttctctgtctcacctgtcgttcgtgtggctgtgcagtgcaaggttgcctctgaccttcccaagcttgttgaaggcttaaagcgtttagctaagtctgatcccatggttgtctgttccattgaggagtctggagagcacatcattgctggtgctggagagctgcatcttgagatctgtttgaaggatctgcaggatgatttcatgggtggtgcagagattgtgaagtctgaccctgttgtctccttccgtgagacagttctngagaaatcatgncgtattgtgatgagcaagtcacctaacaagcacaaccgtctctatatggaagctagacccctggaagaggggcttgctgaggccattgatgacggacgtattggcccaagggatgacccaaaggttcgatctaaaatcttgtccgaggagttcggttgggacaaggatcttgccaagaaaatctggtgttttggccccgaaaccactgggcccaatatggtggttgatatgtgtaagggagtccagtacctcaatgaaatcaaggattccgttgttgccgggttccaatgggcgtccaaggaaggagcactggcagaagaaaacatgaggggtatttgctttgaagtttgtgacgtggttctgcactctgatgctattcacagaggtggtggccaggtcattccgaccgctaggagggttatttatgcctcccanctgactgccaagccccgccttcttgagcctgtgtacttggtggagatccaagcgccagaacaagcccttggtggaatttacagtgtgctgaatcaaaaacgtggccatgtgtttgaggaaatgcagaggcctggtacccctctctacaacatcaaggcataccttcccgtcgtagagtcctttggattttcgagcactttgagggcagcgacttcgggacaggccttcccacagtgcgtgtttgatcactgggacatgatgtcatctgatccgttggaacctggatcgcaggcatcgactcttgtggcagatatccgcaagaggaagggtttgaaggagcagatgacaccgctatctgagttcgaggacaagctgtaaggtgtgttgggtcattcatttcaagcaacaagtttaacttggtgagagagatgatgagaagtataattttgttgcttttatttttattgtttttgtttcacttttccaattttcctcaatatgtctgtggagtagtacttcagttatcgggacttgatgcccgggtctngtgttatgtgttttgtagactatgtttacaaggacaaggttaagttatttctatgtttgttcctttactattttaaaaaaaa

SEQ ID NO: 2072 - DNA, 2746 bp, Actinidia deliciosa
ctccgacctcgccgcggtcttctctgtgtccacctttcatttaaaaactttactgttgcagttttttgaagcagtcaaaatggtgaagttcacagctgatgagcttcgtaggattatggactacaagcataacattcgtaacatgtctgttattgcacatgtcgaccatgggaagtccacacttactgattctcttgtcgctgctgctggtatcattgctcaagaagtggctggtgatgttcgaatgacagatacccgtgcagatgaagctgaacgaggcatcaccatcaagtccactggtatctctctctactatgagatgtctgatgagtccctgaagagctacaagggagagcggcatgggaatgagtaccttatcaatctcattgattcccctgggcatgttgatttttcatctgaggtgacagctgcccttcgtattactgatggtgcgcttgtggtcgttgattgtgttgagggtgtctgtgtccaaacggaaactgttctccgacaggctttgggtgaaaggatccgaccagtcctgaccgttaacaagatggataggtgcttccttgagcttcaggttgatggtgaggaggcttaccaaacatttcaaagagtcattgagaatgctaatgtcatcatggccacatatgaggatcccctccttggagacgttcaggtataccctgagaaaggaacggttgctttctctgctgggttgcacggctgggctttcactttgaccaactttgctaagatgtatgcttccaaatttggtgttgacgagtctaagatgatggaacggctttggggtgagaatttctttgaccctgccacaaaaaagtggaccggcaagaatactggctctgctacttgcaagcgtgggtttgttcagttctgctacgaacctatcaagcagatcattaacacctgcatgaatgatcagaaagataagctgtggcccatgttgcagaagcttggcgttgccatgaagtccgaagaaaaggacttgatggggaaggcactgatgaagcgtgtcatgcagacctggcttccagccagtaatgccctcctggaaatgatgatattccatctcccgtctcctagcaaagctcagaagtaccgtgttgagaacttgtacgagggaccccttgatgatcaatatgctaatgctattaggaactgtgatcccgagggacctcttatgctctatgtgtcgaagatgattcccgcatctgacaaggggagattctttgcctttggtcgcgtgttctctggaaaagtgtccacaggtttgaaggttagaatcatgggccctaactacgtacctggagagaaaaaggacctgtatgttaagagtgtacagaggactgtcatttggatgggaaagaggcaagaaacggttgaggatgtaccatgcggtaatacagttgctatggttggtttggatcaatttatcaccaagaatgctaccttgacaaatgagaaagaagttgatgcacacccaatccgagcaatgaagttctcagtctcacccgttgttcgtgtggccgtgcagtgtaaggttgcctctgatcttcccaagcttgttgaaggtctgaaacgtctggcgaaatctgatcctatggttgtctgttccattgaggagtctggggagcacatcattgctggtgctggagagctgcacctcgagatttgtttgaaggatttgcaggacgatttcatgggtggtgctgaaattataaagtcagatcctgttgtgtcgttccgcgaaaccgttctagagaagtcgagccgaactgtgatgagcaagtcgccaaacaagcataaccgtctttacatggaagctagacccatggaggaggggcttgctgaggccattgatgatggacgtgttggtccaagagatgaccccaaggttcgttctaaaatcttgtctgaagagttcggttgggacaaggatctcgcaaagaaaatctggtgttttggcccggaaaccactggccctaatatggtggttgacatgtgtaagggagttcaatacctcaatgaaatcaaggactcggttgttgctgggtttcaatgggcatcaaaggaaggggcgcttgcggaagaaaacatgcggggtatttgctttgaagtttgtgacgttgttcttcacgcagatgctattcacagaggtggtggccaggtcattccgacggctaggagggttatttacgcttcccagctaaccgccgagccccgtcttttggagcccgtatacttggtggagatccaagccccagagaatgccctcggtggaatctacagtgttctgaatcaaaaacgtggtcacgtgtttgaggaaatgcagaggccaggtactcctctctacaacatcaaggcgtaccttcccgttattgagtcgtttggattctcgagcactttgagggcagccacttcagggcaggccttcccgcaatgtgtgtttgatcattgggagatgatgtcgtcggatccgttggaatccggatcacaggcggcaacccttgtgactgagattcgcaaaagaaaaggtttgaaggagcaaatgacaccactgtccgagttcgaggacaaactgtaagtttgtcataatattcattccaagtgactagagttcagcctcttgataaagacatacgcaattacgcatgctgattgctgggcataattttttgcttttgtttctttttattttctcatttttctgatatgcgac

SEQ ID NO: 2073 - DNA, 2594 bp, Sequoia sempervirens
gcaaaaatggtgaagttcacagctgaagaactccgtaggattatggacttgaaacataatatacggaatatgtctgtcattgctcatgttgaccatgggaagtctacacttactgattctttagtggcagcagctggtatcattgctcaagaagttgcgggtgatgttagaatgactgatactcgtgcagatgaagctgagcgtggtatcaccattaagtcaacaggaatctccttgtattatgagatgacggatgagtctctcaagagttacaagggggagagaatggggaatgaatatttgatcaatctgattgattctccagggcacgttgatttctcttctgaggtcaccgcagccctgcgtatcacagatggtgcattagttgtggtagattgtatcgaaggagtttgtgtacagactgagactgttcttcgacaagctcttggagaaaggattaggccagttcttactgttaacaagatggataggtgttttcttgagttgcaggttgaaggagaggaagcttatcagacatttctaagagtgattgaaaatgcaaatgtgattatggctacctatgaagatcctcttcttggtgattgccaagtttatccagagaaaggtacagtcgctttctcagctggtctgcacgggtgggctttcactttgacaaattttgccaaaatgtatgcttcaaagtttaaagtagatgaagtcaagatgatggaaagactgtggggtgagaacttttttgatccagctaccaaaaagtggacatcaaagaacacaggatctcctagttgcaaaagaggttttgttcaatttatatacgaacccattaagcagattataaacatttgtatgaatgatcagaaggataagttatggccaatgttgcagaaactgggagttgttatgaagagtgatgagaaggaattggcagggaaggccctaatgaaacgtgttatgcaaacctggctacctgcgagcagtgctctacttgagatgatgatattccatcttccatctccatctaaagcacagagatatcgtgtagagaacttgtatgaaggtcctcttgatgatatatatgcaactgccattagaaattgtgaccctgaaggaccattaatgttgtacgtttcaaagatgattcctgcctctgacaaggggcgattctttgcctttggtcgggtttttgcagggaaggtatctacaggagtgaaggttaggatcatgggtcctaactatgtgcctggtcagaagaaggacttgtatgtaaaaagtgtccagaggactgtcatttggatgggtaaaaacaagaatcagttgaggatgtgccctgtggaaatacggtggctttggttgggttagatcagttcatcactaagaatgctactctgactaatgagaaggaggttgacgcccatccaattagagcaatgaagttctctgtctcgcctgttgtacgtgttgcagtgcagtgcaaggtagcctctgaccttccaaagcttgttgaagggttgaagcgtcttgctaagtcagatcctatggttgtgtgtacaattgaggaatccggtgaacatattattgctggagcaggagaacttcaccttgagatttgcttaaaggatttgcaagacgattttatgggtggagctgagattgttgtctctgatcctgttgtctcatttagagaaactgtattagagaagtcagtccgtactgtaatgagtaagtctccaaataaacacaacaggctttattttgaagcaaggcctcttgaagaaggtcttgcagaagcaattgatgatggtcgcattggccccagagatgatcctaaggctcgtgccaaaatcctctctgaggagtttggatgggacaaagatctggctaagaagatttggtgttttgggcctgaaaccactggtcccaacatggttgtagatatgtgtaagggagttcagtacttgaatgaaattaaggattcggttgttgcagcatttcaatgggcatccaaggaaggtgcccttgcagaggagaacatgcgtggcatttgctttgaggtttgtgatgttgttttacacactgatgccattcatagaggaggcggccagattattccaacagccagaagagttatgtatgcatctcagcttactgccaaaccaaggcttctggagccagtatatcttgtagaaattcaggctcctgaacaggcacttggaggtatttatggtgtgctgaatcagaagaggggccatgtgtttgaggaaatgcagaggccaggaactccactctataacattaaggcatatttgccagttgttgagtcatttgggttctctggtactctccgagctgcaacttctggtcaggctttccctcaatgtgtgtttgatcactgggatatgatgggctccgatccactggagcatggcacccaagctgaaaagcttgttcttgatattcgcaagagaaagggtctgaaggagcaaatgactcccttgtcagagtttgaggataagctgtaaagcttttttaggtttgggggatggagattctgaggatgctatggatctccgtttggg

SEQ ID NO: 2074 - DNA, 2724 bp, Vaccinium corymbosum
gcaagactgagagccacccccttcttacctcgccgccgcctctccctatctagctccggtgttctcggtgaagcatctttccttttagcactctgtagcatttaaaaaggtcatcaaaatggtgaagttcacagctgatgagctccgtaggattatggactacaaacacaacatccgtaatatgtctgttattgctcatgttgatcatgggaagtccaccctcactgattctcttgtggctgctgctggtatcattgcccaagaagttgccggtgatgtccggatgacagatactcgtgcagatgaagctgagcgaggtatcaccatcaagtctactggtatctctctctactatgagatgtctgatgaatcactgaagagctacaagggagagcggaatgggaatgagtaccttatcaatctcattgattctcctgggcacgttgacttctcatctgaggtcacagctgctcttcgcattactgacggtgcacttgttgtggttgattgtgttgagggtgtctgtgtacaaaccgaaactgttctccgacaggctttgggtgaaaggatccgaccggtcttaactgttaacaagatggacaggtgcttccttgagctccaggtcgatggagaggaggcttaccagacattccagagagtgattgaaaatgctaatgtgatcatggccacgtacgaggatcccctcctcggtgacgttatggtgtatcctgagaaaggaacagttgctttctcagcagggttgcacggctgggcattcactctgaccaactttgctaaaatgtatgcttccaaatttggtgttgatgagtctaagatgatggaacggctttggggcgaaaactacttcgaccctgccaccaaaaagtggaccaccaagaatactggctctgctacttgcaagcgtggatttgttcagttctgctacgaacccattaagcagatcatcaacacttgcatgaatgaccagaaagacaagctgtggcccatgttgcagaagcttggcgtcacaatgaaatcagacgagaaggagttgatggggaaagctctgatgaagcgcgtcatgcagacctggcttccggcaagtagtgccctcctggaaatgatgatcttccatctcccttctccttccactgctcaaaaatatcgtgttgagaatttgtacgagggacctcttgacgatcagtatgcaaatgctattaggaactgcgatcccgaggggcctctcatgctgtatgtgtccaagatgattcctgcttctgacaagggaaggttctttgccttcggccgtgtgtttgccgggaaagtgtctactggtttgaaggttagaataatgggtcccaactatgtccctggagagaagaaggacttgtatgttaagagtgtgcaaagaactgtcatttggatgggaaagaagcaggaaaccgtggaagacgtgccgtgtgggaatactgtggctttggttggtttggaccagttcatcactaagaatgcgaccttgacgaatgagaaggaagtcgatgcccacccaatccgagcaatgaagttctcagtctcacccgttgtccgtgtggctgttcagtgcaaggttgcctcggaccttcccaagcttgtggaaggtctgaaacgtcttgccaaatccgatcctatggtggtttgtagcattgaggagtctggggagcacatcattgctggtgctggagagcttcaccttgagatctgtctgaaggatttagtggacgatttcatgggtggggctgaaattatcaagtcagatcctgttgtgtctttccgtgagacagttctggagaagtcatcacgcactgtcatgagcaagtcgccaaacaagcataatcgtctatacatggaagctaggcccttggaggaaggcctagctgaggccattgatgacggacgtattggcccaagggatgaccccaaggtacgatctaaaatcttgtctgaggagtttggctgggacaaggatctcgcaaaaaagatatggtgttttgggccggaaaccactgggcctaacatggttgtggatatgtgtaagggagttcaatacctgaatgaaatcaaggattctgtcgttgctgggttccagtgggcgtcaaaagaaggggcactagcagaagaaaatatgaggggtatatgctttgaggtttgtgatgtggttttgcacgcagatgctattcacagaggaggtgggcaggtaattccaactgcccggagggtcatttacgcttcccagctgactgccaagcctagacttttggagcctgtgtacttggtggagatccaagctccggaacaagccctaggaggaatttacagtgttctgaatcaaaaacgtggtcatgtttttgaggaaatgcagaggccaggtacccctctttacaacatcaaggcttacctacctgttatagagtcatttggtttctctagcactttgagggcagcaacttcgggccaggcttttccgcagtgcgtgtttgatcattgggatatgatgatgtctgatccgttggaatctgggtcacaggcggcagtccttgtgtctgatattcgcaagaggaaggggttgaaggaacagatgacaccgctctctgaatacgaggacaagctgtaggttctcacttgtcgcattagagttacaagttcagctccttcatgagagagaatggttgacaaagagtaatgctg

SEQ ID NO: 2075 - DNA, 3547 bp, Theobroma cacao
caaatccgacctaaataataacattgcatcaataagttcgagacttggcgtgcaagatctttaattcatgaatgctgctatataaaaagggaaattcaaaaggaaagtttttaaaagtccaaaagatatttttagaaaccaggcctaaagcccaagagccagagctcaagcccaaaatagaaacaaggaaaaaccctagctaatgcccctcacactcccactctcaaacgcactgccttttgcagctcagcgactataaataaggcatatcctcctttgtgtgcctcttattcgagagagagtcatcaaaatcgacatctccttctctcgccgcctctcctctctctctctctcttacaggttttgattcttatttatagttggggtgtattttaaagacaagtcaagatggtgaagtttacagctgatgagctccgtcgtattatggactataaacacaacatccgtaatatgtctgttattgcccatgttgatcacgggaaatcaactcttactgattctcttgtcgctgctgctggaattattgcacaagaagttgctggtgatgttcggatgacagatacccgtcaggatgaggctgagcgtggtataacaattaagtcaactggtatctctctgtactatgaaatgactgatgaatctttgaagaactacaaaggagagaggcaagggaatgagtacctcatcaatcttattgattcccctgggcacgttgacttttcgtctgaggtcacagctgctcttcgtattactgatggtgcccttgtggtcgttgactgtgttgaaggtgtctgtgtgcaaacagagactgtactccgtcaagcccttggtgaaaggatcaggcctgtcttgactgttaacaagatggacaggtgcttccttgagcttcaggttgatggtgaggaggcttaccagacattccagagagtgattgaaaatgctaatgtcatcatggctacctatgaagatcctcttcttggtgatgttcaagtctaccctgagaaaggaacagttgccttctctgctggtttgcatggttgggcttttacactgaccaactttgctaagatgtatgcctcaaagtttggagttgatgagtcgaaaatgatggaaagactttggggtgagaacttttttgatccagctaccaagaagtggaccagcaagaacactggctctcctacctgcaagcgtggatttgttcaattttgttatgaacccatcaagcagatcatcaacacttgtatgaatgaccagaaggataagctctggcccatgttgcaaaaacttggtgtcaccatgaaggctgaagagaaggacttgatggggaaggccctaatgaagcgtgtaatgcaaacttggcttcctgcaagtaatgctctcctggaaatgatgatctttcaccttccctctcctggcaaggctcagaagtatcgtgttgagaacttgtatgagggtcctcttgatgatatgtatgccaatgctattaggaactgtgatcctgatggtcctcttatgctttatgtttcaaagatgattcctgcctctgataagggcaggttctttgcttttggtcgtgtcttctctggcagagtctcaactggtttgaaggtcaggatcatgggtcccaactatgtccctggtgagaagaaagacttgtatgttaagagtgtacagagaactgttatttggatgggaaagaggcaggaaactgtggaggatgtgccttgtggtaacacagttgctatggttggtttggatcagtttattaccaagaatgctactttgactaatgagaaggaagttgatgcccacccaattcgtgccatgaagttctctgtctctcctgttgttcgtgttgctgttcagtgcaaggtcgcatctgatcttccgaaacttgttgaagggctgaagcgtttggcaaagtctgatcctatggttgtctgtaccattgaagaatctggagaacacattgttgctggtgctggagaacttcaccttgagatctgtctcaaggatttgcaagaagattttatgggtggtgctgagatcattaaatcagaccctgttgtgtcatttcgtgagactgtccttgagaggtcttgtaggactgtgatgagcaagtctcctaacaagcacaaccgtctgtacatggaagcacgacctatggaggaagggcttgctgaggccatagatgatggacgaattggtccaagagatgatcctaaggttcgttctaagatattgtctgaggagtatgggtgggacaaggatcttgctaagaagatttggtgttttggccctgagaccactggtccaaacatggttgttgatatgtgtaaaggagttcagtaccttaatgaaattaaggattctgttgttgctgggttccagtgggcatcaaaggaaggagcattggctgaagagaacatgagaggtatctgctttgaagtctgtgatgtggttctccatgctgatgcaatccatagaggtggtggtcagatcattccaactgctaggagggttttctacgcttctcagctaacagccaagccaaggcttcttgagcctgtttacttggtggagatccaagctcctgagcaggcacttggtggtatttacagtgttcttaaccagaagcgtggacatgtctttgaggagatgcagaggcctggtaccccactttacaacatcaaggcataccttcccgttattgagtcttttggattctctagcactctgagggctgcaacatcaggacaggcattcccacaatgtgtgtttgatcactgggatatgatgtcatcagatccaattgaaccagggacccaggcagcaactcttgttgctgatatccgtaagaggaagggtttgaaggagcagatgaccccactttccgaattcgaggacaagctgtaagctagagaataatggagagggtatgtttgtgcggcaaaatttctgctgcaatttagttttgttttctggctctttatattttggtagtagttgcttcttgggtgctgtcacccattttatcatgtaaggtcctttttagatgtttttttataatgactcgagaattgttctgtggtgttacatttttacgtgttgattatgtattgcaatcgacattggttgtgttcaagttatatttttgaccttcatatgtctacctttgtgatttatttcgagatggttgattgttttactgatgcaacaataggtagaattggtgctctgccaaaggatttagatcagtccttgaggctgggtgtccttatggttgtggtccatgaggaccgtggcccagcaccaagtgctctcagtaacagctgggctgaggcgctgtggttttcttacgaacgcaatccagtgctcttttatgaagccctcccctccctgggcttctacatggagccaaatattggcttgacttccattcgttatctcttccaaaatttgaatggatattctgtgattgattctttttattttggatatttaataatcgtataattaaatt

SEQ ID NO: 2076 - DNA, 2982 bp, Tripterygium wilfordii
gagactaaagagagctgtgcagcccaaaacttctctgctctctctttctctctctgtgagacgtatctgttcttttacaaagttagtttggaaacttaaagagtagtcaggatggtgaagtttactgctgaggagcttcgcaggattatggacctgaagcataatattcgtaatatgtccgttattgctcatgttgatcatgggaagtcaacacttactgattctcttgtggctgctgctggtatcattgctcaagaagttgctggggatgtacgtatgactgacacccgggccgatgaggctgagcgtggcattaccattaagtcaactggtatctctctttattatgagatgagtgatgtctctttgaagagctacaagggggaaagacaaggcaatgagtacctcatcaatctcattgactctcctgggcacgttgacttttcatctgaagtcacagctgcacttcgtatcactgatggtgcactagtggtggtagattgtattgagggagtttgtgtccagacggaaactgtgcttcggcaggcccttggtgaaaggatcaggcctgtcttgactgtaaacaagatggacaggtgttttcttgagttgcaggttgatggagaagaggcttaccaaactttccagagggtaattgagaatgctaacgtcatcatggctacttatgaagatcctctacttggtgatgttcaggtctaccctgagaaaggaacggttgctttctctgctggattgcatggttgggcttttactctaaccaactttgcgaagatgtatgcatccaagtttggagttgatgagggaaagatgatggaaaggctctggggtgagaactacttcgacccagcgacaaagaagtggaccagcaagaactctggctctcctacctgcaagcgtggttttgttcagttctgctatgaacccattaagcagattattaacacttgcatgaatgaccagaaagacaagctttggcctatgttgcagaagcttggtgttaccatgaagtctgatgagaaggacttgatggggaaggcactgatgaagcgtgtcatgcagacctggctcccagcaagttctgccctactggagatgatgatatttcaccttccctctcctgccacggctcaaaagtaccgtgttgaaaacttgtatgagggtcccatggatgatcagtatgctactgctattaggaactgtgatcctgatggtcctctcatgctttatgtgtcaaagatgattcctgcttctgacaaaggtagattctttgcttttgggcgtgtattcgctggaaaggtttcaacaggtgtgaaagttcggatcatgggtcctaactatgtccctggtgagaagaaagacttatatgttaagaatgtgcagagaactgttatctggatgggcaagaaacaagaaactgttgaagatgttccatgtggtaacacagtggcactggttggcttggatcagtttattaccaagaatgctaccttgacaaatgagaaggaagttgatgctcacccaatccgtgctatgaagttctctgtttcacctgtcgttcgtgtagctgttcagtgcaaggttgcttctgaccttcccaagctcgttgaaggtttgaaacgattggccaagtcggatcctatggttgtttgtaccattgaagagtcaggggagcacattattgctggtgcaggagagctccatcttgaaatctgtttgaaggatctgcaggatgatttcatgggtggtgctgagattgttaagtctgatcctgttgtgtcattccgagaaactgtgctcgagaagtcctgccgcactgtgatgagcaagtcccccaacaagcacaatcgtctctacatggaagcacgtccgctggaggaaggtcttgctgaggccattgatgacggccgtatcggtccacgtgatgatcccaaggtccgttctaagatcttgtctgaggagtttgggtgggacaaagatcttgccaagaaaatttggtgttttgggcctgagacaactggcccgaacatggtggttgatatgtgtaaaggggttcagtacctgaatgaaattaaggactctgttgttgctggctttcagtgggcatctaaggaaggtgcattagctgaagagaatatgaggggtatctgttttgaagtctgtgatgttgttcttcacgctgatgctatccacagaggtggtggtcaggtcattccaaccgctaggagggttatttatgcttcccagcttactgccaagcccaggctacttgagcccgtttatctggtcgagatccaggccccagagcaggctcttggtggtatttacagtgttcttaaccagaaacgtggtcatgtctttgaagaaatgcagaggcccggaaccccactctataacatcaaggcttaccttccagtcgtagagtcatttggtttctctggcaatttgagggctgcaacctctggtcaggccttccctcagtgtgtgtttgatcattgggatatgatgacatcagatccattggatcccacatcacaggcttcaacccttgttcatgatatccgtaagaggaagggattgaaggagcagatgacccctctgtcagagttcgaggacaagctgtaagcaatcaaaaaatttattcttcccatggaacaatgttttacttacagaggattacgttgggcagtgtcattttttgctgccctcttttcttgttgtttaaatgtggagttgtagtctttgtgacattgaaagacagacacttgttctgtgttagttttaaaaagcttttatcgttatggggtttaggcctatgtcaggtctggatttggtgttatgtttttcactaaattatttactttggttgagttacttctggttcttgaccttcactttatacttcatgtgtttgattgatggattcctctgatgattcagactataaactgcagactataaacc

SEQ ID NO: 2077 - DNA, 3182 bp, Ricinus communis
acctctgcatactgaagagagagtggctttctaaaccctctcttctaccgccgcctcccgctctatctcgctcctgtttaccggtgatcttatatatagtatttggtggtgaattctaaaggctagtcaagatggtgaagttcacagcggaagagcttcgtcgtattatggactacaagcacaatattcgtaatatgtctgttattgcccatgtcgatcatgggaaatcaacacttaccgattctcttgtggctgctgctggtatcatagcacaagaagttgctggtgatgtccgtatgactgacactcgccaggatgaggcagagcgtggtatcacaatcaaatctactggtatctcactctactatgagatgacggatgagtcccttaagaactacaagggagagagacaaggcaatgagtatcttatcaatctcattgattctcctggacacgtcgacttctcatctgaagtcactgctgctcttcgtattactgatggtgcacttgtggtggttgactgcattgagggtgtttgtgtccagactgaaactgttcttcgccaggctttgggtgaaaggataaggcctgtgttgactgtcaacaaaatggacaggtgcttccttgaactccaggttgatggtgaagaggcttatcaaacattttcgagggtcatcgaaaatgctaatgtcatcatggccacctatgaagatccccttcttggtgattgtcaggtttacccagagaaaggaactgttgcattctcagctggattgcatggttgggcttttactctgacaaactttgccaagatgtatgcctcaaagtttggagttgacgagtctaagatgatggagagactatggggtgagaatttctttgatcctgcaaccaagaagtggactagcaagaactctggctctgcaacttgcaagcgtggctttgtgcagttctgttatgagcctatcaaacagatcattaacacttgcatgaatgaccagaaggataaattgtggccaatgttgcaaaaacttggtgttactatgaagtccgaggagaaggaattgatgggcaaggccctgatgaagcgtgtgatgcaaacttggctccctgccagcagtgctctcctggaaatgatgatctttcaccttccctctcctgccaaggcccagaggtatcgtgttgagaacttgtatgagggtccccttgatgatccttatgcaactgcaatcaggaactgtgatgctgaaggcccccttatgctttatgtgtccaaaatgatccctgcttctgataagggtagattctttgcatttgggcgtgtgtttgctgggaaggtctcaactggtctgaaggtgaggatcatgggtccaaattatgtccctggtgaaaagaaagatttgtatgttaagagtgttcaaagaactgttatttggatggggaaaaggcaggaaactgttgaggatgttccttgtggtaacactgtggccatggttggtttggatcaatttattactaagaatgcaactttgaccaatgagaaggaagttgatgcccatcctattcgtgcaatgaaattctctgtttctccagtcgtccgtgtggcagttcagtgtaaagtcgcatctgatcttcccaagcttgttgaaggtctcaagcgtttggccaagtcagatcctatggttgtctgtagtattgaggagtctggggaacacattattgctggtgcaggggagctacaccttgagatctgtttgaaggatttgcaggacgatttcatgggtggagctgagatcatcaaatcagaccctgttgtgtctttccgagagactgtcctagagaaatcctgccgtgtggtaatgagcaagtccccaaacaagcacaaccgtctttacatggaggcacgacctatggaggaagggcttgctgaggctattgatgatggccgtattggcccaagggatgatcctaaggttcgtgcaaagatattatctgaggaatttggctgggataaggatttggcaaagaagatatggtgttttggtcctgaaactactgggcctaatatggttgttgatatgtgtaagggagtgcaatacttgaatgaaattaaagattctgttgttgctggtttccagtgggcatcaaaggagggtgcgttggctgaaagaaaacatgagaggtatttgctttgaagtttgtgatgttgttcttcatgctgatgctattcacaggggtggtggtcaggtcattccaactgctaggagggttatttacgcatcacagctaacagccaagcccaggctccttgagccagtttacttggttgagattcaagccccagagcaggctcttggtggtatctatagtgttcttaatcagaaacgtggtcatgtgtttgaggaaatgcagaggcctggcactcctctgtacaatatcaaggcgtatctaccagtcattgagtcctttggtttctctggcactttgagggctgccacatctggacaagccttcccgcagtgcgtgtttgatcattgggacatgatgtcttcagatccaatggaggcaggttcacaggcagcacagcttgtaacagacatccgcaagagaaaaggtttgaaggaacagatgacacctctttccgagtttgaggacaagctgtaaacaaattcttttctcgagtatgatcgagaggggcaatgtttggtcttggtttttaattttgttacggttgagtagtactgtgtcttaataggacggattagttatcctattaatttatggcttgttttagtacaatgtctcaggtgatgattccttcctttggtcgtcttaatgcttattcaaccaacgttggttattcatgtcgctctatttttgctttctggctgacattatatttttaaatttattccgtgagaatttttatttatcactatgctatcgaaaagaatcatgccaatcacgattggctcagcaaactgttgttttccttttacgaactcgtttctttcttcttttttttttttttttttttttttttagtacttaaaatcgtagttcagttttaaagtattttaaaaaattgattttaattgcttaattttaaagctccggtggtgaacaagtttagctccttcagactcgtttattggttattactcttttttcttttttaaatt

SEQ ID NO: 2078 - DNA, 3668 bp, Prunus mume
tatacctcggtcgtactattttattctctctcagctccttttgtatataaaggagaagtctgagattctagctccattttctttcgcctgccgcctcgctcgctgcttgtcacccgatactaattatacttttggaggtgacatttgaagactagtcaagatggtgaagttcacagctgaggagctccgtaggattatggactacaaacacaacattcgtaacatgtctgttattgcgcatgttgatcacgggaagtcaacccttaccgactctcttgttgctgctgctggtatcattgcacaagaagttgctggtgatgtccggatgacagatacccgtgcagatgaggcagagcgtggtatcacaatcaaatctactggtatctctctctactatgagatgactgatgaagctttgaagagctacaagggggagagaaacggaaatgagtacctcatcaatctcattgattcccctgggcacgttgacttttcatctgaagtcacagctgctcttcgtattactgatggtgcacttgtggtggttgattgcattgagggtgtttgtgtccaaacagagactgtgcttcgtcaagccttgggagaaaggatcaggcctgttttgactgttaacaagatggacaggtgcttccttgagctccaggtcgatggagaggaggcttaccaaacattccagagggttattgagaatgctaatgtcattatggctacatacgaagacccccttcttggcgatgtccaggtctatccagagaaaggaacagttgccttttctgctgggttgcatggatgggcttttactctgaccaactttgccaagatgtatgcatccaagtttggagttgatgagtcaaagatgatggaaaggctctggggtgagaactactttgacccagctaccaagaaatggaccagcaagaacactggttctgctacctgcaagcgtggttttgttcagttctgttatgaacccatcaagcagattatcaacacctgcatgaatgatcagaaggacaagttgtggcccatgttgacaaagcttggtgtcacaatgaagagtgatgaaaaggagctgatggggaaggggttgatgaagcgtgtcatgcagacctggctaccagccagcagtgccctattggaaatgatgatctttcaccttccctctccttcaactgcccagagatatcgtgttgagaacttgtacgagggtccccttgatgatcaatatgcaaatgctatcaggaactgtgatcccgaagggcctcttatgctctatgtatctaagatgattcccgcatctgacaagggtcgattctttgcctttggtcgtgtctttgctggtaaagtccagacaggtttgaaggttagaatcatgggtccaaattttgttcctggagagaagaaggatttgtatgttaagaacgtgcagaggactgttatttggatgggaaagaaacaagaaactgttgaggatgttccttgtggtaacactgttgccttggtcggtcttgatcagtttatcaccaagaatgctacattgacaaacgagaaggaagtggatgctcaccccattcgtgctatgaagttctctgtttcacctgttgtgcgtgttgctgttcaatgcaaggtggcttctgaccttcccaaactggttgaaggtctcaaacgtctggccaagtctgatcctatggttgtctgttccattgaggaatccggtgagcacattattgctggtgctggtgaactccatcttgagatttgtttgaaggatctacaagatgatttcatgggtggagctgagattataaaatctgaccctgttgtgtctttccgtgagactgtcctggagaagtctagtcgtactgtgatgagcaagtcacccaacaagcataaccgtctgtatatggaagctcgacccttggaggaaggtcttcctgaggccattgatgatggtcgtattggcccaagagatgatcccaaaattcgttccaagatcttggctgaagagtttggttgggacaaggatcttgctaagaaaatctggtgttttggccctgagaccaccggtcccaacatggtggtggatatgtgtaagggagttcagtacctgaatgaaatcaaggactctgttgttgctggtttccagtgggcttcaaaggaaggtgcattggcagaagaaaacatgaggggtatttgctttgaagtctgtgatgtggttcttcatgctgatgccatccacagaggaggtggtcaggtcattcccactgctaggagggtcatctatgcttcccagctcactgccaagccaaggctccttgaacctgtatatcttgttgaaatccaagctccagagcaggctcttggtggtatctacagtgttcttaatcagaaacgtgggcatgtgtttgaggaaatgcagaggcctggtactccactctacaatatcaaggcatacctccctgtcattgaatcttttgggttctctggtcaactgagggcttcgacttcagggcaggccttcccacaatgtgtgtttgatcattgggagatgatgtcgtctgatccattggaaactggatcccaggcttcacagcttgttacagatatccgtaagaggaagggtttgaaggagcaaatgaccccactatccgagtttgaggacaaactctgagtaatttctttgattatatcgaacaattggatgactgagttactttgagacagtagttccattgcactgcctattttttgttttcagttttttgttttcgtttaatgtttgtaccaaccctgttgttgtagtcagcatcctgtgccagtggcccagtagtaacgttttgtgcgtgctcagaagattatgtaatgttatgttcttacttttgcttatggaaccatttctgccaccgctggtacatgctatttttgaatttactgtacactcctttttgtgatttgtttcgtgaattgggtagcttgctcttgcataacttgactgttctgtgtgtttgctacagcttcttatctcaataatagatataggaaagcaggctgatgcctacttttgaacctaattcttctgttgtgatacagggaaaacactggtggcagtctctgaccaccttggcgtgccgagtggccagacagggtggcttacttgagaccagtcttgctgtaggagttggcttgatttgccttttcaattttctgtcgggattcttgtgcagcagcatcaagtaaaatttgattgctttgtgattttggagcaccactggaacttttagatagtaaataactgtattggccttgtatttgcaagttctggagcatttggcctttgattttgcttaatgtggcattgcattttccgtccgtaactgaaactttttggatgttgaccaaagaagaaatggtactgaatggtggaagcatttgatgcatactgtatgaattgaatatggttagccttatatgctccaaagctggaagtagcgtaggaagagaaaatgggagtgaaaatcgccatcctttttattacatgtaatgtgatggagtcacgttctggagaagaacttgtatatcacgggaatgggttttaagatgtatggaatgtatggccagaacccaatacaatttttttgtttcctaaa

SEQ ID NO: 2079 - DNA, 2946 bp, Vaccinium corymbosum
taaccctactactgagagctttctctgtaacctcgccgccgcctcctgtttctctcgtgttctggggcgatcatctttcattttagaactgtgctgctgttgtagttaagagtagtcaagatggtgaagttcacagctgatgagcttcgtaggattatggactacaagcacaacattcgtaacatgtctgttattgcacatgtggatcatgggaaatcgacacttactgattcgcttgtggctgctgctggtatcattgctcaagaagttgctggtgatgtccggatgacagatacccgggcagatgaagctgaacgtggcatcaccatcaagtctactggcatctctttgtactatgagatgtctgatgagtcactaaagagctacaaaggagagcgtaatgggaatgagtatctaatcaatctaattgattctcctggacacgttgatttttcttctgaggtcacagctgcccttcgcattactgatggtgcgcttgtggtggttgattgtgttgagggtgtctgtgtccaaacagaaactgttctccgacaggctttgggtgaaaggatccggcctgtcttaactgttaacaagatggacaggtgcttccttgagctccaggttgatggagaggaggcttaccagacattccagagagtgattgaaaatgctaatgtgatcatggccacgtacgaggatcccctccttggtgacgttatggtttaccctgagaaaggaacagttgctttctcagctgggttgcacggttgggctttcactctgaccaattttgctaagatgtatgcttccaaattcggtgttgatgagtctaagatgatggaacgtctttggggtgaaaacttctttgaccctgccaccaaaaagtggaccaccaagaattctggctctgctacttgcaagcgtggatttgttcagttctgctatgaacccattaagcagatcatcaacacttgcatgaatgaccagaaagataagctgtggcccatgttgcagaagcttggcgtcacaatgaagtcagacgagaaggaattgatggggaaagcgctgatgaagcgtgtcatgcagacctggcttccagcaagcagtgccctccttgaaatgatgatcttccatctcccttctccttccactgctcaaaaatatcgtgtggagaatttgtacgagggacctcttgatgatcagtatgcgaatgcaattaggaactgtgatcccgaggggcctctcatgctgtatgtgtccaagatgattcctgcttctgacaagggaagattctttgcctttggtcgtgtgtttgctgggaaagtgtcgactggtgtgaaggttagaatcatgggtcccaactatgtccccggagagaagaaggacttgtatgttaagagtgtgcaaagaactgttatttggatggggaagaagcaggaaaccgtggaagacgtaccatgtgggaatacagtggctttggttggtttggaccaatatatcactaagaatgctaccttgacgaatgagaaggaagtcgatgcccacccaatccgagcaatgaagttctcagtctcacccgtcgtccgtgtggctgttcaatgcaaggttgcctctgacttgcccaagcttgttgaaggcctcaaacgtctggctaaatctgaccctatggtggtctgtacaattgaggagtctggggaacacatcattgctggtgctggagagctgcaccttgagatctgtctgaaggatttagtggacgatttcatgggtggagctgaaattataaagtcagatcctgttgtatctttccgtgagacagttctggagaagtcgtcacgcactgtcatgagcaagtcgccaaacaagcataatcgtctatacatggaagctaggcccttggaggaaggcctagctgaggccattgatgatggacgtattggcccaagggatgaccccaaggtacgatctaaaatcttatctgaagagttcggttgggacaaggatctcgcgaaaaagatatggtgttttgggcccgaaaccactgggcctaacatggttgtggatatgtgtaagggagttcaatacctgaatgaaatcaaggattctgtcgttgctgggttccagtgggcgtcaaaagaaggggcactagcagaagaaaacatgaggggtatttgctttgaggtctgtgatgtggttttgcactctgatgctattcacagaggaggtgggcaggtcattccaactgcccggagggtcatttatgcttcccagctgactgccaagcccagacttctggagcctgtgtacttggtggagatccaagcgccagaacaagctctagggggaatttacagtgttttgaatcaaaagcgtggtcatgtttttgaggaaatgcagaggccgggtacccccctttacaacatcaaggcttaccttcctgtcgtggagtcatttggtttctctagcactttgagggcatcgacatcaggccaggcttttccgcagtgcgtgtttgatcattgggatatgatgatgtctgatccgttggaatctgggtctcaggctcacggccttgtgacggatattcgcaagaggaaggggttgaaggaacagatgacaccgctgtctgagttcgaggacaagctgtaggttcttacttgtcagattatgcaatccaagctacaagttcggcctcttcacgagagagtggttgacaaaagtaatggtggacaatataattttgttttgtattcgcttgaatttctcatttttcagttgtctgtggagtacatttggtttcctgggcattgtttcccgcggtcttatgtttgcattttattgtatggacgagttttgggtctttagaatattacgttcttgaactatttctatcggttttgtttgcaggataatgttttggtttttcatagcgtagtttttgtt

SEQ ID NO: 2080 - DNA, 3181 bp, Ricinus communis
acctctgcatactgaagagagagtggctttctaaaccctctcttctaccgccgcctcccgctctatctcgctcctgtttaccggtgatcttatatatagtatttggtggtgaattctaaaggctagtcaagatggtgaagttcacagcggaagagcttcgtcgtattatggactacaagcacaatattcgtaatatgtctgttattgcccatgtcgatcatgggaaatcaacacttaccgattctcttgtggctgctgctggtatcatagcacaagaagttgctggtgatgtccgtatgactgacactcgccaggatgaggcagagcgtggtatcacaatcaaatctactggtatctcactctactatgagatgacggatgagtcccttaagaactacaagggagagagacaaggcaatgagtatcttatcaatctcattgattctcctggacacgtcgacttctcatctgaagtcactgctgctcttcgtattactgatggtgcacttgtggtggttgactgcattgagggtgtttgtgtccagactgaaactgttcttcgccaggctttgggtgaaaggataaggcctgtgttgactgtcaacaaaatggacaggtgcttccttgaactccaggttgatggtgaagaggcttatcaaacattttcgagggtcatcgaaaatgctaatgtcatcatggccacctatgaagatccccttcttggtgattgtcaggtttacccagagaaaggaactgttgcattctcagctggattgcatggttgggcttttactctgacaaactttgccaagatgtatgcctcaaagtttggagttgacgagtctaagatgatggagagactatggggtgagaatttctttgatcctgcaaccaagaagtggactagcaagaactctggctctgcaacttgcaagcgtggctttgtgcagttctgttatgagcctatcaaacagatcattaacacttgcatgaatgaccagaaggataaattgtggccaatgttgcaaaaacttggtgttactatgaagtccgaggagaaggaattgatgggcaaggccctgatgaagcgtgtgatgcaaacttggctccctgccagcagtgctctcctggaaatgatgatctttcaccttccctctcctgccaaggcccagaggtatcgtgttgagaacttgtatgagggtccccttgatgatccttatgcaactgcaatcaggaactgtgatgctgaaggcccccttatgctttatgtgtccaaaatgatccctgcttctgataagggtagattctttgcatttgggcgtgtgtttgctgggaaggtctcaactggtctgaaggtgaggatcatgggtccaaattatgtccctggtgaaaagaaagatttgtatgttaagagtgttcaaagaactgttatttggatggggaaaaggcaggaaactgttgaggatgttccttgtggtaacactgtggccatggttggtttggatcaatttattactaagaatgcaactttgaccaatgagaaggaagttgatgcccatcctattcgtgcaatgaaattctctgtttctccagtcgtccgtgtggcagttcagtgtaaagtcgcatctgatcttcccaagcttgttgaaggtctcaagcgtttggccaagtcagatcctatggttgtctgtagtattgaggagtctggggaacacattattgctggtgcaggggagctacaccttgagatctgtttgaaggatttgcaggacgatttcatgggtggagctgagatcatcaaatcagaccctgttgtgtctttccgagagactgtcctagagaaatcctgccgtgtggtaatgagcaagtccccaaacaagcacaaccgtctttacatggaggcacgacctatggaggaagggcttgctgaggctattgatgatggccgtattggcccaagggatgatcctaaggttcgtgcaaagatattatctgaggaatttggctgggataaggatttggcaaagaagatatggtgttttggtcctgaaactactgggcctaatatggttgttgatatgtgtaagggagtgcaatacttgaatgaaattaaagattctgttgttgctggtttccagtgggcatcaaaggagggtgcgttggctgaagaaaacatgagaggtatttgctttgaagtttgtgatgttgttcttcatgctgatgctattcacaggggtggtggtcaggtcattccaactgctaggagggttatttacgcatcacagctaacagccaagcccaggctccttgagccagtttacttggttgagattcaagccccagagcaggctcttggtggtatctatagtgttcttaatcagaaacgtggtcatgtgtttgaggaaatgcagaggcctggcactcctctgtacaatatcaaggcgtatctaccagtcattgagtcctttggtttctctggcactttgagggctgccacatctggacaagccttcccgcagtgcgtgtttgatcattgggacatgatgtcttcagatccaatggaggcaggttcacaggcagcacagcttgtaacagacatccgcaagagaaaaggtttgaaggaacagatgacacctctttccgagtttgaggacaagctgtaaacaaattcttttctcgagtatgatcgagaggggcaatgtttggtcttggtttttaattttgttacggttgagtagtactgtgtcttaataggacggattagttatcctattaatttatggcttgttttagtacaatgtctcaggtgatgattccttcctttggtcgtcttaatgcttattcaaccaacgttggttattcatgtcgctctatttttgctttctggctgacattatatttttaaatttattccgtgagaatttttatttatcactatgctatcgaaaagaatcatgccaatcacgattggctcagcaaactgttgttttccttttacgaactcgtttctttcttcttttttttttttttttttttttttttagtacttaaaatcgtagttcagttttaaagtattttaaaaaattgattttaattgcttaattttaaagctccggtggtgaacaagtttagctccttcagactcgtttattggttattactcttttttcttttttaaatt

SEQ ID NO: 2081 - DNA, 2842 bp, Gossypium hirsutum
tttctctcgccgcctaactctaaggttttgattgttaagtgtaatttgaagacaagtcaagatggtgaagtttacagctgaggagcttcgtgctatcatggaccggaagcacaacatccgtaatatgtctgttattgcccatgtggatcatgggaaatctactcttactgattcacttgtggctgctgctggtatcattgcacaagaagttgctggtgatgttcgtatgacagatacccgtgccgatgaggctgagcgtgggatcacaattaagtctactggtatctctctgtattatgaaatgagtgatgattctttgaagagctacaaaggagagaggcaagggaatgagtacctcatcaatcttattgattcccctgggcacgttgacttttcatctgaggtcacagctgcacttcgtattactgatggtgcccttgtggtcgttgactgtattgaaggtgtctgtgtccaaacagagactgtcctccgtcaggctcttggagaaaggatcaggcctgtcttgactgttaacaagatggacaggtgcttccttgagcttcaggttgatggagaggaggcttaccagacattccagagagtgatcgaaaatgctaatgtcatcatggccacctatgaagatcctcttcttggtgatgttcaagtctaccctgagaagggaacagttgccttctctgctggtttgcatggttgggcttttaccttgaccaacttcgctaaaatgtatgcctcaaagtttggagtcgatgagtccaaaatgatggaaagactttggggtgagaacttttttgatccagctaccaggaaatggaccaccaagaacactggcactgccacctgcaagcgtggttttgttcaattctgttatgagcccatcaagcagatcatcaacacttgtatgaatgaccagaaagataagctctggcccatgctacaaaagcttggtgtcaccatgaagtctgaagagaaggacttgatgggtaaggccctcatgaagcgtgttatgcagacctggcttcctgcaagcagtgctctcctggaaatgatgatctttcacctaccctctcctagcgtggctcagaaatatcgtgttgagaacttgtatgagggtcctcttgatgatatctatgctaatgctattaggaactgtgatcctgagggtcctcttatgctttatgtttcaaagatgattcccgcttctgataagggtaggttctttgctttcggtcgtgtcttttctggcagagttgcaactggtttgaaggtcagaatcatgggtccaaactatgtacctggggagaagaaagacttgtatgtaaagagtgtacagagaactgtgatttggatgggaaagaagcaggagacagttgaggacgttccttgtggtaatacagttgccatggttggtttggatcagttcatcaccaagaatgctacattgaccaatgagaaggaagttgatgcccacccaatacgtgccatgaagttttctgtctcacctgttgtccgtgttgctgttcagtgcaaggttgcatcagatcttcccaaacttgttgaagggttgaagcgtttggccaagtctgatcctatggttgtctgtaccattgaagagtctggtgaacacattgttgctggtgctggagagctccaccttgagatctgtctcaaggatttacaagaagatttcatgggtggtgctgagatcatcaagtcagaccccgttgtgtccttccgtgagactgtccttgagaggtcttgcaggactgtgatgagcaagtctcctaacaagcacaaccgtctgtacatggaagctcgacccttggaggaaggtcttgctgaggccattgacgaaggtcgtattggtccaagagatgatcccaaggttcgttccaagattttggccgaggagtatggttgggacaaagatcttgctaagaagatttggtgttttggccctgagacaactggtcctaacatggtggttgatatgtgtaaaggagttcaataccttaatgaaatcaaggactctgtagttgcggggttccagtgggcatcaaaggaaggtgcgatggctgaggagaacatgaggggtatctgctttgaagtctgtgatgtggttctccatgctgatgctatccacagaggtggtggtcaaatcattccgactgccaggagggttttctatgcttctcagcttacggccaaaccaaggcttctggagcctgtttacttggttgagattcaagcccctgagcaggcacttggtggtatttacagtgttcttaaccagaagcgtggacatgtgtttgaggagatgcagaggcctggtactccactttacaacatcaaggcctaccttccagttattgagtcttttggattctccagcactctgagggctgcaacctccggacaggctttcccacaatgtgtgtttgatcactgggatatgatgtcatcagatccattggaacctggttcccaagcagcagcccatgttgctgagatccgtaagaggaagggattgaaggagcagatgaccccactttctgagtacgaggacaaactgtaaggttgagaataactcagcttctgccgctatattttctgctgcaattttttgttttcggtgtctgtctcttaatgttcttgttagtagttttgggtgccttcacccatactgtcttatcatgcaaggtcatttcagtccttttcagacggtttttacaatgtacttcgctctccatctgtgttgttaatttttattgttttgatgaaatgtatttgagtcaacattgatcgtcttaaaaaaaaaaaaaaa

SEQ ID NO: 2082 - DNA, 3021 bp, Gossypium hirsutum
cgccatcgcatcgaatataagtagcgaatatcctcctttttgcgccttcattccagagagagagaaagagcgttccaacaatcttcgtctctttctctcgcttgccgtttttctctcttaggttttgattcttctttgtagttcgaggtgttttaaagacaagtcaagatggtgaagtttacagctgaggagcttcgtgccattatggacaggaagcacaacatccgtaatatgtctgttattgctcatgtggaccacgggaaatcaactcttaccgattctcttgtggctgctgctggaattattgcacaagaagttgctggtgatgttcgtatgacagatacccgtgctgatgaggctgagcgtggtatcacaatcaagtctactggtatctctctttattatgaaatgtctgatgactctttgaagagctacaaaggagagagacaagggaatgagtacctcatcaatcttatcgattcccctgggcacgttgacttttcatccgaggtcacagctgctctacgtattactgatggtgcccttgtggttgttgactgtattgaaggtgtctgtgtgcaaacagagactgttctccgtcaggctcttggagaaagaatcaggcctgtcttgactgttaacaagatggataggtgcttccttgagctccaggttgatggagaggaggcttaccagacattccagagagtgattgaaaatgctaatgtcatcatggccacctatgaagatcctcttcttggtgatgttcaagtatacccagagaagggaacagttgctttctctgctggtttgcatggttgggcttttaccttgaccaactttgctaaaatgtacgcctctaaatttggagttgatgaggcaaagatgatggaaagactttggggtgagaacttttttgatccagctaccaagaagtggaccaccaagaacactggctctggtacctgcaagcgtggatttgttcagttctgttatgaacccatcaagcagataatcaacacttgtatgaatgaccagaaggacaagctctggcccatgttgcaaaagcttggtgtcaccatgaagtctgatgagaaggacttgatggggaagtccctaatgaagcgtgtaatgcagacgtggcttcctgctagcagtgctctcctggaaatgatgatcttccaccttccctctcctagcaaggctcagaaatatcgtgttgaaaacttgtatgagggtcctcttgatgatatctatgccaatgctatcaggaactgtgatcctgagggtcctcttatgctctatgtttcaaagatgattcctgcttctgataagggtaggttctttgcttttggtcgtgtcttctctggcaaagtttcaactggcctgaaggtcaggatcatgggtcctaactatgtccctggtgagaagaaagatttgtatgtcaagagcgtacagagaactgttatttggatgggaaagaagcaggaaactgttgaggatgttccttgtggtaacacagtggccatggttggtctggatcagtttatcaccaagaatgctactttgactaatgagaaggaagttgatgcgcacccaattcgtgcaatgaagttctctgtctctcctgttgttcgtgttgctgttcagtgcaaggttgcatctgatcttcccaaacttgttgaagggctgaagcgtttggccaagtctgatcctatggttgtttgtacaattgaagagtcgggagagcacattgttgctggtgctggagagctccaccttgagatctgtcttaaggatttgcaagaagattttatgggtggtgctgaaatcgtcaagtcagacccagttgtctcattccgtgaaactgtcctagagaggtcttgcaggactgtgatgagcaagtctcccaacaagcacaaccgattatacatggaagctcgacccttggaggaaggtctggctgaagccattgatgaaggtcgtattggtccaagagatgatcccaaggttcgttcaaaaattttggctgaggagtatggatgggacaaagatcttgctaagaagatatggtgttttggccctgagaccacaggtcctaacatggtggttgatatgtgtaaaggagttcagtacctgaatgaaattaaggattcagtagtcgctgggttccaatgggcatcaaaggaaggtgcaatggccgaagagaacatgaggggtatatgctttgaagtttgtgatgtggttcttcatactgatgctatccatagaggtgggggtcagatcattccaactgctaggagggttttctatgcttctcagctgactgccaagccgaggctgcttgagccagtgtacttggtggagatccaagccccagagcaagcacttggtggtatttacagtgttcttaaccagaagcgaggacatgtgtttgaggagatgcagaggcctggtactccactatacaacatcaaagcatatcttcctgttatcgagtcatttggattctcgagcaccctgagggctgcaacatcaggacaggctttcccacaatgcgtgtttgaccactgggatatgatgtcatcagatccattggaacctggttcccaggcagccacccatgttgctgagatccgtaagaggaagggattgaaggagcagatgaccccgctctccgattacgaggacaagctgtaagctaagctacaaaataataattaattgaagaggttgggttacccattttatgcaatgctgctagttagttccttctatattttgttgtccatggttcggactttttagatggtttttacaatggacacaattgttatgtttttttgtattcaaatagacaattggctttgttaatgtttttgacctccataatcttcattgcttctattatatctttatttatattttccttaaattacttgtaatattttgaccttctttagccaaatgccacataattattggtgatggatcgatcatttcttttaaaaaaaaaaaaaa

SEQ ID NO: 2083 - DNA, 3117 bp, Gossypium raimondii
gaaaaagagttgaaaatatcttaaaggtttcgaaagtcgaagataaccctagctgagacgcccttacatgggcactctcaaacagactttagtcggcacctcgttgaatataaataaagcctatccttctttgtctacctctcattcgagagaaggagagtttttcttgcaatcttcatcccttttctctcgccgcctaactctaaggttttgattgttaagtgtaatttaaagacgagtcaagatggtgaagtttacagctgaggagcttcgtgctatcatggaccggaagcacaacatccgtaatatgtctgttattgcccatgtggatcatgggaaatctactcttactgattcacttgtggctgctgctggtatcattgcacaagaagttgctggtgatgttcgtatgacagatacccgtgccgatgaggctgagcgtgggatcacaattaagtctactggtatctctctgtattatgaaatgagtgatgattctttgaagagctacaaaggagagaggcaagggaatgagtacctcatcaatcttattgattcccctgggcacgttgacttttcatctgaggtcacagctgcacttcgtattactgatggtgcccttgtggtcgttgactgtattgaaggtgtctgtgtccaaacagagactgtcctccgtcaggctcttggagaaaggatcaggcctgtcttgactgttaacaagatggacaggtgcttccttgagcttcaggttgatggagaggaggcttaccagacattccagagagtgatcgaaaatgctaatgtcatcatggccacctatgaagatcctcttcttggtgatgttcaagtctaccctgagaagggaacagttgccttctctgctggtttgcatggttgggcttttaccttgaccaacttcgctaaaatgtatgcctcaaagtttggagtcgatgagtccaaaatgatggaaagactttggggtgagaacttttttgatccagctaccaggaaatggaccaccaagaacactggcactgccacctgcaagcgtggttttgttcaattctgttatgagcccatcaagcagatcatcaacacttgtatgaatgaccagaaagataagctctggcccatgctacaaaagcttggtgtcaccatgaagtctgaagagaaggacttgatgggtaaggccctcatgaagcgtgttatgcagacctggcttcctgcaagcagtgctctcctggaaatgatgatctttcacctaccctctcctagcgtggctcagaaatatcgtgttgagaacttgtatgagggtcctcttgatgatatctatgccaatgctattaggaactgtgatcctgagggtcctcttatgctttatgtttcaaagatgattcccgcttctgataagggtaggttctttgctttcggtcgtgtcttttctggcagagttgcaactggtttgaaggtcagaatcatgggtccaaactatgtacctggggagaagaaagacttgtatgtaaagagtgtacagagaactgtgatttggatgggaaagaagcaggagacagttgaggacgttccttgtggtaatacagttgccatggttggtttggatcagttcatcaccaagaatgctacattgaccaatgagaaggaagttgatgcccacccaatacgtgccatgaagttttctgtctcacctgttgtccgtgttgctgttcagtgcaaggttgcatcagatcttcccaaacttgttgaagggttgaagcgtttggccaagtctgatcctatggttgtctgtaccattgaagagtctggtgaacacattgttgctggtgctggagagctccaccttgagatctgtctcaaggatttacaagaagatttcatgggtggtgctgagatcatcaagtcagaccccgttgtgtccttccgtgagactgtccttgagaggtcttgcaggactgtgatgagcaagtctcctaacaagcacaaccgtctgtacatggaagctcgacccttggaggaaggtcttgctgaggccattgacgaaggtcgtattggtccaagagatgatcccaaggttcgttccaagattttggccgaggagtatggttgggacaaagatcttgctaagaagatttggtgttttggccctgagacaactggtcctaacatggtggttgatatgtgtaaaggagttcaataccttaatgaaatcaaggactctgtagttgcggggttccagtgggcatcaaaggaaggtgcgatggctgaggagaacatgaggggtatctgctttgaagtctgtgatgtggttctccatgctgatgctatccacagaggtggtggtcaaatcattccgactgccaggagggttttctatgcttctcagcttacggccaaaccaaggcttctggagcctgtttacttggttgagattcaagcccctgagcaggcacttggtggtatttacagtgttcttaaccagaagcgtggacatgtgtttgaggagatgcagaggcctggtactccactttacaacatcaaggcctaccttccagttattgagtcttttggattctccagcactctgagggctgcaacctccggacaggctttcccacaatgtgtgtttgatcactgggatatgatgtcatcagatccattggaacctggttcccaagcagcagcccatgttgctgagatccgtaagaggaagggattgaaggagcagatgaccccactttctgagtacgaggacaaactgtaaggttgagaataactcagcttctgccgctatattttctgctgcaatttttttgtttcggtgtctgtctcttaatgtttttgttagtagttttggggtgccttcacccatacagtcttatcatgcaaggtcatttcagtccttttcagacgcttttttacaatgtacttcgctctccatctgtgttgttaatttttattgttttgatgaaatgtatttgagtcaacattgatcgtcttaaacctatatttttcttttaccttcataactgttttgatatccatttacatacactgccggtcgccgttactatgttttaatttaataattttttttaaaaaaaa

SEQ ID NO: 2084 - DNA, 2922 bp, Tripterygium wilfordii
agctcttgagacttgagagagcgcctcaccattggagacggaagagagctgtgacgtccgaaacctctctctgctctctctttctgtcgacgacgtatctgtttcttttacatagttagttgggaaacttaaagagtagtcaagatggtgaagtttactgctgaagagcttcgtaggattatggacctgaagcataatattcgtaatatgtctgttattgcccatgttgatcacgggaagtcaacacttactgattctcttgtggctgctgctggtatcattgcccaagaagttgctggtgatgtacgtatgaccgacacccgggcggatgaggctgagcgtggaattacgattaagtcaactggtatatctctttactatgagatgagtgatgctgctttgaagagctacaagggtgaaagatcagggaacgagtacctcatcaatctcatcgactctcctgggcacgttgacttttcctctgaagtcacagctgcacttcggatcactgatggtgcacttgttgtggttgattgtattgagggggtttgtgtccagacagaaactgttcttaggcaggcccttggtgaaaggatcaggcctgttttgacagtaaacaagatggacaggtgttttctcgagctgcaggttgatggagaggaggcttatcaaactttccagagggtaattgagaatgctaatgtcatcatggctacttatgaagatccactccttggtgatgttcaggtctaccctgagaaaggaacggttgctttctctgctggattgcatggctgggcttttactttaaccaattttgccaagatgtatgcatccaagtttggagttgacgagggaaaaatgatggaaaggctctggggtgagaactactttgacccagcaactaaaaagtggaccagcaagaactctggctctcctacttgcaagcgtggttttgttcagttctgctatgaacccattaagcagattattaacacttgcatgaatgaccagaaagataagctttggccgatgttacagaagcttggcgttaccatgaagtctgatgagaaggacttgatgggcaaggcactgatgaagcgtgtcatgcagacctggctcccagcaagttctgccctactggagatgatgatctttcaccttccctctcctgccacagctcaaaagtaccgtgttgagaacttgtatgagggtcccatggatgatcagtatgctactgctataaggaactgtgatcctgatggtcctctcatgctttatgtgtcgaagatgattcctgcttctgacaaaggtagattctttgcttttggtcgtgtattctctggaaaggtttcaacaggtgtgaaagttcggatcatgggtcctaattatgttcctggtgagaagaaagacttgtatgttaagaatgtgcaaagaactgttatatggatgggcaagaaacaagaaaccgttgaagatgttccttgtggtaacacagtggcattggttggcttggatcagtttattaccaagaatgctaccttgacaaatgaaaaggaagttgatgctcacccaatccgtgctatgaagttctctgtttcacctgtcgttcgtgtcgctgttcagtgcaaggttgcttctgaccttcccaagctcgttgaaggtttgaaacgtttggccaagtcagaccctatggttgtttgtaccattgaagagtctggggagcacattattgctggtgcaggagagctccatcttgaaatctgtttgaaggatctgcaggatgatttcatgggtggtgctgagattgtcaagtctgatcctgttgtgtcatttcgtgagaccgttctcgagaagtcctgccgcactgtcatgagcaagtctcccaacaagcacaatcgtctctacatggaagcacgtcccctggaggaggggcttgctgaggccattgatgacggacgtattggtccacgtgatgaccccaaggtccgatctaagatattgtctgaggaatttggttgggacaaggatcttgccaagaagatttggtgttttgggccagagacaactggccctaacatggtggttgacatgtgtaaaggtgttcagtacctgaatgaaattaaggactctgttgttgctggtttccagtgggcttctaaggaaggtgcgttggctgaagaaaatatgaggggtatctgttttgaagtctgtgatgtcgttcttcacgctgatgccatccacagaggtggtggtcaggtcattccaacggccaggagggttatttatgcttcccagcttactgcaaagcccaggctgcttgagcccgtctatctggttgaaatccaggccccggagcaggctcttggtggtatttacagtgttcttaaccagaaacgtggtcatgtctttgaagaaatgcaaaggcctggaaccccactctataacatcaaggcttaccttccagtcgtagagtcatttggtttctctggcaatttgagggctgcaacctctggtcaggctttccctcagtgtgtgttcgatcattgggatatgatgacatcagatccattggatcccacatcacaggctgcaactcttgttcatgatatccgtaagaggaagggactgaaggagcagatgacccctctgtcagagttcgaggacaagctgtaagcaatcaaaaaattttaatattcatatggaacaatgtttaacccacagaggattatgttgggtgctgtcatttttgctgccttaatattttttgttttcttcccttgtttagtgtctcaatgtggagttgttgtctgtgtgtcgtattgttctgtgttagttttaaataattttatgcctgtttctcaggtccggagtcgttagatttggtttgaattacttcgtttgagatacttcatacttatg

SEQ ID NO: 2085 - DNA, 2717 bp, Chelidonium majus
cgttctctcctcagctactcttctagtgtagcatctctctctcctttggaacctctttcctataattttgtttggtgatttttagacgcagcaaagatggtgaagtttacagcagaagagcttcgcaggattatggacttgaaacataatatacgaaatatgtccgttattgcccatgtagatcatgggaaatccactcttactgattctcttgtggctgctgcgggtatcattgcccaggaagtggcaggtgatgttcgtatgactgatacccgagccgatgaagcagagcgtggtatcactattaaatctactgggatatctctctactacgagatgactgatgcttcactcaaagccttcaagggagaacgttcagggaatgagtacctcatcaaccttattgattcacctggacacgttgacttctcttctgaagtcacagctgcattacgtattactgatggtgcacttgttgtggtagactgtgttgagggtgtttgtgtccaaacagagactgtactccggcaggcacttggtgagaggattaggccggttctaactgttaacaagatggatcggtgtttcctggagctccaggttgatggagaggaggcttatcagactttctccagagtaattgagaacgctaatgtcattatggccacttatgaagatccactacttggtgatgttcaagtgtaccctgagaaaggaactgttgctttctctgctggtttgcatggttgggcctttactctaaccaactttgctgacatgtatgcttccaagtttggtgttgatacgagtaagatgatggagaggctgtggggtgagaacttttttgaccctgcaaccaagaagtggacctccaagaacactggatcacccacctgtaagcgtggttttgtacagttctgttatgagcccatcaagcagattatcaacacttgcatgaatgatcagaaagacaaactgtggcctatgttgcaaaagcttaatgttacaatgaagtctgaagaaaaggatttgatgggaaaggccttgatgaagcgtgtgatgcagacttggctaccagcaagtactgctctactagaaatgatgatttttcaccttccatcaccccacactgctcaaagataccgtgttgagaacttgtacgagggtcctcttgatgatatgtacgctaatgctatcagaaactgcgatcctgaagggcctctaatgctttatgtgtctaagatgattccagcatctgacaagggtaggttctttgcttttggtcgtgtctttgctggaaaggtttcaactggtttgaaggttagaatcatgggacctaactatgtacctggacagaagaaggacttgtatactaagagtgtgcagagaactgtcatttggatgggaaagaagcaggagtcagttgaggatgttccttgtggaaacacagttgctttggtaggcttggatcagtatatcaccaagaatgcaaccttgacaaatgaaaaggaagttgatgctcatcctattaaagccatgaagttttctgtctcgcctgttgtccgtgttgccgtgcagtgtaaggttgcctctgaccttcccaagcttgttgaagggcttaaacgtcttgccaagtctgatcctatggttgtatgttcaattgaggagtctggagagcatattattgctggtgctggagaactacatcttgaaatctgtttgaaggacttgcaggatgatttcatgggtggggcagaaattgtaaaatcagacccagtggtgtccttccgtgaaactgttcttgagaagtcgagcagaactgtgatgagcaagtctccaaacaagcacaaccgtctgtacatggaagcacgacctctagaagaagggcttcctgaggcaatcgatgatggacgtattggtccaagggatgatcctaaggttcgctcaaagatcttgtctgaagagtttggttgggacaaggatcttgcgaagaagatttggtgttttggacctgagaccactggtccaaacatggttgtagatatgtgtaaaggagttcagtacttgaatgaaatcaaggattcagtcgtagctgggttccagtgggcgtcaaaggaaggtgcattagcagaggagaacatgagaggtatttgttttgaggtatgtgatgtggttctccatgctgatgccatccacagaggtggtggacaggtcattcccactgctaggagggttatctatgcctcgcagctcactgccaagccaaggttgttggagccagtctacctagtggagatccaggcaccagaacaagctcttggtggcatttatggtgttctgaaccagaagcgcggacatgtgtttgaggagatgcagagacaaggtactccactctataacatcaaggcttatcttcctgttatcgagtctttcggtttctctggtcagctcagggcagctacatcaggacaggcattcccgcaatgtgtgtttgatcattgggacatgatgtctgctgatccattggagagtggatcccaagctgcccagctagtgatggacatcaggaagaggaagggtctgaaggagcagatgactccactttctgaatttgaggacaagctataaggtgtctaatctcagcagacaagggagagtgatgaatgattgaattgatattttgattctgctgcttttatacaaagttttaagacgga

SEQ ID NO: 2086 - DNA, 3119 bp, Castanea mollissima
  misc_feature (3075)..(3075): n is a, c, g, or t
atcagcctcacatttgcaaactactgagctgaggctgcgctctctcacacaccctctctctttctctctctgcgttgcttaacagcagtatctcttcctttcacttttgctccaaacccctatcttttttttcaggtgttctttgattcttcaagaaatttttgattgtgtcatttacagactagtcaagatggtgaagttcacagctgatgagctccgcagaattatggactacaaacataacatccgtaacatgtctgttattgcccatgttgatcatgggaagtcaacacttaccgattctcttgtggctgctgctggtatcattgctcaagaagttgctggtgatgtccgtatgacagatacccgtgcagatgaggcagagcgtggaattaccatcaaatccactggtatctccctctattatgagatgagtactgagtctctaaagagctacaagggagagcgtaatggaaatgagtacctgatcaatctcattgattcccccggacacgttgacttctcatccgaggtcacagctgctcttcgtattactgatggtgcactcgtggtcgttgattgtgttgaaggtgtttgtgtccaaacagaaactgtgctccgacaagccttgggtgaaaggattaggcctgtcttgaccgttaacaagatggacaggtgtttccttgagctccaggttgatggagaggaggcttaccaaacattctcgagggttattgagaatgctaatgtcattatggctacctatgaagatcccctccttggtgatgtccaggtctaccccgagaaaggaactgttgctttctctgctggtttgcatggctgggcttttactctaaccaattttgccaagatgtatgcttcaaagtttggagttgatgagtccaagatgatggagcgcctctggggtgagaacttctttgatcctgctaccaagaagtggacaactaagaacactggctctgctacctgcaagcgtggtttcgttcagttctgttatgaacccatcaagcagattatcaacacttgcatgaatgaccagaaggacaaactgtggcccatgctgacaaagcttggtgtcaccatgaaatctgaagagaaggacttaatggggaagccattgatgaagcgtgtcatgcagacctggctcccagcaagtagtgctctcttggaaatgatgatctttcaccttccatccccttccacggcccaaaagtatcgtgttgaaaacttgtatgagggtccccttgatgatgcttatgctaatgctatccggaattgtgatcctgatgggcctctcatgctctatgtatcaaaaatgattcctgcctctgataagggtaggttctttgcttttggccgtgtctttgctggcagggtctctacaggtttaaaggttagaattatgggtccaaactacgtccctggtgaaaagaaggacctttatgttaaaagtgtgcagaggactgttatctggatggggaagaagcaggaaactgttgaggatgtgccttgtggtaacacagttgccctagttggattggatcaatatatcaccaagaatgctactttgacaaatgagaaggaaactgatgcacacccaatccgagccatgaagttttctgtgtcacctgttgtccgtgtggctgttcaatgcaaggttgcatctgaccttcccaagcttgttgaaggtctgaaacgtttggccaagtcagatcctatggttgtatgttctattgaagagtctggggagcatatcattgctggtgcaggagaactccaccttgaaatctgtttgaaggatttgcaggatgatttcatgggtggagcagaaattattaagtctgaccctgttgtgtccttccgtgagacggtccttgagaagtcttcccgtattgtgatgagcaagtcacccaacaagcataaccgtctgtacatggaagcacgtcccatggaagatgggcttgcagaggccattgatgacggccgtattggtccaagggatgatcctaaagttcgttccaaaatcttggccgaggaatttggctgggataaggatcttgcaaagaaaatctggtgttttggccctgagaccactggacctaatatggtggttgatatgtgtaagggagtccagtacctcaatgaaattaaggattctgttgttgctgggtttcagtgggcttctaaggaaggtgcactggctgaagaaaacatgagaggtatctgttttgaagtctgtgatgttgtgcttcatgctgatgccatccacagaggtggtggtcaggtaattcctactgccaggagggttatttatgcttcccagctgactgccaagcccaggcttcttgagcctgtgtacatggtggagattcaagctcctgagcaggcacttggtggtatctacagtgttcttaatcagaaacgtggacatgtgtttgaggaaatgcagaggcctggtactccactctacaacatcaaggcatatttacccgtcattgagtcttttggattctcaagtactttgagagctgcaacctcagggcaggctttcccacaatgtgtctttgatcattgggacatgatgtcttctgatccattggaatctggttcacaggcttcgcagcttgtattagacatccgcaagaggaagggtttgaaggagcagatgacaccgttgtctgagtttgaggacaagctataaacatttaatcttagtattgttgatcatgttggtttacttgagcgagacgtcaacacacatcagcagacaggtaagattgcatggggtcgtccccctgcctcgtttttgttttctgtttttgaaatgtcgctatgttttagtagtttctggatccctatgggaataaacactcagttttattattatgtttggttgtaatgttcgattcgaggacaatatgtaacgtttattgtgttagattgttctgttttaaactattccatttgacagtgattgaggttttctatttctgatttagaaatggtggtgcaagttatttttttattaggcggtgataaaaaaaaactaaaagngacacgcaacaagggagtagcgaaggacgacacaggggaggtag

SEQ ID NO: 2087 - DNA, 2825 bp, Gossypium hirsutum
gagagaaagagcgtccaacaatcttcgtctctttctcttgcttgccgtttttctctcttaggttttgattcttgtttatagttcgaggtgttttaaagacaagtcaagatggtgaagtttacagctgaggagcttcgtgccattatggacaggaagcacaacatccgtaatatgtctgttattgctcatgtggaccacgggaaatcaactcttaccgattctcttgtggctgctgctggaattattgcacaagaagttgctggtgatgttcgtatgacagatacccgtgctgatgaggctgagcgtggtatcacaatcaagtctactggtatctctctttattatgaaatgtctgatgactctttgatgagctacaaaggagagagacaagggaatgagtacctcatcaatcttatcgattcccctgggcacgttgacttttcatccgaggtcacagctgctctacgtattactgatggtgcccttgtggttgttgattgtattgaaggtgtctgtgtgcaaacagagactgttctccgtcaggctcttggagaaagaatcaggcctgtcttgactgttaacaagatggataggtgcttccttgagctccaggttgatggagaggaggcttaccagacattccagagagtgattgaaaatgctaatgtcatcatggccacctatgaagatcctcttcttggtgatgttcaagtctacccagagaagggaacagttgctttctctgctggtttgcatggttgggcttttaccttgaccaactttgctaaaatgtatgcctctaaatttggagttgatgaggcaaagatgatggaaagactttggggtgagaacttttttgatccagctaccaagaagtggaccaccaagaacactggctctggtacctgcaagcgtggatttgttcagttctgttatgaacccatcaagcagataatcaacacttgtatgaatgaccagaaggataagctctggcccatgctgcaaaagcttggtgtcaccatgaagtctgatgagaaggacttgatggggaagtccctaatgaaacgtgtaatgcagacgtggcttcctgctagcagtgctctcctggaaatgatgatcttccaccttccctctcctagcaaggctcagaaatatcgtgttgagaacttgtatgagggtcctcttgatgatgtctatgccaatgctatcaggaactgtgatcctgagggtcctcttatgctctatgtttcaaagatgattcctgcttctgataagggtaggttctatgcttttggtcgtgtcttctctggcaaagtttcaactggcctgaaggtcaggatcatgggtccaaactatgtccctggtgagaagaaagatttgtatgtcaagagcgtacagagaactgttatttggatgggaaagaagcaggaaactgttgaggatgttccttgtggtaacacagtggccatggttggtctggatcagtttatcaccaagaatgctactttgactaatgagaaggaagttgatgcgcacccaattcgtgcaatgaagttctctgtctctcctgttgttcgtgttgctgttcagtgcaaggttgcatctgatcttcccaaacttgttgaagggctgaagcgtttggccaagtctgatcctatggttgtttgtacaattgaagagtcgggagagcacattgttgctggtgctggagagctccaccttgagatctgtcttaaggatttgcaagaagattttatgggtggtgctgagatcatcaagtcagacccggttgtctcattccgtgaaactgtcctagagaggtcttgcaggactgtaatgagtaagtctcccaacaagcacaaccgattatacatggaagctcgacccttggaggaaggtctggctgaagccattgatgaaggtcgtattggtccaagagatgatcccaaggttcgttcaaaaattttggctgaggagtatggatgggacaaagatcttgctaagaagatatggtgttttggccctgagaccacaggtcctaacatggtggttgatatgtgtaagggagttcagtacctgaacgaaattaaggattctgtagtcgctgggttccaatgggcatcaaaggaaggtgcaatggccgaagagaacatgaggggtatatgctttgaagtttgtgatgtggttcttcatactgatgctatccatagaggtgggggtcagatcattccaactgctaggagggttttctatgcttctcagctgactgccaagccgaggctgcttgagccagtgtacttggtggagatccaagccccagagcaagcacttggtggtatttacagtgttcttaaccagaagcgaggacatgtgtttgaggagatgcagaggcctggtactccactatacaacatcaaagcatatcttcctgttatcgagtcatttggattctcgagcaccctgagggctgcaacatcaggacaggctttcccacaatgcgtgtttgaccactgggatatgatgtcatcagatccattggaacctggttcccaggcagccacccatgttgctgagatccgtaagaggaagggattgaaggagcagatgaccccgctctccgattacgaggacaagctgtaagctaagctacaaaataataattaattgaagaggttaggttacccattttatgcaatggtgctagttagttccttctatattttgttgtccatggttcggactttttagatggtttttacaatggacacaattgttatgtttttttgtattcaaatagacaattggctttgttaatgtttttgacc

SEQ ID NO: 2088 - DNA, 2597 bp, Cucumis sativus
acagcctaacaacaatcttaatttcggaatattctgaaatttgaagacttgtcaagatggtgaagtttacggctgaagagcttcgtaggattatggactacaagcataacattcgtaatatgtctgttattgctcatgttgatcatgggaagtccactcttacagattctcttgtggctgctgccggtatcattgcacaagaagttgccggtgatgtacgaatgacagatactcgccaagatgaggcagagcgtggtatcaccattaaatctactggaatctccctctactatgagatgtctgatgaatccttgaaaagttacaagggagagagacatggaaatgagtatcttatcaatcttattgattcacctgggcacgttgacttctcgtcggaggttacagctgctttgcgtattactgatggtgctcttgttgtggtggattgcatcgaaggtgtttgtgtccaaacagagactgtgctccgtcaggctttgggagagaggattagacctgtcttgactgttaacaagatggataggtgcttccttgaacttcaagtggatggagaagaggcttatcaaacattccagagggtcattgagaatgccaatgtgattatggccacgtatgaggatccacttctgggcgatgttcaagtgtacccggagaaaggaacagttgctttctctgctggtttgcacggctgggcatttaccctgactaactttgccaagatgtatgcctccaagtttggagtagatgaggcgaagatgatggagagactttggggtgagaatttctttgatcctgcaacgaagaagtggacaagcaagaacactggcacggcaacatgcaagcgtgggtttgtccagttctgctacgaacccatcaagcagatcattgcaacttgcatgaacgatcggaaggacaagctatggcccatgttgcagaagcttggtgttgtcatgaagtctgatgagaaggatctgatgggcaaaccactgatgaagcgggtcatgcaaacatggctaccagcaagtactgctcttttggaaatgatgatctttcatcttccatcccctgccaaggctcaaaagtatcgtgtggagaatttgtatgagggtccacaagatgatgtttacgctagtgccattagaaattgtgatcctgagggacctcttatgctttatgtatcaaagatgattccagcatctgataagggcaggttctttgcctttggacgtgtgttctctgggaaagtttcaactggtttgaaagttagaatcatgggccccaactatgttcctggtgagaaaaaagatttgtatgttaagagcgtccagagaactgtcatttggatgggaaagaagcaagaaacagtggaggatgtgccttgtggtaacactgttgccatggttgggctggatcaatttatcactaagaatgccactctgacaaatgaaaaggaagtcgatgctcatccaattcgagccatgaagttttctgtatctcccgtcgtgcgtgttgccgttcagtgcaaggtggcctctgatcttcccaagcttgtggaaggacttaaacgtctggccaagtcagaccctatggttgtgtgtaccatggaggaatctggtgagcacattgttgctggcgctggagaactacatcttgagatctgtttgaaggatttgcaagatgatttcatgggtggagctgagatcataaaatctgaccctgttgtctctttccgtgaaaccgtacttgagaggtcatgccgcacagtgatgagcaagtcccctaacaagcacaatcgactgtacatggaagcacgacccatggaggatggactggcagaggctattgatgatggccgcattggaccacgagatgatcctaaagttaggtctaaaattttgtcagaggagtttgcttgggacaaagatcttgctaagaagatttggtgctttggtcctgagactaccggccctaacatggtggttgatatgtgtaagggagttcaatacctgaatgaaatcaaggattccgttgttgctggtttccaatgggcgtcgaaagaaggtgcattggcggaagagaacatgagaggcatctgttttgaagtgtgtgatgtggtgcttcacgctgatgccatccacagaggaggtggtcaagtgattccgactgctaggagggtaatctacgcttctcagctgactgccaaaccaagacttcttgagccagtgtacctagtggagattcaggctccggagcaagctcttggtggtatctacagtgttcttaatcaaaagcgtgggcacgtctttgaggaaatgcagaggcctggcacacctctttacaacatcaaggcatatctccccgtcatcgaatcatttgggttctcgagcactttgagagctgcaacttctggacaggcattcccacagtgtgtgtttgaccattgggaaatgatgtcttcagatccattagaaagtgggtctcaagctgcgcagttggttgctgatatcaggaagaggaaggggttgaaggagcaaatgactccactttcggatttcgaggacaagctgtagatcacttgc

SEQ ID NO: 2089 - DNA, 3013 bp, Eucalyptus grandis
aatctacaccctgtggctcgcagcatcgcttccactctcgccgcctctctctctctcctctctcctctacctgatttcttctattttttgaggaggagtgccttttaagaaccagtcaagatggtgaagttcacagctgatgagctccgaagaatcatggactacaagcacaacattcggaatatgtctgtcattgcccatgttgatcacgggaaatccacactcaccgattcccttgtggctgctgctggtattattgcccaggaagttgctggggatgttcgtatgacagatactcgtgcagatgaagcagagcgtggtatcacgatcaagtctactggaatttctctttactatgaaatgtctgacgcttccttgaagagctacacgggagagagaaatggcaatgagtatctcatcaacttgatcgactcacctgggcacgtggacttctcttctgaggtcacagctgccctccgaattaccgatggtgcgttagtggttgtggactgtgttgagggtgtctgtgtccagacagaaactgttcttcgtcaggctttgggtgagaggatcaggcctgtcttgactgtcaacaagatggacaggtgcttcctcgagctgcaggttgatggagaggaggcttatcaaaccttccaaagagttattgagaatgccaacgtcattatggccacgtatgaggatccccttctgggtgatgtccaggtgtacccggagaaaggaactgttgctttttctgctggtctgcatggttgggcctttactctcaccaattttgccaaaatgtatgcctccaagtttggtgttgacgagtcaaagatgatggaacgtttgtggggtgagaatttcttcgatcctgccaccaagaaatggactaccaagaacaccggttctccaacatgtaagcgtggatttgtccagttctgctatgagccaatcaagcagatcatcagtacgtgtatgaacgaccagaaagataagctgtggcccatgctgcagaagcttggggtcaccatgaagtctgatgagaaggacttgatgggtaaggcattgatgaagcgtgtgatgcagacttggcttcctgcaagtactgctctgctggaaatgatgatattccacctcccatctccttctaaggctcagagatatcgtgttgagaacttgtatgagggtccccttgacgatcaatatgccactgctattaggaactgtgatcccgagggacctctcatgctctatgtctccaagatgattcccgcttctgataagggaagattctttgcttttggtcgtgttttcgctggcaaggtgtctactggtctgaaggtcaggatcatgggtcccaactatgtcccaggtgagaagaaggatttatatgtgaagagtgtccagagaactgttatttggatgggaaagaggcaggagactgtcgaggatgtgccgtgtggtaacactgtggctatggttggtcttgatcagtatatcacaaagaatgccactttgacaaatgagaaagaagtcgatgcccatcccattcgtgccatgaaattctccgtctctccagtcgtgcgtgttgctgttcagtgcaaggtggcttctgaccttcccaagctcgtggaaggacttaaacgtttggccaagtcggatcctatggtggtatgtagcattgaggaatctggtgaacacatcattgctggtgctggagagctccatttggaaatttgcctgaaggatttggtggatgacttcatgggcggcgctgagattgtgaaatctgatccagttgtgtctttccgtgaaactgtcttggagaaatcaatccgtactgtcatgagcaagtcgcccaataagcacaacaggctgtacatggaggctcgacctttggaggaggggcttgcagaggccattgacgacgggcgtattggtcctagggatgatcccaaggctcgttcaaagatcttgtctgaagagtttggctgggataaggatcttgccaagaagatttggtgcttcggtcctgagaccactggacctaacatggttgttgatatgtgtaagggtgttcagtacctcaatgaaatcaaggattctgttgtcgctggtttccagtgggcatcaaaagaaggtgctttggctgaggagaatatgcgtggtatttgctttgaggtctgtgatgtggttctgcatgctgatgccattcacagaggtggtggccaggtcattccaactgctaggagggttatctatgcttcgcagttgacagccaagcccaggctgcttgagcctgtctaccttgtcgagatccaagctccagagcaggcccttggtggtatttacagtgtccttaaccagaagcgtgggcatgtgttcgaggagatgcagaggcctggaacccctctgtacaacatcaaggcctacctgcctgttatcgagtcctttggtttctctagtacattgagagctgcaacctctgggcaggcgttccctcagtgtgtctttgaccattgggatatgatgatgtctgatcctctggagtctgggtctcaggcagctcagctggttactgatatccgcaagaggaagggcttgaaggagcagatgaccccgctgtcagagttcgaggacaagctgtaattgcaggatggattgatgaagcagtgtccgtggctccatgagctagttctcttttcttggatactgtcccttgtgtagtagtagtcacaaactttcaagtttaattgctctgcttgtcgtcatgttttgagttttgaacattgtcctggtgtcttgagaggtgcaatttttattttctcataggtggttttgcttgttggagctgatttaagagttaatggtgcgccataatgtaccaagatccaacgcaacttatattgttaactctcctaccagagtatttttgcttctagagaggtctattattatgaataagttttcttttgttctccaaaaatttctccataagaagcgagtcttt

SEQ ID NO: 2090 - DNA, 3515 bp, Pinus pinaster
aaccactctggggcatctggtcggtgtcaaactgctatccatccacgagaagggttcattcaggcccgcttttctatattccgcactagcaattaaagattgaaaaggctttaaattcagtagaatcgtaaaaaggaatatgactttccaaggttaattcgagaaaacttactggaacagggtttcggattcgctacccgtttagtgtccaagtatttcctcaatccacggcatcttattctgcccctcacagaatattcgatcaccgtcctgctccaccaaaaaccctaacggagttacggtcttcaaccaaaagcctactccatcgagcaaagtcatccttttgtttgtctcaggccgccgggtcattcttttatcttagtactcgcatgccttgcctgagccgcgagagtccgtgatttgaaggtttcagaggtctgcaactcgaatccattctgtgccgttctcctttggcgggtgctcattggtattcttctgttttggctgagaagagttttggtgaatacaaaagttaggaaaaatggtgaagttcacggctgaagagcttcgtaaaatcatggacaggaagcataacatacgaaacatgtctgttattgcccatgttgatcacggaaaatccactctcactgattctttggtagcagcagctggtatcattgctcaagaagttgctggagatgtcagaatgactgatactcgggcagatgaagctgaacgtggcatcaccatcaagtcaactggaatttcgttgtactatgtgatggaggattcagcggtgaaaaatttcaagggggatagagaaggacacgaatatttgataaatctgattgattctccagggcatgttgacttttcttcagaagttacagcagccctgcgaatcacagatggtgcactggttgtggtagattgtattgaaggggtttgtgtccagactgagactgttcttcgtcaagctcttggagaaaggattaggcctgttctcactgtgaacaagatggacaggtgctttcttgagttgcaggttgatggagaggaagcttaccaaaccttctcacgtgtcattgaaaatgcaaatgtgattatggctacttatgaagatcctcttcttggtgactgccaagtttatcctgaaaaaggtacagttgcattctcggcaggtctgcacgggtgggcatttaccctcacaaattttgcaaaaatgtatgcttcaaagtttggagtggatgaagcaaagatgatggagaggctctggggtgagaacttttttgatccagctacaaagaaatggacaaccaagaatacaggttctgcaacttgcaaaagaggatttgttcaattcatatatgaacctattaagcaaattatcaatatttgtatgaatgatcaaaaggataagttgtggcccatgttgcagaaattgggagttgtaatgaaaagtgacgagaaggagctggttgcaaaagcactcatgaagcgtgtcatgcaaacctggctacctgcaagtagtgctttacttgaaatgatgattttccatcttccttctccagcgaaggcacagagatatcgtgtggaaaacttgtatgaaggacctcttgatgatgtatatgcaactgcaataagaaactgtgaccctgagggtccactgatgttgtatgtttcaaaaatgattccagcttcggacaaaggacgtttctttgcctttggtcgtgtttttgctggcagagttgcaacaggtatgaaggtaaggatcatgggtcccaactatgtgccaggtcagaagaaagatttatatacaaagagtgttcaaaggactgtgatatggatgggaaagagacaagaatctgttgaggatgtgccttgtggaaatacagtggctttggttgggttagaccagttcataaccaaaaatgctacactgacaaacgagaaggaggctgatgctcatccgatcagagcaatgaagttctctgtgtcccctgttgtacgtgttgctgtgcagtgcaaggtggcatctgaccttccaaaacttgttgaagggctgaagcgtcttgctaagtcggatcctatggttgtttgtacaattgaggaatctggagaacatattattgcaggtgcaggagagcttcatctcgagatttgcttaaaagatctccaagatgattttatgggtggagctgagattgttgtttctgatcctgttgtctcatttagagaaactgttttggagaaatcatgccgtactgttatgagcaagtctccaaataaacataacaggctttactttgaagcaagacctttagaagaaggtcttgcagaagcaattgatgatggtcgcattggcccaaaggatgatccaaaggctcgcgcaaaaatcctttctgaggaatttggatgggacaaagatttggctaagaagatctggtgttttggacctgaaaccactggtcccaatatggtggtggatatgtgtaagggagttcaatacttgaatgaaattaaagattctgtggttgctgcattccaatgggcatctaaggaaggtgctcttgcagaagaaaatatgcgtggtatttgctttgaggtttgtgacgtggttttgcacactgatgctatccatagaggaggtggccaggttatcccaacggccagaagggttatgtatgcatctcagcttactgccaaaccacggcttcttgagccagtatatctcgttgagattcaggctcctgagaatgcccttggtggtatttatggtgtgctgaaccagaagagaggtcatgtttttgaagaaatgcagaggccaggtactccactatacaacatcaaggcatatctgccagttgttgaatcattcggattctcaagcactctccgtgctgcaacttctggccaggctttccctcaatgtgtgtttgaccactgggatatgatgggctctgatccattggaacctggttcccaagctgggcagcttgtgactgatatccgtaagaggaagggtcttaaggagagtatgactcccttgtcagagttcgaagacaagctgtagagctttgctatgtttgcatgtcggatgctgtcaagattgaggaacctccgagtattaaaacacagttttgtgtgctaggactagttgaatttatgctattcaggtatttttgtgatctgttatttatgttattcaggtatttttgtgatttgaaaatactttttacaaggtacatccattaatcttttaaatgttacataattctcccttgtcaatttcaccgtatgtgcggtagtttgaattgcttgcataattatgtatgtcacagaaaagccgagctgagatttgagtagacgttggtttaaaaattgttgtatatatttgtgctccatctattattctcctctctagtttcccaatccatccacgtagtattgtgcctgttgtgtctttgacgtcaatgggtttccctgttagtcttatgttatccatctgtgtccag

SEQ ID NO: 2091 - DNA, 2871 bp, Fagus grandifolia
cttttctgcgtctctaagcggcagagaggtgtgattttgataaataagaggaaaacattctcttagatacaaagactagtcaagatggtgaagtttacagctgatgagctccgtaggattatggactacaaacacaacattcgtaatatgtctgttattgcacatgttgatcatggaaagtcaacgcttaccgattctcttgtggctgctgctggtatcattgctcaagaagttgctggtgatgtccggatgacagatacccgtgcagatgaggcagagcgtggtatcacaattaaatctactggtatatctctctactatgagatgactgatgcgtctctacagagcttcaagggagagcgaaatgggaatgagtaccttatcaatctaatcgattcccctgggcacgttgacttctcatctgaggttacagctgctcttcgtattaccgatggtgcacttgtggttgttgattgtgttgaaggtgtctgtgtccaaacagaaactgtgctccgacaggccttgggagaaaggattaggcctgtcttgactgttaacaagatggacaggtgtttcctgagctccaggttgatggagaggaggcttaccaaacattctcaagggttattgagaatgctaatgtcatcatggctacatatgaagatcccctccttggcgacgtacaggtctaccccgagaaaggaacagttgctttctctgctggtttgcatggctgggcctttacactgaccaactttgcaaagatgtatgcatccaaatttggagttgatgagagcaagatgatggaacgtctctggggtgagaacttctttgaccctgctactaagaagtggacaaccaagaacagtggctctcctacctgcaagcgtggttttgttcagttctgctacgaacctatcaagcagattatcaacacttgcatgaatgaccagaaggataagctgtggcctatgttgacaaagcttggtgttaccatgaagtcagatgagaaggacttgatggggaaggccttgatgaagcgtgtcatgcagacctggctcccagcaagtactgccctcttggaaatgatgatctttcaccttccatccccaagcacagcccaaaggtatcgtgttgaaaacttgtacgagggtccccttgatgatgcctatgctaatgctatccggaactgtgatcctgaagggcctctcatgctctatgtgtcaaaaatgattcctgcctctgataagggtaggttctttgcttttggtcgtgtctttgctggcaaggtcactacaggtttgaaggttagaattatgggtccaaactacgtgcctggggaaaagaaggacctttatgttaagagtgtgcagagaactgttatttggatggggaagaaacaggaaactgttgaggatgtgccttgtggtaacaccgtcgctttggttggattggatcaatatatcaccaagaatgctactttgacaaatgagaaggaagttgatgcacacccaatccgagccatgaagttttctgtgtcacctgttgtgcgtgtggctgttcaatgcaaggttgcatctgaccttcccaagcttgttgaaggtctgaaacgtttggccaagtcagatcctatggttgtatgttcaattgaagagtctggagagcacatcattgctggtgctggagaactccaccttgagatctgtttgaaggatttgcaggatgatttcatgggtggagcagagattataaagtctgaccctgttgtgtccttccgtgagacagttctggagaagtcttgccgcactgtgatgagcaagtcacccaacaagcataaccgtctatacatggaagcacgtcccatggaagaagggcttgcagaggccattgacgacggccgtattggtccaagggatgatcctaaagctcgttccaaaatcttgtctgaggagtttggttgggataaggatcttgcaaagaagatctggtgttttggccctgacaccactggccctaatatggttgttgatatgtgtaagggagtccagtacctcaatgaaattaaggattctgttgttgctgggtttcagtgggcgtctaaggaaggtgcattggctgaagaaaacatgagaggtatttgttttgaagtctgtgatgttgttcttcactctgatgccatccacagaggtggtggtcaggtaattcctactgctaggagggttatatatgcttcccaaataactgccaagcccaggcttcttgagcctgtttacctggtggagatccaagcacctgagcaagcacttggtggtatttatagtgttcttaatcaaaaacgtgggcatgtgtttgaggaaattcagaggcctggcacacccctttacaacatcaaggcatacctacctgttgtcgagtcttttggattctctggcacattgagagctgcaacctcagggcaggctttcccacaatgtgtctttgatcactgggacacgatgtcttctgatccattggaagctggatcacaggctgcactgcttgtaacagacatccgcaagaggaagggattgaaggagcagatgaccccactgtctgatttcgaggacaagctataaacatttcatcttatcattgttgattatgttggtatacttgagcgagataccaacagatgcatatgggggtcataccctcgtctctatttttgttttctgtttttgttatgttgtagtactaatctgtatcctaagggaataaacatccagttttattgttatgtttggttgtaacgttactctcgaggacagtatgtaacgttgtgttgtgttagattgctctgtttaaattattcctatttgacgttggttcgcg

SEQ ID NO: 2092 - DNA, 2886 bp, Musa acuminata
gccacgcgtctttttctatataaatggagagaggattagggtttcaggagcatcgcttgccgccgtgcttctctcatccggaggtccgaaccagaatagttattgcctgatctttaagagcagtcaggatggtgaagttcacggcggaagagctccgcaagattatggacctgaagcataacatccgaaatatgtctgtcattgcacatgtggatcatgggaagtctactctgacagattctctagtggcagctgctggcattattgcacaggaagttgcaggagatgttaggatgacagacacccgacaagatgaagccgaacgtggtatcactattaaatccactgggatttccctttattatgagatgactgatgaatctttgaagaactacaaaggtgaaagggttgggaatgaatacctaattaatctgattgactcacctgggcatgtggatttttcgtctgaggtcacagctgctttacgtattactgatggtgctttggttgttgttgactgtgttgagggtgtatgtgtgcagaccgaaacagtccttcgacaagccttgggagaaagaatcaggcctgtcttgactgttaataagatggaccgctgctttctggagcttcaagttgatggagaagaggcatatcagacttttcagagagtcattgagaatgcaaatgtgatcatggctacttatgaggatgtccttcttggagatgttcaagtttacccagagaaaggaactgttgccttttctgctggtttgcatggttgggctttcacattgaccaactttgctaagatgtatgctgctaaatttggagttgatgaggcaaagatgatggagaggctgtggggtgagaattacttcgaccctgctacaaagaaatggactaccaagagtactggttcgccaacttgcaaacgtggctttgtccagttttgttatgaaccaataaggcaaatcataagcacatgtatgaatgaccaaaaggacaagttgtggcccatgctccagaaacttggtgtgaccatgaaatctgatgagaaggacctgattgggaaagctttgatgaaaagggttatgcagacttggttgcctgctagcagtgcccttcttgagatgatgatcttccaccttccatctcctgccaaggcacagaggtatcgtgtggagaacctgtatgaaggtcctcttgatgatatttatgcaaatgccattagaaattgtgatccagagggcccccttatgttgtacgtgtcaaaaatgattccagcttctgacaagggtaggttttttgcatttggtcgagttttctctggtaaggtttccacaggtttgaaggttcgaattatggggccaaactatgtccctggccaaaagaaggatttgtatgtcaagagtgtgcagagaactgttatttggatgggtaagaaacaagagtctgtggaggatgtgccttgtggaaatacggttgctatggttggtttagaccagtttattaccaagaatgcaaccttaactaatgagaaggaaacagatgcccatcctattagagcaatgaagttttcagtgtctcctgttgttcgtgtcgctgtgcaatgcaaggttgcttctgatcttccaaaacttgtagaaggcttgaaacgattagcaaaatcagatcccatggtggtgtgtacaatagaggaatctggtgagcacattgttgctggtgcaggtgaactacaccttgaaatatgcttgaaagatttgcaggaagatttcatgggaggagcagagattatagtctctgatcctgtggtttctttccgtgaaactgtgttggagaaatcatgtaggactgtcatgagtaagtctccaaacaagcataataggctttacatggaagcacggcccatggaagaaggacttgctgaggcgattgatgacggacgcattggcccaagggatgatcccaaagctcgttccaagattctctctgaagagtttgggtgggacaaggatcttgccaagaagatctggtgctttgggcccgagacgaccggtccaaacatggtggttgatatgtgcaagggagttcagtatcttaatgagatcaaggattctgttgtggctggtttccagtgggcttcaaaggaaggagcagtggctgaggaaaacatgcgtgctatatgttttgaggtgtgtgatgttgtcctgcatgctgatgctattcacagaggtggtggacagattattccaacagccaggagggccatatatgcagctcaattgacagctaagccaagactccttgaaccagtgtacttggtcgagatccaggctccagagcaggcactgggtggcatctatggtgtcctcaaccagaagagaggccatgtctttgaggagatgcagaggccaggaactcccctgtacaacatcaaggcatatcttccagttatcgagtcttttggattctcaagcactctgagggcggcaacatcggggcaggcattccctcagtgtgtttttgatcactgggacatgatgtcgtctgacccgttggagccaggttctcaggcagggcagcttgtgagtgatatcagaaagcgcaagggcctcaaggaacagatgacccctctctctgaatttgaagacaagctttaaggtgtcctagtattaagaaaatgtcaggttgctctttgttgttgcatcagttgccttgggacctctctgcaggactttccagcctgcatcccatttttcttgtggttactttagaactttttatctatttaaagtcttgcacttatgttttttagatgcttaacatattgtcacgtttgtgctttttaagacattgtttgcaataaatatttaggttgagttttaa

SEQ ID NO: 2093 - DNA, 2884 bp, Gossypium hirsutum
ttttttgcaatcttcatcccttttctctcgccgcctaactctaaggttttgattgttcagtgtaatttaaagacaagtcaagatggtgaagtttacagctgaggagcttcgtgctatcatggaccggaagcacaacatccgtaatatgtctgttattgcccatgtggatcatgggaaatctactcttactgattcgcttgtggctgctgctggtatcattgcacaagaagttgctggtgatgttcgtatgacagatacccgtgccgatgaggctgagcgtggtatcacaattaagtctactggcatctctctgtattatgaaatgagtgatgattctttgaagagctacaaaggagagaggcaagggaatgagtacctcatcaatcttattgattcccctgggcacgttgacttttcatctgaggtcacagctgcacttcgtattactgatggtgcccttgtggtcgttgactgtattgaaggtgtctgtgtccaaacagagactgtcctccgtcaggctcttggagaaaggatcaggcctgtcttgactgttaacaagatggataggtgcttccttgagcttcaggttgatggagaggaggcttaccagacattccagagagtgatcgaaaatgctaatgtcatcatggccacctatgaagatcctcttcttggtgatgttcaagtctaccctgagaagggaacagttgccttctctgctggtttgcatggttgggcttttaccttgaccaactttgctaaaatgtatgcctcaaagtttggagtcgatgagtccaaaatgatggaaaggctttggggtgagaacttttttgatccagctaccaggaaatggaccaccaagaacactggcactgccacctgcaagcgtggttttgttcaattctgttatgagcccatcaagcagatcatcaacacttgtatgaatgaccagaaagataagctatggcccatgctacaaaagcttggtgtcaccatgaagtctgaagagaaggacttgatgggtaaggccctcatgaagcgtgttatgcagacctggcttcctgcaagcagtgctctcctggaaatgatgatctttcacctaccctctcctagcgtggctcagaaatatcgtgttgagaacttgtatgagggtcctcttgatgatgtctatgccaatgctattaggaactgtgatcctgagggtcctcttatgctttatgtttcaaagatgattcccgcttctgataagggtaggttctttgctttcggtcgtgtcttttctggcagagttgcaactggtttgaaggtcagaatcatgggtccaaactatgtacctggggagaagaaagacttgtatgtaaagagtgtacagagaactgtgatttggatgggaaagaagcaggagacagttgaggacgttccttgtggtaatacagttgccatggttggtttggatcagttcatcaccaagaatgctacattgaccaatgagaaggaagttgatgcccacccaattcgtgccatgaagttttctgtctcccctgttgtccgtgttgctgttcagtgcaaggttgcatcagatcttcccaaacttgttgaagggttgaagcgtttggccaagtctgatcctatggttgtctgtaccattgaagagtctggtgaacacattgttgctggtgctggagagctccaccttgagatctgtctcaaggatttacaagaagatttcatgggtggtgctgagatcgtcaagtcagacccggttgtgtccttccgtgagactgtccttgagaggtcttgcaggactgtgatgagcaagtctcctaacaagcacaaccgtctgtacatggaagctcgacccttggaggaaggtcttgctgaggccattgatgaaggtcgtattggtccaagagatgatcccaaggttcgttccaagattttggccgaggagtatggttgggacaaagatcttgctaagaagatttggtgtttcggccctgagacaactggtcctaacatggtggttgatatgtgtaaaggagttcaataccttaatgaaatcaaggactctgtagttgcggggttccagtgggcatcaaaggaaggtgcgatagctgaagagaacatgaggggtatctgctttgaagtctgtgatgtggttctccatgctgatgctatccacagaggtggtggtcaaatcattccgactgccaggagggttttctatgcttctcaacttacggccaaaccaaggcttctggagcctgtttacttggttgagattcaagcccctgagcaggcacttggtggtatttacagtgttcttaaccagaagcgtggacatgtgtttgaggagatgcagaggcctggtactccactttacaacatcaaggcctaccttccagttattgagtcttttggattctccagcactctgagggctgcaacctccggacaggctttcccacaatgtgtgtttgatcactgggatatgatgtcatcagatccattggaaccgggttcccaggcagcaggccatgttgctgagatccgtaagaggaagggattgaaggagcagatgaccccactttctgagtacgaggacaagctgtaaggttgagaataactcagcttctgccgctatattttctgctgcaatttagttttgtttcggtgtctgtctcttaatgtttttgttagtagttttggggtgccttcacccatacaatcttatcatgcaaggtcatttcagtcttttttagacgcctttttacaatgtacttcgccctccatctgtgttgttaatttttattgtttcgatgaaatgtatttgagtcaacattgatcgtcttaaacctatatttttcttttaccctaaaaaaaa

SEQ ID NO: 2094 - DNA, 2963 bp, Medicago truncatula
caattttctctctctagggtttttctttcctgcggctgtgaagggaaaacctcttcttcctcaacaccccttctcgccgattctctcttcgctctaacaaacttttctttgtggaccttaaagactattcaaaatggtgaagttcacagctgatgagttgcgtcgtattatggactacaagcacaacattcgtaacatgtctgtcattgctcatgtcgatcatggaaaatctactttgacagattcccttgttgctgccgctggtattatagcacaagaggttgctggagatgttcgaatgacagacacccgtgctgatgaagctgagcgtggtatcactatcaagtccactggtatctctctatactatgaaatgactgacgattctctgaagaggtttaagggggagcgtaatggaaatgagtatctcattaatctcattgattcccctgggcacgtcgacttctcttctgaggttactgctgcactccgtattactgatggagcacttgtggtggttgactgtgtcgaaggtgtatgtgtccaaactgaaactgtgctgcgacaagctcttggagaaaggatcaggcctgttcttacagttaataagatggacaggtgcttccttgagctccaggttgatggagaggaggcgtaccagaccttttcaagggttattgagaatgctaatgtgatcatggctacatatgaagatccacttcttggtgatgttcaggtgtatccagagaaaggaacagttgctttctctgctggtttgcatggttgggcttttactctgaccaactttgcaaaaatgtatgcctcaaaatttggtgttgacgagtccaagatgatggagaggctctggggtgaaaatttcttcgatcctgccactaagaaatggaccaccaagaatactggttcagctacttgcaagcgtgggtttgttcagttctgttatgagcctatcaagcaggtcattaacacttgtatgaatgatcagaaggataagttgtggcctatgctgacaaagctaggggtcaccatgaagtctgaggagaaggacctgatgggtaagccattgatgaaacgtgttatgcagacctggttgccagcaagcactgcactacttgaaatgatgatctttcatctcccctctccatcaacagctcagaggtatcgtgttgagaatttgtatgagggtccccttgatgatcaatatgctaatgctatccgaaactgtgatcctgaaggacctctgatgctttatgtgtcaaagatgattccagcatctgataaaggaaggttttttgcttttggccgtgtgtttgccggtaaggtttccacaggtttgaaggtcagaattatgggaccaaatttcgtccctggagagaagaaagatctgtacgtgaaaagtgtccagagaactgttatttggatgggaaagagacaggagactgttgaggatgtgccttgtggtaacactgttgctttggttggtttggatcaatttattacaaagaatgctacattgacaaatgagaaggaagttgatgcccaccctatccgagctatgaagttttccgtctcccctgttgtgcgtgttgctgttcagtgcaaggttgcttcagatcttcccaagcttgttgaaggtctcaaacgtttggctaagtcagatcctatggttgtttgtactattgaggagtctggagaacacattgttgctggtgcaggagaacttcatcttgagatctgtttgaaggatttgcaggatgatttcatgggtggagctgagattatcaaatccgaccctgttgtgtccttcagagagactgttttagagagatcatgccgcacagtgatgagcaaatcacccaacaaacacaacagattgtacatggaagctaggccgttggaggatgggcttgcagaggccattgacgatggcaagattggaccaagggacgaccctaagaatcgttccaaaatcttgtcagaagagtatggttgggataaggatcttgccaagaaaatctggtgttttggacctgagaccactggacccaacatggtggttgatatgtgcaagggagtccaatacttgaatgaaatcaaggattctgtcgttgctggattccagtgggcatcaaaagaaggtgctttgtccgaagaaaacatgagagccatttgctttgaagtatgtgatgttgtcctccacacagatgctatccacagaggaggtggtcagatcattcctactgctaggagagtcttctatgcctcacagctgacagccaaacccagacttcttgagcctgtttacatggtggaaatccaagctcccgagcaagctcttggtggtatctacagtgttcttaatcagaagcgtggacatgtatttgaagaaatgcagaggcctggtactccactttacaacatcaaagcatacctccctgtcattgagtcctttggattctccagccagttgagagctgcaacatcagggcaggcgttccctcaatgtgtgttcgatcactgggatatgatgtcatcagatccattggaggctggatcacaggctgcaacccttgtgaccgatattcgcaagaggaagggcttgaaggagcagatgacacctctctctgagtttgaagataagctttaaatggatgatgatttttttatttattatgattttagatgagttgttattaaagctgtcaccttagttttttaggattggtactttgagttgtttttggctttatcagtgagttgtggtgtacttcggatttgcattcctgctggtcaaatttattactcagattttgttttaatactgtcttttcaatgacgttctgttgctttgcttttataagatggtggtgtggaaaatgatcaaatctaattgggtttgatggataattataacactactattgccaaatagcatccttgttgaa

SEQ ID NO: 2095 - DNA, 2752 bp, Cucumis melo
ttttgaagacttgtcaagatggtgaagtttacagcagaagagctccgtcggattatggactataagcataacattcgtaatatgtctgttattgctcacgtcgatcatgggaagtccactctcacagattctcttgtggctgctgccggtatcattgcacaagaagttgctggtgatgtacgaatgacagatactcgtcaagatgaggcagagcgtggtatcaccattaaatctactggaatctccctctactatgagatgtctgatgaatccttgaaaagttacaagggagagagacagggaaatgagtatcttatcaatcttattgattcacctgggcacgttgacttctcatctgaggttacagctgctttgcgtattactgatggtgcccttgttgtggtggattgcatcgaaggtgtttgtgtccaaacagagactgtgctccggcaggctttgggagagaggattagacctgtcttgactgttaacaagatggataggtgcttccttgaacttcaagtggatggagaagaggcttatcaaacgttccagagggtcattgagaatgccaatgtgattatggccacatatgaggatccacttcttggcgatgttcaagtgtaccccgagaaaggaacagttgctttctctgctggtttgcacggttgggcatttaccctgactaactttgcgaagatgtatgcttccaagtttggagtagatgaggcgaagatgatggagagactttggggtgagaatttctttgatcctgcaaccaagaagtggaccagcaagaacactggctcgccaacatgcaagcgtgggtttgtccagttctgctacgaacctatcaagcagatcattgcaacttgcatgaacgatcagaaggacaagctatggcccatgttgcagaagcttggtgttgtcatgaagtctgatgagaaggatctgatgggcaaaccattgatgaagcgggtcatgcaaacatggctaccagcaagtactgctctcttggaaatgatgatctttcatcttccatcccctgccaaggcccaaaagtatcgtgtggagaatttgtatgagggtccactagatgatgcttacgctagtgccattagaaattgtgatcctgaaggacctcttatgctttatgtatcgaagatgattcctgcatctgacaagggcaggttctttgcctttggacgtgtgttctctgggaaagtttcaactggtttaaaagttagaatcatgggccccaactatgttcctggtgagaaaaaagatttgtatgttaagagcgtccagagaactgtcatttggatgggaaagaagcaagaaacagtggaggatgtgccttgtggtaacactgttgccatggttgggttggatcaatttatcactaagaatgccactttgacgaatgaaaaggaagttgatgctcatccaattcgagccatgaagttttctgtatctcctgtcgtgcgtgtcgccgttcagtgcaaggtagcctctgatcttcccaagcttgtggaaggacttaaacgtctggccaagtcggaccctatggtcgtgtgtaccatggaggaatctggtgagcacattgttgctggtgctggagaactacatcttgagatctgtttgaaggatttacaagaggatttcatgggtggagctgagatcataaaatctgaccctgttgtctctttccgtgaaaccgtacttgagaggtcatgtcgcacagtgatgagcaaatcccctaacaaacacaatcgactgtacatggaagcacgacccatggaggatggactggcagaggctattgatgatggccgcattggaccacgagatgatcctaaagttaggtctaaaattttgtcagaggagtttggttgggacaaagatcttgctaagaagatttggtgctttggtcctgagactactggccctaacatggtggtcgatatgtgtaagggagttcaatacttgaatgaaatcaaggattccgtcgttgctggtttccaatgggcgtcgaaagaaggtgcattggcggaagagaacatgagaggcatctgttttgaagtttgtgatgtggtgcttcacgctgatgccatccacagaggaggtggtcaagtcattcctactgctagaagggtaatctacgcttctcagctgactgccaaaccaagacttcttgagccagtgtacctagtggagattcaggctcccgagcaagctcttggtggtatctacagtgttcttaaccaaaagcgtgggcacgtctttgaggaaatgcaaaggcctggcacacctctttacaacatcaaggcatatctccctgtcatcgaatcatttggattctcgagcactttgagagctgcaacttctggacaggcattcccacagtgtgtgtttgaccattgggaaatgatgtcttcggatccattagaaagtgggtctcaagctgcgcagttggttgctgatatcaggaagaggaaggggttgaaggaacaaatgactccgttgtccgagtttgaggacaagctgtagattgcaatcgcattgttggttaatatatttaagaatcgcccataaatccgcaggtttgaggttctaatttcctatgggaagttttttgttatttgaaaaagattgttgttatgtttgagtattttatttgcaattatttttaagaactgttgttactccatttcttttaaaagatgcgtgatgatgggcaaaattttggagt

SEQ ID NO: 2096 - DNA, 2825 bp, Elaeis guineensis
atggtgaagttcacagttgaagagctccgtaggattatggacatgaagcataacatccgtaacatgtctgtcatagcacatgttgatcatggcaagtctactctcactgattctctggtggcggctgctggaatcattgcccaggaagttgctggagatgtcaggatgactgacacccgtcaggatgaagcagagcgtggtatcacgatcaaatctacagggatctctctttactatgagatgagtgatgagtctctaaaaaactacaagggtgagagaaatggaaatgagtacctcatcaacctgattgattcacctgggcatgtcgacttctcttctgaggtcactgctgctctccgtattactgatggtgcattagtcgttgttgactgtgtggagggtgtgtgtgtccaaactgaaactgttctccggcaagcacttggagaaagaataagacctgtcttgactgttaacaagatggatagatgtttcttggagcttcaggttgaaggtgaggaagcctatcagacttttcttcgtgtcattgagaatgcaaatgttattatggcaacctacgaagatccccttcttggtgatgtccaagtctatccggagaaggggactgtcgctttctctgctgggttgcacggttgggctttcactctgaccaactttgccaagatgtatgctaccaaatttggagtcgatgaggctaagatgatggaaaggctgtggggtgagaattactttgacccaacaaccaagaagtggactagcaagcacacaggttctcctacttgtaagcgtggctttgtacaattttgttacgaaccaatcaaacaaattattagcacttgcatgaatgatcagaaagacaaattatggccgatgctgcagaaactgggtgtgaccatgaaatctgatgagaaggagctagtaggtaaagctttaatgaagcgtgtcatgcagacttggctgcctgcgagcaatgccctccttgaaatgatgatcttccaccttccatctccttccaaggcacagaagtaccgtgtcgagaacttatacgagggcccacttgatgatatatatgcaactgctatcagaaattgtgacccagaaggtcctcttatgctatatgtttcaaagatgattcctgcttctgataagggtaggttctttgcatttggtcgggttttctctggaagggtggctacaggtatgaaggtacggatcatgggaccaaactatgtcccaggtcagaaaaaagacttgtatgtgaagagcgtgcaaaggactgttatctggatgggtaagaaacaggagtctgtagaggatgtgccttgtggaaacacggttgccatggttgggttagatcaatatatcaccaagaatgcaactctgacaaatgagaaggaagtcgatgcccacccaataagagccatgaaattttctgtttctcctgttgtacgtgtagcagttcaatgcaaggttgcatctgaccttcccaagcttgttgaaggtttaaaacgtctggccaaatcagatcctatggtggtctgtgcaatagaagaatctggtgagcacattgttgcaggtgctggagagctccaccttgagatttgcttgaaagatctgcaggaggatttcatgggaggtgcagagattgtggtctctgaccccgtggtctctttcagggaaactgtccttgagaaatcttgccggactgtgatgagcaagtcaccaaacaagcacaatcggctctatatggaagcacgacccatggaagatgggcttgctgaggccattgatgaagggcgtattggcccacgagatgatccaaaagtacgtgcaaagattctgtctgaggagtttggttgggacaaggatcttgctaagaagatctggtgctttgggcctgaaaccactggccctaacatggttgtcgatatgtgcaagggagtacagtaccttaatgaaattaaggactctgttgtggctggtttccagtgggcatcaaaagaaggagcattggctgaagaaaatatgcgtgcaatatgctttgaagtatgtgatgtggttctgcatgctgatgctattcacagaggtggtggtcaggtcattccaacagctagaagggtcatatatgcatcacagttgactgctaaaccaaggcttttggaaccagtttacctggtagagattcaggctcctgagcaggcactcgggggcatctatggtgttcttaaccagaagcgtggccatgtatttgaagagctacaaaggccgggtacccctctttacaacatcaaggcttaccttccggttatcgagtcctttgggttctcaagcactctgagggctgcaacgtcaggtcaggcattccctcagtgcgtgtttgaccactgggacatgatgtcttctgacccattggagcctggtactcaagcagcacaacttgtgagtgacatccgcaagaggaaaggcttgaaggagcagatgaccccattatccgaatatgaagacaagctctaagtcattaccactcagtctgtttgcaggtagttactctagtcggtttctgtcatgtttgcattttcatttctgatatgttatccgaacaattttaatgtctgagtttgccgtgaggatgctttatacatctttactggttggttatttttcaagatactgtgtaaggtgaagtttgcgggttagagaatttatccattgatgtcaattatattaagtctgagttggatcgtggttgaagtaaccatcttatttttgaatagggtgttatccgaacaattttaatgtctgagttt

SEQ ID NO: 2097 - DNA, 2865 bp, Citrullus lanatus
ctcttatccctcctctcccgcactctgtttcgcttcttgtactactcttttgtggaggctcaagggacagtctcttcctttgctctcccttcatcgtctccctgtttcttctttcccttaataatctctaattcttggacatcgggaagtttgaagacttgtcaagatggtgaagtttacagccgaggagcttcgtaggattatggactttaagcataacattcgtaatatgtctgttattgctcacgtcgatcatggaaagtcgacacttacagactctcttgtggctgctgcgggtatcattgcacaagaagttgccggtgatgtacgaatgacagacactcgccaagatgaggcagagcgtggtatcaccattaaatctactggaatctccctctactatgagatgtctgatgaatccttgaaaagttacaagggagagagacagggaaatgaatatcttatcaatcttattgattcacccgggcacgttgacttctcatctgaggttacagctgctttgcgtattaccgatggtgcccttgttgtggtggattgtgtcgaaggtgtttgtgtccaaacagagaccgtgctccgtcaggctttgggagagaggattagacctgtcttgactgttaacaagatggacaggtgcttccttgaactccaagtggatggagaagaggcttatcaaacatttcagagggtgatagagaatgccaatgtgattatggccacatacgaggatccacttcttggggatgttcaagtgtaccccgagaaaggaacagtcgctttctctgctggtctgcacggttgggcgtttaccctgactaactttgcgaagatgtatgcctccaagtttggagtagacgagtcaaagatgatggagagactttggggtgagaacttctttgatcctgcaaccaagaagtggacgagcaagaacactggctctccaacatgcaagcgtgggtttgtccagttctgctacgaacccatcaagcagatcattgcaacttgcatgaacgatcagaaggacaagctatggcccatgttgcagaagcttggagttgtgatgaagtctgaagagaaggatctgatgagtaaagcattgatgaagagggtcatgcaaacatggctcccagcaagcaatgctcttttggaaatgatgatctttcatcttccatcccctgccacggctcaaaagtaccgtgttgagaatttgtacgagggtccactagatgatgcttatgcgagtgccattagaagttgtgatcctgaaggacctcttatgctttatgtatcgaagatgattcctgcatcagacaagggcaggttctttgcctttggacgtgtcttctctgggaaagtttcaactggtttgaaagttagaattatgggaccaaactatgttcccggcgagaagaaagatttgtatgtgaagagtgtccagagaactgtcatttggatgggaaagaagcaagaaacggtggaggatgtgccgtgtggtaacactgttgccatggttggattggatcaattcatcacaaagaatgctactctgacaaacgagaaggaagttgatgcccatccaattcgagccatgaaattttctgtatcgcctgtggtgcgtgtggctgttcagtgcaaggtggcatctgatcttcccaagctcgtggaagggcttaaacgtctggcgaagtcagatcctatggttgtatgtacaatggaggaatctggtgagcacattgttgccggtgctggagaactgcatcttgagatctgtctgaaggatttgcaagatgacttcatgggtggagctgagatcataaaatctgaccctgttgtctctttccgtgaaactgtccttgagaggtcatgccgcacggtgatgagtaaatcccccaacaaacacaatcgtctatacatggaagcacgaccgatggaggaaggactggcagaagctattgacgatggccgcatcggaccacgggatgaccctaaagttaggtctaaaatcttgtcagaggagtttggttgggacaaagatcttgctaagaagatttggtgctttggtcctgagactaccggccctaacatggtggttgatatgtgtaagggagttcaatacctaaatgaaatcaaggattccgttgtcgccggtttccagtgggcgtcgaaagaaggtgcattggctgaagaaaacatgagaggcatctgttttgaagtttgtgatgtggtgcttcacgctgatgccatccacagaggaggtggtcaagtcattccgaccgctaggagggtaatttacgcttctcagctgaccgccaaaccaagacttcttgagcctgtgtacctagtggagattcaggctcctgagcaagctcttggtggtatctacagtgttcttaaccagaagcgtgggcacgtctttgaggaaatgcagaggcccggtacccctctttacaacatcaaggcgtatctccctgtcattgagtctttcgggttctcgagcacattgagagctgcaacttccgggcaggcgttcccacagtgtgttttcgaccattgggacatgatgtcgtcggatccattggaacctggttcccaggctgcacagttagttgcagatatccgcaagaggaagggattgaaggaacaaatgaccccactttccgagttcgaggacaagctgtagatcacttgcgaggttatttattgagaagcaattacaaaatttgcagaggaggttctaattgagttgtctggcttggcttatcgaatgttctttttgcatatttatctagaagacacttattttacttttaattttcctttttgaatgtgagtggagatcgttgtttt

SEQ ID NO: 2098 - DNA, 2920 bp, Sequoia sempervirens
gcaaaaatggtgaagttcacagctgaagaactccgtaggattatggacttgaaacataacatacgaaatatgtctgtcattgctcatgttgaccatgggaagtctacacttactgattcattagtggcggcagctggtatcattgctcaagaagttgccggtgatgttagaatgactgatactcgcgcagatgaagctgagcgcggtatcaccattaagtcaacaggaatctccttgtattatgagatgacggatgagtctcttaagagtttcaagggggagagaatgggaaatgaatatttgataaatctgattgattctccaggacacgttgacttctcttctgaggtcacagcagccctgcgtatcacagatggtgcattagttgtggtagattgcatcgaaggtgtttgtgtacagactgagactgttctacgacaggctcttggagaaaggattaggccagttcttaccgttaacaagatggataggtgttttcttgagttgcaggtcgaaggagaggaagcttatcagacatttctaagagtgattgaaaatgcaaatgtgattatggctacctatgaagatcctcttcttggtgattgccaagtttatccagagaaaggtacagttgctttctcagctggtctgcatggctgggctttcactttgacaaattttgccaaaatgtatgcttcaaagtttaaagtagatgaagtcaagatgatggaaagactgtggggtgagaacttttttgatccagctaccaaaaagtggacatcaaagaacacaggatctcctacttgcaaaagaggttttgttcaatttatatacgaacccattaagcagattataaacatttgtatgaatgatcagaaggataagttatggccaatgttgcagaaattgggagttgttatgaagagtgaggagaaggaattggcagggaaggccctgatgaaacgtgttatgcaaacctggcttcctgcgagcagtgctctacttgagatgatgatattccatcttccatctccatctaaagcacagagatatcgtgtagagaacttgtatgaaggtcctcttgatgatatatatgcaactgcaattagaaattgtgaccctgaaggaccattaatgttgtacgtttcaaagatgattcctgcctctgacaaggggcgattctttgcttttggcgggtttttgcagggaaggtatctacaggagtgaaggttaggatcatgggtcccaactatgtgcctggtcagaagaaggacttgtatgtaaaaagtgtccagaggactgtcatttggatgggtaaaaaacaagaatcagttgaggatgtgccctgtggaaatacagtggctttggttgggttagatcagttcatcactaagaatgctactctgactaatgagaaggaggttgacgcccatccaattagagcaatgaagttctctgtctcgcctgttgtacgtgttgcagtgcagtgcaaggtagcctctgaccttccaaagcttgttgaagggttgaagcgtcttgctaagtcagatcctatggttatgtgcacaattgaggaatccggtgaacatattattgctggagcaggagaacttcaccttgagatttgcttaaaggatttgcaagacgattttatgggtggagctgagattgttgtctctgatcctgttgtctcatttagagaaactgtattagagaagtcagtccgtactgtaatgagtaagtctccaaataaacacaacaggctttattttgaagcaaggcctctcgaagaaggtcttgcagaagcaattgacgaaggtcgcattggccccagagatgatcctaaggctcgtgccaaaatcctctccgaggagtttggatgggacaaagatctggctaagaagatttggtgttttgggcctgaaaccactggtcccaacatggttgtagatatgtgtaagggagttcagtacttgaatgaaattaaggattcggttgttgcagcatttcaatgggcatccaaggaaggtgcccttgcagaggagaacatgcgtggcatttgctttgaggtttgtgatgttgttttacatactgatgccattcatagaggaggtggccagattattccaacagccagaagggttatgtatgcagctcagcttactgccaaaccaaggcttctggagcctgtatatcttgtagaaattcaggctcctgaacaggcacttggaggtatttacggtgtgctgaatcagaagaggggccatgtgtttgaggaaatgcagaggccaggaactccactctataacattaaggcatatttgccagttgttgagtcatttgggttctctggtactctccgagcagcaacttctggtcaggctttccctcaatgtgtgtttgatcactgggatatgatgggctccgatccactggagcatggaactcaagctgaaaagcttgttcttgatattcgcaagagaaagggtctgaaggagcaaatgactcccttgtcagagtttgaggataagctgtaaagcttatgttggttaaggttcaagcattttatgattcttatttttgccatccattagttgtcttcggtattcttagacatgttagttgtgtcctcgatccatttttattctcatttctaggttatttgcagagttatgtatttgaggtcttgagagatccaaattccatttaagttgtttttggttcaatcatagtccatagagttatgattgtgatacttttaatcacctttaccgccttataattttagactgaagaagatacattttattcttcaagatctatgcttatcattgcaactttgaaattaacatatagagtccagccaactatcttccaatgagatgttagaaatgattacaaaattacatatcaaaattaa

SEQ ID NO: 2099 - DNA, 2965 bp, Coffea canephora
ttctatctctgcggctgcagctcgtaaggtcactgtgtgccttacctcctcctctaacatcgccgcctccttctctccatctttttttccttttctcggttctgtgaattatttttatccaatcctcttttgcggttaatatctgaaagcctatcaagatggtgaagttcacagcagaagagcttcgaaggattatggactacaagcacaatatccgtaatatgtctgttattgcacatgttgatcatgggaagtccactcttactgattctctcgtggctgctgctggtatcattgctcaagaagttgctggagatgttcgaatgacggatacaagagcagatgaagctgagcgtggtattacaatcaagtccactggtatctcactttattatgagatgactgatgaagctttaaaggcctacaaaggggagcggcagggaaatgagtatcttattaatcttattgattcccctgggcatgttgatttctcatctgaggtgactgctgcccttcgtattactgatggtgcattggtggtggttgattgtatcgagggtgtgtgtgtccaaacagaaactgtccttcgacaggctctgggagaaaggattcggcctgtcttaactgtcaacaaaatggacaggtgtttccttgagctccaggttgagggggaggaggcttaccaaacatttcagaaggttattgagaatgccaacgttatcatggccacatatgaagatcctctccttggtgatgtccaggtttacccagagaaaggtaccgttgctttctctgctggtttacatggctgggctttcacccttagtaacttcgccaaaatgtatgcctccaagtttggtgttgatgagtctaagatgatggaaagactgtggggtgagaatttttttgaccctgctaccaagaaatggaccagcaagaacactggctcacctacatgcaagcgtggttttgttcagttctgttatgagcccatcaagcagatcatcagcacttgcatgaatgatcagaaggacaagctgtggccaatgttgtcaaagcttggagtaacgatgaagtctgatgaaaaagagttgatgggaaaggcactcatgaagcgtgtcatgcagacatggcttccagcaagtagtgccctacttgaaatgatgatctaccatcttccatctcctgccaaggctcagaagtaccgtgttgaaaacttgtacgagggtccgcttgatgatcaatatgctaatgccgtcaggaactgtgatcccgagggacctcttatggtctatgtatccaagatgattccagcatctgacaaaggtagattctttgcttttggccgtgtgttttctggaaaaattgccactggcatgaaggttagaatcatgggtcccaactatgttcctggagagaaaaaggacttgtatgttaagaatgtccaaagaacagttatttggatgggtaagaggcaggaaacagttgaggatgtgccatgtggtaacacagttgctatggttggtttggatcaattcatcaccaagaatgcaaccttgaccaatgaaaaggaagttgatgctcatccaattagagcaatgaagttctctgtctcccctgttgtgcgtgttgctgtgcagtgcaaggttgcatctgacctccccaagcttgttgaaggtttgaaacgtctggcaaagtctgaccctatggttgtctgtacgattgaggaatctggagagcacatcattgctggtgctggagaactgcaccttgaaatttgcttaaaggatttgcaagacgattttatgggcggtgctgagattattaagtctgatccagtggtgtctttccgtgagacagttctcgagaagtcttgtcgcactgtgatgagcaaatctcctaacaagcacaaccgtctctatatggaagctaggcccctggaagaggggctcgctgaggccattgatgatggtcgtattggtccaagggatgatccaaagaatcgttctaagatcttgtcagaggagtttggatgggacaaggatcttgcaaagaaaatctggtgttttggtcctgagactactggacccaacatggtggttgatatgtgcaagggagttcagtacctgaatgaaattaaggattctgttgttgctggtttccagtgggcttcaaaagaaggtgcattggctgaagaaaacatgagaggtatctgctttgaggtttgtgacgtcgtcctgcatgctgatgccatccacagaggtggtggccaggttattcctactgctaggagggttatctatgctgcccaacttactgctaagccccgactattggaacccgtgtaccttgtggagatccaagcacccgaacaagctctcggtggcatctacagtgttctgaaccagaagcgtggacacgtctttgaggagatgcagaggccaggcacacccctttacaatatcaaggcctatcttcctgtcgtcgagtcatttggtttctcaggtacattgagagctgctacatcaggacaggcattcccccagtgtgtctttgatcactgggatatgatgtcctcggatccattagaatctggatcgcaagctgctcagcttgttactgacatcagaaagaggaagggtttgaaagatcagatcacaccactttcagagttcgaggacaagctgtaaacctgctgaaatcagctactatatcattgataagcgcatgaaagctgggcggagtataattttgtctttcatcgtttttgaacttttttttaacattttaggtgttgagtgagttgtagccctttttcttgccgtggagtcacactcttgttagatgtgtcatgggaagacgcaaatgtcgtgttgttctatgttttgatttcagtttccatgagaactaccagattggttggaacttcaatttatttcccgtcttccccttattttatacaact

SEQ ID NO: 2100 - DNA, 2981 bp, Gossypium raimondii
actctcacgtatttcgtcgccatcgcatcgaatataagtagcgaatatcctcctttttgtgcccttcatttccacagagagagaaagagcgttccaacaatcttcgtctctttctcttgcttgccgtttttctctcttaggttttgattcttctttatagttcgaggtgttttaaagacaagtcaagatggtgaagtttacagctgaggagcttcgtgccattatggacaggaagcacaacatccgtaatatgtctgttattgctcatgtggaccacgggaaatcaactcttaccgattctcttgtggctgctgctggaattattgcacaagaagttgctggtgatgttcgtatgacagatacccgtgctgatgaggctgagcgtggtatcacaatcaagtctactggtatctctctttattatgaaatgtctgatgactctttgaagagctacaaaggagagagacaagggaatgagtacctcatcaatcttatcgattcccctgggcacgttgacttttcatccgaggtcacagctgctctacgtattactgatggtgcccttgtggttgttgactgtattgaaggtgtctgtgtgcaaacagagactgttctccgtcaggctcttggagaaagaatcaggcctgtcttgactgttaacaagatggataggtgcttccttgagctccaggttgatggagaggaggcttaccagacattccagagagtgattgaaaatgctaatgtcatcatggccacctatgaagatcctcttcttggtgatgttcaagtctacccagagaagggaacagttgctttctctgctggtttgcatggttgggcttttaccttgaccaactttgctaaaatgtacgcctctaaatttggagttgatgaggcaaagatgatggaaagactttggggtgagaacttttttgatccagctaccaagaagtggaccaccaagaacactggctctggtacctgcaagcgtggatttgttcagttctgttatgaacccatcaagcagataatcaacacttgtatgaatgaccagaaggataagctctggcccatgctgcaaaagcttggtgtcaccatgaagtctgatgagaaggacttgatggggaagtccctaatgaaacgtgtaatgcagacgtggcttcctgctagcagtgctctcctggaaatgatgatcttccaccttccctctcctagcaaggctcagaaatatcgtgttgagaacttgtatgagggtcctcttgatgatgtctatgccaatgctatcaggaactgtgatcctgagggtcctcttatgctctatgtttcaaagatgattcctgcttctgataagggtaggttctatgcttttggtcgtgtcttctctggcaaagtttcaactggcctgaaggtcaggatcatgggtccaaactatgtccctggtgagaagaaagatttgtatgtcaagagcgtacagagaactgttatttggatgggaaagaagcaggaaactgttgaggatgttccttgtggtaacacagtggccatggttggtctggatcagtttatcaccaagaatgctactttgactaatgagaaggaagttgatgcgcacccaattcgtgcaatgaagttctctgtctctcctgttgttcgtgttgctgttcagtgcaaggttgcatctgatcttcccaaacttgttgaagggctgaagcgtttggccaagtctgatcctatggttgtttgtacaattgaagagtcgggagagcacattgttgctggtgctggagagctccaccttgagatctgtcttaaggatttgcaagaagattttatgggtggtgctgagatcgtcaagtcagacccagttgtctcattccgtgaaactgtcctagagaggtcttgcaggactgtgatgagcaagtctcccaacaagcacaaccgattatacatggaagctcgacccttggaggaaggtctggctgaagccattgatgaaggtcgtattggtccaagagatgatcccaaggttcgttcaaaaattttggctgaggagtatggatgggacaaagatcttgctaagaagatatggtgttttggccctgagaccacaggtcctaacatggtggttgatatgtgtaaaggagttcagtacctgaacgaaattaaggattcagtagtcgctgggttccaatgggcatcaaaggaaggtgcaatggccgaagagaacatgaggggtatatgctttgaagtttgtgatgtggttcttcatactgatgctatccatagaggtgggggtcagatcattccaactgctaggagggttttctatgcttctcagctgactgccaagccgaggctgcttgagccagtgtacttggtggagatccaagccccagagcaagcacttggtggtatttacagtgttcttaaccagaagcgaggacatgtgtttgaggagatgcagaggcctggtactccactatacaacatcaaagcatatcttcctgttatcgagtcatttggattctcgagcaccctgagggctgcaacatcaggacaggctttcccacaatgcgtgtttgaccactgggatatgatgtcatcagatccattggaacctggttcccaggcagccaaccatgttgctgagatccgtaagaggaagggattgaaggagcagatgaccccgctctccgattacgaggacaagctgtaagctaagcaacaaaataataattaattgaagaggttacgttacccattttatgcaatgctgctagttagttccttctatattttgttttctggtggactttttagatggtttttacaatggacacgattgttatgtttttttgtattcaaatagacaattggctttgttaatgtttttgacctccataatcttcattgcttctattatatctttatttatattttccttaaattacttgtaatattttggccttcaatttctt

SEQ ID NO: 2101 - DNA, 2820 bp, Capsicum annuum
ggtctcacaatactcgccgcctactcctctatactccgttaataagtaattcttagttacgccaacaagcattcaagatggtgaagttcacagctgaagagcttagaaagattatggacttcaagcataacattcgtaatatgtctgttattgctcatgtggaccatggaaaatctacccttaccgattctctggtggcggctgctggtatcattgctcaggaagttgcaggtgatgtcagaatgacagatacacgtgcagatgaggctgagcgtggcatcaccatcaagtccactggtatttcactttactatgagatgagtgatgactccttgaagaatttcaagggagagagaaatgggaatgagtacctcatcaacctcatcgattcacctgggcacgttgacttctcatctgaagtgactgctgctcttcgtattactgatggtgcgcttgttgtggttgattgtgtggaaggtgtctgtgtccagacagagactgtgctccgtcaagcccttggtgaaaggattcgtcctgtcttgacagttaacaagatggacaggtgtttccttgagcttcaggttgatggagaggaggcctatcagacgttccaaagagttattgagaacgctaatgttatcatggctacatatgaggatccccttcttggtgatgtccaagtttatcctgagaaaggtaccgttgctttctctgctggattgcatggttgggctttcactctcaccaattttgccaagatgtacgcttccaaatttggtgttgatgagtctaagatgatggaaagactctggggcgagaacttttttgaccctgccaccaaaaagtggaccaccaaaaacactggaacagcttcatgcaagcgtgggtttgttcagttctgctatgagcccatcaagcagattattaacacttgcatgaatgatcagaaagataagctctggccaatgttgcagaagcttggtgttaccatgaaatctgatgaaaaagatttgatgggcaaggcactgatgaagcgtgtgatgcagacctggcttcccgcaagtactgctcttctggaaatgatgatataccatcttccatctccttccacagctcaaaaataccgtgtggaaaacctgtacgagggaccccttgatgatgcttatgccaatgccatcagaaactgtgaccctgaagggccacttatgctttatgtatccaagatgattccagcatctgacaagggtcgattctttgcctttggtcgtgtatttgccgggaaggttagtactggtatgaaggttagaatcatgggtcccaactatgttcctggtgaaaagaaggatttatatgttaagaatatccagagaactgttatttggatgggtaagaggcaagaaactgttgaggatgtaccctgtggtaacactgttgccatggtcggtttagatcaatttattaccaagaacgcaacattgactaatgaaaaggaagttgatgcccacccaattagagcaatgaagttttctgtatcaccagtcgtgcgtgtagctgttcagtgcaaggttgcatctgaccttcccaagcttgttgaagggttgaagcgtttggctaagtctgatcctatggtggtttgttctattgaagagtctggagagcatatcattgctggtgctggagaactccaccttgagatctgcctgaaggacttgcaggatgacttcatgggtggtgctgaaattataaaatctgatcctgttgtgtccttccgtgagactgttctcgagaagtcttgtcggacagtgatgagcaagtctcctaacaagcacaaccgtttgtacatggaagctagaccaatggaagaaggccttgcagaggctattgacgaggggcgcattggcccaagggatgatcctaaagttcgatccaagatcttggcggaggagtttggttgggacaaagatcttgcaaagaaaatttggtgctttgggccagagacaactggcccaaacatggtggtggatatgtgtaagggagttcagtacctgaatgaaattaaggattctgttgttgctggtttccagtgggcttcgaaggaaggtgctctggctgaagagaacatgagaggtatttgttttgaagtctgtgatgttgtgcttcatgctgatgctattcacaggggtggtggccaagttattcccactgcgagaagggttatctatgcttctcagcttactgccaaaccccgcctgttggaacccgtttaccttgtggagattcaggctccagagcaagctcttggtggcatctatagtgttctgaaccagaagcgtggacatgtgttcgaggagatgcagaggccaggaacccctctttacaacatcaaggcttaccttcctgtcgttgagtcatttggattttcaggtaccttgagagctgctacttcaggtcaagctttcccacaatgcgtgttcgatcattgggacatgatgtcatccgacccactggaagctggtacacaagctcatcaactcgtccttgatatccgcaagaggaagggtttgaaggagcagatgacccctctatcagagttcgaggacaagctgtaagcttgtggaagtttcaacttggcagaggtttttgatggatacttgcttaattggatctgcattagttttgttttacattatgtgtttgggccgtactttttatactttttaccattttccaggtagaagtttgaaccttaagtgagatattgcttttgtcagttacaaagatgagaatcttgctgttgtgttgtttttgaaagtgttttag

SEQ ID NO: 2102 - DNA, 2858 bp, Lippia dulcis
cctccaagttcggcttgcttctctctgtcgtctgattgaaggcaggccttcaacaaactcaacttagcttgtgaaatttagggactgtaaagatggtgaagttcacagcagatgagctccgcaggattatggattacaagcacaacatccgtaatatgtctgtcattgcccatgtcgatcatggaaaatccactcttacggattcacttgttgctgctgccggtattatcgcccaagaagttgctggtgatgttagaatgaccgatacccgtgccgatgaagctgaacgtggtatcactatcaagtccaccggtatctctctgtattatgaaatgtctgatgaatcgttgaagagctacaagggagagaggaatggaaatgagtacctcatcaatcttattgattctcccgggcacgtcgacttctcttctgaagtgactgctgctcttcgtattactgatggtgcccttgtcgtggtggattgtattgaaggagtgtgtgtccaaacagaaactgtcctccgacaggcccttggtgagaggattcgccctgtcttgacagttaacaagatggacaggtgtttccttgagctccaggttgatggagaggaggcctaccagacattccagagggtcattgaaaatgctaatgtcattatggccacatatgaagatcctcttcttggtgatgtccaggtttaccctgagaaaggtacagttgctttctctgctggtctgcacggctgggcgtttactctgaccaactttgccaagatgtacgcctccaagttcggtgttgatgagtcgaagatgatggaaaggctgtggggagaaaatttctttgaccccgcgaccaagaagtggactagcaagaatactggcagtgctacatgcaaacgtggttttgttcaattctgctatgagcccatcaagcagattatcaacacttgtatgaatgatcagaaagacaagttgtggcccatgttacagaagctcggcgtcacgatgaagtctgatgaaaaggaactgatggggaaggcactgatgaaacgtgtgatgcagacctggcttcctgccagcactgctctattggaaatgatgatctttcatcttccatcaccatcaagggcccaaaagtaccgtgtggagaacttgtatgagggtcctcttgatgatgcttatgccaatgctatcaggaactgtgatcctgagggtcctctcatgctctacgtctctaagatgattcctgccccggacaagggtcgtttctttgcttttggtcgggttttctctggcaaggtctccactggtttgaaggtcagaatcatgggacctaactatgtccctggagagaagaaggacttgtatgttaagagtgtccagagaactgttatttggatgggcaagaggcaagaaactgttgaggatgtaccatgtggtaacactgttgctatggttggtcttgatcagttcatcaccaaaaatgctaccctcacaaatgagaaggaagttgatgcccatccaattcgtgccatgaagttctctgtctcccctgtcgtgcgtgttgctgtccagtgcaaggttgcatctgatctcccaaagcttgttgaagggctgaagcgtctggccaagtctgatcctatggttgtctgttccattgaggaatctggtgaacacattgttgccggtgctggagaactccatctcgaaatttgcctgaaagatttgcaggacgatttcatgggtggtgctgaaatcatcaaatctgaccctgttgtgtccttccgtgagaccgttcttgagaggtcgtgccgtactgttatgagcaaatcaccaaacaagcacaaccgtctctacatggaagccagaccaatggaagagggacttgctgaggccatcgatgatggacgtatcggaccacgtgatgacccaaaggtccgatccaagatcttgtctgaagagttcggttgggacaaggagctggcgaaaaagatctgggccttcggtcctgaaacaacgggtcccaacatggtggtcgacatgtgtaagggagtccagtaccttaatgaaatcaaggattctgtcgttgccggtttccagtgggcttccaaggaggggccattggctgaggaaaacatgagaggcatctgctttgaggtgtgtgacgttgttctccatgctgatgctatccacagaggtggtggccaagttattccaacagccagaagggttatttatgcttcccaaatcactgccaagccccgtctcttggagcccgtctaccttgtcgagattcaagcacccgaacaagctcttggaggtatttacagtgttctgaaccagaaacgtggacatgtgtttgaggaaatgcagaggcccggaaccccgctttacaacatcaaggcttacttgcctgttatcgagtctttcggtttctcgagtactttgagagcttcaacgtcgggtcaggctttccctcaatgtgtgtttgaccattgggacatgatgtcatccgacccattagaagctggatctcaggctgctacgcttgttgctgatattaggaagaggaagggtttgaaggagcagatgacaccgctctccgacttcgaggacaggctctgaggatgggttatgaatttgctgttactgggtggaaatttttgtttctggttttttcgcgttcagttcggacatttttattactgctttaatgttatagtgctggtctgttgttgtaagagttcgagttaatttaagttgtgttgtttacccacccagatacttttaagagtctttgttcaagtgttcaaaagacggtaatttgtgctatttatatggttttatttatgtatttgc

SEQ ID NO: 2103 - DNA, 2828 bp, Plantago ovata
caatcgctctcttcttatcttgagatttggtgtaggacatactttttgttaattgagttgccgataatttttagatctaatcaaaatggtgaagttcacggcagatgagctccgtaggattatggacatgaagcataacatccgtaatatgtccgttattgcccatgttgatcatggaaaatccactcttacggattctcttgttgctgctgctggtattattgctcaagaagttgcaggtgatgttagaatgaccgacacacgtgctgatgaagcagaacgtggtatcactatcaaatccaccggcatttctctctattaccaaatgagtgatgagtctttgaagaactttcatggtgaaagggtaggcaacgagtacctgatcaatcttattgattctcctggccacgtcgatttctcttctgaggtcactgctgctctccgtatcactgatggtgctcttgtggtggtggattgcattgaaggggtgtgtgtccaaactgaaactgtcctccgacaagcacttggtgaaaggattcgtcctgtcttgacagtaaacaagatggacaggtgtttccttgagctccaggttgaaggagaggaggcataccagacattctgtagggtcatagaaaatgcaaacgttattatggccacttacgaggacccgctccttggtgattgtcaggtctatccagagaaaggtactgttgccttctctgctggtcttcatgggtgggcattcaccttaacaaacttcgctaagatgtatgcttccaagtttggtgttgacgagagcaagatgatggaaaggctttggggagagaatttcttcgatcccaaaaccaagaagtggactaccaagaataccggctctcccacatgcaaacgtgggttcgtgcagttctgttatgagccaatcaagcagattattgccacttgcatgaatgatcagaaagacaagttgtggcccatgttgcagaagcttggtgtcacaatgaagtcagatgagaaagacttgatggcgaaacctctgatgaagcgtgtgatgcaaacttggctgcctgctagcacagccctactggaaatgatgatcgagcaccttccatcaccggccaaggctcagaggtatcgtgtggagaatttgtatgaaggacctctagatgatcaatatgctaatgctataaggaactgtgatcctgacggtcctctcatgctttatgtgtctaagatgattccagcctcagacaagggtaggttctttgcctttggtcgtgtattcgctggtaaggtctcaactgggttaaaggtcagaattatgggtcctaattatgtgcctggggagaagaaggacttgtatacgaagagtgttcaaagaactgttatttggatggggaagaagcaagagactgttgaagatgttccttgtggtaatacagtcgccatggtgggtcttgatcagtacataacaaagaatgccactctgaccaatgagaaggaagtagatgcccacccaattcgagcgatgaagttctctgtctcacccgtcgtgcgtgtcgctgtccagtgtaagactgcatctgacctacccaagcttgttgaaggtctaaagcgtttggccaaatctgatcctatggttctctgtactatggaggaatctggtgagcatattgttgctggtgctggagaacttcatcttgagatatgcttgaaagacttgcaggatgatttcatgggtggtgcagaaattattgtatctgatcctgtggtgtctttcagggagactgtccttgagaggtcttgccgaactgttatgagcaagtcacctaacaagcataaccgtttgtacatggaagctagacccctggaagatggtcttgcggaggctattgatgatggtcgcattggtccacgtgatgatcctaagattcgatctaagatcttgtccgaagaatttggctgggacaaggagctggcaaagaaaatttgggcttttgggcctgaaaccactggaccaaacatggtggttgatatgtgtaagggggtgcagtacttgaatgaaatcaaagattctgtagttgcaggtttccagtgggcttccaaagaagggtcattagctgaagagaacatgagaggcatttgctttgaggtgtgtgatgttgttcttcacactgatgcgattcacagaggtggtggccaagtaattccaactgctaggagggttatctacgcctcacagatcactgccaagccccgtcttttggagccagtatacatggtggagattcaagctccagagcaagcacttggaggtatttacagtgttctgaatcagaagcgtggacacgtgtttgaagagttgcagaggccaggaactcctctctataacatcaaggcatatctacctgttgtcgagtcttttggtttttcaagtgctttaagagctgctacttctggtcaagcgtttccccaatctgtgttcgatcattgggacatgatggcctctgatccattggaaccaggaactcaagcagctaatcttgtggctgatattcgtaagaggaagggtttgaaggaacagatgactccactctcagacttcgaggacaagctgtgagtagccagattctgttttaagagtttgtgctctaatctcagttgccaattctggcaaggtagtatttcttatgtgttttgaacaatcagtttcttttggtaatggttttttaagttcagttgtcaggcgccagcccagattatgatgtgttatgtatgtaatacagttttctgtttgggactggttcttttgcattactgttgcttccgtt

SEQ ID NO: 2104 - DNA, 2936 bp, Populus trichocarpa
atttacaaccgcatattcccccaatcgcaactatccctctgttctctccttatattgatgcgtctctctttcagcttcaaacactgctcgctcataaaaagagagatcctctggtagtctctctatctttctctttccctcacttctcttgcagctttgtgctcactctctcattttccatcttcaggtgttttcttttgtttttgattataatttggtgaaattttaaagactagccaaaatggttaagtttacggcagaagagcttcggcgtattatggacttcaagcataacatccgtaatatgtctgttattgctcatgttgaccatggaaaatcaactctcactgattctcttgttgctgctgctggtatcattgcccaagaggttgctggtgatgttcgaatgactgatacccgggcagatgaggcagaacgtggtatcacaatcaaatctactggcatctctctatactatgagatgtcagatgaatccctcaagagatacaagggagagaggcatggaaatgagtatcttatcaatcttatagactctccaggacacgttgacttttcatctgaggtcacagctgctcttcgtatcactgatggcgctctggtcgttgtggactgtattgagggtgtgtgtgtccagactgaaactgtgcttcgacaggctttgggtgagaggatcaggcctgtcctgacagttaacaagatggacaggtgtttcctggagctccaggttgatggagaggaggcgtttcagacattttctagggttattgagaatgccaatgtcatcatggcaacctatgaagatcccctccttggtgactgtcaagtctaccctgagaagggtaccgttgctttctctgctggtttgcacggctgggctttcactttgaccaactttgcccagatgtatgcctcgaagtttggagtggatgagtctaagatgatggagaggctgtggggcgagaacttttttgatcctgctaccaagaagtggaccaccaagaacactggttctgctacttgcaagcgtggttttgtgcagttttgttatgagccaatcaaacagattattaaaacgtgcatgaatgatcagaaggataaattgtggcccatgttgcaaaagcttggtgttgtcatgaagtctgatgagaaggacttgatgggaaagcctctgatgaagcgtgtgatgcagacctggctgccagcaagcactgctctgcttgaaatgatgatctttcacctgccctctcctgcaacggctcagagataccgtgtggagaacttgtatgagggtccccttgatgatgcttatgccaatgctatcaggaattgtgaccctaatggccccctcatgctctacgtgtctaagatgattcctgcttctgacaagggtaggttctttgcctttggacgtgttttcgctggaaaggtaacaactggtctgaaggttaggatcatgggaccaaactatgtgcctggtgagaagaaggacttgtatgtgaagagtgtgcagaggactgttatttggatggggaagaggcaagaaaccgttgaggatgtgccttgtggtaacactgttgccttggttggattggatcagttcatcactaagaatgccactttaactaatgaaaaggaagttgatgcccaccctattcgtgctatgaagttctctgtctcgcctgttgtgcgtgtggccgttcagtgcaaggtagcatctgacctccccaagctggtggaaggtctgaagcgtttggccaagtctgatcccatggttgtctgtagcattgaggaatctggagagcatatcattgctggagctggagagctgcaccttgagatctgtttgaaggatttgcaggatgattttatgggtggggcagaaatcatcaagtctgaccctgttgtgtcgttccgtgagactgtcatagataagtcctgccgtgtggtgatgagcaaatctcctaacaagcacaaccgtctctacatggaggcacgacccatggaagaagggcttgcagaggctattgatgatggtcgtattggtccaagagatgatccaaagattcgtggcaagatcttgtccgaggagtttggttgggacaaggatcttgcaaagaaaatctggtgctttggtcctgagaccaccgggccaaacatggttgtggatatgtgtaagggagttcagtaccttaatgaaatcaaggattctgttgttgctggtttccagtgggcttcaaaggaaggtgccttggctgaagaaaacatgcgaggtatctgctttgaagtctgtgatgtggttcttcattccgatgccattcacagaggtggtgggcaggtcattcctactgccaggagggttatctatgcctcccagctgactgccaagcccaggctccttgagcccgtgtacatggtggagatccaagcccccgagcaggctcttggtggcatctacagtgttcttaaccagaaacgtggtcatgtgtttgaagaaattcagaggcccggtacccccctgtacaatatcaaggcgtacctccctgttgtcgagtcttttggattttccggcactttgagggctgcaacatcaggacaggctttcccacaatgtgtttttgatcactgggacacgatgtcttctgatccaatggaagccggtacacaagcagcacagcttgttacagaaatcaggaagcgaaagggtttgaaggagcagatgaccccattatctgatttcgaggacaagctgtgagcatttcagtttcgtgctcaagaaactttgacgagcacagtttggttcttttttgctgtactaattttgtgatgtttttaaattttgttacggggcagtggcgtagttgcctggccttttggaacaattagtatttattttctttaaactcatttttattttc

SEQ ID NO: 2105 - DNA, 3152 bp, Populus trichocarpa
atttacaaccgcatattcccccaatcgcaactatccctctgttctctccttatattgatgcgtctctctttcagcttcaaacactgctcgctcataaagagagagatcctctggtagtctctctatctttctctttccctcacttctcttgcagctagctcactctctcatttttcatcttcaggtgttgtcttttgtttttgattataatttggtgaaattttaaagactagccaaaatggttaagtttacggcagaagagcttcggcgtattatggacttcaagcataacatccgtaatatgtctgttattgctcatgttgaccatggaaaatcaactctcactgattctcttgttgctgctgctggtatcattgcccaagaggttgctggtgatgttcgaatgactgatacccgggcagatgaggcagaacgtggtatcacaatcaaatctactggcatctctctatactatgagatgtcagatgaatccctcaagagatacaagggagagaggcaaggaaatgaatatcttatcaatcttatagactctcccggacacgttgacttttcatctgaggtcacagctgctcttcgtatcactgatggcgctctggtcgttgtggactgtattgagggtgtgtgtgtccagactgaaactgtgcttcgacaggctttgggtgagaggatcaggcctgtcctgacagttaacaagatggacaggtgtttcctggagctccaggttgatggagaggaggcgtttcagacattttctagggttattgagaatgccaatgtcatcatggcaacctatgaagatcccctccttggtgactgtcaagtctaccctgagaagggtaccgttgctttctctgctggtttgcacggctgggctttcactttgaccaactttgccaagatgtatgcctcgaagtttggagtggatgagtctaagatgatggagaggctgtggggcgagaacttttttgatcctgctaccaagaagtggaccaccaagaacactggttctgctacttgcaagcgtggttttgtgcagttttgttatgagccaatcaaacagattattaacacgtgcatgaatgatcagaaggataaattgtggcccatgttgcaaaagcttggtgttgtcatgaagtctgatgagaaggacttgatgggaaagcctctgatgaagcgtgtgatgcagacctggctgccagcaagcactgctctgcttgaaatgatgatctttcacctgccttctcctgcaacggctcagagataccgtgtggagaacttgtatgagggtccccttgatgatgcttatgccaatgctatcaggaattgtgaccctaatggccccctcatgctttacgtgtctaagatgattcctgcttctgacaagggtaggttctttgcctttgggcgtgttttcgctggaaaggtaacaactggtctgaaggttaggatcatgggaccaaactatgtgcctggtgagaagaaggacttgtatgtgaagagtgtgcagaggactgtcatttggatggggaagaggcaagaaaccgttgaggatgtgccttgtggtaacactgttgccttggttggattggatcagttcatcactaagaatgccactttaactaatgaaaaggaagtcgatgcccaccctattcgtgctatgaagttctctgtctcgcctgttgtgcgtgtcgccgttcagtgcaaggtagcatctgacctccccaagctggtggaaggtctgaagcgtttggccaagtctgatcccatggttgtctgtagcattgaggaatctggagagcatatcattgctggagctggagagctgcaccttgagatctgtttgaaggatttgcaggatgattttatgggtggggcagaaatcatcaagtctgaccctgttgtgtcgttccgtgagactgtcatagagaagtccagccgtgtggtgatgagcaaatctcctaacaagcacaaccgtctctacatggaggcacgacccatggaagaagggcttgcagaggccattgatgatggtcgtattggtcccagagatgatccaaagattcgtggcaagatcttgtccgaggagtttggttgggacaaggatcttgcaaagaaaatctggtgctttggtcctgagaccaccgggccaaacatggttgtggatatgtgtaagggagttcagtaccttaatgaaatcaaggattctgttgttgctggtttccagtgggcttcaaaggaaggtgccttggctgaagaaaacatgcgaggtatctgctttgaagtctgtgatgtggttcttcattccgatgccattcacagaggtggtgggcaggtcattcctactgccaggagggttatctatgcctcccagctgactgccaagcccaggcttcttgagcccgtgtacatggtggagatccaagcccccgagcaggctcttggtggcatctacagtgttcttaaccagaaacgtggtcatgtgtttgaagaattgcagaggcccggtacccccctgtacaatatcaaggcgtacctccctgttgtcgagtcttttggattttccggcactttgagggctgcaacatcaggacaggctttcccacaatgtgtttttgatcattgggacacgatgtcttctgatccaatggaagccggtacacaagcagcacagcttgttacagaaatcaggaagcgaaagggtttgaaggagcagatgaccccattatctgagttcgaggacaagctgtgagcatttcagtttcgtgctcaagaaactttgacgagcacagtttggttcttttttgctgtgctaattttgtgatgtttttaaattttgttacggggcagtggcctagttgcctggccttctggaacgattagtatttattttctttaaacacatttttattttctcctgtaagaactctatgaatgttctgattgtttcttttcgtgtttatgaatgcaagctcaaattagattacaaaaaagcaaaaaagccctttttggtgtgcggagggcgtcataagtggtttctcttccttgacccattttgtgcttcgttgcaaaacaagtgtaggttgttgctaatctgctttctagatgcaataaattaaaaaattgaactagaa

SEQ ID NO: 2106 - DNA, 2932 bp, Prunus persica
ataaaggagaagtctgagattccacctccattttctttcgcctgccgcctcgcttgctgcttgtcacctgatactaattatatttttggaggtgacatttgaagactagtcaagatggtgaagttcacagctgaggagctccgtaggattatggactacaaacacaacattcgtaacatgtctgttattgcgcatgttgatcacgggaagtcaacccttaccgactcccttgttgctgctgctggtatcattgcacaagaagttgctggtgatgtccgcatgacagatacccgtgcagatgaggcagagcgtggtatcacaatcaaatctactggtatctctctctactatgagatgactgatgaagctttgaagagctacaagggggagagaaacggaaatgagtacctcatcaatctcattgattcccctgggcacgttgacttttcatctgaagtcacagctgcccttcgcattactgatggtgcacttgtggtggttgattgcattgagggtgtttgtgtccaaacagagactgtgcttcgtcaagccttgggagaaaggatcaggcctgttttgactgttaacaagatggacaggtgcttccttgagctccaggtcgatggagaggaggcttaccaaacattccagagggttattgagaatgctaatgttattatggctacatacgaagaccctcttcttggtgatgtccaggtctatccagagaaaggaacagttgccttttctgctggtttgcacggatgggcttttactctgaccaactttgccaagatgtatgcatccaagtttggagttgatgagtcaaagatgatggaaaggctctggggtgagaactactttgacccagctaccaagaaatggaccagcaagaacactggttctgctacctgcaagcgtggtttcgttcagttctgttatgaacccatcaagcagattatcaacacctgcatgaatgatcagaaggagaagttgtggcccatgttgacaaagcttggtgtgacgatgaagagtgatgaaaaggagctgatggggaaggggttgatgaagcgtgtcatgcagacctggctaccagccagcagtgccctattggaaatgatgatctttcaccttccctctccttcaactgcccagagataccgtgttgagaacttgtacgagggtccccttgatgatcaatatgcaaatgctatcaggaactgcgatcctgaagggcctcttatgctctatgtatctaagatgattcccgcatctgacaagggtcgattctttgcctttggtcgtgtctttgctggtaaagtccagacaggtttgaaggttagaatcatgggtccaaattatgttcctggagagaagaaggatttgtatgttaagaacgtgcagaggactgttatttggatgggaaagaaacaagaaactgttgaggatgttccttgtggtaacactgttgccttggtcggtcttgatcagtttatcaccaagaatgctacgttgacaaatgagaaggaagcggatgctcaccccattcgtgctatgaagttctctgtttcacctgttgtgcgtgttgctgttcaatgcaaggtggcttctgaccttcccaaactggttgaaggtctcaaacgtctggccaagtctgatcctatggttgtctgttccattgaggaatccggtgagcacattattgctggtgctggtgaacttcatcttgagatttgtttgaaggatctacaagatgatttcatgggtggagctgagattataaaatctgaccccgttgtgtctttccgtgagactgtcctggagaagtctagtcgtactgtgatgagcaagtcacccaacaagcataaccgtctgtatatggaagctcgacccttggaggaaggtcttcctgaggccattgatgatggccgtattggcccaagagatgatcccaaaattcgttccaagatattggctgaagagtttggttgggacaaggatcttgctaagaaaatctggtgttttggccctgagaccaccggtcctaacatggtggtggatatgtgtaagggagttcagtacctgaatgaaattaaggactctgttgttgctggtttccagtgggcttcaaaggaaggtgcattggcagaagaaaacatgaggggtatttgctttgaagtctgtgatgtggttcttcatgctgatgccatccacagaggaggtggtcaggtcattcccactgctaggagggtcatctatgcttcccagctcactgccaagccaaggctccttgaacctgtatatcttgttgaaatccaagctccagagcaggctcttggtggtatctacagtgttcttaatcagaaacgtgggcacgtgtttgaggaaatgcagaggcctggtacaccactctacaatatcaaggcatacctccccgtcattgaatcttttgggttctctggtcaactgagggcttcgacttcagggcaggccttcccacaatgtgtctttgatcattgggagatgatgtcgtctgatccattggaagctggatcccaggcttcacagcttgttacagatatccgtaagaggaagggtttgaaggagcaaatgaccccactatccgagtttgaggacaaactctgagtaatttctttgattatatcgaacaattggatgactgagtcactttgagacagtagttccattgcactgcctatttttggttttcagttttttgttttcgtttaatgtttgtaccaaccctgttgttgtagtcagcatcctgtgccagtagtaacgttttgtgcgtgctcagaagattatgtaatgttatgttcttactttgttgcttatggaaccatttctgccattgctggtacatgctatttttgaatttactatacacccctttttgtggtttgtttcgtgg

SEQ ID NO: 2107 - DNA, 2963 bp, Glycine max
gtctctcacacacaccactttatatacccacgcaatagaagggagtgctactctcttcgccgctctctctctccttctcgctctttcagctttgacttttgttggaaactaaggcctaatcaaaatggtgaagttcacagctgaagagctacgtcgtattatggactataagcataatatccgtaatatgtctgtcattgctcatgttgatcacggaaaatcaaccctcactgattctcttgtggctgctgctggtattattgctcaagaagttgccggtgatgtccgtatgactgatacccgtgcagatgaagctgagcgtggtattaccatcaagtctacaggtatctcactctactatgaaatgactgatgaagctctcaagagttttaagggagagcgcaatgggaatgagtatcttatcaatctcattgactcccctgggcacgttgacttctcatctgaggttactgctgcactccgtattactgatggagctctagttgtggtcgattgtgtggaaggagtttgtgtccaaactgaaactgtgctaagacaagcccttggagaaaggattaggcctgttctgactgtcaataagatggacaggtgcttccttgaactccaggttgatggagaggaggcttaccagacattccagagggttattgagaatgctaatgttatcatggctacatatgaagatccactacttggtgatgttcaggtctacccagagaaaggaacagttgctttttctgctggtttgcatggctgggcttttaccctgactaactttgccaagatgtatgcatccaagtttggagttgatgaaggaaagatgatggaaaggctctggggtgaaaacttttttgatccagccacaaagaaatggaccagcaagaatagtggttctgctacctgcaagcgtgggtttgttcagttctgttatgagcccatcaagcagattattaacacttgtatgaatgatcagaaggataagctgtggcctatgctgcaaaagcttggggtcaccatgaaatctgaggagaaggacctcatgggtaaagcattgatgaagcgtgtcatgcaaacctggcttccagcaagtagtgctctattggaaatgatgatatttcatctaccctctccatcaacagcccagaagtatcgtgtggagaacttgtatgagggtcctcttgatgatcaatatgcttctgctatcagaaattgtgatcctgaaggtcctctgatgctctatgtctccaagatgattccagcatctgataaggggagattttttgcctttggccgtgtattctctggcagggtttcaactggtttgaaggtgaggattatgggacctaattatgtccctggggagaaaaaggatttgtatgttaaaagtgtgcaacgaactgtcatttggatgggaaagaggcaagaaactgtagaggatgtcccctgtggtaatacagtggctatggttggtcttgaccagttcatcacaaagaatgcaacattgacaaatgagaaggaagtcgatgcccaccctatccgagctatgaagttttctgtctcacctgttgttcgtgttgctgttcaatgtaaggttgcatcagatcttcccaagcttgttgaaggtcttaagcggttggctaagtcagatcctatggttgtttgtaccattgaggagtctggtgaacacattgttgctggtgcaggagagcttcatcttgagatctgtttgaaggacttgcaggatgatttcatgggtggagctgagattatcaaatctgaccctgttgtgtcattcagggagactgttttggagagatcatgccgcaccgtgatgagcaaatcacccaacaagcacaaccgtctgtacatggaagcaagaccattggaggaaggtcttgctgaggccattgatgatggcaagattggaccaagggatgaccccaaggttcgttccaagatcttgtctgaagagttcggttgggacaaggatcttgccaagaaaatctggtgctttggccctgagacccttggacccaacatggtggttgatatgtgcaagggagtccagtatttgaatgaaatcaaggattctgtggttgctggattccagtgggcatcaaaagaaggtgctttggctgaagaaaacatgagagccatctgctttgaagtatgtgatgttgtgctgcacgctgatgctatccacagaggaggtggtcaaatcattcctactgccaggagagtcttctatgcttcccagattactgccaaacccaggcttcttgagcctgtctacctggttgaaatacaggctcctgaacaagctcttggtggaatctacagtgttcttaaccagaagcgtggacacgtgttcgaggaaatgcagaggccaggtaccccactatacaacatcaaggcatacctccctgtcatcgagtcctttggtttctcgagcacattgagggctgcaacatcaggccaggccttcccacaatgtgtgtttgatcactgggacatgatgtcttctgacccattggaggctggatcacaagctgcacagcttgtcactgacattcgcaagaggaagggcttgaaggaacagatgactcctctctccgagtttgaagacaagctttaaatttgtttcatgaattattttactttgaacttagtcgaatttattttctcttgtgaacaatgctactttagatttaatttctgttagttttgtttgtggttttgcccgtgaatgttgtaatgctgttatttggtccttgcatcgatgtatttttgctctaataggattttgcatcggtgttggttcaaattattattttgcgaattttgcttgaaagatagtattttcaataattgtgtggcgcttttgtttttgtggcgaatgatcaaatgagaacttggtaattgaatgcagctgaagatatttt

SEQ ID NO: 2108 - DNA, 3080 bp, Glycine max
gtttgcattgcgtggtggatacaaccctaaaaaaaacactacacttctctcttcgtgtctctcacacacaccactttatatacccacgcaatagaagggagtgctactctcttcgccgctctctctctccttctcgctctttcagctttgacttttgttggaaactaaggcctaatcaaaatggtgaagttcacagctgaagagctacgtcgtattatggactataagcataatatccgtaatatgtctgtcattgctcatgttgatcacggaaaatcaaccctcactgattctcttgtggctgctgctggtattattgctcaagaagttgccggtgatgtccgtatgactgatacccgtgcagatgaagctgagcgtggtattaccatcaagtctacaggtatctcactctactatgaaatgactgatgaagctctcaagagttttaagggagagcgcaatgggaatgagtatcttatcaatctcattgactcccctgggcacgttgacttctcatctgaggttactgctgcactccgtattactgatggagctctagttgtggtcgattgtgtggaaggagtttgtgtccaaactgaaactgtgctaagacaagcccttggagaaaggattaggcctgttctgactgtcaataagatggacaggtgcttccttgaactccaggttgatggagaggaggcttaccagacattccagagggttattgagaatgctaatgttatcatggctacatatgaagatccactacttggtgatgttcaggtctacccagagaaaggaacagttgctttttctgctggtttgcatggctgggcttttaccctgactaactttgccaagatgtatgcatccaagtttggagttgatgaaggaaagatgatggaaaggctctggggtgaaaacttttttgatccagccacaaagaaatggaccagcaagaatagtggttctgctacctgcaagcgtgggtttgttcagttctgttatgagcccatcaagcagattattaacacttgtatgaatgatcagaaggataagctgtggcctatgctgcaaaagcttggggtcaccatgaaatctgaggagaaggacctcatgggtaaagcattgatgaagcgtgtcatgcaaacctggcttccagcaagtagtgctctattggaaatgatgatatttcatctaccctctccatcaacagcccagaagtatcgtgtggagaacttgtatgagggtcctcttgatgatcaatatgcttctgctatcagaaattgtgatcctgaaggtcctctgatgctctatgtctccaagatgattccagcatctgataaggggagattttttgcctttggccgtgtattctctggcagggtttcaactggtttgaaggtgaggattatgggacctaattatgtccctggggagaaaaaggatttgtatgttaaaagtgtgcaacgaactgtcatttggatgggaaagaggcaagaaactgtagaggatgtcccctgtggtaatacagtggctatggttggtcttgaccagttcatcacaaagaatgcaacattgacaaatgagaaggaagtcgatgcccaccctatccgagctatgaagttttctgtctcacctgttgttcgtgttgctgttcaatgtaaggttgcatcagatcttcccaagcttgttgaaggtcttaagcggttggctaagtcagatcctatggttgtttgtaccattgaggagtctggtgaacacattgttgctggtgcaggagagcttcatcttgagatctgtttgaaggacttgcaggatgatttcatgggtggagctgagattatcaaatctgaccctgttgtgtcattcagggagactgttttggagagatcatgccgcaccgtgatgagcaaatcacccaacaagcacaaccgtctgtacatggaagcaagaccattggaggaaggtcttgctgaggccattgatgatggcaagattggaccaagggatgaccccaaggttcgttccaagatcttgtctgaagagttcggttgggacaaggatcttgccaagaaaatctggtgctttggccctgagacccttggacccaacatggtggttgatatgtgcaagggagtccagtatttgaatgaaatcaaggattctgtggttgctggattccagtgggcatcaaaagaaggtgctttggctgaagaaaacatgagagccatctgctttgaagtatgtgatgttgtgctgcacgctgatgctatccacagaggaggtggtcaaatcattcctactgccaggagagtcttctatgcttcccagattactgccaaacccaggcttcttgagcctgtctacctggttgaaatacaggctcctgaacaagctcttggtggaatctacagtgttcttaaccagaagcgtggacacgtgttcgaggaaatgcagaggccaggtaccccactatacaacatcaaggcatacctccctgtcatcgagtcctttggtttctcgagcacattgagggctgcaacatcaggccaggccttcccacaatgtgtgtttgatcactgggacatgatgtcttctgacccattggaggctggatcacaagctgcacagcttgtcactgacattcgcaagaggaagggcttgaaggaacagatgactcctctctccgagtttgaagacaagctttaaatttgtttcatgaattattttactttgaacttagtcgaatttattttctcttgtgaacaatgctactttagatttaatttctgttagttttgtttgtggttttgcccgtgaatgttgtaatgctgttatttggtccttgcatcgatgtatttttgctctaataggattttgcatcggtgttggttcaaattattattttgcgaattttgcttgaaagatagtattttcaataattgtgtggcgcttttgtttttgtggcgaatgatcaaatgagaacttggtaattgaatgcagctgaagatattttaattactggtgtagaccatgtgtggttgatgatataaagtcggtgaagtgaattgagacta

SEQ ID NO: 2109 - DNA, 3008 bp, Picea glauca
accgagcaaagtcatccttttgtttgtctcaggccgccgggctcattcttttatctttgttctcgcatcccttgcttgagctgcgagagcccgtaatttgaaggtttcagaggtttgcagctctagttccttctgtgccgttctgcgttcgcgggtttcagaccctcgttggtattctttcgattttgctgagaagagttttggtgaatataagagctagacaaaatggtgaagttcacagctgaagagcttcgtaagattatggacaggaaacataacatacgaaacatgtctgttattgcccatgttgaccatggaaaatccactctcaccgattctttggtagcagcagctggtattattgctcaagaagttgctggagatgtcaggatgactgatactcgtgcagatgaagctgaacgtggcatcaccatcaagtcaaccgggatctcattgtattatgagatggaggacgaagctgtgaaaaatttcaagggggatcgagtaggaaatgaatatttgataaatctgattgattctccagggcacgttgacttctcttcagaagttacagcagccctgcgaatcacagatggtgcactggttgtggttgattgcattgaaggggtttgtgtccagacggagactgttcttcgtcaagctcttggagaaaggattaggcctgttctcactgtgaacaagatggacaggtgctttcttgagttacaggttgatggagaggaagcttaccaaactttttcacgtgtcattgaaaatgcaaatgtgattatggctacttatgaagatcctcttcttggtgattgccaagtttatcctgaaaaaggtacagttgcattctcggcaggtctgcatggatgggcattcactttgacaaattttgcaaaaatgtatgcttcaaagtttggagtggatgaagtaaagatgatggagaggctgtggggtgaaaacttttttgatccagctaccaagaaatggacaaccaagaatacaggttcagcaacctgcaaaagaggatttgttcaattcatatatgaacctattaagcaaattatcaatatttgtatgaatgatcaaaaggataagttgtggcccatgttgcagaaattgggagttgtgatgaagagcgaagagaaggagctggttgcaaaagcactcatgaagcgtgtcatgcaaacctggctacctgcaagtagtgctctacttgaaatgatgattttccatcttccttctccatcgaaggcacagagatatcgtgtggaaaacttgtatgaaggacctcttgatgatgtatatgcaactgcaattagaaattgtgaccccgagggaccactgatgttgtatgtttcaaaaatgattccagcttcggacaaaggacgtttctttgcctttggccgtgttttctctgggagagtggcaacaggtatgaaggtaaggatcatgggtcccaattatattccaggtcagaagaaagatttatatactaagagtgttcaaaggactgttatatggatgggaaagagacaagaatctgttgaggatgtgccttgtggaaatacagtggctatggttgggttagaccagttcataaccaaaaatgctactctgacaaatgagaaggaggttgatgctcatccaatcagagcaatgaagttctctgtttcccctgttgtgcgtgttgctgtgcagtgcaaggtggcttctgaccttccaaaacttgttgaagggctgaagcgtcttgctaagtcagatcccatggttgtttgtacaattgaagaatctggagaacatattattgcaggtgcaggagagcttcatcttgagatttgcttaaaagatctccaagaagattttatgggtggagctgagattgttgtttctgatcctgttgtctcatttagagaaactgtgttggagaaatcatgccgcactgttatgagcaagtctccaaacaagcacaacaggctttactttgaagcgagacctttagaagaaggtcttgcagaagcaattgatgatggtcgcattggcccgaaggatgatccaaaggctcgtgcaaaaatcctttctgaggagtttggatgggacaaagatctggctaagaagatctggtgttttgggcctgagaccactggtcccaatctggtagtggatatgtgtaagggagtccagtacttgaatgaaattaaagattctgtggttgctgcattccaatgggcgtccaaggaaggtgctcttgcagaagaaaacatgcgtggtatttgctttgaggtttgtgatgtggttttgcacactgatgctatccataggggaggtggccagattatccccacagccagaagggttatgtatgcttctcagcttactgccaaaccaaggctgcttgagccagtatatcttgttgagattcaggctcctgagaatgcccttggtggtatttatggtgtgctgaatcagaagagaggccacgtatttgaggaaatgcagaggcaaggaactccactatataacatcaaggcctatctgccagtcgttgaatcttttggattctcaagtactctccgtgctgcaacttcaggccaggcttttcctcaatgtgtgtttgaccactgggatatgatgggatctgatccattggaaactggttcccaagctgggcagctcgtgactgacatccgcaagaggaagggtctcaaggagagtatgactcccttgtcagatttcgaagacaagctgtaaagctttgctatgtttgcatgccggatggtgtcaagattgaggagcctccttgagtatcaaaacacagttttgtgtgctaggactagttaattttttgctattaaggtatttttgtgatctgttatttactttagagataaaagttgactcttaagaaccatttattaatacatttgtcttttgaaattgctgaatggcaagcagtatcacattcagtttcttttttatgataagataatgattagttgcta

SEQ ID NO: 2110 - DNA, 3026 bp, Citrullus lanatus
tctgcctctcccgcactctgcttcacatttctgtgcctttacaccttcgtagaggcttaagggaggctccttcctttcctctccctccattttttcttacaggctaacaatcttattttgggacattgtcaaatttgaagacttgtcaagatggtgaagtttacagttgaagagcttcgtaggattatggacttcaagcataacattcgtaatatgtctgttattgctcatgtcgatcatgggaagtccactctcacagattctcttgtggctgctgctggtatcattgctcaagaagttgcgggtgatgttcggatgacagatacccgtcaagatgaggcagaacggggtattaccatcaaatcgactggcatctccctctattatgagatgtctgatgaatcattgaaaaattataagggagagaggcagggaaatgagtaccttatcaatcttattgattcgcctgggcatgttgacttctcatccgaggttacagctgctctacgaattactgatggtgcgcttgtggtggtggattgtgttgaaggagtttgtgtccaaacagagacagtgcttcgtcaggcgttgggagagaggattcgtcctgtgttgacagttaacaagatggacagatgcttccttgagcttcaagtagatggggaagaggcttatcagaccttctcgagagttattgagaatgctaatgtgatcatggctacatatgaggatccacttcttggtgatgtccaagtgtatcctgagaagggaacagttgctttctctgctggtttgcacggttgggctttcaccctgactaactttgcaaagatgtatgcctctaaatttggagtagatgaggctaagatgatggagaggctttggggtgagaacttctttgaccctgccaccaagaaatggaccaccaagaacactggatctgcaacgtgcaagcgtggatttgttcagttctgctatgaacctatcaagcagatcattgcaacttgtatgcatgaccagaaggacaagctatggcctatgttgcagaaacttggagttgtcatgaagtctgaagagaaggatctgatgggaaaagcattgatgaagcgagtcatgcaaacgtggctcccagcaagcaatgctcttttggaaatgatgatctttcatctcccttcccctgccacggcccaaaagtatcgtgtggagaatttgtatgagggtccactagatgatgtgtatgcaagtgccatcagaagttgtgaccctgagggacctcttatgctttatgtatcaaagatgattcctgcatcggacaagggcaggttctttgcctttggtcgggtcttctctgggagggtttcaactggtttgaaagttagaatcatgggtcccaactatgttcctggtgagaagaaagacttgtatgttaagagcgtccagagaactgtcatttggatgggaaagaagcaagaaactgtggaggatgtgccttgtggtaacaccgttgccatggttggattggatcaattcatcacaaagaatgctactctgacaaacgagaaggaagttgatgctcatccaattcgagccatgaaattttctgtatctcccgttgtgcgtgtggctgttcagtgcaaggtggcatctgatcttcccaagctcgtggaagggcttaaacgtctggcgaagtcagatcctatggttgtgtgtaccatggaggaatctggtgagcacattgttgctggtgccggagaactacatcttgagatctgtctgaaggatttgcaagaggatttcatgggtggagctgagatcataaaatctgaccctgttgtctctttccgtgaaaccgtccttgagaggtcatgccgcacggtgatgagtaaatcccccaacaaacacaatcgtctatacatggaagcacgacccatggaggaaggactggcagaggctatcgatgatggccgcattggaccacgagatgatcctaaagttcgttctaaaattttgtcggaggaattcggttgggacaaagatctcgctaagaagatttggtgctttgggcctgagactactggccccaacatggttgttgatatgtgtaagggagttcaatatctgaatgaaatcaaggattctgttgttgccggtttccaatgggcctctaaagaaggtgcattggccgaagaaaacatgagaggcatctgttttgaagtgtgcgatgtggttcttcatgctgatgccatccacagaggaggaggtcaagtcattcccacagctaggagggtaatttacgcttctcagttgacagccaaacccagacttcttgagccagtatacttggtggaaattcaagctccagagcaagctcttggaggtatctacagtgttcttaaccagaagcgtggacacgtatttgaggaaatgcagaggcccggtacccctctttacaacatcaaggcatatctccccgtcatcgagtcattcggattctcgagcactctgagagctgcaacgtctggacaggcattcccacagtgtgtgtttgaccattgggacatgatgtcttcagatccattagaaagtgggtctcaagctgcgcagttggttgctgatatcaggaagaggaagggattgaaggagcagatgactccattgtccgagttcgaagacaagctataaatcactcatttggttgaattttcatgcaccaacacagccttatgaattttcaagctgagaggttctactttgttccctatttttatcatatcatataggacgaaaagcctatctttttggagaattttttttttctcattttcgactgttattttatttttggtttcgagtttgtatggactaccaagatacattcctgttgaaatatgttctgaagatgaagctttttttattgggctatcagtttgttattggtcttaaaaataatcatgttttttaaagatctttaagtaatcacattgaaattagaataaggctttacatttttgtgttgataaaccaaa

SEQ ID NO: 2111 - DNA, 2544 bp, Ricinus communis
aaaagaatttgtttacagcttgtcctcaaactcggaaagaggtgtcatctgttccttcaaaccttttctcttgcggatgtctgttacaagctgtgctgcctgtgaacctgcctccattggatctgaagacatcatgtcccaatgatcaaacacgcactgcgggaaggcttgtccagatgtggcagccctcaaagtgccagagaaaccaaaggactcaatgactggtagatacgccttgatattgtacagaggagtgccaggcctctgcatttcctcaaacacatgaccacgtttctgattaagaacactatagataccaccaagagcctgctctggggcttgaatctcaaccaagtaaactggctcaaggagcctgggcttggctgttagctgtgatgcgtaaataaccctcctagcagttggaatgacctgaccaccacccctgtgaatagcatcagcatgaagaacaacatcacaaacttcaaagcaaatacctctcatgttttcttcagccaacgcaccctcctttgatgcccactggaaaccagcaacaacagaatctttaatttcattcaagtattgcactcccttacacatatcaacaaccatattaggcccagtagtttcaggaccaaaacaccatatcttctttgccaaatccttatcccagccaaattcctcagataatatctttgcacgaaccttaggatcatcccttgggccaatacggccatcatcaatagcctcagcaagcccttcctccataggtcgtgcctccatgtaaagacggttgtgcttgtttggggacttgctcattaccacacggcaggatttctctaggacagtctctcggaaagacacaacagggtctgatttgatgatctcagctccacccatgaaatcgtcctgcaaatccttcaaacagatctcaaggtgtagctcccctgcaccagcaataatgtgttccccagactcctcaatactacagacaaccataggatctgacttggccaaacgcttgagaccttcaacaagcttgggaagatcagatgcgactttacactgaactgccacacggacgactggagaaacagagaatttcattgcacgaataggatgggcatcaacttccttctcattggtcaaagttgcattcttagtaataaattgatccaaaccaaccatggccacagtgttaccacaaggaacatcctcaacagtttcctgccttttccccatccaaataacagttctttgaacactcttaacatacaaatctttcttttcaccagggacataatttggacccatgatcctcaccttcagaccagttgagaccttcccagcaaacacacgcccaaatgcaaagaatctacccttatcagaagcagggatcattttggacacataaagcataagggggccttcagcatcacagttcctgattgcagttgcataaggatcatcaaggggaccctcatacaagttctcaacacgatacctctgggccttggcaggagagggaaggtgaaagatcatcatttccaggagagcactgctggcagggagccaagtttgcatcacacgcttcatcagggccttgcccatcaattccttctcctcggacttcatagtaacaccaagtttttgcaacattggccacaatttatccttctggtcattcatgcaagtgttaatgatctgtttgataggctcataacagaactgcacaaagccacgcttgcaagttgcagagccagagttcttgctagtccacttcttggttgcaggatcaaagaaattctcaccccatagtctctccatcatcttagactcgtcaactccaaactttgaggcatacatcttggcaaagtttgtcagagtaaaagcccaaccatgcaatccagctgagaatgcaacagttcctttctctgggtaaacctgacaatcaccaagaaggggatcttcataggtggccatgatgacattagcattttcgatgaccctcgaaaatgtttgataagcctcttcaccatcaacctggagttcaaggaagcacctgtccattttgttgacagtcaacacaggccttatcctttcacccaaagcctggcgaagaacagtttcagtctggacacaaacaccctcaatgcagtcaaccaccacaagtgcaccatcagtaatacgaagagcagcagtgacttcagatgagaagtcgacgtgtccaggagaatcaatgagattgataagatactcattgccttgtctctctcccttgtagttcttaagggactcatccgtcatctcatagtagagtgagataccagtagatttgattgtgataccacgctctgcctcatcctggcgagtgtcagtcatacggacatcaccagcaacttcttgtgctatgataccagcagcagccacaagagaatcggtaagaagaagacataccatgatcgacatgggcaataacagacatattacgaatattgtgcttgtagtccataatacgacgaagctcttccgctgtgaacttcacct

SEQ ID NO: 2112 - DNA, 2953 bp, Euonymus alatus
cgtgtctcagcggccgggggcgctgaccttgttattgcgaggggaggctcgcctgagtgcagacctgtgacgcccaaattgtctctgctctctctgtacgacgtagctgtttgttttacaaagcttgttgggaaacttagagagtagtcaagatggtgaagtttactgctgatgagcttcgcaggattatggacctgaagcataatattcgtaatatgtctgttattgcccatgttgatcacgggaagtcaacacttactgattctcttgtggctgctgctggtatcattgctcaagaagttgctggtgatgtacgtatgactgacacccgagcagatgaggctgaacgtggcattacgattaagtcaactggtatatctctttactatgagatgagtgatgagtctttgaagagctataagggtgaaagaatggggaatgagtacctcatcaatctcattgactctcctgggcatgttgacttttcatctgaagtcacagccgcacttcgtatcactgatggtgcactcgttgtggttgattgtattgagggggtttgtgttcagacagaaactgttctcaggcaggcccttggtgaaaggattaggcctgttttgacagtaaacaagatggacaggtgttttcttgagctgcaggttgatggagaggaggcttaccaaactttccagagggtaattgagaatgctaatgtcatcatggctacttatgaagatcctctccttggtgatgttcaggtctatcctgagaaaggaacagttgctttctctgctggattgcatggttgggcttttactctaaccaatttcgccaagatgtatgcatccaagtttggagttgatgaggcaaagatgatggaaaggctctggggtgagaactactttgacccagcaacaaaaaaataggaccaccaagaacactggcactccttcgtgcaagcgtggttttgttcagttctgctatgaacctattaagcagattattagaacttgtatgaatgaccagaaagataagctttggcctatgttgcagaagcttggcgttaccatgaagtctgatgagaaagacttgatggggaagccactgatgaagcgtgtcatgcagacctggctcccagcaagtagagctctactggagatgatgatctttcaccttccctctcctgccacggcccaaaggtaccgtgttgagaacttgtatgagggtcccatggatgatcagtatgctaatgctataaggaactgcgatcccgacggtcctctcatgctttatgtgtcaaagatgattcctgcttctgacaaaggtagattctttgcttttggtcgtgtattctctggaaaggtttcaacaggtgtgaaagtccggatcatgggtccaaattatgtccctggtgagaagaaagacttgtatgttaagaatgtgcagagaactgttatctggatgggcaagaaacaagaaactgttgaagatgttccttgtggtaacacagtagcgttggttggcttggatcagtttattaccaagaatgctaccttgacaaatgagaaggaagttgatgctcacccaatccgtgccatgaagttctctgtttcacctgttgttcgtgtggctgttcagtgcaaggttgcttctgacctgcccaagctcgtagaaggtttgaaacgtttggccaagtcagatcctatggtcgtttgtagcatcgaagagtctggagagcacattattgctggtgcaggagagctccatcttgaaatctgtttgaaggatctgcaggacgatttcatgggtggtgctgagattgtgaagtcagatcctgttgtgtcattccgtgaaacagtgctcgagaagtccagccgtactgtgatgagcaagtcccccaacaagcacaatcgtctctacatggaagcacgtccccttgaggagggacttgctgaggccattgatgacggccgtattggtccacgtgatgaccccaaggttcgatctaagatattggctgaggagtttgggtgggacaaggatcttgccaagaaaatttggtgttttgggcctgagacaactggccctaacatggtggttgacatgtgtaagggggttcagtacctgaatgaaattaaggactctgttgttgctggtttccagtgggcatctaaggaaggtgcgttggctgaagagaacatgaggggtatctgttttgaagtctgtgatgttgttcttcacgctgatgccatccacagaggtggtggtcaagtcattccaaccgccaggagggttatttatgcttcgcagcttactgccaagcccaggctgcttgagcctgtgtatatggttgagatccaggccccggagcaggctcttggtggtatttatagtgttcttaaccagaaacgtggtcatgtctttgaagaaatgcagaggcccggaaccccactctataacatcaaggcttacctcccagtcgtagagtcatttggtttctcgggcaatttgagggctgcaacctctggtcaggctttccctcagtgtgtgtttgatcattgggatatgatgatgtcagacccattggatcccacatcacaggctggagttcttgttcatgatatccgtaagaggaagggattgaaggagcagatgacccctctgtcagagtttgaggacaagctgtgagcaataaaaaaatttattattcccatggaacagtgtttaacctacacaatcttatggtttagcggtaccattttttactgcctcaagatgttagttcttttcctttagtttttcaatgtggagttgtagtctctgtcgtattggaagtcacttgttcagtgttaatttgaaaacagttttgttcctgtgtctccggtccgtaattgttacagatttggtggttttggtttgaactatatcatttactttggtttagatgcttatgcat

SEQ ID NO: 2113 - DNA, 2942 bp, Phaseolus vulgaris
tcaccacacactgctttatatactttcgttagagaaggcagcaccactctcttcgccgcctctctctctcttcctcttccagctttgactcatattttggtggaacacaaagactagtcaaaatggtgaagttcacagctgaagagctccgtcgcattatggactataagcacaatatccgtaatatgtctgtcattgcccatgttgaccacggaaagtcaactctcaccgattctcttgttgctgctgctggaattattgctcaagaagtggcaggtgatgtccgtatgactgatacccgtgcagatgaagctgagcgtggtatcacaatcaagtctactggtatctccctctattatgagatgactgatgagtctcttaagaattataagggagaacgtaatgggaatgagtatctcattaatctcattgactcccctggacatgtggacttctcatctgaggttactgctgcactccgcattactgatggagccttagttgttgtggactgtgttgaaggagtctgtgttcaaacggaaactgtgctacgtcaagctctgggtgaaaggattaggcctgttctgactgtcaacaagatggacaggtgcttccttgaactccaagtggatggagaggaggcataccaaacattccagagggttattgagaatgccaatgtgatcatggctacatatgaagatccactcctaggtgatgttcaggtctacccagagaaaggaaccgttgctttctctgcagggctacatgggtgggcttttaccctgacaaactttgctaagatgtatgcctctaagtttggagttgatgaatcaaagatgatggagaggctctggggtgaaaacttctttgatccagccacaaagaaatggaccagcaagaacactggatctgccacttgcaagcgtgggtttgttcagttctgctatgaacccatcaagcagatcattaacacatgcatgaatgaccagaaggataagctgtggcctatgctgcaaaaacttggagtcaccatgaaatctgatgagaaggacctcatgggtaaagcattgatgaagcgtgtcatgcaaacctggcttccagcaagtactgctctattggaaatgatgatctttcatcttccctctccatcaactgctcagaagtatcgtgtggaaaacttgtacgagggtcctcttgatgatcaatatgctgcatctattagggcctgtgaccctgaaggtcctcttatgctctatgtgtcaaagatgattccagcatctgacaagggtagattctttgcttttggacgtgtgttctctggcaaggtttcaactggtttgaaggtaaggattatgggaccaaattatgttcctggagagaaaaaagatttgtatgttaagagtgttcaaagaactgtcatttggatgggtaagagacaggaaactgttgaggatgtgccatgtggtaacacagttgctttggttggtttggatcaattcatcactaagaatgctacattgacaaatgagaaggaagttgatgcacaccctattagggctatgaagttttctgtgtcccctgttgttcgtgttgctgttcagtgcaaggttgcctcagatcttcccaagcttgttgaaggtctcaagaggttggccaaatcagatcctatggttgtttgtaccattgaagagtctggtgaacacattgttgctggtgcgggagagcttcatctggagatctgtttgaaggacttgcaggacgacttcatgggtggagctgagattattaaatccgaccctgttgtgtcattcagggagactgtcctagagaggtcatgccgcactgtgatgagcaagtcacccaacaagcacaaccgtctgtacatggaagcaaggccaatggaggatggtctggctgaagcaattgatgatggcaagattggaccaagagatgaccccaaggttcgttctaagatcttgtctgaagagtatgggtgggacaaggatcttgcgaaaaagatttggtgttttggccctgagaccactggacccaacatggtggttgatatgtgtaagggagtgcagtatctgaatgaaataaaggattctgtggttgctggattccagtgggcatcaaaagaaggtgcattggctgaggagaacatgagagctatatgttttgaagtatgtgatgtggtccttcacgctgatgctatccacagaggaggtggtcaaatcattccgactgccagaagagtgttctatgcttctcagcttactgcaaaacccaggcttcttgagcctgtctacctggttgaaatccaggctcctgagcaagctcttggtggtatctacagtgttctgaatcagaaacgtggacacgtgtttgaggaaatgcagaggccaggtaccccactctacaacatcaaggcatatctccctgtcattgagtcctttggtttctcaagtacgttgagggctgcaacatcaggccaagctttcccacagtgtgtctttgatcattgggacatgatgtcctctgacccattggaggctggatcacaagcttctcagcttgtgacggacattcgtaagaggaagggcttgaaggaacagatgactcctcttgctgagtttgaagacaagctttaaatgcttttaaactatttattttcaacttattagctggatttatctttccaaacttttattttagtttaaattttgtcgagttttgtttgtggttttgtcagtgacttgttgtactctcgttatttctgccgcgtcgatgtatttttgcttctccataggattttgcatcgatgttggttcgaactatttgtgcgaattttgcttgaaagatactgtttcaatatttatgatggtgcaacatctattcatatgaattgaatgcgtgatcgagatgatgatagagaagaa

SEQ ID NO: 2114 - DNA, 2754 bp, Musa acuminata
cagggatacttcttttagaactgtttgatttctcaaagtagccaagatggtgaagttcacagctgaagagctccgccgtattatggacatgaagcataacatccgtaacatgtctgtcattgcacatgttgaccatggtaagtctactctcaccgattctcttgttgctgctgctggaatcattgcacaagaagttgcaggtgatgttaggatgactgatacccgccaggatgaggctgaacgtggtattacaatcaaatctactggaatctctctttactatgagatgactgaggagtcacttaaaaactacaagggtgaaagaagtggaaatgaatatctcattaacctcattgattcgcctgggcatgttgacttctcttctgaggttacagcagcacttcgaattactgatggtgcattagtcgttgtcgactgtattgagggtgtttgtgtgcagactgaaactgttcttagacaagctttgggagaaagaattagacctgtattgactgtcaataagatggatagatgttttctagagcttcaggttgatggtgaggaagcgtaccagacattccaacgtgtcattgagaatgcaaatgttatcatggctacctatgaagatcctcttcttggcgatgtccaagtatatccagagaaggggactgttgcattctctgcagggttgcatggttgggcttttacgcttaccaactttgccaaaatgtatgctgccaaatttggagttgatgaatctaagatgatggagagactttggggtgagaattactttgacccagccactaagaagtggaccagcaagaacactggatctggtacctgcaaacgaggctttgttcaattttgttatgaacctattagacagattatttctacttgcattaatgatcagaaagacaaattatggccgatgctgcagaagcttggtgtgaccatgaaatctgaagagaaagaactggtcggtaaagctttaatgaagcgggtcatgcagacttggctcccggcgagcactgcccttcttgagatgatgatcttccaccttccgtctcctgccaaggcacagaaataccgtgtggagaacttatacgagggccctcttgatgatatatatgccaatgccatcagaaactgtgatcctgaaggccctcttatgttatatgtgtcaaaaatgattcctgcttcagataagggcaggttctttgcattcggccgagtgttctctggcagggttgctacaggcatgaaggtgcgaatcatggggccaaactatgtgccaggtcagaagaaagacttgtacgtgaagagcgtccaaagaacagtcatctggatgggtaagagacaggagtctgtggaggatgtgccttgtggaaacacagttgctatggttggtttagatcaatacatcaccaagaatgccactcttacaaatgagaaggaagtcgatgcacatccaatcagagcaatgaaattctctgtatctcctgttgtacgtgttgcggtgcaatgcaaggtcgcctcggacctgcccaaacttgttgaaggcttaaagcgcctggccaaatcagatcccatggtggtgtgtacaatggaggagtcgggtgagcacatcgttgctggagctggggagctccaccttgagatctgcttgaaggacttgcaagaggatttcatgggaggtgcagaaattgtggtatctgacccagttgtttctttccgagaaacagtgcttgagaagtcctgccggacagtgatgagcaagtcacctaacaagcacaaccgtctgtatatggaagcccgacccatggaagaggggcttgccgaggcaattgatgaagggcgtattggtccaagagatgatcctaaagtgcgttctaagatcctatcagaggagtttggttgggataaagatcttgctaagaaaatttggtgctttggtcctgagacaactggtcctaacatggttgttgatatgtgtaagggagttcagtacctgaatgaaatcaaggactctgttgtggctggtttccagtgggcatcaaaggaaggagcagtggctgaggagaacatgcgtgcaatatgcttcgaggtatgtgatgttgttctgcatgctgatgcgatccatagaggtggtggtcagatcatcccaactgcaagaagggtcatctatgcatcccaattaacagccaaaccgaggcttttggagcctgtttatttggtagagatccaggcccctgagcaggcacttggtggtatctatggtgttcttaaccagaagcgaggtcatgtctttgaagagcttcagaggcccggaactccactttataacatcaaggcttacctccctgtcatcgaatcctttgggttctcgagcactctgagagctgccacatcggggcaagcattcccccagtgtgtgtttgaccactgggacatgatgtcttccgacccgttggagacaggctctcaggcgggacagctggtgagtgagatccgcaagaggaagggtcttaaggagcagattacccctctctctgaattcgaagacaagctgtagagctttatgatatagtgacatgccaacctggtgtgtaccttggtccccatgtttatttgcaagatttttgcctaccgaagtcgctgcaatttgcttgccttatgttttagatactcattatgttattcgaacaattcttgtttccagactatgtttgtaagatgatttagacatct

SEQ ID NO: 2115 - DNA, 2877 bp, Manihot esculenta
atttatctgcttactgaagagagtgagtttcaaacccctctcttctctcgccgcctccatctccgctcttctaccggtgtccttgtttattagtaattggtggtgaattctaaaagctagtcaagatggtgaagtttacagctgaggagcttcgtcgaattatggacttcaagcacaacatccgtaacatgtctgttattgcccatgtcgatcatgggaagtcaacacttaccgattctcttgtggctgctgctggtatcattgcgcaagaagttgctggtgatgtccgtatgactgatacacgtcaagatgaagctgagcgtggtattacaatcaaatccactggtatctcactctactatgaaatgagtgacgaatcccttaaaagttacaagggagagaggaatggaaatgagtatcttatcaatctcattgattcccccggacatgttgacttttcatctgaagtcacagctgctcttcgtattactgatggtgcactcgtggttgttgattgtgtggagggtgtatgtgttcaaacagaaactgtgcttcgtcaggccttgggtgaaaggattagacctgtattgactgtcaacaagatggacaggtgcttccttgagcttcaggttgatggagaggaggcttaccaaacattccagagggtcattgaaaatgctaatgtcatcatggcaacatatgaagatcctctccttggtgattgtcaggtctaccctgagaaaggaactgttgcattttctgctggtttgcatggttgggctttcaccttgacaaattttgccaagatgtatgcctcaaagtttggagttgatgagtctaagatgatggaaaggctatggggtgagaacttctttgaccctgcaaccaagaagtggactaccaagaacacaggctctgcaacttgcaagcgtggctttgtgcagttctgttacgagcccatcaagcagattatcaatacttgcatgaatgaccagaaggataaattgtggccaatgttgcaaaagctcggagtcaccatgaagtctgaggagaaggatttgatgggcaaggctttgatgaagcgtgttatgcagacctggcttcctgcaagcaacgctctcttggaaatgatgatctttcacctacctcctccttccaaggctcaaaagtatcgtgttgagaacttgtacgagggtcctcttgatgatccttatgctactgctatcaggaactgtgatcctgagggccctctcatgctttatgtttctaagatgattccagcttctgacaagggtaggttcttcgcttttggtcgtgtattttctggcaaggtctcaactggtctaaaggtgaggatcatgggtccaaactatgtccctggtgagaagaaagacttgtatgttaagagtgttcagagaactgttatttggatgggaaagaggcaggaaactgtggaggatgtcccttgtggtaacactgttgccatggttggtttggatcaatttatcaccaagaatgcaactttaaccaatgagaaagaagttgatgcacatcctattcgtgctatgaagttctctgtgtctccagttgttcgtgtggctgttcagtgtaaggtggcatctgatctccccaagcttgttgaaggtcttaagcgtttggccaagtctgatcctatggtggtttgtacaattgaggagtccggggaacacattattgctggtgctggagaacttcaccttgagatctgcttgaaggacttgcaggatgatttcatgggtggagctgagatcattaagtcggaccctgttgtgtccttccgggagactgtccttgagaaatcctgccgtgtggtgatgagcaagtcccccaacaagcacaaccgactttacatggaggcaaggcctatggaggaagggcttgctgaggctattgatgatggtcgtattggtccaagggatgatcctaaggcacgtgcaaagatattgtccgaggaatttggttgggataaggatctggctaagaaaatttggtgttttggtccggagactactgggcctaacatggttgttgatatgtgcaagggagttcagtacctcaatgaaatcaaggattctgttgttgctggattccagtgggcatcaaaggaaggggctttagctgaagagaacatgaggggcatatgctttgaagtctgtgatgtggttctccatgctgatgctattcacagaggaggtggtcaagtcattccaactgctaggagagttatctatgcctcacaacttacagccaagcccaggcttctcgagccagtttacttggttgagatccaagccccagagcaggcccttggtggtatctacagcgttcttaaccagaaacgtgggcatgtctttgaggaattgcagaggcctggtacccctctctacaacatcaaggcatacctcccggttatcgagtcctttggattctccagcacattgagggctgctacatcaggacaagctttcccacagtgtgtgtttgatcattgggacatgatgtcttctgatcccttggaggctgggtcacaagcagcacaacttgtatcagatatccgcaagaggaagggcttgaaggaacagatgacacctttatctgagtacgaggacaagctgtagtcaaatcttgagtgtgaagatgatacggacgagaatgcttttgttgccttttttctttgttttcattttgaatttttgttgctgttgggatcattcgtcctctatgtttgttctagcgtaacgtctgcaatgatatgtgttaccttgccatgttttgaactattccaaccaacattggttgattataatgctatttaagtctatagatgttgctttctcc

SEQ ID NO: 2116 - DNA, 2822 bp, Pinus pinaster
aaaatggtgaagttcacagctgaagggcttcgtacgatcatggacagaaagcataacatacgaaacatgtctgttattgcccatgttgaccacggaaaatccactctcactgattctttggtagcagcagctggtatcattgcgcaagaagttgccggagatgtcagaatgactgatactcgggcagatgaagctgaacgtggcatcaccattaagtcaactggaatttcattgtactatgagatggaggatgcagctgtgaaaaatttcaagggggatagagaaggacatgaatatttgataaatctgattgattctccagggcacgttgacttttcttcagaagttacagcagccctgcgaatcacagatggtgcactggttgtggtagattgtattgaaggggtttgtgtccagactgagactgttcttcgtcaagctcttggagaaaggattaggcctgttctcaccgtgaacaagatggacaggtgctttcttgagttgcaggttgatggagaggaagcttaccaaaccttctcacgtgtcattgaaaatgcaaatgtgattatggctacttatgaagatcctcttcttggtgactgccaagtttatcctgaaaaaggcacagttgcattctcagcaggtctgcatgggtgggcatttaccctcacaaattttgcaaaaatgtatgcttcaaagtttggagtggatgaagcaaagatgatggagaggctctggggtgaaaacttttttgatccagctaccaagaaatggactaccaagaatacaggttctgcaacttgcaaaagaggatttgttcaattcatatatgaacctattaagcaaattatcaatatttgtatgaatgatcaaaaggataagttgtggcccatgttgcagaaattgggagttgtaatgaaaagtgaagagaaagagctggttgcaaaagcactcatgaagcgtgtcatgcaaacctggctacctgcaagtagtgctttacttgaaatgatgattttccatcttccttctccagcgaaggcacagagatatcgtgtggaaaacttgtatgaaggacctcttgatgatatatatgcaactgcaataagaaattgtgaccctgagggtccactgatgttgtatgtttcaaaaatgattccagcttcggacaaaggacgtttctttgcctttggtcgtgtttttgctgggagagttgcaacaggtatgaaggtaaggatcatgggtcccaactatgtgccaggtcagaagaaagatttatatacaaagagtgttcaaaggactgtgatatggatgggaaagaaacaagaatctgttgaggatgtgccttgtggaaatacagtggctttggttgggttagaccagttcataacaaaaaatgctacactgacaaacgagaaggaggttgatgctcatccgatcagagcaatgaagttctctgtgtcccctgttgtacgtgttgctgtgcagtgcaaggtggcatctgaccttccaaaacttgttgaagggctgaagcgtcttgctaagtcggatcctatggtggtttgtacaattgaggaatctggagaacatattattgcaggtgcaggagagcttcatcttgagatttgcttaaaagatctccaagaagattttatgggtggagctgagattgttgtttctgatcctgttgtctcatttagagaaactgttttggagaaatcatgccgtactgttatgagcaagtctccaaataaacataacaggctttactttgaagcaagacctttagaagaaggtcttgcagaagcaattgatgaaggtcgtattggcccgaaggatgatccaaaggctcgctcaaaaattctttctgaggaatttggatgggacaaagatttggctaagaagatctggtgttttggacctgaaaccactggtcccaatatggtggtggatatgtgtaagggagttcaatacttgaatgaaattaaagattctgtggttgctgcattccaatgggcatccaaggaaggtgctcttgcagaagaaaacatgcgtggtatttgctttgaggtttgtgacgtggttttacacactgatgctatccatagaggaggtggccaggttatcccaacggccagaagggtcatgtatgcatctcagcttactgccaaaccgcggcttcttgaaccagtgtatcttgttgagattcaggctcctgagaatgcccttggtggtatttatggtgtgctgaaccagaagagaggtcatgtttttgaagaaatgcagaggccaggtactccactatacaacatcaaggcatatctgccggttgttgaatcattcggattctcaagcactctccgcgctgcaacttccggccaggcttttcctcaatgtgtgtttgaccactgggatatgatgggctctgatccattggaatctgggtcacaagctggtcagcttgtgatcgatatacgtaagaggaagggtcttaaggagagtatgactcccttgtcagagtacgaagacaagctgtagagctttgttatgtttgcctgccggatgctgtcaatattgaggatagtatttttatttatagtaggatcagaaatcattaaagctgccatttcttttcgctacctattgaatctcaaagggagacccgacttcccaggcttcactaagtatgaaaaggcaattgtttcaaccatcttgtaggcaggacttcaaaattcaaactgagtatgaaaaggcaattgtttgagccatcttgctgtcaggacattaaaattcagcgaataaattgaagttgcccatagattgtt

SEQ ID NO: 2117 - DNA, 2916 bp, Populus trichocarpa
gagagtgaccctccctctctcgccgcatccttctctccgtggtattgatattgtcattggatttttagaaactagtcaagatggtgaagtttacagcagaggagcttcggcgtattatggactacaagcataacatccgtaatatgtccgttattgctcatgttgatcatggaaaatcaacacttacagattctcttgttgccgctgctggtatcattgcccaagaggttgctggtgatgtccgaatgacagatacccgtgctgatgaggcagagcgcggtatcactataaaatctactggtatctctctatattatgagatggctgatgaagccctcaagaacttcaagggagagagacaagggaacgagtatctcatcaatcttattgactcccctggacacgtcgacttttcatctgaggtcacagctgctcttcgaattactgatggtgccctcgtggtggtggactgtatcgagggtgtgtgtgttcaaactgaaaccgtgcttcgacaggctttgggtgagaggatcaggcctgtcttgactgtcaacaagatggacaggtgtttcctggagctccaggttgatggggaggaggcttatcagacattctctagggttattgagaatgccaatgtcatcatggcaacatatgaagatcccctccttggtgactgccaggtctaccctgaaaagggtactgttgctttctctgctggtttgcatggttgggctttcactttgaccaactttgccaacatgtacgcctcaaagtttaaagtggatgagggaaagatgatggagaggctgtggggtgagaacttcttcgatcctgctaccaagaagtggagcagcaagaacaccggttctcccacatgcaagcgtggttttgtgcaattttgttatgagccaatcaagcagattattaacacttgcatgaatgaccaaaaggataaattgtggcccatgctccaaaagcttggtgttgtcatgaagtctgaggagaaggacttgatgggaaaggctttgatgaagcgtgtgatgcagacatggctgccagcaagtactgctctgcttgaaatgatgatctttcacctcccctctcctgccaaggctcaaaaataccgtgtggagaacttgtacgagggtccacttgatgatgtttatgccaatgctatcaggaattgcgaccctgaaggccccctcatgctttatgtatctaagatgattcctgcatctgacaagggtaggttctttgccttcgggcgtgttttttctggaaaggtatccactggtctgaaggttaggatcatgggaccaaactttgtccctggtgagaagaaggacctgtatgtgaagagtgtgcagagaaccgtcatttggatgggaaagaggcaagaaacagttgaggatgtgccttgtggtaacactgttgccatggttggtttggatcagttcatcaccaagaatgccactttaacaaacgagaaggaagttgatgcccaccctattcgtgctatgaagttctccgtgtctccagttgtgcgtgttgctgttcaatgtaaggtggcatctgacctcccaaagctcgttgaaggtctgaagcggttggccaagtctgatcccatggttgtctgttccatcgaggaatctggagagcatatcattgctggtgcaggagaactccaccttgagatctgtttgaaggatttgcaggaagactttatgggtggggctgagatcatcaagtctgatcctgttgtctctttccgtgagactgtcctggagaagtcctgccgtgtggtgatgagcaaatctcctaacaagcacaaccgtctctacatggaggcacgacccatggaagaagggcttgctgaggctattgatgacggccgtattggtccaagagacgatcctaagaatcgtgccaagatcttgtcggaggagtttggttgggacaaggatcttgctaagaaaatctggtgttttggtcctgagactacgggacccaacatggttgtggatatgtgtaagggagttcagtaccttaatgaaatcaaggattctgttgttgctgggttccaatgggcttcaaaggaaggtgctttggctgaagaaaacatgagaggtatctgctttgaagtctgtgacgtggttctccatgctgatgccattcacagaggtggtggtcaggttattccaactgccaggagggttatctatgcttcccagatcactgccaagcccaggcttcttgagcctgtttacttggtggagatccaagctccagagcaggctcttggtggtatctacagcgttcttaaccagaaacgtggtcacgtgtttgaagaaatgcagaggcctgggactcccctatacaacatcaaggcataccttcctgtcatagagtcttttggattttcagggactttgagggctgcaacatcaggacaggctttcccacaatgtgttttcgatcactgggacatgatgtcttctgatcctttggaggctggcacacaggcagctcagcttgttactgatatcaggaagcggaagggtttgaaggagcagatgacacctctatctgactttgaggacaagctataagcattttcccgttcttgttaaagcaacttggttaccttgagagatgatgaagcagaaggaccatttttgctgcttggttctttgcagcctcctcatttgtgatgttttgaaattttgttaccgtggattagtagatgtcctattggaacagtgggtcattttatccgtcttctcttataagaactccgcacatgttgtgttgtgatgaacttggtatgctttaaactttcacatcatcatcatgctatatttaattttcagatggtgcattccttaatgctattatgtatgtgtttgtggggat

SEQ ID NO: 2118 - DNA, 2948 bp, Populus trichocarpa
agagagtgaccctccctctctcgccgcatccttctctccgtggtattgatattgtcattggatttttagaaactagtcaagatggtgaagtttacagcagaggagcttcggcgtattatggactacaagcataacatccgtaatatgtccgttattgctcatgttgatcatggaaaatcaacacttacagattctcttgttgccgctgctggtatcattgcccaagaggttgctggtgatgtccgaatgacagatacccgtgctgatgaggcagagcgcggtatcactataaaatctactggtatctctctatattatgagatggctgatgaagccctcaagaacttcaagggagagagacaagggaacgagtatctcatcaatcttattgactcccctggacacgtcgacttttcatctgaggtcacagctgctcttcgaattactgatggtgccctcgtggtggtggactgtatcgagggtgtgtgtgttcaaactgaaaccgtgcttcgacaggctttgggtgagaggatcaggcctgtcttgactgtcaacaagatggacaggtgtttcctggagctccaggttgatggggaggaggcttatcagacattctctagggttattgagaatgccaatgtcatcatggcaacatatgaagatcccctccttggtgactgccaggtctaccctgaaaagggtactgttgctttctctgctggtttgcatggttgggctttcactttgaccaactttgccaacatgtacgcctcaaagtttaaagtggatgagggaaagatgatggagaggctgtggggtgagaacttcttcgatcctgctaccaagaagtggagcagcaagaacaccggttctcccacatgcaagcgtggttttgtgcaattttgttatgagccaatcaagcagattattaacacttgcatgaatgaccaaaaggataaattgtggcccatgctccaaaagcttggtgttgtcatgaagtctgaggagaaggacttgatgggaaaggctttgatgaagcgtgtgatgcagacatggctgccagcaagtactgctctgcttgaaatgatgatctttcacctcccctctcctgccaaggctcaaaaataccgtgtggagaacttgtacgagggtccacttgatgatgtttatgccaatgctatcaggaattgcgaccctgaaggccccctcatgctttatgtatctaagatgattcctgcatctgacaagggtaggttctttgccttcgggcgtgttttttctggaaaggtatccactggtctgaaggttaggatcatgggaccaaactttgtccctggtgagaagaaggacctgtatgtgaagagtgtgcagagaaccgtcatttggatgggaaagaggcaagaaacagttgaggatgtgccttgtggtaacactgttgccatggttggtttggatcagttcatcaccaagaatgccactttaacaaacgagaaggaagttgatgcccaccctattcgtgctatgaagttctccgtgtctccagttgtgcgtgttgctgttcaatgtaaggtggcatctgacctcccaaagctcgttgaaggtctgaagcggttggccaagtctgatcccatggttgtctgttccatcgaggaatctggagagcatatcattgctggtgcaggagaactccaccttgagatctgtttgaaggatttgcaggaagactttatgggtggggctgagatcatcaagtctgatcctgttgtctctttccgtgagactgtcctggagaagtcctgccgtgtggtgatgagcaaatctcctaacaagcacaaccgtctctacatggaggcacgacccatggaagaagggcttgctgaggctattgatgacggccgtattggtccaagagacgatcctaagaatcgtgccaagatcttgtcggaggagtttggttgggacaaggatcttgctaagaaaatctggtgttttggtcctgagactacgggacccaacatggttgtggatatgtgtaagggagttcagtaccttaatgaaatcaaggattctgttgttgctgggttccaatgggcttcaaaggaaggtgctttggctgaagaaaacatgagaggtatctgctttgaagtctgtgacgtggttctccatgctgatgccattcacagaggtggtggtcaggttattccaactgccaggagggttatctatgcttcccagatcactgccaagcccaggcttcttgagcctgtttacttggtggagatccaagctccagagcaggctcttggtggtatctacagcgttcttaaccagaaacgtggtcacgtgtttgaagaaatgcagaggcctgggactcccctatacaacatcaaggcataccttcctgtcatagagtcttttggattttcagggactttgagggctgcaacatcaggacaggctttcccacaatgtgttttcgatcactgggacatgatgtcttctgatcctttggaggctggcacacaggcagctcagcttgttactgatatcaggaagcggaagggtttgaaggagcagatgacacctctatctgactttgaggacaagctataagcattttcccgttcttgttaaagcaacttggttaccttgagagatgatgaagcagaaggaccatttttgctgcttggttctttgcagcctcctcatttgtgatgttttgaaattttgttaccgtggattagtagatgtcctattggaacagtgggtcattttatccgtcttctcttataagaactccgcacatgttgtgttgtgatgaacttggtatgctttaaactttcacatcatcatcatgctatatttaattttcagatggtgcattccttaatgctattatgtatgtgtttgtggggattatatctgcagtctatatgctagttagaaga

SEQ ID NO: 2119 - DNA, 2970 bp, Solanum tuberosum
gaattgtaaggtctcacaatactcgccgcctacttctctattctctgaacaaaaagtaatttgtagttacattaacagccattcaagatggtgaagttcacggctgaagagcttagaaggattatggacttcaagcataacattcgtaatatgtctgttattgctcatgtggaccatggaaaatctacccttactgattctctggtggcggctgctggtatcattgctcaggaagttgcaggtgatgtcaggatgacagatacacgtgcagatgaggctgagcgtggtatcaccatcaagtccactggtatttcactttactacgagatgactgatgaatccttgaggaacttcaagggagagagaaatgggaacgagtacctcatcaacctcatcgattcacctgggcacgtcgacttctcatctgaagtgactgctgctcttcgtattactgatggtgcgcttgttgtggttgattgtgtggaaggcgtctgtgtccagacagagactgtgctccgtcaggcccttggtgaaaggattcgtcctgtcttgacagttaacaagatggacaggtgtttccttgaacttcaggttgatggagaggaggcctatcagacgttccaaagagttattgagaacgctaatgttatcatggctacatatgaggatccccttcttggtgatgtccaggtttatcctgagaaaggtaccgttgctttctccgctgggttgcatgggtgggctttcactctcaccaattttgccaagatgtatgcttccaaatttggcgttgacgagtctaagatgatggaaaggctgtggggtgagaacttttttgaccctgccaccaaaaagtggaccaccaaaaacagcgggacagcttcgtgcaagcgtgggtttgttcaattctgctatgagccaatcaagcagattatcaacacttgcatgaatgatcagaaagataagctctggcctatgttgcagaagcttggtgtaaccatgaaatctgatgaaaaagatttaatgggcaaggcactgatgaagcgtgtgatgcagacctggcttcccgcaagtactgctcttctggaaatgatgatatatcatcttccatctccttccacagctcaaagataccgtgtggaaaacctgtacgaaggaccccttgatgatgcttatgccaatgccatcaggaactgtgacccagaaggcccacttatgctttatgtatccaagatgattccagcatctgacaagggtaggttctttgcttttggtcgtgtctttgctgggaaggtttgtactggtatgaaggttagaatcatgggtcctaactatgttcctggtgaaaagaaggatctatatgttaagaatatccagcgaactgttatttggatgggcaagaggcaagaaactgttgaggatgttccctgtggtaacactgttgccatggttggtttggatcaatatattaccaagaatgcaacattgaccaatgaaaaggaagtcgatgcccacccgatcagagcaatgaagttttctgtctcaccagtcgtgcgtgttgctgttcagtgcaaggttgcatctgaccttcccaagcttgttgaagggttgaaacgtctggctaagtctgatcctatggttgtttgttctattgaagaatctggagagcatattattgctggtgctggagaactccaccttgaaatctgtctgaaggatttgcaggatgactttatgggcggtgctgaaattataaaatctgatcctgttgtgtccttccgtgagacagtccttgagaagtctactcgaactgtgatgagcaagtcccctaacaagcataaccgtttgtacatggaggctagaccaatggaggaagggcttgctgaggctattgatgacggacgcattggccctagggatgaccccaaggttcgttccaagatcttggctgaggagtttggttgggacaaagatcttgcaaagaagatttggtgctttggtcctgagacaactggtcccaatatggtggtggatatgtgtaagggagttcagtacctgaatgaaattaaggattctgttgttgctggtttccagtgggcttccaaggaaggtgcattggctgaagagaacatgagaggtatttgctttgaagtctgtgatgttgttcttcattctgatgctattcacaggggtggtggccaagttattcccactgctaggagggttatctatgcttctcagcttactgccaaaccccgcctgttggaacccgtttaccttgtggaaattcaggctccggagcaagccctcggtggtatctatagtgttctgaaccagaagcgtggacacgtgtttgaggagatgcagaggccaggaactcctctttacaacatcaaggcttaccttcctgttgttgagtcttttggattttcaggtaccttgagagctgctacttcaggtcaagcattcccacaatgtgtgtttgatcattgggaaatgatgtcatccgacccattggaagttggctcacaagctaatcaactcgtccttgatatccgcaagaggaagggtttgaaggaacagatgacccctctatccgagtttgaggacaagctgtaagacatatgtttgagatggcagcagatatttaacctgctcaattgggtctgcgaaagttttgttttgcatttatcatctatctgtttggataattacttcgatcattttgtgttgttgattaggatactagctcgtaaggttgttgttgcagaacttattacatctatcgtttcttttccatggacaaaactgtttctgtcgtattttattttaagatgtcatttagttcaaaaattagtttcttagcaagtgcgattgcaaatataatgaaataatttcactgtgtaattggattaattatgcaagtgtttcatgttgacaggaattaaatttgcacgattaatgtgtttc

SEQ ID NO: 2120 - DNA, 2901 bp, Solanum phureja
atagcggcagaattgtaaggtctcacaatactcgccgcctacttctctattctcagaaaaggaagtaattcttagttaccacaacaaacattcaagatggtgaagttcacagctgaagagcttcgaaggattatggacttcaagcataacattcgtaatatgtctgttattgctcatgtggaccatggaaaatctacccttactgattctctggtggcggctgctggtatcattgctcaggaagttgcaggtgatgtcaggatgacagatacacgtgcagatgaggctgagcgtggtatcaccatcaagtccactggtatttcactttactacgagatgactgatgaatccttgaggaacttcaagggagagagaaatgggaacgagtacctcatcaacctcatcgattcacctgggcacgtcgacttctcatctgaagtgactgctgctcttcgtattactgatggtgcgcttgttgtggttgattgtgtggaaggcgtctgtgtccagacagagactgtgctccgtcaggcccttggtgaaaggattcgtcctgtcttgacagttaacaagatggacaggtgtttccttgaacttcaggttgatggtgaggaggcctatcagacgttccaaagagttattgagaacgctaatgttatcatggctacatatgaggatccccttcttggtgatgtccaggtttatcctgagaaaggtaccgttgctttctccgctgggttgcatgggtgggctttcactctcaccaattttgccaagatgtatgcttccaaatttggcgttgacgagtctaagatgatggaaaggctgtggggtgagaacttttttgaccctgccaccaaaaagtggaccaccaaaaacagcgggacagcttcgtgcaagcgtgggtttgttcaattctgctatgagccaatcaagcagattatcaacacttgcatgaatgatcagaaagataagctctggcctatgttgcagaagcttggtgtaaccatgaaatctgatgaaaaagatttaatgggcaaggcactgatgaagcgtgtgatgcagacctggcttcctgcaagtactgctcttcttgaaatgatgatatatcatcttccatctcctgccatagctcaaagataccgtgtggaaaacctgtacgaaggaccccttgatgatgcttatgccaatgccatcaggaactgtgacccagaaggcccacttatgctgtatgtatccaagatgattccagcatctgacaagggtaggttctttgcttttggtcgtgtctttgctgggaaggtttgtactggtatgaaggttagaatcatgggtcctaactatgttcctggtgaaaagaaggatctatatgttaagaatatccagcgaactgttatttggatgggcaagaggcaagaaactgtcgaggatgttccctgtggtaacactgttgccatggttggtttggatcaatatattaccaagaatgcaacattgaccaatgaaaaggaagtcgatgcccacccgatcagagcaatgaagttttctgtctcaccagtcgtgcgtgttgctgttcagtgcaaggttgcatctgaccttcccaagcttgttgaagggttgaaacgtctggctaagtctgatcctatggttgtttgttctattgaagaatctggagagcatattattgctggtgctggagaactccaccttgaaatctgtctgaaggatttgcaggatgactttatgggcggtgctgaaattataaaatctgatcctgttgtgtccttccgtgagacagtccttgagaagtctactcgaactgtgatgagcaagtcccctaacaagcataaccgtttgtacatggaggctagaccaatggaggaagggcttgctgaggctattgatgacggacgcattggccctagggatgaccccaaggttcgttccaagatcttggctgaggagtttggttgggacaaagatcttgcaaagaagatttggtgctttggtcctgagacaactggtcccaatatggtggtggatatgtgtaagggagttcagtacctgaatgaaattaaggattctgttgttgctggtttccagtgggcttccaaggaaggtgcattggctgaagagaacatgagaggtatttgctttgaagtctgtgatgttgttcttcattctgatgctattcacaggggtggtgggcaagttattcccactgctaggagggttatctatgcttctcagcttactgccaaaccccgcctgttggaacccgtttacctcgtggaaattcaggctccggagcaagccctcggtggtatctatagtgttctgaaccagaagcgtggacacgtgtttgaggagatgcagaggcaaggaactcctctttacaacatcaaggcttaccttcctgttgttgagtcttttggattttcaggtaccttgagagctgctacttcaggtcaagcattcccacaatgtgtgtttgatcattgggaaatgatgtcatccgacccattggaagttggctcacaagctaatcaactcgtccttgatatccgcaagaggaagggtttgaaggaacagatgacccctctatccgagtttgaggacaagctgtaagcttgtggaagtttcaacttggcagaggtttttgatggacacttttgcttaatcggatctgcattagttttgttttacatttttctgtgttttggcagtatgttttaccattttctatgtaggagtttgaaccgaaagtgagctattttgttacttcatttatgtcatttacagagacaaaaatcttgcccttggtgttttcaaaagtggtattttagttcttttaacaattccttttgtggctttttactttccccaaccccacaaatgttt

SEQ ID NO: 2121 - DNA, 2926 bp, Glycine max
actacctttctctcaccgtctctcacacacaccactttatatacgcacacgagagtcggaagcactactctcttcgccgcttgctcgctctctctcgctctttcagctttgactttggtggaaactaaagactagtcaaaatggtgaagttcacagctgaagagctgcgtcgcattatggactataagcataatatccgtaatatgtctgtcattgcccatgttgatcacggaaaatcaaccctgactgattctcttgtggctgctgctggtattattgctcaagaagttgcaggtgatgtccgtatgactgatacccgtgcagatgaagctgagcgtggtattacaatcaagtctacgggtatctcactctactatgaaatgactgatgaagctctcaagagttttaagggagagcgcaatgggaatgagtatcttattaatctcattgactcccctgggcacgttgacttctcttctgaggttactgctgcacttcgtattaccgatggagctcttgttgtggtcgattgtgtggaaggagtttgtgtccaaaccgaaactgttctacgacaagcccttggagaaaggattaggcctgttctgactgtcaataagatggacaggtgcttccttgaactccaggttgacggagaggaggcttaccagacattccagagagttattgagaatgctaatgtgatcatggctacatatgaagatccacttctcggtgatgttcaggtctatccagagaaaggaacagttgctttttctgctggtttgcacggctgggcttttaccctgactaactttgccaagatgtatgcatctaagtttggagttgatgaaggaaaaatgatggaaaggctctggggtgaaaacttctttgatccagccacaaagaaatggtccagcaagaatactggttctgctacctgcaagcgtgggtttgttcagttctgttacgagcccatcaagcagattattaacacttgtatgaatgatcagaaggataagctgtggcctatgctgcaaaagcttggggtcaccatgaaatctgaggagaaggacctaatgggcaaagcattgatgaagcgtgtcatgcaaacctggcttccagcaagtagtgcattactggaaatgatgatatttcatctaccctctccatcaacagcccagaagtatcgtgtggagaatttgtatgagggtccccttgatgatcaatatgcttcggctatcagaaactgtgatcctgagggtcctctgatgctctatgtctcaaagatgattccagcatctgacaagggcagattttttgcttttggtcgtgtattctctggcagagtttcaactggtttgaaggtgaggattatgggaccaaattatgtccctggggagaagaaggatttgtatgttaaaagtgttcaaagaactgtcatttggatgggaaaaagacaggaaactgtggaagatgtcccctgtggtaacactgttgctatggttggtttggatcagttcataacaaagaatgctaccttgactaatgaaaaggaagttgatgcccatcccattcgagctatgaagttttctgtctctcctgttgttcgtgttgctgttcaatgtaaggttgcatcagatcttcccaagcttgttgaaggtcttaagcggttggccaagtcagatcctatggttgtttgtaccattgaggagtctggtgaacacattgttgctggtgcaggagagcttcatcttgagatctgtttgaaggacttgcaggatgatttcatgggtggagctgagatcattaaatctgaccctgttgtgtcattcagggagactgtcctggagagatcatgccgcactgtgatgagcaaatcacccaacaagcacaatcgtctgtacatggaagcaagaccattggaggagggtcttgccgaggccattgacgatggcaagattggaccaagggatgaccccaagattcgctccaagatcttgtcagaagagtttggttgggacaaggatctcgccaagaaaatctggtgctttggccctgagacccttggacccaacatggtggttgatatgtgtaagggagtccagtatttgaatgaaatcaaggattctgtggttgctggattccagtgggcatcaaaagaaggtgctttggccgaagaaaacatgagagccatttgctttgaagtatgtgatgttgttctgcacgctgatgctatccacagaggaggtggtcaaatcatccctactgccaggagagtcttctatgcttcccagattactgccaaacccaggcttcttgagcctgtctacctggttgaaatccaggctcctgagcaagctcttggtggaatctacagtgttcttaaccagaaacgtggacatgtgttcgaggaaatgcagaggcctggtaccccactttacaacatcaaagcatacctccctgtcattgagtcctttggtttctcgagcacattgagggctgcaacatcaggccaggctttcccacaatgtgtctttgatcactgggatatgatgtcttctgacccattggaggctggatcacaagctgcacagcttgtcaccgacatccgcaagaggaagggcttgaaggaacagatgactcctctctccgagtttgaagacaagctttaaattgtttgaactatttaacttacttttgaacttagccgaatttatttctcatatgaacaatgttacttaagatttaagttttgtcgagttttgtttgtggttttgtccgtgaatgttgtacttctgttatttggtccttgcatcggtgtatttttgatccataggattttgcatcggtgttggttcgaactatttgggaattttgcttgaaagataagatagtagtattttcaataattgtgtggtgcttttga

SEQ ID NO: 2122 - DNA, 3065 bp, Glycine max
agaaagaatagcatcgggcttgagagatccaggcccaaggcccatactctaggattgggtttacattgcgtggtggatacaaccctaaaaaatcactacctttctctcaccgtctctcacacacaccactttatatacgcacacgagagtcggaagcactactctcttcgccgcttgctcgctctctctcgctctttcagctttgactttggtggaaactaaagactagtcaaaatggtgaagttcacagctgaagagctgcgtcgcattatggactataagcataatatccgtaatatgtctgtcattgcccatgttgatcacggaaaatcaaccctgactgattctcttgtggctgctgctggtattattgctcaagaagttgcaggtgatgtccgtatgactgatacccgtgcagatgaagctgagcgtggtattacaatcaagtctacgggtatctcactctactatgaaatgactgatgaagctctcaagagttttaagggagagcgcaatgggaatgagtatcttattaatctcattgactcccctgggcacgttgacttctcttctgaggttactgctgcacttcgtattaccgatggagctcttgttgtggtcgattgtgtggaaggagtttgtgtccaaaccgaaactgttctacgacaagcccttggagaaaggattaggcctgttctgactgtcaataagatggacaggtgcttccttgaactccaggttgacggagaggaggcttaccagacattccagagagttattgagaatgctaatgtgatcatggctacatatgaagatccacttctcggtgatgttcaggtctatccagagaaaggaacagttgctttttctgctggtttgcacggctgggcttttaccctgactaactttgccaagatgtatgcatctaagtttggagttgatgaaggaaaaatgatggaaaggctctggggtgaaaacttctttgatccagccacaaagaaatggtccagcaagaatactggttctgctacctgcaagcgtgggtttgttcagttctgttacgagcccatcaagcagattattaacacttgtatgaatgatcagaaggataagctgtggcctatgctgcaaaagcttggggtcaccatgaaatctgaggagaaggacctaatgggcaaagcattgatgaagcgtgtcatgcaaacctggcttccagcaagtagtgcattactggaaatgatgatatttcatctaccctctccatcaacagcccagaagtatcgtgtggagaatttgtatgagggtccccttgatgatcaatatgcttcggctatcagaaactgtgatcctgagggtcctctgatgctctatgtctcaaagatgattccagcatctgacaagggcagattttttgcttttggtcgtgtattctctggcagagtttcaactggtttgaaggtgaggattatgggaccaaattatgtccctggggagaagaaggatttgtatgttaaaagtgttcaaagaactgtcatttggatgggaaaaagacaggaaactgtggaagatgtcccctgtggtaacactgttgctatggttggtttggatcagttcataacaaagaatgctaccttgactaatgaaaaggaagttgatgcccatcccattcgagctatgaagttttctgtctctcctgttgttcgtgttgctgttcaatgtaaggttgcatcagatcttcccaagcttgttgaaggtcttaagcggttggccaagtcagatcctatggttgtttgtaccattgaggagtctggtgaacacattgttgctggtgcaggagagcttcatcttgagatctgtttgaaggacttgcaggatgatttcatgggtggagctgagatcattaaatctgaccctgttgtgtcattcagggagactgtcctggagagatcatgccgcactgtgatgagcaaatcacccaacaagcacaatcgtctgtacatggaagcaagaccattggaggagggtcttgccgaggccattgacgatggcaagattggaccaagggatgaccccaagattcgctccaagatcttgtcagaagagtttggttgggacaaggatctcgccaagaaaatctggtgctttggccctgagacccttggacccaacatggtggttgatatgtgtaagggagtccagtatttgaatgaaatcaaggattctgtggttgctggattccagtgggcatcaaaagaaggtgctttggccgaagaaaacatgagagccatttgctttgaagtatgtgatgttgttctgcacgctgatgctatccacagaggaggtggtcaaatcatccctactgccaggagagtcttctatgcttcccagattactgccaaacccaggcttcttgagcctgtctacctggttgaaatccaggctcctgagcaagctcttggtggaatctacagtgttcttaaccagaaacgtggacatgtgttcgaggaaatgcagaggcctggtaccccactttacaacatcaaagcatacctccctgtcattgagtcctttggtttctcgagcacattgagggctgcaacatcaggccaggctttcccacaatgtgtctttgatcactgggatatgatgtcttctgacccattggaggctggatcacaagctgcacagcttgtcaccgacatccgcaagaggaagggcttgaaggaacagatgactcctctctccgagtttgaagacaagctttaaattgtttgaactatttaacttacttttgaacttagccgaatttatttctcatatgaacaatgttacttaagatttaagttttgtcgagttttgtttgtggttttgtccgtgaatgttgtacttctgttatttggtccttgcatcggtgtatttttgatccataggattttgcatcggtgttggttcgaactatttgggaattttgcttgaaagataagatagtagtattttcaataattgtgtggtgcttttgattttgtggtgcatgatcaaatgggaactgggtatactaggacaaa

SEQ ID NO: 2123 - DNA, 2673 bp, Panicum virgatum
ggcggcgcctccacatctcgtctctcagatcgggaggcgaaaccaagaaggaaaatatatatttgtagtgtgatcttcaaaagaagtcaagatggtgaagttcacggcagaggagctccgcgccatcatggacaaaaagaacaacattcgtaatatgtctgttattgctcatgtggaccacggcaagtctacccttacagactcccttgtggcagctgctgggattattgcccaggaagttgctggtgatgtccgcatgactgatactcgcgctgatgaagcagagcgtggtattacaatcaaatccaccggtatctctctctactatgagatgactcctgagtcactgaagaattacaagggtgagagagatggcaaccagtatttgatcaaccttatcgactcacctgggcacgtcgatttttcttcggaagtgacagctgcccttcgtatcaccgatggtgctctggtggtggttgactgtattgaaggtgtctgcgtgcaaactgagactgtgcttcgccaggctcttggtgagaggattaggccagtccttactgtgaacaagatggacaggtgcttccttgagcttcaggttgagggtgaggaagcctaccagactttctcccgtgtgattgagaatgccaacgtcattatggcaacatatgaagataagctccttggtgatgtccaagtctacccggagaagggaactgttgctttctctgctggtctgcacggctgggccttcaccctcaccaactttgccaagatgtatgcatctaagtttggagttgatgaaactaagatgatggagaggctctggggtgagaacttctttgacccagccacgaagaagtggaccaccaagaacacaggctcagctacctgcaagagaggatttgttcagttctgctatgagcccatcaagcagatcatcaacacctgcatgaacgaccagaaggataagttgtggcccatgcttcaaaagctcaatgttaccatgaaggctgatgagaaggaattggttggcaaggctttgatgaagcgtgttatgcaaacctggttgccagctagtaccgcactgcttgagatgatgatattccaccttccttccccatcaaaggcgcagaagtatcgtgtggagaacctgtacgagggaccccttgatgatatctatgctactgccatcaggaactgtgatccggagggtcctctcatgctgtatgtttcaaagatgattccagcttctgacaaagggcggttctttgccttcggtcgtgtcttctccgggaaggttgctaccggtatgaaggttcggatcatgggtcccaactatgtgcctggccagaagaaggatctgtatgtcaagagtgtccaacgcactgttatctggatgggaaagaaacaagagtctgttgaggatgttccctgtggtaacaccgttgctatggtcggtctggatcagttcatcacgaagaatgccacactcaccaatgagaaggaagttgatgcatgcccaatcagagcaatgaagttctcagtgtctcctgttgtgcgtgttgctgttcagtgcaaggttgcctctgacctcccgaagctagttgaaggtttgaagcgtctggccaagtctgatcctatggtcctctgtagcattgaagaatctggtgagcatattattgctggagctggtgagcttcaccttgagatctgcctgaaggatctgcaggaagacttcatgggtggtgctgaaattattgtttcccctcctgttgtctctttccgtgaaactgttcttgagaagtcctgcagaacagtcatgagcaagtctcccaacaagcacaaccgtctttacatggaagcccggccgttggaagagggtcttcctgaggctattgatgagggacgcattggcccacgtgatgatcccaaggtgcgctccaagatcctctccgaggagtttgggtgggacaaggatcttgccaagaagatttggtgctttggacctgagaccacaggcccaaacatggtcgtcgatatgtgtaagggagtacagtatctcaatgaaatcaaggattctgttgtggctggattccagtgggcctctaaggagggagcacttgctgaggagaacatgcgtggaatttgctttgaggtctgtgatgttgttcttcatgctgatgccattcacaggggtggtggccaggtcattccaactgccaggagggtcatatatgcttctcagctcactgccaagccaaggctgctcgagccggtgtaccttgtggagatccaggctcctgagaatgctcttggtggtatctacggtgttctgaaccagaagagagggcacgtgtttgaggagatgcagaggccgggtaccccgctctacaacatcaaggcttacctccctgtcatcgagtcctttgggttctccagccaactgagggccgcaacctctggtcaggcgttccctcagtgtgtgtttgaccactgggacatgatgggctctgatcctttggaggctggctcccagctgctcagctggtgttggacatccgcaagaggaagggtctcaaggaacagatgaccccgctttccgagttcgaggacaagctctaaatttttgggccttctgtggtactgttaccctctgctggtttaatcacccgt

SEQ ID NO: 2124 - DNA, 3119 bp, Populus trichocarpa
atctcatgcattttctgatagagtgagtaaccctaaaaaactacactctttttcactctttcgccgcctcctcgtccctgttttattatcctaattaaatttttaggagctagacaagatggtgaagtttacagcagaggagcttcggcgtattatggacttcaagcacaacatccgtaatatgtccgtcatcgctcatgttgatcatggaaaatcaactctcactgattctcttgttgctgctgctggtatcattgcccaagaggttgctggtgatgttcgaatgactgatacccgggcagatgaggcagaacgtggtatcacaatcaaatctactggtatctctctatactatgagatgtcagatgaatccctcaagagattcaagggagagaggcatggaaatgagtatcttatcaatcttatagactctccaggacacgttgacttttcatctgaggtcacagctgctcttcgtatcactgatggcgctctggtcgttgtggactgtattgagggtgtgtgtgtccagactgaaactgtgcttcgacaggctttgggtgagaggatcaggcctgtcctgacagttaacaagatggacaggtgtttcctggagctccaggttgatggagaggaggcgtttcagacattttctagggttattgagaatgccaatgtcatcatggcaacctatgaagatcccctccttggtgactgtcaagtctaccctgagaagggtaccgttgctttctctgctggtttgcacggctgggctttcactttgaccaactttgccaagatgtatgcctcgaagtttggagtggatgagtctaagatgatggagaggctgtggggcgagaacttttttgatcctgctaccaagaagtggaccaccaagaacactggttctgctacttgcaagcgtggttttgtgcagttttgttatgagccaatcaaacagattattaacacgtgcatgaatgatcagaaggataaattgtggcccatgttgcaaaagcttggtgttgtcatgaagtctgatgagaaggacttgatgggaaagcctctgatgaagcgtgtgatgcagacctggctgccagcaagcactgctctgcttgaaatgatgatctttcacctgccttctcctgcaacggctcagagataccgtgtggagaacttgtatgagggtccccttgatgatgcttatgccaatgctatcaggaattgtgaccctaatggccccctcatgctttacgtgtctaagatgattcctgcttctgacaagggtaggttctttgcctttgggcgtgttttcgctggaaaggtaacaactggtctgaaggttaggatcatgggaccaaactatgtgcctggtgagaagaaggacttgtatgtgaagagtgtgcagaggactgtcatttggatggggaagaggcaagaaaccgttgaggatgtgccttgtggtaacactgttgccttggttggattggatcagttcatcactaagaatgccactttaactaatgaaaaggaagtcgatgcccatcctattcgtgctatgaagttctctgtctcgcctgttgtgcgtgtggctgttcagtgcaaggtagcatctgacctccccaagctggtggaaggtctgaagcgtttggcgaagtctgatcccatggttgtctgtagcattgaggaatctggagagcatatcattgctggagctggagagctgcaccttgagatctgtttgaaggatttgcaggatgattttatgggtggggcagaaatcataaagtctgaccctgttgtgtcgttccgtgagactgtcatagataagtcctgccgtgtggtgatgagcaaatctcctaacaagcacaaccgtctctacatggaggcacggcccatggaagaagggcttgcagaggctattgatgatggtcgtattggtccaagagatgatccaaagattcggggcaagatcttgtccgaggagtttggttgggacaaggatcttgcaaagaaaatctggtgctttggtcctgagaccaccgggccaaacatggttgtggatatgtgtaagggagttcagtaccttaatgaaatcaaggattctgttgttgctggtttccagtgggcttcaaaggaaggtgccttggccgaagaaaacatgcgaggtatctgctttgaagtctgtgatgtggttcttcattccgatgccattcatagaggtggtgggcaggtcattcctactgccaggagggttatctatgcctcccagctgactgccaagcccaggcttcttgagcccgtgtacatggtggagatccaagcccccgagcaggctcttggtggcatctacagtgttcttaaccagaaacgtggtcatgtgtttgaagaattgcagaggcccggtacacccctgtacaatatcaaggcgtacctccctgttgtcgagtcttttggattttccggcactttgagggctgcaacatcaggacaggctttcccacaatgtgtttttgatcattgggacacgatgtcttctgatccaatggaagccggtacacaagcagcacagcttgttacagaaatcaggaagcgaaagggtttgaaggagcagatgaccccattatctgagttcgaggacaagctgtgagcatttcagtatggtgttcaagaaacttgattagctttgagagatatggcgatacagagtggcattgatgctgcttggtttgttgcagtcttcttatcttcgattctaaatttcgttactctggattagtaattgccctgtggaaacaggtggaattctttctgtctcgtgttttgttgtctcgtagtaactccagtcatgttgtgatgaagttggtatgctttaaagtttaaattattcgcgtatttatcgtgttatatttaattttcaatgggtgcattcctcatcagattattatatgttgtttgtggtgattgtttctttggtcttgaaaagatcagattcagccagtggtgctttatgacctgaattcctgaagtggaactggagctggtaagatttgtttgtgattttctcagcactttgtttgtggtttttttttaataaaaattaaagctaattaaaataa

SEQ ID NO: 2125 - DNA, 3095 bp, Pinus taeda
gccttgcctgagccgcgagagtccgtgatttgaaggtttcagaggtctgcaactcgaatccattctgtgccgttctcctttggcgggtgctcattggtattcttctgttttggctgagaagagttttggtgaatacaaaagttaggaaaaatggtgaagttcacggctgaagagcttcgtaaaatcatggacaggaagcataacatacgaaacatgtctgttattgcccatgttgatcacggaaaatccactctcactgattctttggtagcagcagctggtatcattgctcaagaagttgctggagatgtcagaatgactgatactcgggcagatgaagctgaacgtggcatcaccatcaagtcaactggaatttcgttgtactatgtgatggaggatgcagctgtgaaaaatttcaagggggatagagaaggacacgaatatttgataaatctgattgattctccagggcacgttgacttttcttcagaagttacagcagccctgcgaatcacagatggtgcactggttgtggtagattgtattgaaggtgtttgtgtccagactgagactgttcttcgtcaagctcttggagaaaggattaggcctgttctcactgtgaacaagatggacaggtgctttcttgagttgcaggttgatggagaggaagcttaccaaaccttctcacgtgtcattgaaaatgcaaatgtaattatggctacttatgaagatcctcttcttggtgactgccaagtttatcctgaaaaaggtacagttgcattctcggcaggtctgcacgggtgggcatttaccctcacaaattttgcaaaaatgtatgcttcaaagtttggagtggatgaagcaaagatgatggagaggctttggggtgaaaacttttttgatccagctacaaagaaatggacaaccaagaatacaggttctgcaacttgcaaaagaggatttgttcaattcatatatgaacctattaagcaaattatcaatatttgtatgaatgatcaaaaggataagttgtggcccatgttgcagaaattgggagttgtaatgaaaagtgatgagaaggagctggttgcaaaagcactcatgaagcgtgtcatgcaaacctggctacctgcaagtagtgctttacttgaaatgatgattttccatcttccttctccagcgaaggcacagagatatcgtgtggaaaacttgtatgaaggacctcttgatgatgtatatgcaactgcaataagaaactgtgaccctgagggtccactgatgttgtatgtttcaaaaatgattccagcttcggacaaaggacgtttctttgcctttggtcgtgtttttgctgggagagttgcaacaggtatgaaggtaaggatcatgggtcccaactatgtgccgggtcagaagaaagatttatatacaaagagtgttcaaaggactgtgatatggatgggaaagaaacaagaatctcgttagaacccgtgtgtgccttgtggaaatacagtggctttggttgggttagaccagttcataaccaaaaatgctacactgacaaacgagaaggaggctgatgctcatccgatcagagcaatgaagttttctgtgtcccctgttgtacgtgttgctgtgcagtgcaaggtggcatctgaccttccaaaacttgttgaagggctgaagcgtcttgctaagtcggatcctatggtggtttgtacaattgaggaatctggagaacatattattgcaggtgcaggagagcttcatcttgagatttgcttaaaagatctccaagatgattttatgggtggagctgagattgttgtttctgatcctgttgtctcatttagggaaactgttttggagaaatcatgccgtactgttatgagcaagtctccaaataaacataacaggctttactttgaagcaagacctttagaagaaggtcttgcagaagcaattgatgatggtcgcattggcccgaaggatgatccaaaggctcgcgcaaaaatcctttctgaggaatttggatgggacaaagatttggctaagaagatctggtgttttggacctgaaaccactggtcccaatatggtggtggatatgtgtaagggagttcaatacttgaatgaaattaaagattctgtggttgctgcattccaatgggcatctaaggaaggtgctcttgcagaagaaaacatgcgtggtatttgctttgaggtttgtgacgtggttttgcacactgatgctatccatagaggaggtggccaggttatcccaacggccagaagggttatgtatgcatctcagcttactgccaaaccacggcttcttgagccagtatatcttgttgagattcaggctcctgagaatgcccttggtggtatttatggtgtgctgaaccagaagagaggtcatgtttttgaagaaatgcagaggccaggtactccactatacaacatcaaggcatatctgccggttgttgaatcattcggattctcaagcactctccgtgctgcaacttctggccaggctttccctcaatgtgtgtttgaccactgggatatgatgggatctgatccattggaacctggttcccaagctgggcagcttgtgactgatatccgtaagaggaagggtcttaaggagagtatgactcccttgtcagagttcgaagacaagctgtagagctttgctatgtttgcatgtcggatgctgtcaagattgaggaacctccgagtattaaaacacagttttgtgtgctaggactatttaaatttatgctattcaggtatttttgtgatctgttatttatgttattcaggtatttttgattggaaaatactttttacaaggtacatccattaatcttttaaatgttacataattctctcttgtcaatttcaccgtatgtgcggtagtttgaattgtttgcataattatgtatgtcacagaaaagccgggctgagatttgggtagacattggtttaaaaacacattcacctggccgttggtttaaaaattgttgtatataattgtgctccatctattattctcctctctagtttcccaatccatccacgtagtattgtgcc

SEQ ID NO: 2126 - DNA, 2807 bp, Gossypium hirsutum
gcgtccaacaatcttcgtctctttctcttgcttgccgtttttctctcttaggttttgattcttgtttatagttcgaggtgttttaaagacaagtcaagatggtgaagtttacagctgaggagcttcgtgccattatggacaggaagcacaacatccgtaatatgtctgttattgctcatgtggaccacgggaaatcaactcttaccgattctcttgtggctgctgctggaattattgcacaagaagttgctggtgatgttcgtatgacagatacccgtgctgatgaggctgagcgtggtatcacaatcaagtctactggtatctctctttattatgaaatgtctgatgactctttgatgagctacaaaggagagagacaagggaatgagtacctcatcaatcttatcgattcccctgggcacgttgacttttcatccgaggtcacagctgctctacgtattactgatggtgcccttgtggttgttgattgtattgaaggtgtctgtgtgcaaatagagactgttctccgtcaggctcttggagaaagaatcaggcctgtcttgactgttaacaagatggataggtgcttccttgagctccaggttgatggagaggaggcttaccagacattccagagagtgattgaaaatgctaatgtcatcatggccacctatgaagatcctcttcttggtgatgttcaagtctacccagagaagggaacagttgctttctctgctggtttgcatggttgggcttttaccttgaccaactttgctaaaatgtatgcctcaaagtttggagtcgatgagtccaaaatgatggaaaggctttggggtgagaacttttttgatccagctaccaggaaatggaccaccaagaacactggcactgccacctgcaagcgtggttttgttcaattctgttatgagcccatcaagcagatcatcaacacttgtatgaatgaccagaaagataagctatggcccatgctacaaaagcttggtgtcaccatgaagtctgaagagaaggacttgatgggtaaggccctcatgaagcgtgttatgcagacctggcttcctgcaagcagtgctctcctggaaatgatgatctttcacctaccctctcctagcgtggctcagaaatatcgtgttgagaacttgtatgagggtcctcttgatgatgtctatgccaatgctattaggaactgtgatcctgagggtcctcttatgctttatgtttcaaagatgattcccgcttctgataagggtaggttctttgctttcggtcgtgtcttttctggcagagttgcaactggtttgaaggtcagaatcatgggtccaaactatgtacctggggagaagaaagacttgtatgtaaagagtgtacagagaactgtgatttggatgggaaagaagcaggagacagttgaggacgttccttgtggtaatacagttgccatggttggtttggatcagttcatcaccaagaatgctacattgaccaatgagaaggaagttgatgcccacccaattcgtgccatgagttttctgtctcccctgttgtccgtgttgctgttcagtgcaaggttgcatcagatcctcccaaacttgttgaagggttgaagcgtttggccaagtctgatcctatggttgtctgtaccattgaagagtctggtgaacacattgttgctggtgctggagagctccaccttgagatctgtctcaaggatttacaagaagatttcatgggtggtgctgagatcatcaagtcagaccccgttgtgtccttccgtgagactgtccttgagaggtcttgcaggactgtgatgagcaagtctcctaacaagcacaaccgtctgtacatggaagctcgacccttggaggaaggtcttgctgaggccattgacgaaggtcgtattggtccaagagatgatcccaaggttcgttccaagattttggccgaggagtatggttgggacaaagatcttgctaagaagatttggtgtttcggccctgagacaactggtcctaacatggtggttgatatgtgtaaaggagttcaataccttaatgaaatcaaggactctgtagttgcggggttccagtgggcatcaaaggaaggtgcgatagctgaagagaacatgaggggtatctgctttgaagtctgtgatgtggttctccatgctgatgctatccacagaggtggtggtcaaatcattccgactgccaggagggttttctatgcttctcaacttacggccaaaccaaggcttctggagcctgtttacttggttgagattcaagcccctgagcaggcacttggtggtatttacagtgttcttaaccagaagcgtggacatgtgtttgaggagatgcagaggcctggtactccactttacaacatcaaggcctaccttccagttattgagtcttttggattctccagcactctgagggctgcaacctccggacaggctttcccacaatgtgtgtttgatcactgggatatgatgtcatcagatccattggaacctggttcccaggcagcagcccatgttgctgagatccgtaagaggaagggattgaaggagcagatgaccccacttgctgagtacgaggacaagctgtaaggttgagaataactcagcttctgccgctatattttctgctgcaatttagttttgtttcggtgtctgtctcttaatgttttggtagtagttttggggtgccttcacccatacaatcttatcatgcaaggtcatttcagtctttttcagacgccttttacaatgtacttcgccctccatc

SEQ ID NO: 2127 - DNA, 3063 bp, Manihot esculenta
gtctggttactgaagagagacactcggaaagccctctcttctttcgccgcctctgtctcgactcttttgtcccttataagagggaggaaggaaggctgttgtaaactgattgagtttaggattgccttctaatatcgttatacttagtgatagcaattagtggtgaactctaaagactagtcaaaatggtgaagtttacagctgaggagcttcgtcgaattatggatttcaagcacaacattcgtaacatgtctgtcatcgcacatgtcgatcatgggaagtcgactcttacagattctcttgtggctgctgctggtatcattgcacaagaagttgctggtgatgtccgtatgactgatacccgtcaggatgaagcagagcgtggtattacaattaaatctactggtatctcactctactatgaaatgagtgatgaggcacttaagagttacaagggggagaggaatggaaatgagtatctcatcaatctcattgattcccctggacacgttgacttttcatctgaagtcactgctgctcttcgtataaccgatggtgcacttgtggtggttgattgtgttgagggtgtctgtgtccaaactgaaactgtgcttcgtcaggctttgggtgaaaggatcagacctgtcttgaccgttaacaagatggacaggtgtttccttgagctccaggttgatggagaggaggcttatcaaacatttcagcgggtaattgaaaatgctaatgtcatcatggcaacatatgaagatcccctccttggggattgtcaggtctaccctgagaaaggaactgttgctttttctgctggtttgcatggttgggctttcaccttgacaaactttgccaagatgtatgcctcaaagtttggagtggatgagtctaagatgatggaaaggctatggggtgagaatttttttgacccggctaccaagaagtggactacgaagaacactgggtctccaacttgcaagcgtggctttgtgcagttctgttatgagccgatcaagcagattatcaatacttgcatgaatgaccagaaggataaattgtggccaatgttgcaaaagctcggagtcaccatgaagtccgaggagaaggatttgatgggcaaggctttgatgaagcgtgttatgcagacctggcttcctgcaagcaatgctctcctggaaatgatgatctttcaccttccttctccttccaaggctcaaaggtatcgtgttgagaacttgtatgagggtccacttgatgatccttatgctactgctatcagaaactgtgatcctgaggggccccttatgctttacgtttctaagatgattccagcttctgacaagggtaggttctttgcttttggtcgtgtattttctggcaaggtctcaactggtctaaaggttaggatcatgggtccaaactatgtacctggtgagaagaaagacttgtatgttaagagtgttcagagaactgttatttggatgggaaagaggcaggaaactgttgaggatgtgccttgtggtaacactgtagctatggttggtttagatcaatttatcactaagaacgcaactttgaccaatgagaaggaagttgatgcacatcccattcgagctatgaagttctccgtctcacctgttgtgcgtgtcgctgtgcaatgtaaggttgcatctgatctgcccaagcttgttgaaggtctaaagcgtttggccaagtcagatcctatggttgtatgtaccattgaggagtctggagagcacatcattgctggtgctggggaacttcacctggagatttgcttgaaggatttgcaagaagatttcatgggtggagcagagatcatcaagtcagaccctgttgtgtccttccgtgagactgtccttgagaaatcttgtcgggttgtgatgagcaagtcccccaacaagcacaatcgtctctacatggaggcaaggcctatggaggatgggcttgctgaggccattgatgatggccgtattggtccaagggatgatcccaaggcacgagctaagatattgtccgaggaatttggttgggataaggatctggctaagaagatttggtgttttggtcctgagactactggacctaacatggttgttgatatgtgcaagggagtgcagtaccttaatgaaatcaaggactcggtcgtagctgggttccagtgggcttcaaaagaaggtgcactggctgaagaaaacatgaggggcatttgctttgaagtatgtgatgtggttcttcatgctgatgctattcacagaggtggtggtcaggtcattcccactgctaggagggttatctatgcatctcaactcacagctaagcccaggcttcttgagccagtttacttggttgagatccaagcccctgagcaggcccttggaggtatttacagcgttcttaaccagaaacgtgggcacgtctttgaggaaatgcagaggcctggcacccccttatacaatatcaaggcgtatctccctgttatagagtcttttggattctccagtactttgagagctgccacctctggacaggctttcccacaatgtgtgtttgatcactgggacatgatgtcttctgatccactcgaagcaggttcgcaggctgcacagcttgttgcagacatccgcaagaggaagggcttgaaggagcagatgactcctttatccgagtacgaggacaagttgtaagcggttcatcaagttgatgagctgcaaaatttgctattgcttttcagtttgctctctgttccttacattatgagttaatgtctagtattagatgtttttcaatgggagtagttcatctttgatgccacatttcccttttaggagttttgagtatgatgaggactattaattattgttttgcggttttaaagttatcatgatttgaactctttcgaggaatatttgcgagagttgctctcgtttttcttttttctctctcgtggtttggtttctcttgtaatattttcggaagctattcgaggattaaacttgataggaagattaatcaatgtttttggtgatgatt

SEQ ID NO: 2128 - DNA, 2881 bp, Vigna unguiculata
tactttcgttagagaaggcagcaccactctcttcgccgcctctctctctccctcttccagttttgactcattttttggtggaaaataaagactagtcaaaatggtgaagttcacagctgaagagctccgtcgtattatggactttaagcacaatatccgtaatatgtctgtcattgcccatgttgatcatggaaaatcaactctgaccgattctcttgtggccgctgctggcattattgctcaggaagtggctggtgatgtccgaatgactgataccagggcggatgaagctgagcgtggtatcacaatcaagtctactggtatctcactctattacgagatgagtgatgaatctctgaagaatttcaagggagaacgtaatgggaatgagtatctcattaatctcattgactcccctggacatgttgacttctcatctgaagttactgctgcactccgtattactgatggagccctagtcgtggtggactgtgttgaaggagtttgtgtccaaactgaaactgtgctgcgtcaagctctgggagaaaggattaggcctgttctgactgtcaacaagatggacaggtgcttccttgaactccaggtggatggagaggaggcttaccaaacattccagagggttattgagaatgctaatgtcatcatggctacttatgaagatccacttctgggtgatgttcaggtctacccagagaaaggaactgttgctttctctgcagggttacatgggtgggcttttaccttgactaactttgccaagatgtatgcttcaaagtttggagttgatgaaggcaagatgatggagagactctggggtgaaaacttctttgatccagccacaaagaaatggaccagtaagaacactggatctgctacctgtaagcgtgggtttgttcagttctgctatgagcccatcaaacagatcattaacacttgcatgaatgaccagaaggataagctgtggcctatgctcctaaaacttggtgtcaccatgaaatctgaggagaaggacctcatgggtaaagcattgatgaagcgtgtcatgcaaacctggcttccagcaagtactgccctattggaaatgatgatctttcatcttccctctccttcaactgcccagaagtaccgtgtggaaaatttgtacgagggtccacttgacgatcaatatgctgcagctatcagagcctgtgaccctgagggtcctctgatgctctatgtgtcaaagatgattccagcatctgacaagggtagattctttgcttttggacgtgtgttctctggcagggtttcaactggtttgaaagtgaggattatgggaccaaattatgttcctggagagaaaaaagatttgtatgtcaagagtgttcaacgtactgtcatttggatgggtaagaggcaggaaactgttgaggatgtgccatgtggtaacacagttgctatggttggtttggatcaattcatcacaaagaatgctacattgacgaacgagaaggaagttgatgctcaccctattagggcaatgaagttttctgtctccccagttgtgcgtgttgctgttcagtgcaaggttgcctcagatcttcccaaacttgttgaaggtctcaagcgattggccaaatcagatcctatggttgtttgtaccattgaggagtctggtgagcacattgttgctggtgcaggggagcttcatcttgagatctgtttgaaggatttgcaggatgatttcatgggtggagctgagatcattaaatctgaccctgttgtgtcattcagggagactgtgctggagaggtcatgccgcactgtgatgagcaagtcaccaaacaagcacaaccgtctgtacatggaagcaaggccaatggaggagggtctggctgaagccattgatgatggcaagattggaccaagggatgaccccaaggttcgttctaagatcttgtctgaagattatggctgggataaggatcttgctaagaagatttggtgtttcggccctgagaccacaggacccaacatggtggttgatatgtgtaagggagtgcagtatctgaatgaaatcaaggattctgtggttgctggattccagtgggcatcaaaagaaggtgcattggctgaggagaacatgaggggtatctgctttgaagtatgtgatgtcgttcttcacgctgatgctatccacagaggtggtggtcagatcattcctactgccaggagagtgttctatgcttcacagcttactgctaaacccaggcttcttgagcctgtctacctggttgaaatccaggctcctgagcaagctcttggtggtatctacagtgttctgaatcaaaaacgtggtcacgtttttgaggaaatgcagaggccaggtaccccactctacaacatcaaggcatatctccctgtcattgagtcatttggtttctcaagcaccttgagggctgcaacatcaggccaagctttcccacagtgtgtctttgatcactgggacatgatgtcctctgacccattggaggctggatcacaagctgcacagctggtggcggacattcgcaagaggaagggcttgaaggaacagatgactcctctttctgagtatgaagacaagctttaaaatcttttattttagaactatttatttttcaacttattagctgaatttatcttccgaaaccttagttttaaatttttgtcgagttttgtttgtggttttgtcagtgacttgttgtacttgttatttgtgcttgcgtcgatgtatttttgttgctccataggattttgcatcgatgtttcgaactatttctgcgaattttgctttaaacatactatatcaatatttgtgtggtgcaaaaaaaaaaaaaaa

SEQ ID NO: 2129 - DNA, 2839 bp, Elaeis guineensis
gccatcgcttctgaggttgcggctgtgctttcttggtccggtggaacatacctgagcatcttttgttgaatcttcagagcaggcaagatggtgaagttcacagttgaagagctccgtaggattatggacatgaagcataacatccgtaacatgtctgtcatagcacatgttgatcatggcaagtctactctcactgattctcttgtggcggctgctggaatcatcgcccaggaagttgctggtgatgtcaggatgactgatacccgccaggatgaagcagaacgtggtatcacgatcaaatctacagggatctctctttactatgagatgagtgatgagtctttgaagaactataagggtgagaggaatggcaatgagtatctcatcaatctcattgattcacctgggcatgttgacttctcttctgaggtcactgctgctctccgtatcactgatggtgcattagtcgtcgttgactgtgtggagggtgtttgtgtccagaccgaaactgttcttcgacaagcgcttggagaaagaatcagacctgtcttgactgttaacaagatggatagatgtttcttagagcttcaggttgatggggaggaagcctatcagacctttcagcgtgtcattgagaatgcaaatgttattatggcaacctacgaagatccacttcttggtgatgtccaagtctatccagagaaagggactgttgctttctcagctgggttgcatggttgggctttcactctcaccaactttgccaaaatgtatgctgccaaatttggagttgatgaggccaagatgatggaaagactttggggtgagaattacttcgacccagcaaccaagaagtggaccaacaagaacacaggttctcctacttgtaagcgtggctttgtacaattttgttatgaaccaatcaaacaaattatcagaacttgcatgaatgatcagaaagacaaattatggccgatgctgcagaaacttggtgtcagcatgaaatctgacgagaaggaacttatgggcaaggctttgatgaagcgtgtcatgcagacctggctgcctgcaagcagtgccctccttgaaatgatgatcttccaccttccatctccttccaaggcacagaagtaccgtgtggagaacttatatgagggcccactagatgatgtatatgcaaatgctatcagaaattgtgacccagaaggccctcttatgctatatgtttcaaagatgattcccgcttctgataagggtagattctttgcatttggtcgggttttctctggaagggtctctacaggtatgaaggttcggatcatgggaccaaactatgtcccaggtcagaaaaaagacttgtatgtgaagagcgtgcaaagaactgttatctggatgggtaagagacaagagtctgtagaggatgtgccttgtggaaacacagttgccatggttgggttagatcaattcatcaccaagaatgcaactcttacaaatgagaaggaagccgatgcccatccgataagagctatgaaattttctgtttctcctgttgtacgcgtagcagttcaatgcaagattgcatctgaccttcccaagcttgtggaaggtttaaaacgtctggccaaatcagatcctatggtggtctgtacaatagaagaatctggtgagcacatcattgcaggagctggggagctccaccttgagatttgtttgaaagatttgcaggaggatttcatgggaggtgcagagattgtagtctctgatcccgtggtctctttccgtgaaactgtcctggagaaatcttgccggactgtgatgagcaagtcaccaaacaagcacaatcgtctctacatggaagcacgacccatggaagatgggcttgctgaggccattgatgaagggcgcattggcccacgagatgatccaaaagtacgtgcaaagattctgtctgaggagtttggttgggacaaggatcttgctaagaagatctggtgctttgggcccgagaccactggtcctaacatggtcgttgatatgtgtaagggagttcagtaccttaatgaaattaaggactctgttgtggctgggttccagtgggcgtcaaaggaaggagcaatggctgaagaaaacatgcgtggaatatgctttgaagtatgcgatgtggttctgcatgctgatgctattcacagaggtggtggtcagatcattccaactgctagaagggtcatatatgcatctcagttgacagccaaaccacggctgttggaaccagtttacctggtagagattcaggctcctgagcaggcacttggaggcatttatggtgttctcaaccagaagcgaggccatgtctttgaagagctacaaaggccaggtactcccctttacaacatcaaggcttacctcccagtcatcgagtcttttgggttctcgggcactctgagggctgccacatctggtcaggctttcccccagtgtgtgtttgaccactgggacatgatgtcttcggacccattggagcctggtactcaagcagcacagcttgtgagcgacatccgcaagaggaaaggcttgaaggatcagatgaccccattatctgaatatgaagacaagctctaagttattacgagttatgcatctagtcttatctcgtatctgtcccacctaccagagtctttttgcaggtagttcctgtatttgttttctttcatgttttttcatgtccttggatattaatttctgatgtgttatttgaacaattcctaatggcaaagtatgttgtcgagatgctttatacatctttgctaagcaaggcactgtcaagatattgagacagttt

SEQ ID NO: 2130 - DNA, 2900 bp, Arachis hypogaea
ggggattctctcgttctcaacgcaatttagagagaggccaagccgtaacccttggccgccgctctatattgtcttcttcttctcttctcaattttgctttcactctttcagctctgaaggatttcttctgtgggaaataaagattagtcaagatggtgaagttcacagctgaagagctccgtcgtattatggactacaaacacaacattcgtaatatgtctgtgattgctcatgtcgatcacggaaaatcaaccctcaccgattctctggtggctgctgctggaattattgcacaagaagtggcaggggatgtccgcatgactgatacccgggcagatgaagctgagcgtggtattacaatcaagtctactggtatttctctctactatgaaatgagtgatgaagccctcaagaattacaagggagaacgccaaggaaatgagtatctcatcaatctcattgattcacccgggcacgtcgatttctcatcagaggttactgctgcactccgtattactgacggagctctagtggtggtggattgtatcgaaggtgtctgtgtgcaaaccgaaactgtgctgcgacaggcccttggagaaaggattaggcctgttctgactgtcaacaagatggacagatgcttcctggagctccaggtggatggagaggaggcttaccagaccttctcaagggttattgagaatgccaatgtgatcatggctacatatgaagatccattgcttggtgattgccaggtatacccagagaaaggaacagttgctttctctgctggtttgcacggctgggcttttaccttgacgaacttcgcaaaaatgtatgcctcaaaattcggtgttgatgaatcaaagatgatggaaaggctctggggtgaaaacttctttgatcctgctacaaagaaatggaccagcaagaacactggtagtgccacatgcaaacgtgggtttgtacagttctgttatgagcccatcaagcaaataatcaacacttgtatgaatgaccagaaggataaactctggcctatgttgcagaagttgggagttaccatgaagtctgatgagaaggaattgatgggtaaagcattgatgaaacgtgtcatgcaaacctggctcccagcaagtactgccctcttggaaatgatgatatttcaccttccatctccagctaaggcccaaaagtatcgtgttgagaacttgtatgagggtcccctggatgatcaatatgctgctgctattagagcctgtgatcctgagggtccacttatgctctatgtctctaagatgattcctgcttctgacaagggtcggttctttgcttttggtcgtgttttctctgggagagtgtccactggtctgaaggtcagaattatgggaccaaattatgttcctggtgagaagaaagacctgtatgttaaaagtgtgcaaaggactgtcatttggatgggaaagaggcaagaaacagtggaggatgttccttgtggtaacacagttgccatggttgggttggatcaatttatcaccaagaatgccacattgacaaatgagaaggaagttgatgcccaccccattcgagccatgaagttttctgtctcacctgttgtgcgtgttgctgttcagtgtaaggttgcatctgatcttcctaagcttgttgagggtctcaagaggttggccaaatctgatcctatggttctctgtactattgaggaatctggagagcacattgttgctggtgctggggagcttcacttggaaatttgcttgaaggacttgcaagaagatttcatgggaggagctgagattatcaaatctgaccctgttgtgtctttccgcgagactgttcttgagaggtcatgccgcactgtgatgagcaagtcacccaacaagcacaaccgtctctacatggaagctaggccaatggaggatggtcttgcagaggccattgatgatggcaagattggaccgagggatgaccccaaagttcgttccaagatcttgtctgaagagtacggttgggacaaggatcttgccaagaaaatctggtgttttggccctgagacaactggacccaacatggttgttgatatgtgtaagggagtccagtacttgaatgaaatcaaggactctgtggttgctggtttccaatgggcatcaaaggaaggtgctcttgctgaagaaaacatgagagctatctgcttcgaagtctgcgatgtagtcctccacgctgatgctatccacagaggtggtggtcagattatccccactgccaggagagtcttctatgcttcccagttgactgccaagcccaggcttcttgagcctgtctacttggttgaaatccaagctcctgagcaggctcttggtggtatttacagtgttctgaaccagaagcgtggacacgtgtttgaggaaatgcagaggcccgggactccactctacaacatcaaggcttacctccctgtcattgagtcctttggattctccagcaccttgagagccgcaacttccggtcaagctttcccacaatgtgtatttgatcactgggacatgatgtcttcagatccattggagtctggatcacaggctgcacagcttgttatggatatccgtaagaggaaaggtttgaaggagcaaatgacgcctctatccgagtacgaggacaagctttaaattgtttcctgctgttctattttatggtattaggtaagtttttgatggtgtaaaattgttatctgaatagtttacaagttccattatcttgaattttgttagtctggttttgctccctgggttgttgtacttggaattatttgtctctgcattgatgtatatctgatatataagattgcatcgatatttgtcatattatttcttgagaattttgct

SEQ ID NO: 2131 - DNA, 2907 bp, Populus trichocarpa
atgcattttctgatagagtgagtgaccctaaaaaactactctcctattcactctttcgccgcctcctcgtccctgttttgtcatactaattaattttttaggagctagacaagatggtgaagtttacagcagaggagcttcggcgtattatggacttcaagcacaacatccgtaatatgtccgttatcgctcatgttgatcatggaaaatcaactctcactgattctcttgtcgctgctgctggtatcattgcccaagaggttgctggtgatgttcgaatgactgatacccgggcagatgaggcagaacgtggtatcacaatcaaatctactggtatctctctatactatgagatgtcagatgaatccctcaagagattcaagggagagaggcatggaaatgagtatcttatcaatcttatagactctccaggacacgttgacttttcatctgaggtcacagctgctcttcgtatcactgatggcgctctggtcgttgtggactgtattgagggtgtgtgtgtccagactgaaactgtgcttcgacaggctttgggtgagaggatcaggcctgtcctgacagttaacaagatggacaggtgtttcctggagctccaggttgatggagaggaggcgtttcagacattttctagggttattgagaatgccaatgtcatcatggcaacctatgaagatcccctccttggtgactgtcaagtctaccctgagaagggtaccgttgctttctctgctggtttgcacggctgggctttcactttgaccaactttgcccagatgtatgcctcgaagtttggagtggatgagtctaagatgatggagaggctgtggggcgagaacttttttgatcctgctaccaagaagtggaccaccaagaacactggttctgctacttgcaagcgtggttttgtgcagttttgttatgagccaatcaaacagattattaaaacgtgcatgaatgatcagaaggataaattgtggcccatgttgcaaaagcttggtgttgtcatgaagtctgatgagaaggacttgatgggaaagcctctgatgaagcgtgtgatgcagacctggctgccagcaagcactgctctgcttgaaatgatgatctttcacctgccctctcctgcaacggctcagagataccgtgtggagaacttgtatgagggtccccttgatgatgcttatgccaatgctatcaggaattgtgaccctaatggccccctcatgctctacgtgtctaagatgattcctgcttctgacaagggtaggttctttgcctttgggcgtgttttcgctggaaaggtaacaactggtctgaaggttaggatcatgggaccaaactatgtgcctggtgagaagaaggacttgtatgtgaagagtgtgcagaggactgttatttggatggggaagaggcaagaaaccgttgaggatgtgccttgtggtaacactgttgccttggttggactggatcagttcatcactaagaatgccactttaactaatgaaaaggaagtcgatgcccatcctattcgtgctatgaagttctctgtctcgcctgttgtgcgtgtggctgttcagtgcaaggtagcatctgacctccccaagctggtggaaggtctgaagcgtttggcgaagtctgatcccatggttgtctgtagcattgaggaatctggagagcatatcattgctggagctggagagctgcaccttgagatctgtttgaaggatttgcaggatgattttatgggtggggcagaaatcataaagtctgaccctgttgtgtcgttccgtgagactgtcatagataagtcctgccgtgtggtgatgagcaaatctcctaacaagcacaaccgtctctacatggaggcacggcccatggaagaagggcttgcagaggctattgatgatggtcgtattggtccaagagatgatccaaagattcggggcaagatcttgtccgaggagtttggttgggacaaggatcttgcaaagaaaatctggtgctttggtcctgagaccaccgggccaaacatggttgtggatatgtgtaagggagttcagtaccttaatgaaatcaaggattctgttgttgctggtttccagtgggcttcaaaggaaggtgccttggctgaagaaaacatgcgaggtatctgctttgaagtctgtgatgtggttcttcattccgatgccattcacagaggtggtgggcaggtcattcctactgccaggagggttatctatgcctcccagctgactgccaagcccaggctccttgagcccgtgtacatggtggagatccaagcccccgagcaggctcttggtggcatctacagtgttcttaaccagaaacgtggtcatgtgtttgaagaaattcagaggcccggtacccccctgtacaatatcaaggcgtacctccctgttgtcgagtcttttggattttccggcactttgagggctgcaacatcaggacaggctttcccacaatgtgtttttgatcattgggacacgatgtcttctgatccaatggaagccggtacacaagcagcacagcttgttgcagaaatcaggaagcgaaagggtttgaaggagcagatgaccccattatctgatttcgaggacaagctgtgagcatttcaggatggtgttcaagaaacttgattagctttgagagatatgacgatacagagtggcattgatgctgcttggtttgttgcagtcttcttatcttcgattctaaatttcgttactctggattagtaattgccctgtggaaacaggtggaattctttctgtctcgtgttttgttgcgtcgtagtaactccagtcatgttgtgatgaagttggtatgctttaaagtttaaattattcgggtatttatcgtcttatattt

SEQ ID NO: 2132 - DNA, 2858 bp, Prunus persica
tggacagatactaattatatttttggaggtgacatttgaagactagtcaagatggtgaagttcacagctgaggagctccgtaggattatggactacaaacacaacattcgtaacatgtctgttattgcgcatgttgatcacgggaagtcaacccttaccgactcccttgttgctgctgctggtatcattgcacaagaagttgctggtgatgtccggatgacagatacccgtgcagatgaggcagagcgtggtatcacaatcaaatctactggtatctctctctactatgagatgactgatgaagctttgaagagctacaagggggagagaaacggaaatgagtacctcatcaatctcattgattcccctgggcacgttgacttttcatctgaagtcacagctgcccttcgcattactgatggtgcacttgtggtggttgattgcattgagggtgtttgtgtccaaacagagactgtgcttcgtcaagccttgggagaaaggatcaggcctgttttgactgttaacaagatggacaggtgcttccttgagctccaggtcgatggagaggaggcttaccaagcattccaaagggttattgagaatgctaatgtcattatggctacatacgaagacccccttcttggtgatgtccaggtctatccagagaaaggaacagttgccttttcagctggtttgcatggttgggcttttactctgaccaactttgccaagatgtatgcatccaagtttggagttgatgaatcaaagatgatggaaaggctctggggtgagaactactttgacccagctaccaagaaatggaccagcaaaaacactggttctgctacctgcaagcgtggtttcgttcagttctgttatgaacccatcaagcagattatcaacatctgcatgaatgatcagaaggagaagttgtggcccatgttgacaaagcttggtgtgacgatgaagagtgatgaaaaggagctgatggggaaggcgttgatgaagcgtgtcatgcagacctggctaccagccagcagtgcccttttggaaatgatgatctttcaccttccctctccttcaactgcccagagataccgtgttgagaacttgtacgagggtccccttgatgatcaatatgcaaatgctatcaggaactgcgatcctgaagggcctcttatgctctatgtatctaagatgattcccgcatctgacaagggtcgattctttgcctttggtcgtgtctttgctggtaaagtccagacaggtttgaaggttagaatcatgggtccaaattatgttcctggagagaagaaggatttgtatgttaagaacgtgcagaggactgttatttggatgggaaagaaacaagaaactgttgaggatgttccttgtggtaacactgttgccttggtcggtcttgatcagtttatcaccaagaatgctacgttgacaaatgagaaggaagcggatgctcaccccattcgtgctatgaagttctctgtttcacctgttgtgcgtgttgctgttcaatgcaaggtggcttctgaccttcccaaactggttgaaggtctcaaacgtctggccaagtctgatcctatggttgtctgttccattgaggaatccggtgagcacattattgctggtgctggtgaacttcatcttgagatttgtttgaaggatctacaagatgatttcatgggtggagctgagattataaaatctgaccccgttgtgtctttccgtgagactgtcctggagaagtctagtcgtactgtgatgagcaagtcacccaacaagcataaccgtctgtatatggaagctcgacccttggaggaaggtcttcctgaggccattgatgatggccgtattggcccaagagatgatcccaaaattcgttccaagatcttggctgaagagtttggttgggacaaggatcttgctaagaaaatctggtgttttggccctgagaccaccggtcctaacatggtggtggatatgtgtaagggagttcagtacctgaatgaaattaaggactctgttgttgctggtttccagtgggcttcaaaggaaggtgcattggcagaagaaaacatgaggggtatttgctttgaagtctgtgatgtggttcttcatgctgatgccatccacagaggaggtggtcaggtcattcccactgctaggagggtcatctatgcttcccagatcactgccaagccaaggctccttgaacctgtatatcttgttgaaatccaagctccagagcaggctcttggtggtatctacagtgttcttaatcagaaacgtgggcatgtgtttgaggaaattcagaggcctggtaccccactctacaacatcaaggcctacctccccgtcattgaatcttttgggttctctggtcaactgagggcttcgacttcagggcaggccttcccgcaatgtgtctttgatcattgggagatgatgtcgtctgatccattggaagttggatcccaggctgcgcagcttgttacagatatccgcaagaggaagggcttgaaggagcaaatgaccccgctatccgagtttgaggataagctttaaacaatttactgtgctattagttttttgtcctgccaattggcctgaggagattgcactacaatatttttggtctttagctattttaatttgttggttctgtcctccgttactgttagggacttgtagcttcatcttccctgttatgatgttccgtttggtgaacttcttactctattttctacatgggttatgatatatatcgtactttctcttctattttcacatctgtgttccttttgtttattttattaccatctgtaaacaaattattccac

SEQ ID NO: 2133 - DNA, 2963 bp, Fragaria vesca
actctgccgcctctctcgtcacctggtcgtaactttaattactgagaggtgacattaacaatcagtcaagatggtgaagtttacggcagaagagttgcgtaggattatggactacaagcataacatccgtaatatgtccgttattgcccatgtcgatcatggtaaatcaacccttacggactcccttgttgctgctgccggtatcatcgcacaagaagttgctggtgatgtccggatgacagatacccgtgctgatgaggcagagcgtggtattacaattaaatctactggaatctctctttactacgagatgactgacgagtctttgaagatgttcaagggagagaggaacggaaatgagtacctcatcaatctcatcgattctcccgggcacgttgacttttcatctgaggttactgctgctcttcgtattactgatggtgcccttgtggtggtggattgtattgagggcgtgtgtgtccaaacagagaccgtgcttcgtcaagccttgggagaaaggatcaggcctgttttgactgttaacaagatggacaggtgcttccttgagctccaggtggatggtgaggaggcctaccagaccttccaaagggttattgagaatgccaatgtcatcatggctacctatgaagaccctcttcttggtgatgtccaggtctaccccgagaagggaactgttgctttctctgctggtttgcacggttgggcattcacccttaccaactttgccaagatgtatgctgataagtttaaagttgatgaggcaaagatgatggaaaggctctggggtgagaacttttttgacccagcaacgaagaagtggaccagcaagaacactggttctcctacgtgcaagcgtggtttcgttcagttttgttatgaacccatcaagcaggttattgctacctgcatgaatgaccagaaggataagctgtggcccatgttgacaaagctaggaatcaccatgaagggtgaggaaaaagatctgatgggaaaaccattgatgaagagggttatgcagacctggctgccagccagcagtgccctactggagatgatgatctttcaccttccctctccacatacagctcagaggtatcgtgtggagaatttgtacgagggtcccctggatgatcagtatgctaatgccatcagaaactgtgacccagatggtcctcttatgctctatgtgtctaagatgattcccgcatctgacaagggtaggttctttgcctttggccgtgtgtttgctggaaaggtccaaacaggtttgaaggttagaatcatgggacctaactatgttcccggagaaaagaaggatctgtatgtcaagaatgtacagaggactgttatctggatgggaaagaaacaagaaactgttgaggatgttccctgtggtaacactgttgccttggttggtctggatcagttcatcaccaagaatgctaccttgacaaatgagaaggaaacagatgctcaccctattcgtgccatgaagttctctgtgtctcctgttgtgcgtgttgctgttcagtgcaaggttgcttcagatcttcccaagcttgtggaaggtctcaaacgtctggcaaaatcggatcctatggttgtttgttctattgaggagtctggagagcacatcattgctggtgctggtgaacttcaccttgagatctgtttgaaggatcttcaggatgattttatgggtggagctgagattattaaatctgaccctgttgtgtccttccgtgagaccgttcttgagaagtcatgccgtactgtgatgagcaagtctcccaacaagcacaaccgtctctacatggaagcacgcccattggaagatggtcttgctgaggccattgatgatggtcgtattggtccaagggatgatcctaaaatccgctcaaagatcttggctgaggaattcggttgggacaaagatcttgctaagaagatctggtgttttggtcctgagaccactggtcctaacatggttgttgatatgtgtaagggagtccagtacctcaatgaaatcaaggattctgttgttgctgggttccagtgggcttcaaaggaaggtgcattggctgaagaaaacatgaggggtatttgctttgaagtttgtgatgttgttctccatgctgatgctattcacagaggaggtggtcaggtcattccaaccgccaggagggtcatctatgcttctcagattacagccaagccaaggcttcttgaacctgtgtatcttgttgagattcaagcccctgagggtgctctcggtggtatctacagtgttctcaatcagaagcgtggacatgtttttgaagaaatgcagaggcctggtaccccactgtacaatatcaaggcatacctgcctgttgttgaatcctttgggttctctggccagttgagggcttccacttcaggacaggctttcccccagtgtgtgtttgatcattgggagatgatgtcttctgatccattggagactggttcccaggcatctcagctggttcaagacatccgtaagaggaagggtttgaaggagcaaatgaccccgctttccgatttcgaggacaagctttgagagactaattttatcggtcccattgatgaggaaagttcctctgctgctcgtagtacgattcactgcctattttttgtttcagtttttcatttcttgtttgaagttaccctgttgttgttgtagtcagcattctgttgaagtagcgacattttgtgcttgcccataacaagattatgtaattttgttatgttcatgttggtacattatattttgatttgagcttttacaatataagtctagtgtttgttccattcgagcttctctactattatatcttggcaggcatacatatgatttgctattataatttatcatggtatctggtatctgtattttgattagcagtaaaatataacaacag

SEQ ID NO: 2134 - DNA, 2886 bp, Tabernaemontana elegans
acgcactctctatccagagcggctgcagcttgtaaggtcactgagtgccttacccttttggcttgccgccaacttctctcttctattgcttaggttttgtcagaaaaagagaaattttgaacccatttttctgtaatatctgctaacctgtcaagatggtgaagttcacagttgaagagcttcgtaggattatggactacaagcacaacattcgtaatatgtccgtcattgcacatgtggatcatgggaagtccactctgactgattctcttgtcgctgctgcgggtatcatagctcaagaagtagctggtgatgtccgaatgacagatacaagagcagatgaagctgagcgtggtatcactatcaagtccactggaatttccctttattatgagatggctgatgaagctctgaaaggctacaagggggagcgacaaggaaatgagtacctcatcaaccttattgattctcctggacacgttgacttctcatctgaagttacagctgcccttcgtattactgatggtgcactagttgttgttgattgtatcgagggggtttgtgtccagactgaaactgtcctccgacaggcccttggtgagaggattcgacctgtcctgactgttaacaagatggacagatgtttccttgagcttcaggttgatggagaggaggcttaccaaacattccagaaggttattgagaatgccaacgttatcatggctacgtatgaagatcctcttctaggtgatgtgcaggtttatccagagaaaggaacagttgctttctctgctgggttacatggctgggcatttactttgactaactttgctaagatgtatgcctctaagtttggtgttgatgagtctaagatgatggaaagactttggggtgagaatttctttgatcctgctaccaaaaagtggaccagtaaaaacactggttctgctacatgcaagcgtggctttgttcagttctgctatgagcctatcaagcagatcatcagcacttgtatgaatgatcagaaagataagctctggcccatgttgcagaagcttggtgttaccatgaagtctgaagaaaaagatttgatgggtaaggcattgatgaaacgtgtcatgcagacatggcttccggcaagtaatgccctgttggaaatgatgatctttcatcttccatctccggccaaggcccagagataccgtgttgagaacttatatgaagggcctcttgatgatgcttatgctactgctatcaggaactgtgatcctgagggtcctctcatgctttacgtgtctaagatgattccagcatcagataagggacgattctttgcttttggccgtgtttttgctggcaaagtggccactggtttgaaagtcagaatcatgggtcccaactatgttcctggagagaaaaaggacctctatgttaagaatgtccagagaacagttatttggatgggtaagaggcaggaaactgtggatgatgtgccttgtggaaacacagttgccatggttggtttggatcagttcatcaccaagaatgccactttgaccaatgagaaggaagttgatgctcatcctattcgagcaatgaagttctctgtctcacccgttgtgcgtgttgcagttcaatgcaaggttgcatctgatcttcccaaacttgttgaaggcctgaagcgtctggctaaatctgatcctatggttgtctgcacaattgaagaatctggggagcatattattgctggtgctggtgaactccaccttgagatttgtttgaaggatttgcaagatgacttcatgggtggtgctgagattatcaagtctgatccagttgtgtccttccgcgagacagttcttgagaagtcttcccgtactgtgatgagcaaatctcctaacaagcataatcgtctatacatggaagcaagacccatggaagaaggacttgcagaggccattgatgatggacgcattggtcctagggatgatcctaagacccgtgccaagatattggcagaggagtttggatgggacaaggatcttgcaaagaaaatctggtgttttggtcctgagaccactggtccaaacatggtggttgatatgtgtaagggagtacaatacttaaatgaaattaaggattctgttgttgcaggtttccagtgggcttccaaggaaggtgctttggctgaagaaaacatgagaggtatttgctttgaggtctgcgatgttgttcttcatgctgatgccattcacagaggtggtggccagattattcctactgctaggagggttatttatgcttcccaaattactgccaagccacgccttctggaacccgtgtacctggtggaaattcaagcaccagagcaagctcttggaggtatttacagtgttctgaaccagaaacgtggacacgtctttgaggaaatgcagaggccaggcacacccctgtacaacatcaaggcctaccttcctgtcatcgagtcatttggtttctcaggtacattgagagctgctacctcaggacaggcattcccacaatgtgtgtttgatcattgggacatgatgtcatctgacccactggaatctggatcccaagcttctcagcttgttgctgatatcagaaagaggaagggtttgaaggagcagatgacgccactatcggagttcgaggacaagctgtaaatcagctgatcaaactttctgagattgcttatggaagctgggcagtataattttgtccttttcttcatattttattttgtccggacttctgtttaggttttgagtgagtcgtagcccatgttttcccgtgaaatgccgccctttacttattttacattgttaggattgtcgtgtagaagacattaatgttgtggtgttt

SEQ ID NO: 2135 - DNA, 2832 bp, Taxus baccata
taaatatcaagttgtcttttggtgaataaaagagttctgcaaaatggtgaagttcacagctgaagaactccgtaggattatggacttgaaacataacatacgaaatatgtcagtcattgcccatgttgatcatggaaagtccactcttactgattctttggtggcagcagctggtatcattgctcaagaagttgctggtgatgttagaatgactgatactcgtgcagatgaagctgagcgtggtattaccattaagtcgacaggaatctccttgtattatgagatgacggatgcatctctgaagagtttcactggtgaaagggtcggaaatgagtacctgataaatctgattgattctccagggcatgttgacttctcttctgaggttacagcagccttgcgtatcacagatggtgcattggttgtggtagattgtattgaaggagtttgtgtacagacagaaactgttcttagacaggccctcggagaaaggattaagccagttcttactgtgaacaagatggataggtgttttcttgagttgcaggtcgaaggagaggaagcttatcagacatttttacgtgtgattgaaaatgcaaatgtgattatggctacctatgaagatcctcttctcggtgattgccaagtgtatccagagaaaggtactgttgcattctcagccggtctacatgggtgggcgtttactttgacaaattttgctaaaatgtatgcttcaaagtttggagtagatgaatccaagatgatggagaggttgtggggtgagaactattttgacccagctacgaagaagtggacatcgaaaaacacgggaacagctacttgcaaaagaggttttgttcaatttatatatgaacccattaagcagattataaaaatttgtatgaacgatcagaaggataagttatggccaatgttgcagaagctgggagttgttatgaagagtgaggagaaggaacttgcggggaaggccctaatgaaacgtgtaatgcaaacttggctacctgcaagtacagctctacttgagatgatgattttccatcttccatctccatctaaagcacagagatatcgtgtagagaacttatatgaaggccctcttgatgatatatatgcaactgcaattagaaattgcgaccctgaaggaccattgatgttgtatatttctaagatgattcctgcttctgacaaggggcgcttctttgcctttggccgtgtcttcgctggaaaagtatcaacaggtcagaaagtaaggatcatgggtcctaactacgtgcctggtcagaagaaggacctgtatgtaaagagtgtccagaggactgtgatttggatgggaaaaaaacaagaatctgttgaggatgtaccttgtggaaatacagtggctctggttgggttagaccagttcatcactaagaatgctaccctcacaaatgagaaggaggttgatgcacatccgatcagagcaatgaagttctctgtctcacctgttgtacgtgttgctgtgcagtgcaaggtagcttctgaccttccaaagcttgttgaagggttgaagcgtcttgctaagtcagatcctatggttgtgtgtactattgaagaatctggtgagcatattattgctggagcaggagaacttcaccttgagatttgcttaaaggacttgcaagatgatttcatgggtggagctgagattgttgtatctgatcctgttgtctcatttagagaaactgttctggagaagtcagtccgtactgtaatgagcaaatctccaaataagcacaacaggctttattttgaagcacgacctcttgaagaaggtcttcctgaagcaattgatgatggtcgcattggccccagggatgatcctaaggctcgtgccaaaattctctctgaggagtttggatgggacaaagatctggctaaaaagatttggtgctttggacctgaaactactggacccaacatggtggttgatatgtgtaagggagttcagtacttgaatgaaattaaggattcagtggttgcagcatttcagtgggcatccaaagaaggtgctctggctgaggagaatatgcgtggcatatgctttgaggtttgtgatgttgttttacatactgatgccattcatagaggaggtggtcagattattccaacagcacgaagggttatgtatgcagctcagcttactgctaaacctaggcttcttgagccagtatatcttgtggagattcaggctcctgaacaggcgcttggaggtatttatggtgtgctgaatcagaagcggggtcacgtttttgaggaaatgcagagaccaggaactccactctataacatcaaggcatatctgccggttgtggagtcatttgggttctcaggtactctccgagctgcaacttctggtcaggctttccctcaatgtgtgtttgatcactgggatatgatgggttcggatccaatggagcatggtactcaagctgagaaactcgttattgatatccgtaagaggaaaggtctgaaagagcagatgactcccttgtcagagtttgaggataagctgtaaagctcatttctatagttgataaggttgacatactattgtgtttgacaagatcggaacatttctggatgatggatagtctcttgatcaaacggctctcctgttgagtatgaatactttcactaagtttctgcatatcaggatatttcttgtgattttattagtagttttgattattattaaatgatctcgttttgaatgttgaaatttagaccaattgaagctttgttgctagtttggatgggtgggtggtttgcttg

SEQ ID NO: 2136 - DNA, 2801 bp, Olea europaea
ccaactaattttttcttgtcttttttgagttgtgaaatttagaaaacagtcaaaatggtgaagttcacagctgatgagctccgcaggattatggactacaagcacaacattcgcaatatgtcggttattgcccatgttgatcacgggaagtccacacttactgattctcttgttgctgctgctggtattattgctcaagaagttgctggtgatgttagaatgacagatacccgtgctgatgaggctgagcgtggtatcactatcaagtccaccggtatctctctgtattatgagatgtctgacgagtctttgaagagctacaagggagagcggaatggcaacgagtacctcatcaatcttatcgattctcctggacacgtcgacttctcatctgaagtgacagctgctcttcgtatcactgatggggctcttgttgtggttgactgtgttgaaggcgtgtgtgtccaaacagaaacagtcctccgacaggcccttggagaaaggattagacctgttttgactgttaacaagatggacaggtgtttccttgagctccaggttgatggagaggaggcttaccaaacattccagagggtcattgaaaatgcaaatgtcattatggctacttacgaagatcctctcttgggtgatgttcaggtttaccccgagaaaggtaccgttgccttttctgctggtttgcatggctgggctttcaccctaacaaacttcgccaagatgtatgcctccaagtttggtgttgatgaggggaagatgatggaaaggctctggggagagaatttctttgatccagccacaaagaagtggaccaccaagaataccggttcacctacatgtaaacgtggatttgttcaattctgttacgaacctatcaagcagattattaacacttgcatgaatgatcagaaagataagctctggcccatgttacagaagcttggtgttgttatgaagtctgatgagaaggatttaatggggaaggcattaatgaagcgtgtgatgcagacatggcttccagctagtactgccctcttagaaatgatgatcttccaccttccatcaccttctaaggcacaaaggtaccgtgtggaaaatttgtacgagggacctatggatgattcttatgctactgctattaggaactgtgatcctgatggccctctcatgctttatgtgtcaaagatgattccagcatctgataagggtaggttctttgcgtttggtcgtgtattctccggcagggtctcgactggtttgaaggtcagaatcatgggtcctaactatgtcccgggagagaaaaaggacttgtatgtcaagagtgttcagagaactgttatttggatgggtaagaggcaggaaactgttgaggatgtaccgtgtgggaacacagttgctatggttggtctagatcaatacatcaccaaaaatgcaaccctgaccaatgaaaaggaagtcgatgcacacccaattagagcaatgaagttctccgtgtcacctgttgtacgtgttgctgttcagtgcaaggttgcgtctgaccttccgaagcttgttgaaggtttgaagcgtttggccaagtcagaccctatggttgtctgtaccattgaggagtctggtgagcatattattgctggtgctggagaactccacctggagatatgcttgaaggacttgcaagaagatttcatgggtggtgctgaaattataaaatcagatccagttgtgtccttccgtgagacagttcttgagaggtcctctcgcattgttatgagcaaatcacctaataagcacaaccgtctgtacatggaagccaggccgttggaagagggacttgctgaggctattgacgatggacgtattggtccaagagatgatccaaagcttcgttctaagatcttgtctgaggagttcggttgggataaggagcttgcaaagaaaatttggtgcttcggtcctgagacaactggtccaaacatggtggttgatatgtgcaagggagtccagtaccttaatgaaattaaagattctgttgttgctggttttcagtgggcttcgaaggaaggcccattggctgaagaaaacatgaggggcatctgcttcgaagtttgtgacgtggttcttcatgctgatgctattcacagaggtggtggtcaggtcattccaactgctaggagggttatttatgcctcccatctgactgccaagccccgtcttttggaaccagtgtacttggtggagattcaagcaccagagcaggctcttggtggtatctacagtgtcctgaaccagaaacggggacacgtgtttgaggaattgcagaggccaggtactccactttataatatcaaggcatacttgcctgttatcgaatcatttggtttctcaagtaccttgagagccgcaacttctggacaagcctttccccagtgcgtgtttgatcactgggacatgatgtcatctgatccattggaagcagggtcgcaggctgcacagcttgtgattgatattcgaaagagaaagggtttgaaggagcagatgacaccactctccgagtttgaggacagactgtgagtcaataaaggcttaaacctttgtgaatttattacctctgcgcgctgtaaaatttataatttttctggttcttatattttcggtgttctattaaactcttgagtccgctcccagattctgatatttgttgcttttagatgtcactaggacaaagagtgttgctattcttcattgctttatcctgaaccatttccctttcgagaatcttggtagaa

SEQ ID NO: 2137 - DNA, 2839 bp, Arnica chamissonis
agatcaaagctgaggcacagagagctaattccccttgcggctgcttcctctcttttgcttataggattttgttagtggctatttaaaatacatttttgtcggggctctgaacactcggcaaaatggtgaagtttactgctgaagagcttcgaaggattatggacttcaagcataacattcgtaatatgtctgttattgctcatgttgaccatgggaaatccaccttgactgattcgcttgtggctgctgctggtatcattgcccaagaagttgctggtgatgttcgtatgactgatacccgtgctgatgaagcagaacgtggaatcacaatcaaatccacgggtatctcactttactatgagatgactgatgcagctctaaaagccttcaagggagaacgaaatgggaatgagtacctgattaatcttattgactcacctgggcatgttgacttttcttctgaagtcactgctgccctacgtatcactgatggtgcactggtggtggttgattgtatcgaaggtgtttgtgtgcaaacagaaactgttcttagacaagctcttggagaaagaatccgacctgttttaactgtcaataaaatggacaggtgcttccttgagcttcaggttgatggtgaagaagcgtatcaaacatttcaaagggttatcgaaaatgctaatgtcatcatggccacttacgaggacccacttcttggtgatgtcatggtttaccctgagaaaggtactgttgctttctcagcaggtcttcacggttgggcttttactctaaccaactttgcaaagatgtatgcatccaaatttggtgttgatgaatctaaaatgatggaaaggctttggggagagaactactttgacccaaaaaccaaaaagtggaccacaaagagcaccggtgctgcaacttgcaaacgtgggtttgtgcagttctgttatgagccaattaagcaggttattaacacttgcatgaatgaccaaaaagatcagttgtggcctatgttgactaagcttggtgtctccttgaaatctgatgagaaagagttgatgggtaaggccttgatgaagcgtgttatgcagacttggcttcctgctgctactgctctacttgaaatgatgatttttcatctgccatcacctcacactgcccaaagataccgtgttgagaatctttatgagggtccgttggatgatcaatatgctaatgctattagaaactgtgacccggaaggtccccttatgctttatgtttctaagatgattcccgcttctgacaaaggtagattctttgcatttggtcgtgtttttgctgggaaggtttctactggtttgaaagttaggatcatgggtcctaactttgtccctggtgaaaagaaggatttatacgtgaaaagtgttcagaggactgtcatctggatgggaaagaagcaagaaactgttgaagacgtgccatgtggaaacacagtggctctagttggtttggatcaattcatcacaaaaaacgcaactctaaccaatgaaaaagaagttgatgcccatccgatccgagccatgaagttttctgtctcgcccgttgtgcgtgttgcggttcagtgcaaggttgcatctgatctccccaagcttgttgaaggtctgaaacgtctggctaaatccgaccctatggttgtctgcaccatcgaggagtctggtgaacacatcattgctggtgctggtgagctgcatcttgaaatctgtttgaaggatctgcaagacgatttcatgggtggtgctgaaatcgttgtttcagaccccgtcgtgtctttccgtgaaactgtcttggagaaatcatcccgaactgtgatgagcaagtcccctaacaaacacaaccgtctctacatggaagctagacccctggaggacggtcttgccgaggctatagatgatggcaggattggtccacgtgatgatcccaaggttcgtggaaaaatcttatctgaggaattcggttgggataaggatttggctaaaaagatctggtgttttggtcctgaaaccaccggccccaacatggtagttgacatgtgtaagggagttcagtatcttaatgaaatcaaggattcagtggttgctgggtttcagtgggcttctaaggaaggcgctttggctgaagaaaacatgaggggtatttgttttgaagtttgtgatgtcgttctccatgctgatgccatccacagaggtggcggtcaagttattccaactgccaggagagtcatatatgcatcccagctcaccgccaagccacggttgctcgagccggtctacttggttgaaattcaggcaccagagcaagccctgggtggaatctacagtgtgctgaatcaaaggcgtgggcatgtgtttgaagaaatgcagaggcaaggtacccctctgtacaacattaaggcatatctccctgtggtggaatcattcgggttttcaggtgctttgcgagcatctacttcgggtcaagcttttccacaatgtgtgtttgatcattgggacatgatggggtcagacccattggaggctggatcccaggcaagcacacttgtcactcagatccgtaagaggaagggtttgaaggagcagatgacaccgttgtctgattttgaggataagctgtgagcggtgaaaacattggcagagatcttatcattaattatctcctctgggtttgtctttgttatattttctataatgtttttttagcatgctgtatcgtgttatgttttattgtcatgagaacctaccaacctgcagacaatggtgctgttaattttgacattcttgttttactatttctggttaag

SEQ ID NO: 2138 - DNA, 2983 bp, Cycas rumphii
  misc_feature (901)..(901): n is a, c, g, or t
  misc_feature (2325)..(2325): n is a, c, g, or t
  misc_feature (2355)..(2355): n is a, c, g, or t
  misc_feature (2499)..(2499): n is a, c, g, or t
  misc_feature (2505)..(2505): n is a, c, g, or t
gaagctccattcgatgaaacgaaaaatctctaaaggctttgactgtataataatcttaattttaggttttccatcggccgaaatcctttataaaccctagtgagcaaaggaagtctttccttcactgtgttgaggagagccgccttgagctctcgttttatagcttccatcgtcgcttgggaagcaattttgcggcgtcggcagatcttttgcgcctcttcctgctagaggcattttttaatttacttcatttaggtgacacaagaattagcaaagatggtgaaattcactgcagaagagctccgtaagattatggacttgaagcataacatacgcaacatgtctgttattgcgcatgttgaccatggaaaatctacccttacagattctttagttgcggcagcagggattattgctcaagaagttgctggagatgtaaggatgactgatactcgtgcagatgaagctgaacgtggtatcaccatcaagtcaaccggcatctccttgtattatgagatgtcagatgaatcccttaaaatgtataaaggggaacgctcaggtaatgagtacttgatcaatttaattgattctcctgggcatgtcgacttctcatcagaagttacagctgctctccgtattacggatggagctttggtagttgtggattgtgttgaaggtgtgtgtgtccagaccgagactgtacttcgtcaagctctgggagaaaggattagaccagtccttactgtgaacaagatggacaggtgtttccttgaattacaagttgatggggaggaagcctatcaaactttctcacgagtcattgaaaatgcaaatgtgattatggctacttatgaggacccacttcttggtgatgtccaagtttatccagagaaagggactnttgcattttcagctggtctgcatggttgggcttttaccctgacaaactttgcaaaaatgtatgctacaaagtttggagttgatgaagctaagatgatggaaaggttgtggggtgaaaactattttgatccagctactaggaaatggacaagcaaaaacacaggttcagcaacctgcaaaagaggttttgttcaatttatatatgaacccatcaagcagatcatcaatatttgtatgaatgatcaaaaagataagttgtggcccatgttacagaagctgggagttactatgaagaatgaggagaaggatctggttgcaaaggcactgatgaaacgtgttatgcaaacctggcttcctgctagcagtgcccttcttgaaatgatgatatttcatcttccttctccatccaaagcacagaaatatcgtgtggaaaatttgtatgaaggacctcttgatgatcaatatgcaaatgcaattagaaattgtgatcctgatgggccattgatgttgtatgtttcaaaaatgattccagcctcggataaagggcggttttttgcctttggccgtgtgttttctgggagagtggcaacaggtatgaaggtaaggattatgggtcccaattatgttcctggtcagaaaaaggatttatatgtaaagagtgttcagaggactgttatatggatgggaaagaagcaggagtcagttgaggatgtgccatgtggaaacactgtggccatggttgggttagaccaatacatcactaagaatgctactctgacaaatgagaaggaggttgatgcccaccctattagagcaatgaagttctctgtctcccctgtcgtccgtgttgctgtgcagtgtaaggttgcttctgatcttccaaagctggttgaggggctgaagcgtcttgcaaagtcagatcctatggttgtctgtacaattgaagaatctggggaacacatcattgctggtgctggagagcttcaccttgagatatgcttgaaagacttgcaagaagattttatggggggagctgagattgtggtgtctgatcctgttgtttctttcagagaaacggtgctggagaagtcaaatcacactgtgatgagcaagtctccgaataagcacaacaggctttattttgaagccaggcctttggaagaaggtcttcctgaagcaattgatgatggtcgtattgggccaagggatgaccctaaggttcggtccaagattcttgctgaggaatttggttgggacaaagatctcgcgaagaagatctggtgctttgggcccgaaacaactggtcccaacatggtggttgatatgtgcaagggagttcaatatttgaatgaaattaaggattctgtagttgctgcatttcagtgggcatccaaggaaggtgcccttgcagaagagaacatgcgnggtatttgttttgaggtttgtgatgtggtnttgcatgctgatgccatccacagagggggtggtcaggttattcccacagcaagaagggttatgtatgctgctcagcttactgccaaaccaaggcttcttgaaccagtgtatctggttgagattcaggcacctgagcaggctctnggtggnatttatggtgtgctgaaccagaagagaggtcatgtgtttgaggaaattcagaggccgggaactccactttataacatcaaggcatacctgccagttattgaatcttttgggttctcgggcactctcagggctgcaacttctggccaggctttccctcaatgtgtgtttgatcattgggatatgatgagttctgatccaatggaaacttcttcacaagctgggcagctagtgattgatatccgcaagaggaagggtttgaaggagcagatgacccctctttctgagtacgaagataagctttaaaaatacttcatattttccataccaggttttgtagcgacttttagcagttagtcttttctcatattccatggcttttgccaggacagaattttgttttcttattgtgttttaaatgaacaatttaatttgttgtgcttatgtcatttatttgaatgaacggttctgtttggatata

SEQ ID NO: 2139 - DNA, 2757 bp, Eschscholzia californica
agtatttaggttaccctctctcgcttggtcatctgtttttcttcatccgctgctgaacctccgtagccgctccagaggaacgtttctcatacagatagagtttatccctttgaaattgaaaaggagtaaaaatggtgaagttcacagcagaagagctacgcaggattatggacctgaaacacaacatccgtaatatgtctgtcattgcccacgtcgatcatggcaaatccactcttaccgattctttggtggccgctgctggtatcatcgcacaagaagttgctggagatgtacgaatgaccgacacccgtgctgatgaggcagagcgtggtattacaatcaagtccaccggtatctctctctattacgagatgaccgacgcttctttgaaggccttcaagggagaaagaatggggaatgagtatctcatcaaccttattgattcacctggtcacgttgacttctcttccgaggtcacagctgcattgcgtattactgatggtgcccttgtggtggtcgattgcattgaaggtgtttgtgtccaaaccgagactgtccttcgccaggcccttggagaaaggattaggcccgttttaactgttaacaagatggacaggtgctttctcgaactacaggttgacggagaggaggcttatcagaccttccagagggtcattgagaatgccaatgtcattatggctacctatgaagacccacttctcggtgatgtccaagtttaccctgagaaaggaactgttgccttctctgctggtttgcacgggtgggctttcactctgactaatttcgccaacatgtatgcatcgaagttcggagttgatgtgactaagatgatggagaggctgtggggtgagaacttctttgacccggcaaccaagaaatggaccagcaagaacactggatctccaacttgcaagcgtgggttcgtccagttctgttatgaacctattaagcagattattaacacttgcatgaacgaccagaaggacaagttgtggcctatgttgcagaagcttggagttacaatgaaatctgaagagaaagatctgctcggtaaacccttgatgaagcgtgtgatgcaaacatggctcccagcaagtactgctctacttgaaatgatgatctttcaccttccatctccttccactgctcaaagataccgtgttgagaacttatacgaggggcctcttgatgaccaatatgccaacgctatcagaaactgtgatcctgaaggacccctcatgctttacgtgtctaagatgattcccgcacctgataagggtagattctttgcttttggtcgtgttttctctggtaaggttgcaactggtatgaaagttcgaatcatggggcctaactttgttcctggccagaagaaagacttgtatactaaaagtgtccagaggactgtcatctggatgggaaagaggcaagaatcagttgaggatgtaccttgtggtaacacagttgctatggtgggtctggatcaatttatcaccaagaatgctactctaacaaatgagaaagaagttgatgcccatcctatcagagccatgaaattttcagtatctcctgttgtccgtgtcgctgtccagtgcaaggttgcttccgacctacccaaacttgttgaaggactcaagcgtcttgccaagtccgatcctatggttgtctgttcaattgaggagtctggggagcacattattgctggtgcaggagaactccacctcgagatttgcttgaaggacttgcaagatgatttcatgggtggagcagaaatagtcaagtctgacccagtcgtgtccttccgtgagactgttctcgacaaatcatgcagaactgtgatgagcaagtctccaaataagcacaaccgtttgtacatggaagcacgaccccttgaagatgggcttgctgaggcaatcgacgacggcagaattggtccaagagacgaccccaaggtccgctcaaagatcttatccgaggaatttggatgggacaaggatctagccaaaaagatctggtgtttcgggcccgagaccactggaccaaacatggttgtagacatgtgtaagggagtacagtatcttaatgaaatcaaggactctgtcgttgctgggttccagtgggcttcaaaggaaggagcattggctgaagaaaacatgaggggaatatgttttgaagtatgtgatgttgttctcacgctgatgccatccacagaggtggtggacaagtcatccccacggccagaagagctatctatgcctcacaaatcactgccaagcccaggctattggagccagtctacctagtggagatccaggcgccagagcaggctcttggtggtatttacggggttctgaatcagaaacgtggtcacgtcttcgaagaaatgcagaggccgggtactccactatacaacattaaggcttatcttcctgtcgtcgagtcctttggattttctagtcagcttcgtgctgcaacatcaggacaggctttcccacagtgtgtatttgatcattgggacgtcatgtcttctgatccatatgaagctggaagccaggctgctgtcctagttgcagacgtcaggaagagaaaaggggtttgaaggaacagatgacaccactttctgaatatgaagacaagctataagcaacaatggtgggtatgttttttgatttcatgaaacaatattatatttttgttattctgtctggattttgggttatggatatttgaagtttt

SEQ ID NO: 2140 - DNA, 3014 bp, Lactuca sativa
taagagggtagcgctatattagggttttagagaggcatacgccgctcactttatatctctcgttgtagaccaaagccaaaggtctctgagagctcatctatcttcgccgccgctctctctcgttttcttttaggatttctgttagaagcattcaaactacatttttgttcgagacaactaaacaccagtcaaaatggtgaagttcacagctgaagagcttcgtaggattatggactacaagcataacattcgtaacatgtctgttattgctcatgttgatcatggaaaatccactttgactgattcccttgtggctgctgctggtatcattgcccaagaagttgctggtgatgtccgtatgactgacacccgtgccgacgaggcggaacgtggtatcaccatcaagtccactggtatctccctttactatgaaatgaccgatgcagccctcaaggccttcaagggagaaagaaacggaaacgagtacctcatcaatctcattgactcacccggacacgttgacttttcctcagaagtcactgctgcccttcgtatcactgatggtgctctcgtggttgttgactgtatcgagggtgtttgtgtccaaaccgaaactgtccttcgtcaagctctcggtgaaagaatccgacccgtgttgactgtcaacaaaatggaccgatgtttccttgaacttcaagtcgatggtgaagaagcgtatcaaactttccagagagttattgaaaacgcaaatgtcatcatggctacttatgaggacccacttttgggtgatgtcatggtgtaccccgagaaaggtacagtcgcgttttcagccgggctccacgggtgggcgtttacattgaccaatttcgctaaaatgtacgcttccaaattcggtgttgacgagtcaaagatgatggagaggctttggggtgagaactactttgacccaaaaaccaagaagtggactacaaaaagcaccggaacagctacctgcaaacgtgggtttgttcagttttgttatgaacccattaagcagattatcaacacgtgtatgaatgaccagaaggatatcttgtggcctatgttggcgaaactcggtgtcaccatgaaaggagaggagaaagagttgatgggaaaggctttgatgaagcgtgtgatgcagacatggcttccagctgctactgctctacttgaaatgatgatatttcatttgccttcaccacatactgctcagagatatcgtgtggagaatctttatgaaggtcctttggatgatcagtacgccaatgccatcagaaactgtgaccccgatggtcctctcatgctctatgtatccaagatgattcccgcatccgacaagggtcggtttttcgctttcgggcgtgtgttcgcgggtcgggtttctaccggtttgaaggtccggatcatgggtccgaactacgtcccgggcgagaagaaagatctgtatgttaagagtgttcagagaaccgttatctggatgggaaagaaacaagaaactgtggaagatgttccttgtggtaacacagtcgctcttgttggtttggatcagtttattaccaaaaacgccactctaactaatgaaaaggaaaccgaggctcaccctattcgtgccatgaagttttcagtgtctccggttgtccgtgttgcagtccagtgtaaggttgcgtctgatttgcctaaattggttgaaggtcttaagcgattggctaaatccgatcctatggtggtgtgtacaattgaagaatccggtgaacacattattgctggtgctggtgagctccatttggaaatctgtttgaaagatttgcaagatgacttcatgggtggagctgaaattgttgtatctgaccctgttgtgtctttccgtgaaactgttttggagaaatcttcacgcactgtgatgagcaaatcccccaacaaacataaccgtttgtacatggaagcgcgtccaatggaggaaggtttggcggaagccattgacgaagggcgtattggtccacgtgacgacccaaaggtccgaggaaagattctctcagaagaattcggttgggacaaggatcttgccaagaagatctggtgttttggacctgaaacaactggacccaacatggttgttgacatgtgtaagggagtccagtacctgaacgaaatcaaggattcggttgttgctggtttccaatgggcatcaaaggaaggcgcgttggctgaagagaacatgagaggcatctgttttgaagtgtgtgatgttgtgctccatgctgatgctattcatcgtggtggtggacaagttatcccgactgcccgacgtgtgatctatgcgtctcagctgaccgcaaaaccaaggttgttggagccggtttacttggtggaaattcaagcaccggagcaggcgcttggtggaatctacagtgtgctgaatcaaaggcgtgggcatgtgtttgaggagatgcagaggcaaggaacacctttgtacaacattaaagcttatctccctgtggttgagtcttttgggttttctggtgctttgagggcttcgacttcaggtcaagctttccctcagtgtgtgtttgatcattgggatatgatgggttcggatcctttggaggctgggtctcaggcaagtacacttgtgggacagattaggaagaggaagggtttgaaggagcagatgactcctttgtctgactttgaggacaagctgtaagcagcggattggagagtgaggtataattattattcgctgggtttttatttttatgctgtgtcggattttctatattgttttttttttcagttgctactgtggtatgttttgttgttaggtgtcgtgagaactaaacttgtttgcgtacgatgctgttataattttgatgttcttgtttactatttttaagttttgagttttttttacttgttttaatttatagtcttcttaattttttctgatagattaaattatattttgaaaaaatggtattcatagggattgcgag

SEQ ID NO: 2141 - DNA, 2952 bp, Medicago truncatula
atgcaggagtaatagtgttcagcgttgcggcaaccctaacaataaaaacctatcagactctcattttcatcacaaacagccgtctcatctcctccaactgctctgtctgtcggtggagatccgcctttggattcatttctcaacaacactctttttgcgtgtggattatttcaaagactagtcacaatggtgaagttcacagctgatgagttacgtcgtattatggactacaagcacaacatccgtaatatgtctgtcattgctcatgttgaccacggaaaatcgaccttaaccgactctttagtcgctgctgcgggaattattgcccaggaagttgctggtgatgtccgtatgactgacacccgtgctgatgaagctgagcgtggtattacaatcaagagtaccggtatctcactctactatgaaatgactgatgaatctctgaagaggttcaagggggagcgtaatggaaatgagtatctcattaatctcattgattcccctgggcacgtcgacttctcgtctgaggttactgctgcactccgtattactgatggagcacttgtggtggttgactgtgtggaaggtgtatgtgtccaaactgaaactgtgcttcgacaagctcttggagaaaggatcaggccggttctgacagttaacaagatggacagatgcttccttgagctccaggttgatggagaggaggcttatcagaccttctcaagagttattgagaatgctaatgtgatcatggctacatatgaagatccattgctcggtgatgttcaagtgtatcccgagaaaggaacagttgctttctctgctggtttgcacggttgggcttttactctgaccaactttgcaaagatgtatgcctctaaatttggtgttgacgagacaaagatgatggagaggctttggggtgaaaatttctttgatcctgccactaagaaatggaccaccaagaacactggttcagctacttgcaagcgtgggtttgttcagttctgttatgagcctatcaagcaggtcattaacacttgtatgaatgatcagaaggataagttgtggccgatgttgacaaagctagggatcaccatgaaatcagaggagaaggacttgatgggtaagcctttgatgaaacgtgtcatgcagacatggctcccagcaagcactgcacttcttgaaatgatgatctttcatctcccctctccatcaacagctcagaggtatcgtgttgagaatttgtatgagggtccccttgatgatcaatatgctactgctatcagaaactgtgaccctgaaggacctctcatgctttatgtgtcaaagatgattcccgcttctgataaaggaaggttttttgcttttggtcgtgtattttctggtaaagtttcaactggtttgaaggtcagaattatgggaccaaattttgtccctggggagaagaaagatttgtatgtgaaaagtgttcagcgaactgttatttggatgggaaagagacaagaaactgttgaggacgtgccttgtggtaacacagtcgctatggttggtttggatcaatttatcaccaagaatgctacattgacgaatgagaaggaagttgatgcacaccctattcgtgcgatgaagttttccgtctcacctgttgtgcgtgttgctgtacagtgcaaggttgcttcagatcttcctaagcttgttgaaggtctcaaacgtcttgctaagtcggatcctatggttgtttgtactattgaggagtctggtgaacacattgttgctggtgcaggagaacttcatcttgagatctgtttgaaggatttgcaggatgatttcatgggtggagctgagattatcaaatccgaccctgttgtctccttcagagagactgttctagagagatcatgccgcactgtgatgagcaaatcacccaacaagcacaacagattgtacatggaagctagaccattggaggatggacttgcagaggccattgatgagggcacaataggaccaagggatgaccccaagaatcgttctaagatcttgtccgaacagtatggttgggacaaggatcttgccaagaaaatctggtgttttggacctgagaccactgggcccaacatggtggttgatatgtgtaagggagttcagtatttgaatgaaatcaaggattccgtggttgctggattccagtgggcatcaaaagaaggtgctttgtctgaagaaaacatgagaggcatttgctttgaagtatgcgatgttgtcctgcacactgatgctatccacagaggaggtggtcagatcattcctactgctaggagagtcttctatgcctcacagctgacagccaaacccaggcttctggagcctgtttacatggtggaaatccaagctcctgagcaagctcttggtggtatctacagtgttcttaatcagaagcgtggacatgtctttgaagaaatgcagaggcctgggactccactttacaacatcaaagcataccttcctgtcattgagtcctttggattctccagccagttgagagctgcaacatcagggcaggcgttccctcaatgtgtgttcgatcactgggatatgatgtcatcagatccattggaggctggatcacaggctgcaacccttgtgaccgatattcgcaagaggaagggcttgaaggagcagatgacacctctatctgagtttgaagataagctataaatggaaacctatttttgttatgacttagctaatattctgtttaaactgttaccttagtgttgagttctgtttcggctttagcagtaaattgtggtgcacttcgagtgatgtgtctgagtcggtgtatttttggtcttggttgtaagatttgcattcgtgctgtttaaacttatgcaaattttgctttaaactcctattcaatagttttctgctgcttttataaggtggtttgaa

SEQ ID NO: 2142 - DNA, 3150 bp, Sciadopitys verticillata
agctttgaagagcccctctgagttgttggagatttagtgtaattaaccaaatggaggagactcttgattcttttatctttgtttggggttccattcttttcttatcagcggctgcggaaactctttttttcgtaggtctgcagcacgaatcctcgcagagccattctctgttagctggtttcaggcatactttgaagttttaatcaagcggtgttttggggaatataagagttagcgaaaatggtgaagtttacagctgaaggactgcgtaggattatggacttgaaacataatatacgaaatatgtctgttattgcccatgttgaccatgggaaatccactcttactgattctttagtggcagcagctggtattattgcacaagaagttgctggtgatgttagaatgacggatactcgcgcagatgaagctgagcgtggtatcactataaagtcgactggaatctccttgtattatgagatgacggatgaatctcttaagagtttcaagggagacagaatgggaaatgaatatttgataaatctgattgattctccagggcatgttgacttttcatcggaggttacagcagccctccgaatcacagatggtgcattggttgttgtagattgtattgaaggagtttgtgtacagactgaaactgttcttcgacaagctcttggagaaaggattaggccagttcttactgtgaacaagatggataggtgctttcttgagttacaggttgatggggaggaagcttatcagacatttttacgtgtgattgaaaatgcaaatgttattatggctacttatgaggatcctcttcttggtgattgtcaagtgtatccagagaaaggtactgtagcattctcagctggtcttcatgggtgggcttttactttgacaaattttgctaaaatgtatgcttcaaagtttggagtggatgaggcaaagatgatggaaaggctgtggggagagaacttttttgacccagcaaccaagaaatggacatcgaaaaacacaggatctcctacctgcaaaagaggctttgttcaatttatatatgaacccattaagcagattataaacatttgtatgaatgatcaaaaggataagttatggccaatgttgaagaaactgggagttgttatgaagagtgaagagaaggatctggctgggaaggccctaatgaagcgtgtcatgcaaacctggctacctgcaagcagtgccctacttgagatgatgatattccatcttccatctccatctaaagctcagaaatatcgtgtggagaacttgtatgaggggccgcttgatgatatgtatgcgaatgcaattagaaattgtgatcctgaagggccattgatgttgtatgtttcaaaaatgattcctgcctctgacaaggggcgcttctttgcctttggccgtgttttttctggaaaagtagcaacaggaatgaaagtgaggatcatgggtcctaactacgtgcctggtcagaagaaggacttatacgtaaaaagtgtccagaggactgtgatatggatgggaaagagacaagaatcagttgaggatgtgccctgtggaaatacagtggccatggttggcttggaccagttcatcactaagaatgcaactctgacaaatgagaaagaagttgatgctcatccaattagagcaatgaagttctctgtctcacctgtcgtgcgcgttgctgtgcagtgcaaagtagcttctgaccttccaaagcttgttgaagggttaaagcgtcttgctaagtcagatcctatggttgtgtgtacaattgaggaatctggtgaacatattattgctggagcaggagaacttcaccttgaaatttgcctaaaggatttgcaagatgattttatgggaggagctgagattgttgtgtctgatcctgttgtctcatttagagaaacagtgctggagaagtcaacccgtactgttatgagcaagtctccaaataagcacaacaggctctattttgaagcaagacctcttgaagatggtctagctgaagcaattgatgacggtcgcgttggcccaagggatgatcctaaggcacgtgccaaaatcctttctgaagagtttggatgggacaaagatctggctaagaagatttggtgttttgggcctgaaaccactggtcccaacatggtggtggatatgtgtaagggagtacaatacttgaatgaaatcaaggattcggtggttgcagcattccagtgggcttccaaggaaggtgttcttgcagaagagaacatgcgtggtatttgctttgaggtttgtgatgttgttctacatactgatgccatccatagaggaggtggtcagattattccaacagctagaagggttatgtatgcatgccagcttactgccaaaccaaggcttcttgagccagtgtatctcgtggagattcaggctcctgaacaggcacttggtggtatttatggtgtgctgaaccagaagaggggtcatgtctttgaggaaatgcagaggccaggaactccactttacaacattaaggcatatttgccagtcgttgagtcatttgggttttcaggtactctccgtggtgcaactgctggtcaggccttccctcaatgtgtgtttgatcactgggatatgatgagttctgacccactggagcatggtacccaagcagagaaacttgtgtttgacatccgcaaaaggaagggcctgaaagagcaaatgactcccttgtcagagtttgaggataagctgtaaagctgtttccgttaatgttatcaggaaaacatagtattgtgtttgacaagatcgggatatgtctggaggatggagggtcaggatgaaatgactctcctgttgaggatgaacactagtttaagttttgcttactaggacagtttaaataccttttagaaactatttttgttatttctgatttcttttcagataaaccatgtcatctaaattatcatttattatatgtctaccttatctgaaattgctgtgcaactctagagatgtttggcatttactctcaggttgggtatggaaacttaagtttgcatagaaaggaattattcatcttctgttgtctgctgcctctgccgcctttggtgtcattaagaacgaagtttc

SEQ ID NO: 2143 - DNA, 2947 bp, Solanum lycopersicum
attcagtgttgcaaagagaagacctcgccgcctccttctctctgcactgaacaagacgaatttgtagttacattgacagccattcaagatggtgaagttcacagctgaagagcttagaaggattatggacttcaagcataacattcgtaatatgtctgttattgctcatgtggaccatggaaaatctacccttactgattctctggtggcggctgctggtatcattgctcaggaagttgcaggtgatgtcagaatgacagatacacgtgcagatgaggctgagcgtggtatcaccatcaagtccactggtatttcactttactacgagatgactgatgactccttgaggaacttcaagggagagagaaatgggaacgagtacctcatcaacctcatcgattcacctgggcacgttgacttctcatctgaagtgactgctgctcttcgtattactgatggtgcacttgtggtggttgattgtgtggaaggtgtctgtgtccagacagagactgtgctccgtcaggcccttggtgaaaggattcgtcccgtcttgacagttaacaagatggacaggtgtttcctcgagcttcaggttgatggagaggaggcctatcagacattccaaagagttattgagaacgctaatgttatcatggctacatatgaggatccccttcttggtgatgtccaggtttatcctgagaaaggtaccgttgctttctctgctgggttgcatgggtgggctttcactctcaccaattttgccaagatgtatgcttccaaatttggtgttgatgagtctaagatgatggagaggctgtggggtgagaacttttttgaccctgccaccaaaaagtggaccacaaaaaacaccgggacagcttcgtgcaagcgtgggtttgttcaattctgctatgagccaattaagcagattatcaacacttgcatgaacgatcagaaagataaactctggcctatgttgcagaagcttggtgtaaccatgaaatctgatgaaaaagatttgatgggcaaggcactgatgaagcgtgtgatgcagacctggcttcccgcaagtactgctcttcttgaaatgatgatatatcatctcccatcaccgtccacagctcaaaaataccgtgtggagaacttgtatgagggaccccttgatgatgcttatgctaatgctatcaggaactgtgacccagaagggccgcttatgctttatgtatcaaagatgattccagcatctgacaagggtagattctttgcttttggtcgtgtctttgctgggaaggtttctactggtatgaaggttagaatcatgggtcctaactatgttcctggtgaaaagaaggatttatatgtcaagaatatccagcgaactgttatttggatgggtaagaggcaagaaactgttgaggatgttccctgtggtaacactgttgccatggttggtttggatcagtttattaccaagaatgcaacattgaccaatgaaaaggaagtcgatgctcaccctatcagagcaatgaagttttctgtctcaccagttgtgcgtgtagctgttcagtgcaaggtcgcatctgaccttcccaagcttgttgaagggttgaaacgtctggctaagtctgatcctatggttgtttgttctattgaagagtctggagagcatattattgctggtgctggagaactccaccttgagatctgtctgaaggatttgcaggatgactttatgggcggtgctgaaattataaaatctgatcccgttgtgtccttccgtgagacagtcctcgagaagtctactcgaactgtgatgagcaagtcccctaacaagcataaccgtttgtacatggaggctagaccaatggaggaagggcttgctgaggctattgacgagggacgcattggccctagggatgaccctaaggttcgttccaagatcttggctgaggagtttggctgggacaaagatcttgcaaagaagatttggtgctttggtcctgagacaactggtcccaacatggtggtggatatgtgtaagggagttcagtacctgaatgaaattaaggattctgttgttgctggtttccagtgggcttcgaaggaaggtgcattggctgaagagaacatgagaggtatttgctttgaagtctgtgatgttgttcttcattctgatgctattcacaggggtggtggccaagttattcccactgctaggagggttatctatgcttctcagcttactgctaaaccccgcctgttggagcccgtttaccttgtggaaattcaggctccggagcaagcccttggtggtatctatagtgttctgaatcagaagcgtggacacgtgtttgaggagatgcagaggccaggaactcctctttacaacatcaaggcttaccttcctgttgttgagtcttttggattttcaggtaccttgagagctgctacttcaggtcaagccttcccacaatgtgtgtttgatcattgggaaatgatgtcatctgacccattggaagctggctcacaagctcatcaactcgtccttgatatccgcaagaggaagggtttgaaggatcagatgacccctctatccgagtttgaggacaagctgtaaggcatatgtttgagatggcagcagatgatatttaacctgctcaatcgattccgcgaaagttttgttttgcatttatcatctatctgtttggataattactttgatcatcttgtgttgattaggatactagctcgtaagtttgttgttgcagaatttattacctctatcttttctatggacaaaactatttctgtcgtattttattttaagttgccttttacttcaaacattagataattttgctgtgttagtttctaaacaaagtgcaatttcaaatataattaaataatttctctgttgaattagattaattatgcaagtgtttca

SEQ ID NO: 2144 - DNA, 3137 bp, Cicer arietinum
cacaagtcagcaatctaataagatatatatatacgcgtgttaatagctatgcagtttcagtttcgcacttcactttttagggttttctttcttgcggctgtgaagggaagctcttctcattcgttttcgccgcttccctgttctttctcttcgctataacagactcctttgcggactataaagactagtcaaaatggtgaagttcacagctgatgagttacgtcgcattatggactataagcacaacattcgtaatatgtctgtcattgctcatgttgaccacggaaaatcaacattgacagattcccttgttgctgctgctggaattattgcacaagaggttgctggtgatgtccggatgacagatacccgtgcagatgaggctgagcgtggtatcactattaagtctactggtatctctctatactatgaaatgtctgatgagtctctcaagagttacaagggggaacgtaatgggaatgagtatctcattaatctcattgattcacctggacacgttgacttctcatctgaggttactgctgcactccgtattactgatggagcactagtggtggtggattgtgttgagggtgtttgtgtccaaactgaaactgttctgcgacaggctcttggtgaaaggatcaggcctgttctgactgttaacaagatggacagatgtttccttgagctccaggtggatggagaggaggcttatcagacattccagagggttattgagaatgctaatgtgattatggctacatatgaagatccattgctcggtgatgttcaggtgtatcctgagaaaggtacagttgccttctctgctggtttgcacggttgggcatttactctgaccaactttgcaaaaatgtatgcctcaaagtttggcgttgatgaatccaagatgatggagaggctctggggtgaaaacttctttgatccagccacaaagaaatggaccacaaagaatactggttcaccttcttgcaagcgtggatttgttcaattctgttacgagcctatcaagcagattattaacacttgtatgaatgaccagaaggacaagttgtggcctatgctaacaaagctaggagtcaccatgaaatctgaagagaaagacttgatgggtaaggcattgatgaaacgtgtcatgcagacttggctcccagctagcagcgcactattggaaatgatgatctttcatcttccctctccatcaactgctcagaggtatcgtgttgagaatttgtatgagggtccccttgatgatcaatatgctaatgctatcagaaactgcgatcccgaaggacctcttatgctttatgtctctaagatgattcccgcatctgataagggaaggttttttgcttttggtcgtgtatttgctggtaaggtttcaacaggtttgaaagtcagaattatgggaccaaattacgtccctggtgaaaagaaagacttgtatgtgaaaagtgttcagagaaccgtcatttggatgggaaagagacaggagaccgttgaagatgtgccttgtggtaacactgttgctatggttggtttggatcaatttatcaccaagaatgctacattgacaaatgagaaggaagttgatgcccaccctattcgagctatgaagttttctgtctcacctgttgtgcgtgttgctgttcagtgcaaggttgcttcagatcttcccaagctcgttgaaggtctcaaacgtctggctaagtcagatcctatggttgtttgtactattgaggaatctggagaacacattgttgctggtgcaggagagcttcatcttgagatttgtttgaaggacttgcaggatgatttcatgggtggggctgaaattattaaatctgaccccgttgtgtcattccgtgagactgttcttgacagatcatgccgcactgtgatgagtaaatcaccaaacaagcacaacaggttgtacatggaagcaagaccgttggaagatgggcttgcagaggccattgatgaaggcacaattggaccaagggatgaccccaaaatccgttctaaaatcttgtcagagcagtatggttgggataaggatcttgctaagaagatttggtgttttggacctgagaccactggacccaacatggtggttgatatgtgtaagggagtccagtatttgaatgaaatcaaggattctgttgttgctggattccagtgggcatctaaagaaggtgctttagcagaagaaaacatgagagccatttgttttgaagtgtgtgatgttgtcctccacactgatgctatccatagaggaggtggtcagatcattcctactgccaggagagtgttctatgcctcacagctgacagccaaacctaggcttcttgagcctgtttaccttgtggaaatccaagctcctgagcaagctcttggtggtatctacagtgttcttaatcagaaacgtggacatgtgttcgaagaaatgcagaggcctggtactccactttacaacatcaaggcataccttcctgtcgtcgagtcctttggattctccagtcaattgagggctgcaacatcaggacaggctttcccacagtgtgtgtttgatcactgggatatgatgtcatcagatccattggaggctggatcacaagctgcaacacttgttactgatattcgtaagaggaagggtttgaaggagcagatgactccactctccgagttcgaagacaagctttaaattatttaaactgttttatttttatttatcaacttagcttatgttctggtcattgaaactgttacctgagcttttaaagttcagttttttgtgtcattgtgttgtacttcgggatttattgtcgttgaatcactgtatttttgtgcttagtagttgcaggttttgcatccatggtgatcaaaacttattatgcagattttgtgttaaatctgtcctttttcaataactttatgttggttttataacatagttgtgggtttgatgaataattttaccactaattgcaccccgatagcaaggttttgttggctaattgtcaacccgatgacagatataaattatggaaatttatgatgattttatttatttgcaaatgttagaaattagtggttaatttagtttactttttgga

SEQ ID NO: 2145 - DNA, 2768 bp, Zostera marina
tactactattctggcggctcatcagcaggaagtatccgattagatctctctgtactatcattttctaatttggaagaaaagcaaaagaatatggtgaagttcacagcagaggagcttcggaggattatggacttgaagcacaacatccgcaacatgtctgtgattgctcatgtcgatcacgggaagtctactctaactgattctttggtagccgcggccggaatcattgcgcaagaagttgcaggagatgtgaggatgactgacacacgttccgacgaggctgaacgtgggattacaatcaaatcaactggtatatcactgtactatgagatgactgatgaatctttaaagagcttcaaaggggagagaatgggaaatgagtatctcatcaacctcattgactctcctggacacgttgatttctcatcggaggtcacagcagcgctccgtattaccgatggagctttggttgttgtcgattgtatcgagggtgtctgcgtccagactgagactgttctccggcaagctttgggggagagaatcaggcctgtactgacagtcaacaagatggacagatgttttttggaacttcaggtaaacggtgatgaggcttatcagacgttccagcgtgtgattgaaaatgccaatgttatcatggccacctacgaagatgctctcctcggagatgtgcaggtttacccggagaaaggaactgtagctttctccgccggtctgcacggttgggcgttcactcttactaactttgccaagatgtatgcttcgaaatttggggtggatgaatctaaaatgatggaaagactctggggtgaaaactacttcgatccggctactaagaagtggaccagcaaaatgactgcttcccctacctgcaagagaggatttgtgcagttctgttacgagccgatcaagcagatcattaatacttgcatgaatgatcagaaagacaagctctggccgatgttgaagaaacttggagtggtcatgaagtccgaagagaaagagctcatgggtaagccattgatgaagcgtgtgatgcagaattggcttccggcgagtactgctcttcttgagatgatgattttccatctgccctccccacatactgcacagaggtatcgtgtagagaatctgtacgaaggtccgcttgatgatgtgtatgcaaatgctatcaggaattgcgacccaaatggtcctcttatgctctacgtttccaagatgattccggcgtccgacaagggtagattctttgcctttggtcgtgtgttttccggcaaggtttctaccggtgttaaggtccgaatcatgggaccgaattacgtccctggacagaagaaggatctgtacgtgaagagtgtccagagaaccgttatctggatgggaaagaagcaggaatccgtcgaggacgtcccttgtggaaacactgttgcccttgtcggactggatcagttcataacaaaaaacgccacacttaccaacgagaaagaatccgatgctcatccaatccgtgccatgaaattctcagtctcgcctgtggttcgtgttgcggtacagtgcaaggtggcctccgatcttcccaagctggtcgaaggtttgaaacgtcttgcaaaatctgaccctatggtgatgtgcatgatagaagaatctggtgagcacattattgccggagccggtgagcttcatcttgaaatctgtcttaaggatcttcaggatgatttcatggggggtgcacagattgtagtatccgacccagttgtttctttccgtgaaactgtcatggagaaatcatctcggacggtgatgagcaagtctcccaacaaacacaatcgtctctacatggaagcacgacctttggaagacggtttaccggaggccattgacgatggtaggatcggccctcgtgacgatcccaaaatccgttccaagatcctcgccgaggaattcggatgggataaggacctggcgaagaagatctggtgctttggaccggaaacaaccggacccaatatggttgttgacatgtgcaagggagtgcaatacctaaacgaaatcaaggactctgttgttgcaggtttccagtgggcgtccaaggaaggagccatggcagaggagaacatgcgtggcatctgcttcgaggtatgcgacgtcgttcttcacgccgacgccatccacagaggcggaggacaggttattccgacagcaaggagagtcatctacgcttctcaaataactgccaagccaaggcttctagagccagtgtaccttgtcgagatccaggcacccgagggcgctctagggggcatctacggcgttttgaaccagaagagaggacacgtgtttgaggagatacaaaggccgggaactcctctctacaatatcaaagcttatcttcccgtcatcgaatcttttgggttctctagcacactccgagcctcgacctccggtcaagcattcccccaatgtgtcttcgatcattgggacatgatgatgtcggatccgttggacccaggtactcaggcagcgacgcttgtcaaggacattcgtaagaggaaggggctaaaggatcagatgaccccactttcggaatttgaagacaagctttgatttatttcccgagtttgccagaaagccctgaactatatataaattttaaatatgtccactgttaaaacttgtagtcatatctcaaagacactttgatattcggagaactatagttcgaatgtcagtgtgtgtattttaattttatt

SEQ ID NO: 2146 - DNA, 2804 bp, Ambrosia trifida
ctcactttatatctctcattctactccaaacctaaaccactcacacctctctgcggccgctctctctctcgtttttttaggattttgttagaagcattttcaccgcatttccgtcgggagctctaacaactagccaaaatggtgaagtttactgctgaagagctccgtaggattatggactacaagcataacattcgtaatatgtctgttattgctcacgtcgatcatggaaagtccactttgactgattctcttgtggctgctgctggtatcattgcccaagaagttgctggtgatgttcgtatgactgatacccgtgctgatgaagctgaacgtggtatcacaatcaaatccactggtatctcactttactatgagatgactgatgaagctttaaaaagcttcaagggagaaaggaacggaaatgagtacctgattaatcttatcgactctcccgggcacgttgacttttcttctgaagtcactgctgccctacgtattactgatggtgccctggtggtggttgattgtattgagggtgtctgtgtgcaaacagaaactgtgcttagacaagctcttggtgaaagaatccggcctgtgttaactgtcaacaagatggacaggtgtttccttgagcttcaggttgatggtgaagaagcataccaaaccttccagagggttattgaaaatgctaacgtcatcatggccacttatgaggacccacttcttggtgatgtcatggtttaccctgagaaaggtactgttgctttctcagctgggctccacggttgggcatttactttaaccaactttgcaaagatgtatgcttccaaattcggtgttgatgaggctaaaatgatggaaagactctggggagagaacttctttgacccaaaaaccaagaagtggaccaccaagagcactggtacagccacatgcaaacgtgggtttgttcagttttgctatgagcccattaagcagattattaacacgtgcatgaacgaccaaaaagatcagttgtggcctatgttgactaagcttggtgtcaccatgaaatctgaagagaaagagttgatgggtaaggcattgatgaagcgtgttatgcagaattggcttcctgctgctaccgctttacttgaaatgatgatctttcatttgccttcacctcacactgcccaaagataccgtgttgagaatctttatgagggtccgttggacgatcaatatgctaatgctattagaaactgtgacccggatggtccccttatgctttatgtttctaagatgattcccgcttctgataagggtagattctttgcctttggtcgtgttttcgccggtagggtttctactggtctgaaggttaggatcatgggtcccaactatgtccctggtgaaaagaaagacttgtatgtgaagagtgttcagaggactgtcatctggatgggaaagaagcaagaaactgttgaagacgtgccatgtggtaacactgtggctatggttggtttggatcaattcatcaccaaaaacgcaaccctaaccaatgaaaaagaggttgatgcccaccccattcgagccatgaagttttccgtctcacctgtggtgcgtgttgcagttcagtgcaaggtcgcatctgatctccccaagcttgttgaaggtcttaaacgtttggctaaatctgaccctatggttgtctgtaccattgaggagtcaggtgaacacatcattgctggtgccggtgaactgcatcttgaaatctgtttgaaggatctgcaagacgatttcatgggtggtgctgaaattgttgtttcagaccctgttgtgtctttccgtgaaaccgtcttggagaaatcatcccgaactgtgatgagcaagtctcctaacaagcataaccgtctctacatggaagctagacccatggaggatggtcttgccgaggctattgatgaaggcagggtgggtccccgtgatgaccccaaggttcgtggaaagatcttgtctgaggaatttggttgggacaaggatttggcaaagaagatctggtgtttcggtcctgaaacaaccgggcccaacatggttgttgacatgtgtaagggagttcagtatcttaatgaaatcaaggattcagtggttgcaggttttcagtgggcttctaaggaaggtgctttggctgaagagaacatgagaggtatttgttttgaagtgtgcgatgtcgttctccatgctgatgctattcacagaggtggtggtcaagttattccaaccgccaggagagtcatctacgcctcccagttgaccgcaaagccacgtctacttgagccagtttacttggttgaaattcaggcaccagagcaagccctaggtggaatctacagcgtgctgaatcaaaggcgtggacacgtgtttgaagaaatgcagaggccgggtaccccactctacaacatcaaggcttatctccctgtggtggaatccttcgggttctctggtgctttgagagcttcaacttcgggccaagctttcccgcaatgtgtgtttgatcattgggacatgatgggttctgatccattggaagttgggtcccaggcaagcacactcgtgacccagatccgtaagaggaagggtttgaaggagcagatgacaccactctctgagtttgaggacaagctgtgagcactggctgaaatgttatcgaccgggtttcatcatattttctataatgttttttagcttgctggatgtattttgttatgttttgttgtcgtgagaagctacttacctgcagacaatgatgtcgttaattttga

SEQ ID NO: 2147 - DNA, 2847 bp, Amorphophallus konjac
ggtgaagtttacggcagaagagctgcgtagaattatggacttgaagcataatatccgaaacatgtctgtcattgctcatgttgatcatggcaagtctactctcacagattctcttgttgcggctgctgggatcattgcacaagaagttgcaggagatgtccgaatgacggacactcgccaggatgaagctgaacgcggtatcacgatcaaatctactgggatctctctgtattatgagatggatgctgatgatttgaaggactttaagggtgaaagaagtgggaatgaatatctcattaacctcattgattcacctgggcacgtggatttctcttctgaggttacagctgctcttcgtatcactgatggtgcactggttgtggtggactgtgtggaaggggtgtgtgttcagactgagaccgtacttcgacaagcccttggagaaaggattaggcctgtcttgactgtcaacaagatggacaggtgcttccttgagctccaggttgaaggtgaagaggcctatcagaccttcctacgtgtcattgaaaatgctaatgttatcatggccacttacgaagatccccttcttggcgacgtacaagtttatccggagaaggggactgttgccttttctgctggtttgcatggttgggctttcactttgacaaactttgccaaaatgtatgccagtaagtttggtgttgatgagagtaagatgatggagcggctttggggagaaaacttctttgatcctgctacgaagaagtggaccaccaagaacacgggttctcctacctgcaagcgaggatttgttcaattctgttacgaaccgatcaagcaaatcatcagtacatgcatgaatgatcagaaggacaaattgtggcctatgcttcagaagctcaaagttaccatgaaatctgaagacaaggatctgactgggaaggcgctgatgaaacgtgtcatgcagacttggttgccagcaagtgatgcccttcttgaaatgatgattttccatctcccttctcctgcgaaggcacagaaatatcgtgtggagaacttatacgagggtcctttggatgatatctacgcaaatgcaatcagaaattgtgatccggatgggcctctcatgctctatgtctcaaagatgattccggcctctgacaagggtaggtttttcgccttcggacgagttttctctgggaaagtttccaccggtatgaaggttagaatcatgggtccaaactatgtccctggccagaagaaagatctgtatgtgaagagtgtgcagaggactgtgatttggatgggtaagaagcaagaatctgttgaggatgtaccttgtggaaacacagttgcaatggttggcttggatcaatttatcaccaagaatgcgactctgacaaacgagaaggaagttgatgcccatcccattagggcaatgaaattttctgtttctccggtcgttcgcgttgcagtgcaatgcaaggtcgcttctgatctccctaagcttgtcgagggactgaaacgtttagctaagtcagatcctatggtggtgtgtgcaatggaggaatctggtgaacacattgttgccggagctggggagctccacctcgagatatgcttgaaagatttgcaggaagatttcatgggaggtgctgagattattgtctccgacccagtcgtctctttccgtgaaactgtgctcgagaaatcctgcaggactgtgatgagcaaatctcccaacaagcacaaccgtctttacatggaagctcgcccgatggaagaaggccttgccgaggccattgacgaagggcgcattggccctagggatgatcctaaagctcgtgccaagattctgtcagaagagttcggctgggataaggatctcgccaagaagatctggtgttttggccctgaaaccacgggtccgaacatggttgtcgacatgtgcaagggagttcaatacctcaatgaaattaaggactccgttgtagctggcttccagtgggcgtcgaaggaaggtgcggtggctgaggaaaacatgcgaggcatatgctttgaggtgtgcgatgtggttctacacgctgatgccatccacaggggtggcggacaggttattcctacggcacgtagggtcatctatgctgcgcagttgactgccaaacccaggctgctggagccagtctacctggttgagatccaggcgccagagcaagcgctcgggggtatatatggtgttctcaaccagaagagaggccatgtgttcgaagaactgcagaggcccggtactcccctttacaacatcaaggcatacctcccggttatcgagtccttcggtttctcgagtacactcagggcagcaacatcagggcaagccttcccccagtgtgtttttgatcactgggacatgatgtcctccgacccattggattccggctctcaggcagcacagatcgtgtcggatattcgcaagaggaagggcctcaaggagcagatgactcccctctccgagtacgaggacaagctgtgaggcggcgcacgtgtctaccacacctgggtttggcggcccttcacctgcttctcttgagactactgtggcctctgttttgaggcgatttcttcctcggtgcttgtccttattaaggcaagttctcggactcgttctattgttgtccatttgacattccaacattctgcatttgatcaacttccaacagaacatggtaattggtgtaatagcaacaggattgaggtatctgttttctctcgggggtttttttctcacccttctctgaggttgatcggtagttgcattttcctttgagagagattgagagactaccggcc

SEQ ID NO: 2148 - DNA, 2931 bp, Cannabis sativa
taattttggtatttgcaggtgaagtttacagcagaagagttgcgtaggatcatggatcttaaagaaaacatccgtaacatgtccgttattgctcatgtcgatcacggaaaatctacccttaccgactctttggtggctgctgccggtattatcgcacaagaagttgctggtgatgtccgtatgactgatacccgtgctgatgaggccgagcgtggtattactatcaagtccactggtatctctctctactaccaaatgtctgatgaatcattgagctgctacaaaggagagagaaaagggaatgagtatcttatcaatctcattgattcacctgggcacgttgacttttcctctgaggtcactgctgctcttcgaattactgatggtgctcttgttgtggttgattgtattgagggtgtttgtgttcaaactgaaactgtgctcaggcaggcccttggtgaaaggattaggcctgttttgacagtgaacaagatggacaggtgtttccttgagcttcaggtggatggtgaggaagcttaccaaactttccagagggttattgaaaatgctaatgtcattatggcaacttatgaagatcctcttctcggtgacgttcaggtctatcccgagaaaggaacagttgccttctctgctggtttgcacggttgggctttcactctaaccaactttgctaacatgtatgcttccaagtttggagttgatgagtctaagatgatggaaaggctctggggtgagaacttttttgaccctgccaccaagaaatggaccagcaagaacactggctctcctacctgcaagcgtggtttcgttcagttttgttacgagccaatcaggcaaatcattgccacttgtatgaatgaccagaaggataagctgtggcctatgttgaagaagcttaatgtcaccatgaagaatgatgagaaggagcttatgggcaaggcattgatgaagcgtgtcatgcagacatggctacctgcaagtagtgctctattggaaatgatgatctttcacttgccatctcctgcaacagctcagaagtaccgtgttgagaacttgtacgagggtccccttgacgatcagtatgcaactgctattaggaactgtgatcctaatggtcctcttatgctttatgtatctaagatgattcccgcttctgacaagggtagattctttgctttcggtcgtgttttcgctggtaaggtgtctactggtatgaaggtcaggattatgggccccaactttgttcctggtgagaagaaagatctgtatgtcaagagtgttcagagaactgttatctggatgggaaagaggcaggaaaccgttgaggatgttccctgtggtaacacagttgccatggtcggtcttgatcaatttattaccaagaatgctactttgaccaatgagaaggaagtagatgcacacccaatccgtgctatgaagttctctgtgtcgcctgttgttcgtgttgcagtccagtgcaaggttgcatctgatcttcccaagcttgttgaaggactcaaacgtctggccaagtctgatcctatggttgtgtgtaccatcgaggaatctggtgagcacattattgctggtgctggtgaacttcatcttgagatctgtttgaaggatttgcaagatgacttcatgggtggagctgaaatcatcaaatctgatccagttgtgtctttccgtgaaactgtccttgagaagtcagtccgtaccgtgatgagcaagtctccaaacaagcacaaccgtctttacatggaagcaagaccattggaggaaggacttgctgaggctattgatgatggacgtattggcccaagagatgatcctaagatccgatccaagattcttgctgaggagtttggttgggacaaggatcttgccaagaaaatctggtgtttcggtcctgagaccactggtcctaacatggttgttgatatgtgtaagggagttcagtaccttaatgaaattaaggattctgttgttgctggtttccaatgggcatctaaggaaggtgctttggccgaggaaaacatgagaggtatttgctttgaggtatgtgatgttgttcttcacgctgatgctattcacagaggtggtggacaggtcatcccaactgccaggagggttatctatgcttcccaaatcactgccaagcctagacttcttgagcctgtgtacttggtcgagatccaagctccagagggtgctctcggtggtatctacagtgttcttaaccagaagcgtggacacgtcttcgaggagatgcagaggcagggtaccccactttacaacatcaaggcataccttccagtcattgagtctttcggtttctcagctacattgagagctgctacctcaggacaggctttcccacagtgtgtgttcgaccattgggacatgatgtcttctgatccattggaggccggaactcaagcttccgtacttgttgctgatatcaggaagagaaagggtttgaaggagcaaatgaccccactttccgagtttgaagacaagctgtaagtttctactacaacttgtgcttgttgagaacatacagcttaggtttgaggaggaaagatgaggagaagggaaagaagttatcaggaatcgacattttttatgcttttctccattgccttatctattttgcttattttctagtctgttgttttttaagttttgttacaggggatatttggttgtatcctttggcattttaggggaaagaccttttattattattataactttttaaattgtttgtgcttttttgtttgaagaggacacagtatgtaatgttaaatgttggctttttgtctcacatttttattttattttcaattttttatcttaaaacattacttttctatggaattggtttttatactaggggatttcttatat

SEQ ID NO: 2149 - DNA, 2815 bp, Podocarpus macrophillus
atcgaatacgtgcggtgctactgcctctgcgcggatttcggtcattgctggtttacatctagcaagtgttgttttagtgaatattaaagttagcaaaatggtgaagtttacagctgaagaactccgtaggattatggacttcaaacataacatacggaatatgtctgttatcgcccatgttgaccatggaaagtccacactcacagattcgttggttgcagctgctggtatcattgcacaagaagttgctggcgatgttagaatgactgatactcgtcaagatgaagctgagcgtggtatcacaattaagtcaactggaatctccctctattacgagatgtctgatgaatctctgaaaagatacacaggcgagaggaatggtaacgagtatttgattaacctgattgattctccagggcatgttgacttctcttcagaggttacagcagccttgcgtatcacagatggtgcattggttgttgtagattgtattgaaggagtttgtgtacagactgaaactgtacttcggcaggctcttggagaaaggattaggccagttcttactgtgaacaagatggacaggtgctttcttgagttacaagttgagggagaggaagcatatcagacatttttacgtgtgattgaaaatgcaaatgttattatggctacttatgaggatcctcttcttggtgattgtcaagtatatcccgaaaaaggtactgttgcattctcagctggtctgcatgggtgggcgtttactctaacaaattttgcaaaaatgtatgcttcaaaatttggagtggatgaagccaaaatgatggagaggttgtggggtgaaaacttttttgatccagccaccaagaaatggacaaccaaaaacacaggatcacccacatgcaaaagaggctttgttcaattcatttatgagcccattaagcaaattataaagatttgcatgaatgaccaaaaggataagttatggccaatgttgcagaaactaggtgttgtaatgaagagtgacgaaaaggatcttgttggaaagcctcttatgaaacgtgtcatgcaaacctggctacctgccagcactgctctacttgagatgatgatattccatcttccttctccatcaaaagcacaaaaatatagagtagaaaacttgtatgaagggcctttggatgatatttatgcaaatgcaatcagaaattgtgatccggaaggccccttgatgttgtacgtatcaaagatgattcctgcctctgacaaaggacgattctttgcatttggccgtgtttttgcgggtaaagtttccacaggaatgaaggtaaggatcatgggtcctaactatgtccctggtcaaaagaaggacttgtatgtaaaaagtgtccagagaactgtcatttggatggggaaaagacaagaatcagtcgaggatgtgccttgtggaaatacagttgctatggttggcttggaccagtacatcactaagaatgctactctgacaagtgagaaagaagttgatgctcatcccattagagcaatgaagttctctgtgtcacctgttgttcgagttgctgtacagtgcaaggtggcctctgaccttccaaagcttgttgaagggttgaagcgtcttgccaagtctgatcctatggttgtgtgcaccattgaggaatctggtgaacatattattgctggagcaggtgaacttcatcttgagatttgcctgaaggatctgcaggaagattttatgggtggagctgagattgtcgtgtctgatccagtcgtctcatttagggaaactgtgttggaaaagtcaatccgtactgtgatgagcaagtctcctaataagcataaccgactctactttgaagcaagacctttggaagaaggtcttccggaagcaattgatgagggccgcattggtccaagggatgatcctaaggcccgtgccaagatactttccgaagagtttgggtgggataaagatctggctaagaagatttggtgctttggtcctgaaacaactggtcccaacatggtggtggatatgtgtaagggagtacaatacctgaatgaaattaaagattcagtggttgctgccttccagtgggcatccaaggaaggtgctcttgctgaagaaaacatgcgtggtatttgctttgaggtttgtgatgttgttttgcatactgatgccatacatagaggaggtggtcagattatcccaacagccaggcgggttatgtatgcagctcagctcactgcaaaaccaagacttcttgagccagtgtatcttgtggagattcaggcccctgaacaggcgcttggaggtatttatggtgtgctgaatcagaagaggggtcatgtctttgaggaaatgcagaggccaggaacaccactctataacatcaaggcttatttacctgttgtagagtcgtttgggttctctggtactctacgagctgcaacatctgggcaggccttccctcaatgtgtgtttgatcactgggatatgatgaattctgacccaatggatgcaggcacacaagcacacagtcttgtgattgatattcgcaagagaaagggtctgaaagaacagatgacaccactgtcagattttgaggataagctgtaaagctttcttgttttgcatggtatcttagtagatcatactagtatttgatcaagtccggcagatttcaggaagatgaagggtcaaggattaaatggctctcttgttgagcatgattttttaggtttgtgtgttgacaattttagaccctctcaggaacaaattttattatatttgcttactttgact

SEQ ID NO: 2150 - DNA, 2991 bp, Papaver somniferum
tcagggatttgtctgctgctacatctattcagtgatatttggtatctttagaatttatcatctaaagaaacaaagatggtgaagtttacagctgaagagcttcgtaggatcatggacctgaagcataatatcaggaacatgtccgtcattgctcatgtggatcatggaaaatcaacacttactgattctcttgtggctgctgctggaatcattgcccaagagactgctggtgatgttcgtatgacagatacccgtgcagatgaggcagaacgtggtattacaattaaatctactggtatctctctctattacgagatgagtgacgagtctttgaaggcctacaagggtgaaaggatgggtaacgagtacctcatcaaccttattgattcacctggtcacgttgacttctcttctgaagtcacagctgcattacgtattaccgatggtgcacttgttgtggttgattgtatcgagggtgtttgtgttcaaaccgagaccgtccttcgacaagctcttggagaaaggatcaggcctgttttgactgtcaacaagatggacagatgtttcctagagctacaggttgatggagaagaggcttatcagactttctcccgagtcatcgagaatgctaatgttattatggccacatatgaagacccactcctcggtgacgtccaagtttaccctgagaaaggaacagttgccttctctgctggtttgcacggttgggcttttactctcaccaatttcgcaaacatgtatgcttccaagttcggtgtcgaacacagtaagatgatggagaggctctggggtgagaacttctttgacccagcaactaagaagtggactaataagagaacctcctctcccacatgtaagcgtggatttgttcagttctgttatgaacccatcaagcagatcattgccacttgcatgaatgatcagaaagacaagttgtggcctatgcttcagaagcttggtgttacaatgaagaatgacgagaaggaattgattgggaagcccttgatgaaacgtgtgatgcagacttggctccctgcagctactgctctacttgaaatgatgatttatcatctcccctctccccacacagctcagaagtatcgtgttgagaacttgtacgagggtcctcttgacgaccagtatgccaatgccatcagaaactgtgatcccgaaggtcctcttatgctctacgtgtctaagatgattcccgcctctgacaagggtagattctttgccttcggtcgtgtctttgctggtaaggttgcaacaggtgctaaggtcagaatcatggggcctaactacgttcctggtgggaagaaagacttgtacaccaagagtgtccagagaactgttatctggatgggaaagaaacaggagtcggttgaggatgtaccttgtggtaacactgttgccctggttggactggatcaatttatcaccaagaatgcaaccctcacaaacgagaaggaagttgatgcccatcctatcagagctatgaagttttccgtctctcccgttgttcgtgttgctgtccagtgtaaggttgcctctgacctgcccaagctggttgaagggcttaagcgtctatccaaatcagatcctatggtggtgtgtaccattgaggagtcaggcgagcacattattgcaggtgctggagaactccatcttgagatctgtttgaaggacttgcaggatgatttcatgggtggtgctgaaattgtgaagtctgaccctgtggtgtcattccgtgagactgtcctagaaaagtcttcaagaacagtgatgagcaagtccccaaacaagcacaaccgtttgtacatggaggcacgtcctcttgaggatggacttgctgaagccatcgatgatggtcgtattggtccaagagatgatcccaaagttcgttcaaagatcttatctgaagagtttggatgggataaggatcttgcaaagaagatctggtgttttggtccagatactactggtccaaacatggttgtggatatgtgtaagggagttcagtaccttaatgaaatcaaggattcagttgtcgcagggtttcagtgggcttcaaaggaaggtgtgctagcagaagagaacatgagaggtatatgctttgaagtatgtgacgtggttctccattctgatgccattcacagaggtggcggacaggttattcctaccgctaggagggtcatgtatgcctcacagctcacagctaaacctagactgctagaacctgtgtacctagtcgagatccaggctcctgaaggtgctcttggtggtatttatggtgttctcaatcagaagcgtggtcacgtctttgaggaaatgcagagaccaggaactcctctctacaacattaaagcatatctacctgtcgttgagtcatttggtttctctgcccagcttagggctgctacatctggacaggcttttccccagtccgtgtttgatcattgggatatgatgatggctgatcctttggagcctggtactcaagctgcagagcttgtgacagacatcagaaagaggaagggtttgaaggctcagatgacccctctctctgattttgaagacaagctttaagtctatgatatttcatttggatgccgagttgtctttaagttttagatattaggttaatttatgctatggatttttttctttctttttatgtgtcatctttttcttttgttttctttggtgctgaatttatgtggttatgtttctaggatctgcacaatccatgatctgtaattgggttgggtgatttataaagtaaacgaacacgaaaatgagtaatattagcaccaactctgtcatggtttgcttattactaaaagggcttgcttcaattttactaatcgggaccatatgattttggatgagtgaaggaagcaaacaaagagttgtaggttcccgtttgagaaagctgtgttagctttgtattggctcccatcttacttaaca

SEQ ID NO: 2151 - DNA, 2819 bp, Rosa hybrid cultivar
cctctctcgtcgtagctttgtcacctggtcgtacttcaaattactgacaggtgacatttacaatcagtcaagatggtgaagtttactgcagaggagttgcgaaggattatggactacaagcacaacatccgtaatatgtccgttattgcccatgtcgatcatggtaaatcaacccttacagactcccttgtcgctgctgctggtatcattgcacaagaaactgctggtgatgtccggatgacggatacccgtgcagatgaggcagagcgtggtatcacaattaagtcaactggaatctctctctactatgagatgacggatgagtctttggcaagcttcaagggagagaggaatggaaatgagtaccttatcaatctcattgattcccctgggcatgttgacttttcatctgaggtcactgctgctcttcgtattactgatggtgcacttgtggtggtggattgtattgagggcgtgtgtgtccaaactgagactgtgctccgtcaagccttgggagaaaggatcaggcctgtgttgactgttaacaagatggacaggtgcttccttgaactccaggtggatggtgaagaggcctaccagaattttcagagggttattgagaatgctaatgtcatcatggctacctatgaagaccctcttcttggtgatgtccaggtctaccccgagaaaggaacagttgctttctctgctggtttgcacggttgggcttttactttaaccaactttgccaagatgtatgccgaaaagtttaaagttgatgaggcaaagatgatggaaaggctctggggtgagaacttttttgacccagcaaccaagaagtggaccagcaagaacaccggttctgctacctgcaagcgcggtttcgttcagttctgttatgaacccatcaagcaggttatcgctacctgcatgaatgaccagaaggataagctgtggcccatgttggcaaagcttggaatcaccatgaagggtgacgagaaagatctgatgggaaagccattgatgaagagggtcatgcagacctggctgccagccagcactgccctattggaaatgatgatctttcaccttccttctccatcaactgctcaaaagtatcgtgtcgagaatttgtacgagggtcccctggatgaccgatatgccactgctatcagaaactgtgatccggatggtcctcttatgctctatgtatctaagatgattcctgcatctgacaagggtaggttctttgcctttggccgtgtgtttgctgggagggtccaaacaggtttgaaggttagaatcatgggaccaaactatgttcccggggaaaagaaggatctgtatgtgaagaatgtacagaggactgttatctggatgggaaagaaacaagaaactgttgaggatgttccctgtggtaacactgttgccttagttggtctggatcagttcatcaccaagaatgctaccttgacaaatgagaaggaatctgatgctcaccccattcgtgctatgaagttctctgtctcacctgttgtgcgtgttgctgttcagtgcaaggttgcttcagatcttcccaagcttgttgaaggtctcaagcgtctggcaaagtctgatcctatggttgtctgttctattgaggagtctggagagcacattattgccggtgctggtgaactccaccttgagatctgtttgaaggatcttcaggatgattttatgggtggagctgaaattgtaaaatctgaccctgttgtgtccttccgtgagactgtccttgagaagtctgtccgtacagtgatgagcaagtcccccaacaagcataaccgtttgtacatggaagcacgcccattggaagaaggtcttgcagaggccattgatgatggccgtattggtccaagggatgatcctaaaattcgttccaagatcttggccgaggaatttggttgggacaaggatcttgctaagaaaatctggtgttttggccctgagaccactggtcctaacatggtggttgacatgtgtaagggagttcagtaccttaatgaaatcaaggactctgttgttgctgggttccagtgggcttcaaaggaaggtgcattggctgaagaaaacatgaggggtatttgctttgaagtctgtgatgttgttcttcatgctgatgctattcacagaggtggtggtcaggtcattccaactgccaggagggttatctatgcttctcagcttacagccaagccaaggctccttgaacccgtgtatcttgttgaaattcaagcccctgagggtgctcttggaggtatctacagtgttctcaatcagaagcgtggacacgttttcgaagaaattcagaggcctggtaccccactgtacaacatcaaggcatacctgcccgttgttgaatctttcgggttctctggtcagttgagggcttccacttcaggacaggctttcccccagtgtgtgtttgatcattgggagatgatgtcttctgatccgttggaggctggttcccaggcatctcagctggttcaagacatccgtaagaggaagggtttgaaggagcaaatgaccccgctttctgactttgaggacaagctctaaaccttttctaattctctttttgcaaaccaacttggagtagatgttgttaagttttgttctcaattaaactctttacctttccagttttcctttgtagtatttaatggcacttcgatggaaccattactactttatgtttgagagtatggattttagtaatgtattttgatctattttaaatttctggtgtacgtaaaaaaaaaaaaaaaactcga

SEQ ID NO: 2152 - DNA, 2857 bp, Helianthus annuus
tctcttggtgctcacaaaacctaaaccactgagacctctttgcagccgttttctctcgtttttgtaggattttgtgagaagcaattcaactatatttctgtcggagctctaaaaacaagccaaaatggtgaagtttactgctgaagagcttcgaaggattatggactacaagcataacattcgtaatatgtctgttattgctcatgtcgatcacggaaaatccactttgactgattctcttgtggctgctgctggtattattgcccaagaagttgctggtgatgttcgtatgactgatacccgtgctgatgaagcagaacgtggtattacaatcaaatccactggtatctcactttactacgagatgaccgatgaagctttgaaaagcttcaagggagaaagaaacggaaacgagtacctgatcaatcttatcgactctcccgggcacgttgacttttcttccgaagtcactgctgctctacgtatcactgacggtgcactcgtggtggttgattgtattgaaggtgtctgtgtgcaaactgaaactgttcttcgacaagctctcggagaaagaatccgacctgtcttaaccgtcaacaagatggacaggtgttttctcgagcttcaggttgatggtgaagaagcgtatcaaacgtttcagagggttattgaaaacgctaatgttatcatggctacttatgaggacccacttcttggtgatgtcatggtttaccccgagaaaggaaccgttgctttctcagctgggctccacggttgggcttttacgttaaccaactttgctaagatgtacgcttcgaaatttggtgttgacgagtctaaaatgatggaaaggctttggggagagaactttttcgacccgaaaaccaagaagtggaccactaagagcaccggcactgctacctgcaaacgtgggttcgttcagttctgttacgagccaattaagcagattatcaacacgtgcatgaatgaccagaaagatcagttgtggcctatgttgacaaagctcggtgtcaccatgaaatccgaagagaaagagttgatgggtaaggcgttgatgaagcgtgttatgcagaattggcttccggctgctaccgctttacttgaaatgatgatctttcatctgccttcacctcacactgcccaaagataccgtgttgagaatctttatgagggtcctttggacgatcaatacgctaacgctatcagaaactgtgaccccgatggtccccttatgctttatgtttctaagatgattcccgcttctgataaaggtagattcttcgcctttggtcgtgtttttgctggtagggtgtctaccggtttgaaggttcggatcatgggtcccaactacgttcccggtgaaaagaaagatttgtacgtgaagagtgttcagagaaccgtcatctggatgggaaagaagcaagaaaccgttgaagatgtaccgtgtggtaacacagtggctatggtcggtttggatcagttcatcaccaaaaacgcaacgttaacaaacgaaaaggaagtcgacgctcaccccatccgagccatgaagttttccgtctcacctgtggtgcgtgttgcagtccagtgcaaggtcgcgtctgacctacccaagctcgttgaaggactgaaacgtctggcgaaatctgaccctatggttgtgtgtactattgaggagtccggtgagcacatcatcgctggtgccggtgagcttcatttggaaatctgtttgaaggacttgcaggatgatttcatgggtggtgcggaaatcgtcgtttccgaccctgttgtgtctttccgtgaaaccgtcttggagaaatcatcccgaaccgtgatgagcaagtctcctaacaaacacaaccgtctctacatggaagctagacccatggaagatggtcttgctgaggctatagatgaaggcagggtgggcccacgtgatgaccccaaggttcgtggtaagatcttgtctgaggagttcggctgggataaggatttggctaagaagatctggtgttttgggcctgaaacaaccggtcccaacatggttgttgacatgtgtaagggagtccagtatcttaatgaaatcaaggattcggtggttgctggttttcagtgggcttctaaggaaggtgctttggctgaagagaacatgaggggtatttgctttgaagtgtgtgatgtcgttctccatgctgatgccatccacagaggtggtggtcaagttattccaaccgcaaggagagtcatatacgcgtctcagttgaccgctaagccacgtttgctggagccggtctaccttgttgaaattcaagcacccgagcaagctttgggtggaatctacagtgtgctgaatcaaaggcgtggacacgtgtttgaagaaatgcagaggccgggtaccccactgtacaacatcaaggcttatcttccagtcgtggagtccttcgggttttctggtgccttgagagcttctacttcgggtcaagctttcccacaatgtgtgtttgaccattgggacatgatggggtcagatccattggaagctggttcgcaggcaagcacgctcgtgacccagatccgtaagaggaagggtttgaaggagcagatgacaccactgtctgagtttgaggataagctgtaagcgctggatgcaagctgtaagtgctggatgagatgttatcgagaattactgtctgggtttcatgttatattttctacaatgttttttagtatgctggttgtactatgttttgttttgttgtcgtgagaaacacctacttgcagacgttgatgctgttaattttgacattcttgtttttaccattttctgtttttagttttc

SEQ ID NO: 2153 - DNA, 2853 bp, Vinca minor
atctttctagcggctactgcagcattgtaaggtcaactaaggaccttacccttttgcctcgccgcctcctaggtttttgtttgaagaatacttataagtccattttctgtgacctataactagccgtcaagatggtgaagttcacagctgaagagctccgtaggattatggacttaaagcacaacatccgtaacatgtccgtcattgcccatgtggatcacgggaagtccactcttaccgactctctagttgctgcggctggtatcattgctcaggaagttgctggggatgtcagaatgacagataccagagcagatgaagctgaacgtggtatcaccatcaaatccactgggatttccctttactatgagatgactgaggaggccctcagaaacttcaagggagaacgagtggggaatgagtacctcatcaaccttattgattctcctggacacgttgacttctcatctgaagtcacagctgctctccgtattactgatggtgctttggtcgtggttgattgtgttgagggagtttgtgtgcagactgaaactgtcctccgacaagcccttggtgagaggattcgacctgtccttactgtcaacaagatggacagatgtttccttgaacttcaggttgatggagaggaggcatatcagactttccagaaggttattgagaatgctaacgttatcatggctacttatgaagatcctcttctaggagatgttatggtttatcccgagaaaggaacagttgctttctctgctgggttgcacggatgggcatttactttgactaactttgccaagatgtatgcttctaagtttggtgttgacgagtcgaagatgatggaaagactttggggtgagaatttctttgatcccgctaccaaaaagtggaccagtaagaatacaggttccccaacatgcaagcgtggttttgttcaattctgttatgagcccatcaagcagatcatcaagatttgcatgaatgatcagaaagataagctctggcccatgttgcagaagcttggtgtctccatgaagtctgaagagaaagagttgatgggcaaggcattgatgaaacgtgtcatgcagacatggcttccagcaagtactgccctacttgaaatgatgatctaccatctcccatctccggacaaggcccagaggtaccgtgttgagaatttgtatgaaggtcctcttgatgatatgtatgctaatgctatcaggaactgcgatcccgaggggcctctaatgctctatgtgtctaagatgattccagcatcagataaaggtcgattctttgcctttggccgtgttttttctggcaaggtgtctactggtttaaaggtcagaatcatgggtcctaactatgttcctggagagaaaaaggacctctatgttaagaatgtccagaggacagttatctggatgggtaagaggcaggaaactgtggaagatgtgccctgtggaaacacagttgctttggttggtttggatcagttcattaccaagaacgcgaccttgaccaatgagaaggaaactgatgctcacccaattcgtgcaatgaagttctctgtctcgcccgttgtgcgtgttgcagttcaatgcaaggttgcatctgatcttcccaaacttgtagaaggtctgaaacgtctgtccaaatctgatcctatggttatctgttctattgaagaatccggggaacatattattgctggtgctggtgaactccaccttgagatttgtttgaaagatttggtcgacgacttcatgggtggtgctgaaatcatcaagtctgatccagtcgtgtctttccgtgagactgttcttgagaaatcttgccgtactgtgatgagtaaatctcctaacaagcataatcggctgtacatggaagcaagacccttggaggaaggacttgcagaggccattgatgatgggcgtattggcccaagggatgatcctaaggtccgtgccaagatcttgtcagaggagtttggttgggacaaggatcttgctaagaaaatctggtgttttggtcctgaaaccactggtccaaacatggtggtcgatatgtgtaagggagtacaatacctgaatgaaattaaggattctgttgttgcaggtttccaatgggcttcaaaggaaggtgcgttggctgaagaaaacatgagaggtatctgctttgaggtgtgcgacgttgttcttcacactgatgccattcacagaggcggcggtcaagttattcctactgctaggagggttatttacgcctctcagattactgccaagcctcgccttcttgaacccgtttaccttgttgaaatccaagcacccgagcaagctcttggtggtatttacagtgttctgaatcagaaacgtggacacgtctttgaggagatgcagaggccggggacccccctttacaacatcaaggcttaccttcctgtcgtcgaatcatttggtttctctagtacattgagagctgctacctcaggtcaggccttcccacaaagtgtgttcgatcattgggaaatgatgatgtctgatccattggaagctggttcccaagctgctacacttgtggctgatatcaggaagaggaagggtttgaaggagcaaatgaccccactttcagatttcgaagacaagctgtaaaccagtttatactatcctcgaagatatgctcgtgggaagtataattttgtcgttcccccccttaatttacctactttgtcaagcactctatttaggttttgattgagttatagcccgtgtttccgtgagatgttggtttacttgttattttaccatctttggtagaagacattaaagttgtgttgtctta

SEQ ID NO: 2154 - DNA, 2768 bp, Zostera marina
atcattttctaatttggaagaaaagcaaaagaatatggtgaagttcacagcagaggagcttcggaggattatggacttgaagcacaacatccgcaacatgtctgtgattgctcatgtcgatcacgggaagtctactctaactgattctttggtagccgcggccggaatcattgcgcaagaagttgcaggagatgtgaggatgactgacacacgttccgacgaggctgaacgtgggattacaatcaaatcaactggtatatcactgtactatgagatgactgatgaatctttaaagagcttcaaaggggagagaatgggaaatgagtatctcatcaacctcattgactctcctggacacgttgatttctcatcggaggtcacagcagcgctccgtattaccgatggagctttggttgttgtcgattgtatcgagggtgtctgcgtccagactgagactgttctccggcaagctttgggggagagaatcaggcctgtactgacagtcaacaagatggacagatgttttttggaacttcaggtaaacggtgatgaggcttatcagacgttccagcgtgtgattgaaaatgccaatgttatcatggccacctacgaagatgctctcctcggagatgtgcaggtttacccggagaaaggaactgtagctttctccgccggtctgcacggttgggcgttcactcttactaactttgccaagatgtatgcttcgaaatttggggtggatgaatctaaaatgatggaaagactctggggtgaaaactacttcgatccggctactaagaagtggaccagcaaaatgactgcttcccctacctgcaagagaggatttgtgcagttctgttacgagccgatcaagcagatcattaatacttgcatgaatgatcagaaagacaagctctggccgatgttgaagaaacttggagtggtcatgaagtccgaagagaaagagctcatgggtaagccattgatgaagcgtgtgatgcagaattggcttccggcgagtactgctcttcttgagatgatgattttccatctgccctccccacatactgcacagaggtatcgtgtagagaatctgtacgaaggtccgcttgatgatgtgtatgcaaatgctatcaggaattgcgacccaaatggtcctcttatgctctacgtttccaagatgattccggcgtccgacaagggtagattctttgcctttggtcgtgtgttttccggcaaggtttctaccggtgttaaggtccgaatcatgggaccgaattacgtccctggacagaagaaggatctgtacgtgaagagtgtccagagaaccgttatctggatgggaaagaagcaggaatccgtcgaggacgtcccttgtggaaacactgttgcccttgtcggactggatcagttcataacaaaaaacgccacacttaccaacgagaaagaatccgatgctcatccaatccgtgccatgaaattctcagtctcgcctgtggttcgtgttgcggtacagtgcaaggtggcctccgatcttcccaagctggtcgaaggtttgaaacgtcttgcaaaatctgaccctatggtgatgtgcatgatagaagaatctggtgagcacattattgccggagccggtgagcttcatcttgaaatctgtcttaaggatcttcaggatgatttcatggggggtgcacagattgtagtatccgacccagttgtttctttccgtgaaactgtcatggagaaatcatctcggacggtgatgagcaagtctcccaacaaacacaatcgtctctacatggaagcacgacctttggaagacggtttaccggaggccattgacgatggtaggatcggccctcgtgacgatcccaaaatccgttccaagatcctcgccgaggaattcggatgggataaggacctggcgaagaagatctggtgctttggaccggaaacaaccggacccaatatggttgttgacatgtgcaagggagtgcaatacctaaacgaaatcaaggactctgttgttgcaggtttccagtgggcgtccaaggaaggagccatggcagaggagaacatgcgtggcatctgcttcgaggtatgcgacgtcgttcttcacgccgacgccatccacagaggcggaggacaggttattccgacagcaaggagagtcatctacgcttctcaaataactgccaagccaaggcttctagagccagtgtaccttgtcgagatccaggcacccgagggcgctctagggggcatctacggcgttttgaaccagaagagaggacacgtgtttgaggagatacaaaggccgggaactcctctctacaatatcaaagcttatcttcccgtcatcgaatcttttgggttctctagcacactccgagcctcgacctccggtcaagcattcccccaatgtgtcttcgatcattgggacatgatgatgtcggatccgttggacccaggtactcaggcagcgacgcttgtcaaggacattcgtaagaggaaggggctaaaggatcagatgaccccactttcggaatttgaagacaagctttgatttatttcccgagtttgccagaaagccctgaactatatacaaattttaaatatgtccactgttaaaacttgtagtcatatctcaaagacactatgatattcggagaactatagttcgaatgtcagtgtgtgtattttaatttttatttacttatgtattaccgtattttattaaaaaattacatagttacataattgtatat

SEQ ID NO: 2155 - DNA, 2773 bp, Cicer arietinum
ttctcttccacacagccgttggtggaaaccagatctcatctcccttcaatttcttcactttgattgatactcgtttttgtttgtggactatacaaaagactagtcaaaatggtgaagtttacagccgatgagttgcgtcgtattatggactataagcataacattcgtaatatgtctgttattgctcatgtcgatcatggaaaatcaacattgacagattcccttgtcgctgctgctggaattattgcacaagaggtggctggtgatgtccggatgacagatacccgtgcagatgaggctgagcgtggtatcactattaagtctactggtatctctctatactatgaaatgtctgatgagtctctcaagagttacaagggggaacgtaatgggaatgagtatctcattaatctcattgattcacctggacacgttgacttctcatctgaggttactgctgcactccgtattactgatggagcactagtggtggtggattgtgttgagggtgtttgtgtccaaactgaaactgttctgcgacaggctcttggtgaaaggatcaggcctgttctgactgttaacaagatggacagatgtttccttgagctccaggtggatggagaggaggcttatcagacattccagagggttattgagaatgctaatgtgattatggctacatatgaagatccattgctcggtgatgttcaggtgtatcctgagaaaggtacagttgccttctctgctggtttgcacggttgggcatttactctgaccaactttgcaaaaatgtatgcctcaaagtttggcgttgatgaatccaagatgatggagaggctctggggtgaaaacttctttgatccagccacaaagaaatggaccacaaagaatactggttcaccttcttgcaagcgtggatttgttcaattctgttacgagcctatcaagcagattattaacacttgtatgaatgaccagaaggacaagttgtggcctatgctaacaaagctaggagtcaccatgaaatctgaagagaaagacttgatgggtaaggcattgatgaaacgtgtcatgcagacttggctcccagctagcagcgcactattggaaatgatgatctttcatcttccctctccatcaactgctcagaggtatcgtgttgagaatttgtatgagggtccccttgatgatcaatatgctaatgctatcagaaactgcgatcccgaaggacctcttatgctttatgtctctaagatgattcccgcatctgataagggaaggttttttgcttttggtcgtgtatttgctggtaaggtttcaacaggtttgaaagtcagaattatgggaccaaattacgtccctggtgaaaagaaagacttgtatgtgaaaagtgttcagagaaccgtcatttggatgggaaagagacaggagaccgttgaagatgtgccttgtggtaacactgttgctatggttggtttggatcaatatatcaccaagaatgctacattgacaaatgagaaggaagttgatgctcatcctatccgagcaatgaaattttctgtctcacctgttgtgcgtgttgctgttcagtgcaaggttgcttcagatcttcccaagcttgttgaaggtctcaaacgtttggcaaagtcagatcctatggttgtttgtactattgaggaatctggagaacacattgttgctggtgcaggagagcttcatcttgagatttgtttgaaggacttgcaggatgatttcatgggtggggctgaaattattaaatctgaccccgttgtgtcattccgtgagactgttcttgacagatcatgccgcactgtgatgagtaaatcaccaaacaagcacaacaggttgtacatggaagcaagaccgttggaagatgggcttgcagaggccattgatgaaggcacaattggaccaagggatgaccccaaaatccgttctaaaatcttgtcagagcagtatggttgggataaggatcttgctaagaagatttggtgttttggacctgagaccactggacccaacatggtggttgatatgtgtaagggagtccagtatttgaatgaaatcaaggattctgttgttgctggattccagtgggcatctaaagaaggtgctttagcagaagaaaacatgagagccatttgttttgaagtgtgtgatgttgtcctccacactgatgctatccatagaggaggtggtcagatcattcctactgccaggagagtgttctatgcctcacagctgacagccaaacctaggcttcttgagcctgtttaccttgtggaaatccaagctcctgagcaagctcttggtggtatctacagtgttcttaatcagaaacgtggacatgtgttcgaagaaatgcagaggcctggtactccactttacaacatcaaggcataccttcctgtcgtcgagtcctttggattctccagtcaattgagggctgcaacatcaggacaggctttcccacagtgtgtgtttgatcactgggatatgatgtcatcagatccattggaggctggatcacaagctgcaacacttgttactgatattcgtaagaggaagggtttgaaggagcagatgactccactctccgagttcgaagacaagctttaaattatttaaactgttttcttttatttatcaacttagcttatgttctggtcattgaaactgttacctgagcttttaaagttcagtatcttgagtttttgtgtatgactatcagtctgtcttgtacttcgggatt

SEQ ID NO: 2156 - DNA, 2774 bp, Cicer arietinum
gggggggccttatccccttgtgttgccttgcctcccacgactaagcttcttctctattcgttttcgccgcttccctgttctttctcttcgctataacagactcctttgcggactataaagactagtcaaaatggtgaagttcacagctgatgagttacgtcgcattatggactataagcacaacattcgtaatatgtctgtcattgctcatgttgaccacggaaaatcaacattgacagattcccttgttgctgctgctggaattattgcacaagaggttgctggtgatgtccggatgacagatacccgtgcagatgaggctgagcgtggtatcactattaagtctactggtatctctctatactatgaaatgtctgatgagtctctcaagagttacaagggggaacgtaatgggaatgagtatctcattaatctcattgattcacctggacacgttgacttctcatctgaggttactgctgcactccgtattactgatggagcactagtggtggtggattgtgttgagggtgtttgtgtccaaactgaaactgttctgcgacaggctcttggtgaaaggatcaggcctgttctgactgttaacaagatggacagatgtttccttgagctccaggtggatggagaggaggcttatcagacattccagagggttattgagaatgctaatgtgattatggctacatatgaagatccattgctcggtgatgttcaggtgtatcctgagaaaggtacagttgccttctctgctggtttgcacggttgggcatttactctgaccaactttgcaaaaatgtatgcctcaaagtttggcgttgatgaatccaagatgatggagaggctctggggtgaaaacttctttgatccagccacaaagaaatggaccacaaagaatactggttcaccttcttgcaagcgtggatttgttcaattctgttacgagcctatcaagcagattattaacacttgtatgaatgaccagaaggacaagttgtggcctatgctaacaaagctaggagtcaccatgaaatctgaagagaaagacttgatgggtaaggcattgatgaaacgtgtcatgcagacttggctcccagctagcagcgcactattggaaatgatgatctttcatcttccctctccatcaactgctcagaggtatcgtgttgagaatttgtatgagggtccccttgatgatcaatatgctaatgctatcagaaactgcgatcctgaaggacctcttatgctttatgtctctaagatgattcccgcatctgataagggaaggttttttgcttttggtcgtgtatttgctggtaaggtttcaacaggtttgaaagtcagaattatgggaccaaattacgtccctggtgaaaagaaagacttgtatgtgaaaagtgttcagagaaccgtcatttggatgggaaagagacaggagaccgttgaagatgtgccttgtggtaacactgttgctatggttggtttggatcaatatatcaccaagaatgctacattgacaaatgagaaggaagttgatgctcatcctatccgagcaatgaaattttctgtctcacctgttgtgcgtgttgctgttcagtgcaaggttgcttcagatcttcccaagcttgttgaaggtctcaaacgtttggcaaagtcagatcctatggttgtttgtactattgaggaatctggagaacacattgttgctggtgcaggagagcttcatcttgagatttgtttgaaggacttgcaggatgatttcatgggtggggctgaaattattaaatctgaccccgttgtgtcattccgtgagactgttcttgacagatcatgccgcactgtgatgagtaaatcaccaaacaagcacaacaggttgtacatggaagcaagaccgttggaagatgggcttgcagaggccattgatgaaggcacaattggaccaagggatgaccccaaaatccgttctaaaatcttgtcagagcagtatggttgggataaggatcttgctaagaaaatttggtgttttggacctgagaccactggacccaacatggtggttgatatgtgtaagggagtccagtatttgaatgaaatcaaggattccgttgttgctggattccagtgggcatctaaagaaggtgctttggcagaagaaaacatgagagccatttgttttgaagtgtgtgatgttgtcctccacactgatgctatccatagaggaggtggtcagatcattcctactgccaggagagtgttctatgcctcacagctgacagccaaacccaggcttcttgagcctgtttaccttgtggaaatccaagctcctgagcaagctcttggtggtatctacagtgttcttaatcagaaacgtggacatgtgttcgaagaaatgcagaggcctggtactccactttacaacatcaaggcataccttcctgtcgtcgagtcctttggattctccagtcaattgagggctgcaacatcaggacaggctttcccacagtgtgtgtttgatcactgggatatgatgtcatcagatccattggaggctggatcacaagctgcaacacttgttactgatattcgtaagaggaagggtttgaaggagcagatgactccactctccgagttcgaagacaagctttaaattatttaaactgttttatttttatttatcaacttagcttatgttctggtcattgaaactgttacctgagcttttaaagttcagtttttgtgtcattgtgttgtacttcggg

SEQ ID NO: 2157 - DNA, 2755 bp, Cicer arietinum
aaaaaattaacctttctcgtatccatcacactatttctcttccacacagccgttggtggaaaccagatctcatctcccttcaatttcttcactttgattgatactcgtttttgtttgtggactatacaaaagactagtcaaaatggtgaagtttacagccgatgagttgcgtcgtattatggactataagcataacattcgtaatatgtctgttattgctcatgtcgatcatggaaaatcaacattgacagattcccttgtcgctgctgctggaattattgcacaagaggtggctggtgatgtccggatgacagatactcgtgcagatgaggctgagcgtggtatcactattaagtctactggtatctctctatactatgaaatgtctgatgagtctctcaagagttacaagggagaacgtaatgggaatgagtatctcattaatctcattgattcccctggacacgttgacttctcatctgaggttactgctgcactccgtattactgatggagcactagttgtggtggattgtgttgagggtgtttgtgtccaaactgaaactgtgctgcgacaggctcttggtgaaaggattaggcctgttctgactgttaacaagatggacagatgcttccttgagctccaggtggatggagaggaggcttatcagacattccagagggttattgagaatgctaatgtgattatggctacctatgaagatccattgctcggtgatgttcaggtgtatcctgagaaaggtacagttgctttctctgctggtttgcacggttgggcatttactctgaccaactttgcaaaaatgtatgcctcaaagtttggcgttgatgaatccaagatgatggagaggctctggggtgaaaacttctttgatccagccacaaagaaatggaccacaaagaatactggttcaccttcttgcaaacgtggatttgttcaattctgttacgagcctatcaagcagattattaacacttgtatgaatgaccagaaggacaagttgtggcctatgctaacaaagctaggagtcaccatgaaatctgaagaaaaagacttgatgggtaaggcattgatgaaacgtgtcatgcagacatggctcccagctagcagcgcactattggaaatgatgatctttcatcttccctctccatcaactgctcagaggtatcgtgttgagaatttgtatgagggtccccttgatgatcaatatgctaatgctatcagaaactgcgatcctgaaggacctcttatgctttatgtctctaagatgattcccgcatctgataagggaaggttttttgcttttggtcgtgtatttgctggtaaggtttcaacaggtttgaaagtcagaattatgggaccaaattacgtccctggtgaaaagaaagacttgtatgtgaaaagtgttcagagaaccgtcatttggatgggaaagagacaggagaccgttgaagatgtgccttgtggtaacactgttgctatggttggtttggatcaatatatcaccaagaatgctacattgacaaatgagaaggaagttgatgctcatcctatccgagcaatgaaattttctgtctcacctgttgtgcgtgttgctgttcagtgcaaggttgcttcagatcttcccaagcttgttgaaggtctcaaacgtttggcaaagtcagatcctatggttgtttgtactattgaggaatctggagaacacattgttgctggtgcaggagagcttcatcttgagatttgtttgaaggacttgcaggatgatttcatgggtggggctgaaattattaaatctgaccccgttgtgtcattccgtgagactgttcttgacagatcatgccgcactgtgatgagtaaatcaccaaacaagcacaacaggttgtacatggaagcaagaccgttggaagatgggcttgcagaggccattgatgaaggcacaattggaccaagggatgaccccaaaatccgttctaaaatcttgtcagagcagtatggttgggataaggatcttgctaagaagatttggtgttttggacctgagaccactggacccaacatggtggttgatatgtgtaagggagtccagtatttgaatgaaatcaaggattctgttgttgctggattccagtgggcatctaaagaaggtgctttagcagaagaaaacatgagagccatttgttttgaagtgtgtgatgttgtcctccacactgatgctatccatagaggaggtggtcagatcattcctactgccaggagagtgttctatgcctcacagctgacagccaaacctaggcttcttgagcctgtttaccttgtggaaatccaagctcctgagcaagctcttggtggtatctacagtgttcttaatcagaaacgtggacatgtgttcgaagaaatgcagaggcctggtactccactttacaacatcaaggcataccttcctgtcgtcgagtcctttggattctccagtcaattgagggctgcaacatcaggacaggctttcccacagtgtgtgtttgatcactgggatatgatgtcatcagatccattggaggctggatcacaagctgcaacacttgttactgatattcgtaagaggaagggtttgaaggagcagatgactccactctccgagttcgaagacaagctttaaattatttaaactgttttattttatttatcaacttagcttatgttctggtcattgaaactgttacctgagcttttaaagttc

SEQ ID NO: 2158 - DNA, 2852 bp, Olea europaea
gttttttggttgtgaaatttagaaacctgtcaaaatggtgaagttcacagctgatgagctccgcaggattatggactacaagcacaacattcgtaatatgtcggttattgctcatgtcgatcacgggaaatccacacttaccgattctcttgtcgctgctgctggtattatcgctcaagaagttgctggtgacgttagaatgacagatacccgtgctgatgaggctgagcgtggtatcactatcaagtcaactggtatctctctgtattacgagatgtctgacgcgtctttgaagagctacacgggagagcgaaatggcaacgagtaccttatcaatcttattgattctcctggacacgtcgacttctcatcggaagtgacagccgcacttcgtattactgatggggctcttgttgtggtagactgtgttgaaggcgtttgtgtccaaacagaaactgtcctccgacaggcccttggagaaaggattcgacctgtcttgacggttaacaagatggacaggtgcttccttgagctccaggttgatggagaggaggcttaccaaacattccagagggtcattgaaaatgcaaatgtcatcatggctacttatgaagaccctctcttgggcgatgttcaggtttacccggagaaaggtactgttgccttttctgctggtttgcacggctgggctttcacgcttacgaactttgcaaagatgtatgcttccaagtttggtgttgacgagtccaagatgatggaaaggctttggggagagaatttctttgatccagccactaagaagtggaccaccaagaataccggttcagctacatgtaaacgtggatttgttcaattctgttacgagcccattaagcagattattaacacttgcatgaatgatcagaaagataagctctggcccatgttacagaagctcggcgttgtcatgaagtctgatgagaaggatttaatgggcaagccattaatgaagcgtgtgatgcagacctggcttccagctagtactgcgctcttggaaatgatgatctttcacctcccatcaccttctaaggcacaaaggtaccgtgtggagaacttgtacgagggacctatggacgatgtttatgctactgctattaggaactgtgatcctgatggcccccttatgctttatgtgtcgaagatgattccggcatctgacaagggcaggttctttgcatttggtcgtgtgttctccggaaaggtttcgactggtttgaaggtcagaatcatgggtcctaactacgtccccggggagaaaaaggacttgtacgtcaagagtgtccagagaactgttatttggatgggtaagaggcaggaaactgtggaggatgtaccgtgtgggaacacagtggctatggttggtctagatcaatacataaccaaaaatgcaaccctgaccaatgaaaaggaagtagacgctcatccaattagagcaatgaagttctccgtgtcacccgttgtgcgtgttgccgtccagtgcaaggttgcatctgaccttccgaagcttgttgaaggtctgaagcgtttggccaagtcagaccctatggttgtctgtagcattgaggagtccggtgagcatatcattgctggtgctggagaactccacctggagatatgtttgaaggatttacaagatgatttcatgggtggtgctgaaatcattaaatctgatccagtcgtgtccttccgtgagactgttcttgagaggtcgtgtcgcactgttatgagcaaatcacctaataagcacaaccgtctgtacatggaagccaggcccttggaagagggactggccgaggctattgacgatggtcgtattggtccaagagatgatcctaaggttcgttctaagatcttgtccgaggagttcggttgggataaggagcttgcaaagaaaatttggtgctttggtcctgagacaaccggtccaaacatggtggttgatatgtgtaagggagtccagtacctgaatgaaattaaagattctgttgtcgctggttttcagtgggcttcgaaggaaggcccattggctgaagaaaacatgaggggtatttgcttcgaagtctgtgatgttgttctccatgctgatgctattcatagaggaggcggtcaggtcattccaactgctaggagggttatttatgcctcgcatattactgccaaaccccgtcttctggaacccgtgtacatggtggagattcaagcaccggagcaagctcttggtggtatctacagtgtcctgaaccagaaacgtggacacgtgttcgaggaattgcagaggccgggtactccactatataatatcaaggcatacttacctgtcatcgaatcatttggtttctctagtaccttgagagccgcaacttctggacaagcctttccccagtgcgtgtttgatcattgggacatgatgtcgtctgatccactggaaccagggtcgcaggcttctcaactcgttaccgatatccgaaagaggaagggcttgaaggagcagatgacaccactttccgagtacgaggacaggctttgagtcaatgaaggtttaatccttttatcaatttattacctctgggaggactagtttatcttttaacgtttcatatttttggtgtagcattaagctttttaagtttatttcccggattctgttgtgttgcttttagatgtctcaaggacaagagtgttgttattcttcattgttgtgtcccgtactcttcgttctgagactattggtaccgaattttgttctgtttaatattttgtttgataatatcctgattaccctgaaagaatgctcagtataattggtgtttcaa

SEQ ID NO: 2159 - DNA, 2939 bp, Olea europaea
cctccttttaacctctctgaaatttgtattctgacagacctaccacaaattttttatttgtaaaatttagaaaccagaaaaatggtgaagttcacagctgatgagctccgcaggattatggactacaagcacaacattcgtaatatgtcggttattgctcacgtcgatcacgggaaatccacacttaccgattctcttgtcgctgctgctggtattatcgctcaagaagttgctggtgacgttagaatgacagatacccgtgctgatgaggctgagcgtggtatcactatcaagtccactggtatctctctgtattacgagatgtctgacgcatctttgaagagctacacgggagagcgaaatggcaacgagtacctcatcaatcttattgattctcctggacacgtcgacttctcatccgaagtgacagccgcacttcgtattacggatggggctcttgttgtggttgactgtgttgaaggcgtctgtgtccaaacagaaactgtcctccgacaggcccttggagaaaggattcgacctgtcttgacggttaacaagatggataggtgcttccttgagctccaggttgatggagaggaggcctaccaaacattccagagggtcattgaaaatgcaaatgtcatcatggctacttatgaagaccctctcttgggcgatgttcaggtttacccggagaaaggtactgttgccttttctgctggtttgcacggctgggctttcacgcttacgaactttgcaaagatgtacgcctccaagtttggtgttgacgagtccaagatgatggaaaggctttggggagagaatttctttgatccagccactaagaagtggaccaccaagaataccggttcagctacatgtaaacgtggatttgttcaattctgttacgaacccatcaagcagattattaacacttgcatgaatgatcagaaagataagctctggcccatgttacagaagctcggcgttgtcatgaagtctgatgagaaggatttaatgggcaagccattaatgaagcgtgtgatgcagacctggcttccggctagtactgcgctcttggaaatgatgatctttcacctcccatcaccttctaaggcacaaaggtaccgtgtggagaacttgtacgagggacctatggacgatgtttatgctactgctattaggaactgtgatcctgacggcccccttatgctttatgtgtcgaagatgattccggcatctgacaagggcaggttctttgcatttggtcgtgtattctccggaaaggtttcgaccggtttgaaggtcagaatcatgggtcctaactacgtccccggggagaaaaaggacttgtacgtcaagagtgttcagagaactgttatttggatgggtaagaggcaggaaactgtggaggatgtaccgtgtgggaacacagtggctatggttggtctagatcaatacataaccaaaaatgcaaccctgaccaatgaaaaggaagtagacgctcatccaattagagcaatgaagttctccgtgtcacccgttgtgcgtgttgccgtccagtgcaaggttgcatctgaccttccgaagcttgttgaaggtctgaagcgtttggccaagtcagaccctatggttgtctgtagcattgaggagtccggtgagcatatcattgctggtgctggagaactccacctggagatatgtttgaaggatttacaagacgatttcatgggtggtgctgaaatcattaaatcagatccagtcgtgtccttccgtgagactgttcttgagaggtcgtgtcgcactgttatgagcaaatcacctaataagcacaaccgtctgtacatggaagccaggcccttggaagagggacttgccgaggctattgacgatggtcgtattggtccaagagatgatcctaaggttcgttctaagatcttgtccgaggagttcggttgggataaggagcttgcaaagaaaatttggtgctttggtcctgagacaaccggtccaaacatggtggttgatatgtgcaagggagtccagtacctgaatgaaattaaagattctgttgtcgctggttttcagtgggcttcgaaggaaggcccattggctgaagaaaacatgaggggtatttgcttcgaagtctgtgatgttgttctccatgctgatgctattcatagaggaggcggtcaggtcattccaactgctaggagggttatttatgcctcgcatattactgccaaaccccgtcttctggaacccgtgtacatggtggagattcaagcaccggagcaagctcttggtggtatctacagtgtcctgaaccagaaacgtggacacgtgttcgaggaattgcagaggccgggtactccactatataatatcaaggcatacttacctgtcatcgaatcatttggtttctctagtaccttgagagccgcaacttctggacaagcctttccccagtgcgtgtttgatcattgggacatgatgtcgtctgatccactggaaccagggtcacaggcttcccaactcgtgaccgatatccgaaagaggaagggcttgaaggagcagatgacaccactctctgagtacgaggacaggctttgagtcaatgaaggtttaaacctttatcaatttattatctctgggagcagtctagtttatcttttaacgtttcatatttttggtgtagcgttaagctttttaagtttatttcccggattctgttgtgttgcttttagatgttgcaaggacaacagtgttgctattcttcattgttgtgtcccgtactctcttcgttttgagactattggtaccgaatattgttctgtttaatgttttgtttgttttgtttgataatatcctgattagcctgaaagaatgctcagtataattggtgttacaacgtattacttgatgaaacaaaaaatgcg

SEQ ID NO: 2160 - DNA, 3050 bp, Amsonia hubrichtii
atacgtgaggctgctgttcgtaaggtcactgagtgccttacccttttgcctcgccgctaacttctctcttcctatttcttaggttttgtcagaaaaggcagaaattttgatccatttttctgtaatctctaagaagcagtcaagatggtgaagttcacagttgatgggcttcgtaggattatggactacaagcacaacatccgtaatatgtctgtcattgcccatgtggatcatgggaagtccactcttaccgattctcttgtcgctgctgctggtatcattgctcaagaagttgctggagatgtccgaatgacagatacaagagcagatgaagcagagcgtggtatcaccatcaagtccactggtatttccctttattatgagatgaccgatgaagctctgagaggcttcaagggagagcgacaaggaaatgagtacctcatcaaccttattgattctcctggacacgttgacttctcatctgaagttacagctgctcttcgtatcactgatggtgcactcgttgttgttgattgtgttgagggagtttgtgtccagacagaaactgtcctccgacaggcccttggtgagaggatccgacctgtcctgactgttaacaagatggacagatgtttccttgagcttcaggttgatggagaggaggcttaccaaactttccagaaggttattgagaatgccaatgttataatggctacctatgaagatcctctcctaggtgatgtgcaggtctatccagagaaaggaacagttgctttctctgctgggttgcatggctgggcgtttactttgagtaactttgccaagatgtatgcttctaagtttggtgtttacgagtctaagatgatggaaagactttggggtgagaatttctttgaccccgctaccaaaaaatggaccaataagaatactggttctcctacctgcaagcgtggctttgttcagttctgctacgagcctatcaagcagatcatcagcacatgcatgaatgatcagaaagataagctctggcccatgttgcagaagcttggtgtcacaatgaagtctgaagaaaaagacttgatgggtaaagcattgatgaaacgtgtcatgcagacatggcttccagctagtaatgccctactagaaatgatgatccatcatcttccatctccggccaaggcccagaagtaccgtgttgagaacttgtatgaagggcctcttgatgatgcttatgctaatgctattaggaactgtgatcctgaggggcctcttatgctctacgtctctaagatgattcctgcatcagataaaggacgattctttgcttttggccgtgtttttgctggcaaggtatccactggtttgaaggtcagaatcatgggtcccaactatgttcctggagagaagaaggacctctatgttaagaatgtccagagaacagttatttggatgggtaagaggcaggaaaccgttgatgatgtgccttgtggaaacacagttgctatggttggtctggatcagttcatcaccaagaatgcaaccttgaccaatgagaaggaagttgatgctcatccaattcgtgcaatgaagttttctgtttcacctgttgtgcgtgttgcagttcaatgcaaggttgcctctgatcttcccaaacttgtagaaggtctgaagcgtctagcaaaatctgatcctatggttgtctgcacaattgaagaatctggggagcacattattgctggtgctggtgaactccaccttgagatttgtttgaaggatttgcaagatgacttcatgggtggtgctgagattatcaagtctgatccagttgtgtctttccgtgagactgttcttgagaagtcatgccgtactgtgatgagcaaatctccaaacaagcataatcgtctatacatggaagccagacccctggaagaaggacttgcagaggccattgatgatggacgcattggtccaagggatgatcctaaggtccgtgccaagattttgtcagaggagtttgggtgggacaaggatcttgcaaagaaaatctggtgttttggtcctgagaccactggtccaaacatggtggttgatatgtgtaagggagtacaatacttgaatgaaattaaggattctgttgttgcaggtttccagtgggcttccaaggaaggtgcattggctgaagaaaatatgagaggtatttgctttgaggtctgtgatgttgttcttcatgctgatgccattcacagaggtggtggccaggttattcctactgccaggagggttatttatgcttcccaaattactgcaaagccccgccttttggaacctgtctacctggttgaaatccaggcaccagagcaagctcttggtggtatttacagtgttctgaaccagaaacgtggtcatgtctttgaggaaatgcagaggcctggcacacccctgtacaacatcaaggcctaccttcctgtcattgagtcatttggtttctcaggtacattgagagctgctacctcagggcaggcattcccacaatgtgtgtttgatcattgggatatgatgtcatctgacccattggagcctggatcccaagcctctcaacttgttgctgatatcagaaagaggaagggtttgaaggagcagatgaccccactttcagaattcgaggacaagctgtaaatcagctgagtctttctgagatcgatgtgctcatggaaactgggcagtataattttttattttttatccttcatttactttacccggacattattaggttttgaatgagttgatgtagcccatgttctgccatgagattcccttattaggatatctgtagaagacatgaatgctgtgttctctgttgtgctgttggatgttatgttatgttctatttacttgaactatttatgtagtcttatttacacctcactatatctttgaatgtttttgtgttgcattgtgtttgactatttggattcaggtaaagtttttttcctttgtttgctattttcgtcctatttttctaaagtatttgtaaagtttttaaattg

SEQ ID NO: 2161 - DNA, 3102 bp, Catharanthus roseus
tgtgtcttggtccaagagagatcttgaatccatgggcctaatatgggcttcttctacttttgccaaatttgacctttgatgcctacaaaacccatactatatatatttgcataacccctccgattttcatcagcctcacactgccctttatctcagcggctgcagcttgtaaggtcactgagtgccttaccctttgtgtcgccgccaacttctccctctccatttcttaggtttttgtctgaaaaggcagaattttgtaatccatttttctgtaatctctgagaatctgtcaagatggtgaagttcacagctgaagagctccgtaggattatggactacaagcataacatccgtaatatgtctgtcattgcgcacgtggatcatgggaagtccactcttactgattctcttgtcgctgcggctggtatcattgcccaggaagttgccggtgatgtcagaatgacagatacaagagcagatgaagctgagcgtggtatcaccatcaaatccactgggatttccctttactatgagatgactgatgatgcactaagagcctacaagggagagcgacagggaaatgagtatctcatcaaccttatcgattctcctggacacgttgacttctcatctgaagtcacagctgcgctccgtattactgatggcgccctggttgttgttgattgtgttgagggagtttgtgtccagactgaaactgtcctccgacaggcccttggtgagaggattcgacctgtcctgactgttaacaagatggacagatgtttccttgagcttcaggttgatggagaggaggcctatcagactttccagaaggttattgagaatgctaatgttatcatggctacgtatgaagatcctcttctgggtgatgtgcaggtttatcccgagagaggaacagttgctttctctgctgggttgcatgggtgggcatttactctgagtaactttgccaagatgtatgcctctaagtttggtgttgacgagtctaagatgatggaaaggctttggggtgagaatttctttgatcctgccaccaaaaagtggactagtaagaacacaggttctcctacatgcaagcgtggctttgtacaattctgttacgagcctatcaagcagatcatcaacacttgcatgaatgaccagaaagataagctctggccaatgttgacaaagcttggtgtcaccatgaagaatgaagaaaaggagttgatgggcaaggcattgatgaaacgtgtcatgcagacatggcttccagcaagtactgccctgcttgaaatgatgatctatcatcttccatctccggctaaggcccagaagtaccgtgttgagaacttgtatgaagggcctcttgatgatatgtatgctactgctatcaggaactgtgatccggaggggcctctcatgctctatgtgtcaaagatgattcccgcatcagataaaggacgattctttgcttttggtcgtgtctttgctggaaaggtgtcaactggtttgaaggtaaggatcatgggtcctaactatgttcctggtgagaagaaggacctctatgttaagaatgtccagagaactgttatttggatgggtaagaggcaggaaaccgtggatgatgtgccttgtggaaacacagttgctatggttggtttggatcagttcattaccaagaatgcaaccttgaccaatgagaaggaagttgatgctcacccaattcgagcaatgaagttctctgtctctcctgttgtgcgtgttgctgttcaatgcaaggttgcatctgatcttcccaaacttgttgaaggtttgaagcgtctggccaaatctgatcctatggttgtttgtacgattgaagaatctggggagcatattattgcgggtgctggtgaactccaccttgagatttgtttgaaggatttgcaagacgacttcatgggtggtgctgagatcatcaagtctgatccagttgtgtctttccgtgagacagttcttgagaaatcttgccgtactgtgatgagcaaatctcctaacaagcataatcgtttatatatggaagcaagacccatggaagaaggacttgcggaggccattgatgatgggcgcattggtccaagggatgatcctaaggttcgtgccaagatcttgtcagaggagtttggttgggacaaggatctggcaaagaaaatctggtgttttggtcctgagaccactggtccgaacatggttgttgatatgtgtaagggagtacaatacttgaatgaaattaaggattctgttgttgcaggtttccagtgggcttcaaaagaaggtgcattggctgaagaaaacatgagaggtatctgctttgaggtttgtgatgtcgttcttcatgctgatgctattcacagaggtggtggccaggttattcctactgcccggagggttatctatgcttcccaaattactgctaagccccgccttctggaacctgtgtaccttgtagaaatccaagcacccgagcaggctcttggtggtatttacagtgttctgaaccagaaacgtggtcatgtctttgaggaaatgcagaggccgggaacacctctgtacaacatcaaggcctacctccctgtcattgagtcatttggtttctctggacaattgagagctgctacatcagggcaggcattcccacaatgtgtgtttgatcattgggacatgatgtcatctgaccccttggaggctggatcccaagctgctctgcttgttgccgatatcagaaagaggaagggtttgaaggagcagatgaccccactttcagaatacgaagacaagctgtaaatcagcttagaaacttttcaatatgctcatggaaagccgggcggtataattttgtctttttttctttctttatttactatgtctcagtactctctatatttaggttttgagtgagttatgatggcccatgttctgccgtgagacagacaccccaattactttgttatattaggtcgttcgtattagacattaatgttgtgctgttctatgttatgttttcgattttcttgaacaattaacttttgatgtatttctactcttgcaaactttttgggc

SEQ ID NO: 2162 - DNA, 2969 bp, Cicer arietinum
ttgcggctgtgaagggaagctcttctcattcgttttcgccgcttccctgttctttctcttcgctataacagactcctttgcggactataaagactagtcaaaatggtgaagttcacagctgatgagttacgtcgcattatggactataagcacaacattcgtaatatgtctgtcattgctcatgttgaccacggaaaatcaacattgacagattcccttgttgctgctgctggaattattgcacaagaggttgctggtgatgtccggatgacagatacccgtgcagatgaggctgagcgtggtatcactattaagtctactggtatctctctatactatgaaatgtctgatgagtctctcaagagttacaagggggaacgtaatgggaatgagtatctcattaatctcattgattcacctggacacgttgacttctcatctgaggttactgctgcactccgtattactgatggagcactagtggtggtggattgtgttgagggtgtttgtgtccaaactgaaactgtgctgcgacaggctcttggtgaaaggattaggcctgttctgactgttaacaagatggacagatgcttccttgagctccaggtggatggagaggaggcttatcagacattccagagggttattgagaatgctaatgtgattatggctacatatgaagatccattgctcggtgatgttcaggtgtatcctgagaaaggtacagttgccttctctgctggtttgcacggttgggcatttactctgaccaactttgcaaaaatgtatgcctcaaagtttggcgttgatgaatccaagatgatggagaggctctggggtgaaaacttctttgatccagccacaaagaaatggaccacaaagaatactggttcaccttcttgcaagcgtggatttgttcaattctgttacgagcctatcaagcagattattaacacttgtatgaatgaccagaaggacaagttgtggcctatgctaacaaagctaggagtcaccatgaaatctgaagagaaagacttgatgggtaaggcattgatgaaacgtgtcatgcagacttggctcccagctagcagcgcactattggaaatgatgatctttcatcttccctctccatcaactgctcagaggtatcgtgttgagaatttgtatgagggtccccttgatgatcaatatgctaatgctatcagaaactgcgatcccgaaggacctcttatgctttatgtctctaagatgattcccgcatctgataagggaaggttttttgcttttggtcgtgtatttgctggtaaggtttcaacaggtttgaaagtcagaattatgggaccaaattacgtccctggtgaaaagaaagacttgtatgtgaaaagtgttcagagaaccgtcatttggatgggaaagagacaggagaccgttgaagatgtgccttgtggtaacactgttgctatggttggtttggatcaatatatcaccaagaatgctacattgacaaatgagaaggaagttgatgctcatcctatccgagcaatgaaattttctgtctcacctgttgtgcgtgttgctgttcagtgcaaggttgcttcagatcttcccaagcttgttgaaggtctcaaacgtttggcaaagtcagatcctatggttgtttgtactattgaggaatctggagaacacattgttgctggtgcaggagagcttcatcttgagatttgtttgaaggacttgcaggatgatttcatgggtggggctgaaattattaaatctgaccccgttgtgtcattccgtgagactgttcttgacagatcatgccgcactgtgatgagtaaatcaccaaacaagcacaacaggttgtacatggaagcaagaccgttggaagatgggcttgcagaggccattgatgaaggcacaattggaccaagggatgaccccaaaatccgttctaaaatcttgtcagagcagtatggttgggataaggatcttgctaagaagatttggtgttttggacctgagaccactggacccaacatggtggttgatatgtgtaagggagtccagtatttgaatgaaatcaaggattctgttgttgctggattccagtgggcatctaaagaaggtgctttagcagaagaaaacatgagagccatttgttttgaagtgtgtgatgttgtcctccacactgatgctatccatagaggaggtggtcagatcattcctactgccaggagagtgttctatgcctcacagctgacagccaaacctaggcttcttgagcctgtttaccttgtggaaatccaagctcctgagcaagctcttggtggtatctacagtgttcttaatcagaaacgtggacatgtgttcgaagaaatgcagaggcctggtactccactttacaacatcaaggcataccttcctgtcgtcgagtcctttggattctccagtcaattgagggctgcaacatcaggacaggctttcccacagtgtgtgtttgatcactgggatatgatgtcatcagatccattggaggctggatcacaagctgcaacacttgttactgatattcgtaagaggaagggtttgaaggagcaaatgactccactctccgagttcgaagacaagctttaaattatttaaactgttttattttatttatcaacttagcttatgttctggtcattgaaactgttacctgagcttttaaagttcagtatcttgagttttttgtgtatgactatcagtctgtcttgtacttcgggattatttgttgttgaatcacttgatttttgggcttatgagttgcaggatttccgttcgtgctggtcaaacttattatgcaaattggtcgtttttcaataactttatgttgtttttataagatgcttgtgtggttttgatgaatagttataccactaattgcagcgattggcaaggttgagttggctaattgtcaacccgatgac

SEQ ID NO: 2163 - DNA, 3230 bp, Cicer arietinum
tccagatccacgaaataaaagcccaaacattatcaatagcgtttagcgttcacaacgagaagcggcaaccctaaaaacctaacaataaaaacctaacaaacaaacaaaaaaaaattaccctttctcgtatccatcacactatttctcttccacacagccgttggtggaaaccagatctcatctcccttcaatttcttcactttgattgatactcgtttttgtttgtggactatacaaaagactagtcaaaatggtgaagtttacagccgatgagttgcgtcgtattatggactataagcataacattcgtaatatgtctgttattgctcatgtcgatcatggaaaatcaacattgacagattcccttgtcgctgctgctggaattattgcacaagaggtggctggtgatgtccggatgacagatactcgtgcagatgaggctgagcgtggtatcactattaagtctactggtatctctctatactatgaaatgtctgatgagtctctcaagagttacaagggagaacgtaatgggaatgagtatctcattaatctcattgattcccctggacacgttgacttctcatctgaggttactgctgcactccgtattactgatggagcactagttgtggtggattgtgttgagggtgtttgtgtccaaactgaaactgtgctgcgacaggctcttggtgaaaggattaggcctgttctgactgttaacaagatggacagatgcttccttgagctccaggtggatggagaggaggcttatcagacattccagagggttattgagaatgctaatgtgattatggctacctatgaagatccattgctcggtgatgttcaggtgtatcctgagaaaggtacagttgctttctctgctggtttgcacggttgggcatttactctgaccaactttgcaaaaatgtatgcctcaaagtttggcgttgatgaatccaagatgatggagaggctctggggtgaaaacttctttgatccagccacaaagaaatggaccacaaagaatactggttcaccttcttgcaaacgtggatttgttcaattctgttacgagcctatcaagcagattattaacacttgtatgaatgaccagaaggacaagttgtggcctatgctaacaaagctaggagtcaccatgaaatctgaagaaaaagacttgatgggtaaggcattgatgaaacgtgtcatgcagacatggctcccagctagcagcgcactattggaaatgatgatctttcatcttccctctccatcaactgctcagaggtatcgtgttgagaatttgtatgagggtccccttgatgatcaatatgctaatgctatcagaaactgcgatcctgaaggacctcttatgctttatgtctctaagatgattcccgcatctgataagggaaggttttttgcttttggtcgtgtatttgctggtaaggtttcaacaggtttgaaagtcagaattatgggaccaaattacgtccctggtgaaaagaaagacttgtatgtgaaaagtgttcagagaaccgtcatttggatgggaaagagacaggagaccgttgaagatgtgccttgtggtaacactgttgctatggttggtttggatcaatatatcaccaagaatgctacattgacaaatgagaaggaagttgatgctcatcctatccgagcaatgaaattttctgtctcacctgttgtgcgtgttgctgttcagtgcaaggttgcttcagatcttcccaagcttgttgaaggtctcaaacgtttggcaaagtcagatcctatggttgtttgtactattgaggaatctggagaacacattgttgctggtgcaggagagcttcatcttgagatttgtttgaaggacttgcaggatgatttcatgggtggggctgaaattattaaatctgaccccgttgtgtcattccgtgagactgttcttgacagatcatgccgcactgtgatgagtaaatcaccaaacaagcacaacaggttgtacatggaagcaagaccgttggaagatgggcttgcagaggccattgatgaaggcacaattggaccaagggatgaccccaaaatccgttctaaaatcttgtcagagcagtatggttgggataaggatcttgctaagaaaatttggtgttttggacctgagaccactggacccaacatggtggttgatatgtgtaagggagtccagtatttgaatgaaatcaaggattccgttgttgctggattccagtgggcatctaaagaaggtgctttggcagaagaaaacatgagagccatttgttttgaagtgtgtgatgttgtcctccacactgatgctatccatagaggaggtggtcagatcattcctactgccaggagagtgttctatgcctcacagctgacagccaaacctaggcttcttgagcctgtttaccttgtggaaatccaagctcctgagcaagctcttggtggtatctacagtgttcttaatcagaaacgtggacatgtgttcgaagaaatgcagaggcctggtactccactttacaacatcaaggcataccttcctgtcgtcgagtcctttggattctccagtcaattgagggctgcaacatcaggacaggctttcccacagtgtgtgtttgatcactgggatatgatgtcatcagatccattggaggctggatcacaagctgcaacacttgttactgatattcgtaagaggaagggtttgaaggagcaaatgactccactctccgagttcgaagacaagctttaaattatttaaactgttttctttttatttatcaacttagcttatgttctggtcattgaaactgttacctgagcttttaaagttcagtatcttgagttttttgtgtatgactatcagtctgtcttgtacttcgggattatttgttgttgaatcacttgatttttgggcttatgagttgcaggatttccgttcgtgctggtcaaacttattatgcaaattggtcgtttttcaataactttatgttgtttttataagatgcttgtgtggttttgatgaatagttataccactaattgcagcgattggcaaggttgagttggctaattgtcaacccgatgacagtgatatgaatgaaaatacttgttaaagttatctgtggatttaaagttatctgatgaaaatacaaaggccgtatggattttaaatgtctcaaaataagcttagtagcatta

SEQ ID NO: 2164 - DNA, 2972 bp, Citrus clementina
ctcgtcttgtcacacacacgctatatatacgcagctacgttgtaaagttcactcctttctctctatttttacggattgagacatttgcagtctctctcgctcgccgcctttgaaagaaatactgttgttgttggtaatatttgagaatcagtcaagatggtgaagttcacagcagaagagctccggcgtattatggacttcaaacataacatccgcaatatgtctgttattgcccatgttgatcatgggaagtcaacccttaccgactctcttgtggctgctgctggtattatcgcccaagaagttgctggcgatgtccgtatgacagatactcgtcaggatgaagctgagcgtggtattacaatcaagtctactggtatatctctctactacgagatgactgatgcggctttgaagagcttcaagggagagcgtcaagggaatgaatacctcatcaaccttattgattcccctgggcacgtcgatttctcatctgaggttacagctgcccttcgtatcactgatggtgcacttgtggtcgtagactgcattgaaggtgtttgtgtccaaacagaaactgtgcttagacaagccctgggtgaaaggattaggccagtcttgactgtgaacaagatggacaggtgcttccttgagcttcaggttgacggtgaagaggcttaccagactttccagaaagtgattgagaatgctaatgtcattatggctacctatgaagatccactccttggcgatgttcaggtttaccctgaaaagggaacagttgctttctctgctggtttgcatggttgggcttttaccttgacaaattttgctaagatgtatgcatccaagttcggagttgatgagtcaaagatgatggagaggctctggggtgagaacttctttgaccctgctacaaggaagtggaccagcaggaacactggctctcccacttgcaagcgtggttttgtccagttctgctatgaacccatcaagcagatcatcaacatttgcatgaatgatgagaaagataagctgtggcctatgttacaaaagcttggtgtcacgatgaagtcggaagaaaaggagttgatgggtaaggcattgatgaagcgtgtgatgcagacctggctccctgcaagtagtgctcttctggaaatgatgatctttcaccttccctctcctgccacggcccaaaagtaccgtgttgagaacttgtatgagggtccccttgatgatgcttatgctaatgccatcaggaactgtgatcccgagggccctctcatgctctatgtatctaagatgattcctgcgtcggataagggtagattctttgcttttggtcgtgtgttctctggcaaggttgcaactggtttgaaggtcaggatcatgggtcctaactatgtccctggtgagaagaaagacttgtatgtgaagagtgtacaaaggactgttatttggatgggaaagaagcaggaaactgtagaggatgtgccttgtggcaatacggtcgccatggttggtttggatcagtatatcaccaagaatgctaccttgacaaacgagaaggaagttgatgcccatcctatccgtgctatgaagttctccgtctcacctgtggttcgtgtggctgtacagtgcaaagttgcatctgatctccctaagcttgttgaaggtcttaaacggttggccaagtcagatcccatggttgtctgttccatggaggaatctggagagcatatcattgccggtgcaggagaactccatcttgagatctgtttgaaggatttgcaggatgatttcatgggtggtgctgagattatcaaatctgatcctgttgtgtccttccgtgagactgtccttgagaagtcctgccgtactgttatgagcaagtctccaaacaaacacaatcgtctctatatggaagcccggccattggaggaaggtcttgctgaggcaattgatgatggtcgtattggtccaagggatgatcctaaggttcgttctaagattctgtctgaggaatttggttgggacaaggatcttgccaagaaaatctggtgttttggtcctgagaccattggtcctaacatggttgtggatatgtgcaagggagttcagtacttgaatgaaattaaggattcagttgttgctgggttccagtgggcatcaaaggaaggtgcattggctgaagaaaacatgaggggcatttgctttgaagtttgtgatgtggttcttcatgccgatgctatccacagaggtggtggccaggttattccaactgctagaagggtcatttatgcatcccagcttacagccaaaccaaggcttcttgagcctgtctacttggtggaaatccaagctcctgaacaggcacttggtggtatttacagtgttcttaaccagaaacgtggtcacgtttttgaggagatgcagagacctggtaccccactttataacatcaaggcatacctcccggtcgttgagtcttttggattttccagcactttgagagctgcaacctctggacaggcattccctcaatgtgtgtttgatcactgggacatgatgtcatctgatccattggagccgggatcccaggcttcacaacttgttttggatattaggaagaggaagggtttgaaggaacagatgacccccctctctgaatatgaagacaagctgtaagcgcttttgccattatcgattgctggcgactagattcattttttgctgcctttggttttgttctgtttttttctttgaaggaaacaatgttgacttatctgagtttgttgttgtagcctctgtttatttaagtttggacgttcaaattctgttattccattcactttctgatctgatatgacttgtgatgaatgttagtactgactatgattgcttttcatgttatgcgttctcgcaataatgacaaaggtatatctagaagcctattttttgccattgcaaat

SEQ ID NO: 2165 - DNA, 3911 bp, Distylium racemosum
cgggagagcccgaattggaaggtctgcagctcgaatccctgcggcgcgcttgctttcgcggatttcgaacatcttggttattcttaatatcaagcgttgttttggtgaatataaaagttagcaaaaatggtgaagttcacagctgaagaactacgtaggattatggacttgaaacataacatacgcaatatgtctgttattgcccatgttgaccatggaaagtctacactcaccgattcgttggtggcagcagctggtatcattgctcaagaagttgctggtgatgtcagaatgactgatactcgtgcggatgaagctgagcgtggtatcactataaagtcgacgggaatctccttgtactatgagatgactgatgcagaactcaagagtttcaagggtgagagaatgggtaatgagtatttgattaatctgattgattctccggggcatgttgacttctcttcggaggttacagcagccctgcgcattacagatggtgcgttggtcgtggtagattgtattgaaggagtttgtgtgcagactgaaactgttcttcgacaagctcttggagaaagaattaggccagttcttactgtgaacaagatggataggtgctttcttgagttacaggttgatggagaggaagcttttcagacattttctcgtgttattgaaaacgcaaatgttattatggctacttatgaagatccacttcttggtgattgccaagtttacccagacaaaggtactgttgcattctcagctggtttgcatgggtgggcatttactttgacaaattttgcaaaaatgtatgcttcaaagtttggagtggatgaaggcaagatgatggagaggctgtggggtgagaacttttttgatccagctacaaagaaatggacaacgaaaaacacaggatctggaacatgcaaaagaggctttgtccaatttatttatgaacctattaagcagatcataaatatttgtatgaatgatcaaaaggataagttatggccaatgctgcaaaaactgggagttgtaatgaagggtgaggagaaagaactgcttgggaagcacctcatgaaacgtgttatgcagacctggttacctgcaagcaaagctttgctagagatgatgatattccatcttccatctccatcaaaggcacagagatatcgtgtagagaacttgtatgaagggcctcttgatgatatgtatgcaaatgcaatcagaaattgcgacccagaaggaccattgatgttgtatgtttcaaaaatgattcctgcctcagataagggacgattctttgcctttggccgtgtttttgctggcaaagtttctacaggaatgaaggtaaggatcatgggtcctaactatgtgcctggtcaaaagaaggatttgtatgtaaaaagtgtccagaggacagtcatatggatgggcaaaagacaagaatccgttgaggatgtgccttgtggaaatacagttgctatggttggcttagaccaatacatcactaagaatgctactttgacaaatgagaaagaggttgatgctcatccaatcagagcaatgaagttctctgtgtcacctgttgtccgtgttgctgtgcaatgcaaggtggcttctgatcttccaaagcttgtggaaggattgaagcgacttgctaagtcagatcctatggttatgtgttcaattgaggaatctggtgaacatatcattgctggagcaggagaacttcatcttgagatttgcttaaaggatttacaagatgattttatgggtggagctgagattgtcgtgtctgatcctgttgtctcatttagagaaactgtgctggagaaatcatgccgtactgtgatgagcaagtctcccaataagcacaacaggctttactttgaagcaaggcctctggaagaaggtctccctgaagcaattgatgatggtcgcattggcccaagggatgatcccaaggcccgttctaagatcctttctgaggagtttggatgggacaaagatctggcaaagaagatttggtgttttgggcctgaaaccactggtcccaacatggtagttgacatgtgtaaaggagttcagtacttgaatgaaattaaagattcagtggttgcagcattccagtgggcatctaaggaaggagctcttgcagaagagaacatgcgtggtatctgttttgaggtctgtgatgttgttttgcatactgatgccatccacagaggaggtggtcagattatcccaacagccagaagggttatgtatgcagctcagattactgccaaaccaaggcttcttgagccagtgtatcttgtagaaattcaggctcctgaacaggcacttgggggtatttatggtgtgttgaaccagaagagaggtcatgtctttgaggaaatgcagaggcctggaactccactttataacattaaggcttatttgccagtcattgagtcatttggtttctcaggtactcttcgtgctgcgacatctggccaggctttccctcaatgtgtgtttgatcactgggatatgatgaattctgacccaatggaccatggcacaccagcttataaccttgttactgatatccgtaagaggaagggtctgaaggagcagatgactcctctgtcagagttcgaggataagctataaagcttttgtctgtgggacgctattaagggaacatactattgtgttggataagattcgggatagacctgaaagatggagggtcagaggattaaatcactctcctgttgagtatgaaaacgtttttaggttgtgtcaggatagtttaagttccatcttgaaactctttttgatatttattttactttccagaaactatggcaattttacatatcatttattttatggctacttttctgagacacataagttttgcatgacaagtaaattgaagattttgtgtctattcacaccatctctgttatgataggtgtggttatggtcttttattgtttgccaattcaatggccttgtgctgtatgcctcacatccattctacagctaatgaattttgttacaacaatttaacagttaatttataaatttgagtttatcatgacttaaaaaaaaaaaaaaggagtagtccagacaagcttcccccacgctccagcaaatttattcaggcctaataaacgaccgttatcttcaatgtctcccactatagttctcaaggatggacaattagcagggtgctgggtggaagtggcggcatgtttataattcctgcagttgctcaagtgtttattaaccacttcattaaagggatggatccattggctgctgtgacagctccaagagtcttccacgagttgattcccaacgttgtcaggtacgagaactggacgattgtggatggagaccacattgaactttcagatgagtcgaaggtaggtcttagaaagctaggccatgagttaaaagcaatggctggaggtgctatatgtcaacttgtagtgcagaatctggataatcctatcaaagtgcagggatctgataatcaagtcttttatggggtactaacagccgtaagtgatcccagaaaagatggcattccagctgggttctagatccttaaacttgtctataaatatcatttctgccgacgcctgtaagtttttagtccatgtgtaatcttctccacaaaatgtcttattcaagattagcctagatgttggttttagaaagggcattgaccactaaggagcctctgctgcctgctgctgctctgtgtcagtttagttctatgccatgatgagcttaccttcataagctaaattcaaggattgttctaattcaagagcgcactgttccctaattttgtggagatgatctgcatgctttcactctataaatagggatcgaacctaagtgtatat

SEQ ID NO: 2166 - DNA, 2803 bp, Euphorbia peplus
tttgtgcgccttttttctatcatcacagtgagagatttcagaggctgcctcttcatctctctcattttcgccgccttttcaggtttcttttgattgtttttgcggcctttaaaatctagcaaaaatggtgaagtttacagctgaagagcttcggcgtattatggacttgaagcacaacatccgtaatatgtctgttattgctcatgtggatcatgggaagtcaactctcacagactctcttgtggctgctgctggtatcattgcacaagaagttgctggtgatgtacgtatgactgatacccgtgctgatgaagcagagcgtggtattacaattaaatctactggtatctcactttattacgagatgactgatgcttccctcaagagcttcaaaggagagaggatgggcaatgaatatcttatcaatcttattgattctcccggccacgttgacttttcatctgaagtcactgctgctcttcgtattactgatggtgctcttgtggtggttgattgtatcgagggtgtgtgtgtccaaactgaaactgttcttcgccaagcattgggtgaaagaatcaagcctgtattgacagtcaacaagatggacaggtgcttccttgagctacaggttgatggtgaggaggcatttcaaacattctccagggtcattgagaacgctaatgtcatcatggcaacatacgaagatcctcttctcggggattgccaagtataccccgagaaaggaactgttgctttctcagctgggctccatggttgggctttcactttgacaaattttgccaagatgtatgcctcaaagtttggagttgatgagtctaaaatgatggaaaggttatggggtgagaattttttcgatccagccaccaggaagtggactaccaagaacactggaactgctacctgcaagcgcgggtttgtacagttctgttacgagcctatcaagcaggtcattaatacttgcatgaatgaccaaaaggataagttatggcccatgttgcagaagcttggtatttccatcaagtcggaggaaaaggatttgatggggaagcctttgatgaagcgtgtcatgcagacctggctgcctgctagctctgctctattggaaatgatgatattccaccttccatcaccttccaccgcccagaggtatcgtgttgagaacttgtacgagggtccccttgatgatatgtatgcaaatgctatcaggaactgcgatcctgaaggccctctcatgctttacgtgtcaaagatgattccggcttccgataagggtagattctttgcttttggtcgtgtgtttgcaggaaaggtatccactggtttgaaggtgaggatcatgggtcccaactatgtacctggtgagaagaaagatttgtacactaagagtgttcagagaactgttatttggatgggaaagaagcaggaaactgttgaagatgttccatgtggaaacacagttgctttggttggtttggatcaatacatcaccaaaaatgcaacattgaccaatgagaaggaagttgatgctcatccaattcgggctatgaagttctccgtctctcctgttgtgcgtgttgctgttcaatgcaaagtggcatctgatctacccaagcttgttgaaggtctaaaacgtttggccaagtcagatcctatggttgtgtgttccattgaggagtccggcgaacacatcattgctggtgcaggtgagcttcatcttgagatctgtttgaaggatttggtggatgatttcatgggtggagctgagatcatcaaatcagatccagttgtgtccttccgcgagacagtccttgagaagtcttgccgtatagtgatggccaagtcccccaacaagcacaacagactttacatggaggcacggcctttggaagatgggcttgctgaggcaattgatgatggtcgtattggcccaagagatgaccccaaagttcgttctaagatcttggctgaggaattcgggtgggacaaggatctcgctaagaagatttggtgctttggtccagaaaccaccggcccaaacatggtggttgatatgtgtaagggagttcagtaccttaatgaaatcaaagattctgttgttgctggttttcagtgggcatcaaaggagggtgcattagccgaagagaacatgaggggtatctgctttgaggtgtgtgatgttgttcttcacactgatgctattcacagaggaggtggtcaggttattccaactgcacgaagagtcatttatgcttcacagttaacagccaaacctaggctgctcgagccagtctacctcgttgagatccaagccccggaacaggcccttggtggtatttacagtgtcctgaatcaaaaacgtggtcatgtcttcgaggaaatgcaaaggcctggtacacccttgtacaacatcaaagcctatcttcctgtcgtggagtcttttggtttttcaggaactctaaggcaggctacctctggacaagctttcccacaatgtgtcttcgatcattgggatatgatgacttcagatccattagatcccacttcacaagctgctacgctcataatggatatccgcaagaggaagggcttgaaacaacagatgacacctctttctgaattcgaagacaagctgtgagcaaatttttctacttcagaactcaacttttcgtacctttttatattttcctcgctgcactttttcttaagacgttaacgcttgaggtgcttctagttaatttattttcatgggatctgttgtgcccattattatgttataactatg

SEQ ID NO: 2167 - DNA, 2975 bp, Citrus sinensis
ctcgtcttgtcacacacacgctatatatacgcagctacgttgtaaagttcactcctttctctctatttttacggattgagacatttgcagtctctctcgctcgccgccttcgaaagaaatactgttgttgttggtaatatttgagaatcagtcaagatggtgaagttcacagcagaagagctccggcgtattatggacttcaaacataacatccgcaatatgtctgttattgcccatgttgatcatgggaagtcaacccttaccgactctcttgtggctgctgctggtattatcgcccaagaagttgctggggatgtccgtatgacagatactcgtcaggatgaggctgagcgtggtattacaatcaagtctactggtatatctctctactacgagatgactgatgcggctttgaagagctacaggggagagcgtcaagggaatgaatacctcatcaaccttattgattcccctgggcacgtcgatttctcatctgaggttacagctgcccttcgtatcactgatggtgcacttgtggtcgtagactgcattgaaggtgtttgtgtccaaacagaaactgtgcttagacaagccctgggtgaaaggattaggccagtcttgactgtgaacaagatggacaggtgcttccttgagcttcaggttgacggtgaagaggcttaccagactttccagaaagtgattgagaatgctaatgtcattatggctacctatgaagatccactccttggcgatgttcaggtttaccctgaaaagggaacagttgctttctctgctggtttgcatggttgggcttttaccttgacaaattttgctaagatgtatgcatccaagttcggagttgatgagtcaaagatgatggagaggctctggggtgagaacttctttgaccctgctacaaggaagtggaccagcaggaacactggctctcccacttgcaagcgtggttttgtccagttctgctatgaacccatcaagcagatcatcaacatttgcatgaatgatgagaaagataagctgtggcctatgttacaaaagcttggtgtcacgatgaagtcggaagaaaaggagttgatgggtaaggcattgatgaagcgtgtgatgcagacctggctccctgcaagtagtgctcttctggaaatgatgatctttcaccttccctctcctgccacggcccaaaagtaccgtgttgagaacttgtatgagggtccccttgatgatgcttatgctaatgccatcaggaactgtgatcccgagggccctctcatgctctatgtatctaagatgattcctgcgtcggataagggtagattctttgcttttggtcgtgtgttctctggcaaggttgcaactggtttgaaggtcaggatcatgggtcctaactatgtccctggtgagaagaaagacttgtatgtgaagagtgtacaaaggactgttatttggatgggaaagaagcaggaaactgtagaggatgtgccttgtggcaatacggtcgccatggttggtttggatcagtatatcaccaagaatgctaccttgacaaacgagaaggaagttgatgcccatcctatccgtgctatgaagttctccgtctcacctgtggttcgtgtggctgtacagtgcaaagttgcatctgatctccctaagcttgttgaaggtcttaaacggttggccaagtcagatcccatggttgtctgttccatggaggaatctggagagcatatcattgccggtgcaggagaactccatcttgagatctgtttgaaggatttgcaggatgatttcatgggtggtgctgagattatcaaatctgatcctgttgtgtccttccgtgagactgtccttgagaagtcctgccgtactgttatgagcaagtctccaaacaaacacaatcgtctctatatggaagcccgaccattggaggaaggtcttgccgaggcaattgatgatggtcgtattggtccaagggatgatcctaaggttcgttctaagattctgtctgaggaatttggttgggacaaggatcttgccaagaaaatctggtgttttggtcctgagaccattggtcctaacatggttgtggatatgtgcaagggagttcagtacttgaatgaaattaaggattcagttgttgctgggttccagtgggcatcaaaggaaggtgcattggctgaagaaaacatgaggggcatttgctttgaagtttgtgatgtggttcttcatgccgatgctatccacagaggtggtggccaggttattccaactgctagaagggtcatttatgcatcccagcttacagccaaaccaaggcttcttgagcctgtctacttagtggaaatccaagctcctgaacaggcacttggtggtatttacagtgttcttaaccagaaacgtggtcacgtttttgaggagatgcagagacctggtaccccactttataacatcaaggcatacctcccggtcgttgagtcttttggattttccagcactttgagagctgcaacctctggacaggcattccctcaatgtgtgtttgatcactgggacatgatgtcatctgatccattggagccgggatcccaggcttcacagcttgttttggatattaggaagaggaagggtttgaaggaacagatgacccccctctctgaatatgaagacaagctgtaagcgcttttgccattatcgattgctggcgactagattcattttttgctgcctttggttttgttctgtttttttctttgaaggaaacaatgttgacttatctgtgtttgttgttgtagtctctgtttatgtaagtttggacgttcaaattctgttattccattcgctttctgatctgatatgacttgtgatgaatgttcttagtactcactatgattgcttttcatgttatgcgttctcgcaataatgataaaggtatatctagaagcctattttttgccattgcaaat

SEQ ID NO: 2168 - DNA, 3036 bp, Papaver somniferum
aacacctaaccattagggtttagataagaagaggaaacccttccttctttcgttactctttctcttctttctttctccttcttctcctcccactgcggcacttcctctcagggatttgcctgttcagtgatatttggtagtaacaaagttattttttacagaagcaaagatggtgaagtttacagctgaagagctgcgccggatcatggacctgaagcataatatcaggaacatgtccgtcattgctcatgtcgaccatggaaaatcaacacttactgattctcttgtggctgctgctggtattattgcccaagaaactgctggtgatgttcgtatgacagatacccgtgcagatgaggcagaacgtggtattacaattaaatctactggtatctctctctattatgagatgtctgatgagtctttaaaggcctacaagggtgacagaatgggtaacgagtacctcatcaaccttatcgattcacctggtcacgtcgacttttcttctgaagtcacagctgcattacgtattactgatggtgcacttgttgtggtggactgtattgagggtgtctgtgttcaaaccgagactgtccttcgacaagctcttggagaaaggatcaggcctgtgttgactgtcaacaagatggacagatgtttcctagagctacaggttgatggagaagaggcttatcagaccttctccagagttattgagaatgccaatgttatcatggccacttatgaagacccactccttggtgacgtccaggtttatcctgaaaaaggaactgtcgccttctctgctggtttgcacggttgggctttcactctaaccaatttcgcaaacatgtatgcttctaagttcggtgttgaacacagtaagatgatggagaggctttggggtgagaacttctttgacccagcaactaagaagtggactaataagagaaccgcgtctcctacatgtaagcgtgggtttgtccagttctgttatgaacccatcaagcagatcattgccacttgcatgaatgatcaaaaagacaagttgtggcctatgttgcaaaagcttggtgttacaatgaagaatgatgagaaggaattgattggaaagcccttgatgaagcgtgtgatgcagacttggctccctgcagctactgccctacttgaaatgatgatttatcatctcccctctccccacacagctcagaagtatcgtgttgagaacttgtacgagggtcctcttgatgaccagtatgctaatgccatcagaaactgtgatcctgaaggtcctcttatgctctacgtgtctaagatgattcccgcctccgacaagggtagattctttgccttcggtcgtgtctttgctggtaaggttgcaacaggtgctaaagtcagaatcatggggcctaactatgttcctggtgggaagaaggacttgtacaccaagagtgtccagagaactgttatctggatgggaaagaaacaggagtctgttgaggatgttccttgtggtaacacagttgccctggtcggattggatcaatttatcaccaagaatgcaaccctcacaaacgagaaggaagttgatgctcatcctatcagagccatgaagttttctgtctctcccgttgttcgtgttgctgtccagtgtaaggttgcctctgacttgcccaagctggttgaagggcttaagcgtctgtccaaatctgaccctatggttgtgtgtaccattgaggagtcaggagagcacattattgcaggtgctggagaactccatcttgagatctgtttgaaggatttgcaggatgatttcatgggtggtgctgaaattgtgaagtccgaccccgtggtgtctttccgtgagactgtgcttgaaaagtcttcaagaactgtgatgagcaaatctccaaacaagcacaaccgattgtacatggaggcacgtcctcttgaggatggacttgctgaagccattgatgatggtcgtattggtccaagagatgatcctaaagttcgttcaaagatcttatctgaagagtttggatgggataaggatcttgcaaagaagatctggtgttttggtcccgatactactggtccaaacatggttgtggatatgtgtaagggagttcagtaccttaatgaaatcaaggattcagttgttgcaggttttcagtgggcgtcaaaggaaggtgtgctggcagaagagaacatgagaggtatatgctttgaagtatgtgatgtggttctccattctgatgccattcacagaggtggtggacaggttattcctactgctaggagagttatgtatgcctcacagctcacagctaaacccagacttttagaacctgtgtacctggtcgaaatccaggctcccgaaggtgctcttgggggtatctacggtgttctcaatcagaagcgtggtcacgtctttgaggaaatgcagagaccaggaactcctctgtacaacatcaaagcatatctacctgtagttgagtcatttggtttctctgcccagcttagggctgccacatcaggacaggctttcccccagtctgtgtttgatcattgggatatgatgatggctgatcctttggaacaaggcactcaagcttcagatcttgtgactgagatcaggaggaggaagggtttgaaggctcagatgacccctctatctgattttgaggacaagctttaagtatgaggttactcgtaaaagttcctggaagtgaagagagctagatgacattgttgatccgaactagagttttggttgggagagtgttaatcctaaaagacccctcttttgttttccattttggtttttcttctgctgggtgtgtaacactattaatatttacgaaactttcacaatgtgttctcgtgattttgatccatgaaacaacatttttcccagtagcaagtctttgtagtttataatagggatccatgaacatcaatgagatggtttttgtttgcagcttattattttggatgctgatggtaatgtttatatattgctttgttgtggga

SEQ ID NO: 2169 - DNA, 3054 bp, Pseudotsuga menziesii
agttagacaaaatggtgaagttcacagctgaagggcttcgtggtattatggacaggaaacataacatacggaacatgtctgttattgcccatgttgaccatggaaaatctactctcacagattctttggtagcagcagctggtattattgctcaagaagttgctggagatgtcaggatgactgatactcgtgctgatgaagctgaacgtggtatcaccatcaagtcaactggaatctcattgtattatgagatggaggatgcggctgtgagaaatttcaagggggatagagtaggaaacgaatatttgataaatctgatcgattctccagggcatgttgacttctcttcagaggttacagcagctctgcgaattaccgatggtgcattggttgtggtagattgcattgaaggggtttgtgtccagaccgaaactgttcttcgtcaagctcttggagaaaggattaggccagttcttactgtgaacaagatggacaggtgctttcttgaattacaggttgatggagaggaagcttaccaaactttttcacgtgtcattgaaaatgcaaatgtgattatggctacttatgaagatcctcttcttggtgattgccaagtttatcccgaaaaaggtacggttgcattctctgcaggtttgcatgggtgggcatttactttgacaaattttgcaaaaatgtatgcttcaaagtttggagtggatgaatctaagatgatggagaggctgtggggtgagaacttttttgatccagctaccaagaaatggacaaccaagaatacaggttcagcaacctgcaaaagaggttttgttcaatttatatatgaacctattaagcaaatcatcaatatttgtatgaatgatcaaaaggacaagttgtggcccatgttgcagaaattgggagttgtgatgaagagtgacgagaaggagctggttgcaaaggcactcatgaagcgtgtcatgcaaacctggctacctgcaagtagtgctttacttgaaatgatgatttttcatcttccttctccagcgaaggcacagagatatcgtgtggaaaacttgtatgaaggacctcttgatgatgtatacgcaactgcaattaggaattgtgatcctgaggggccactgatgttgtatgtttcaaaaatgattccagcctcggacaaaggacgtttctttgcctttggccgtgttttcgctgggaaagtggcaacaggtatgaaggtaaggatcatgggtcccaactatgtgccaggtcagaaaaaagatttatatacaaagagtgttcaaaggactgtgatatggatgggaaagaaacaagaatctgtagaggacgtgccttgtggaaatacagtggctatggttgggttagatcagttcataacaaaaaatgctactctaacaggtgagaaggaggttgatgctcatcccatcagagcaatgaagttctctgtctcccctgttgtacgtgttgctgtgcagtgcaaggttgcttctgaccttccaaaacttgttgaagggctgaagcgtcttgctaagtcagatcctatggttgtatgtacaattgaggaatctggagaacatattattgcaggtgcaggagagcttcatcttgagatttgcttaaaagatcttcaagaagattttatgggtggagctgagattgttgtttctgatcctgttgtctcatttagagaaactgttttggagaaatcatgccgcactgttatgagcaagtctccaaataagcacaacaggctttattttgaagcaagacctttggaagacggtcttccagaagcaattgatgatggtcggattggcccgaaggatgatccaaaggctcgtgcaaaaatcctttctgaggagtttggatgggacaaagatttggctaagaagatctggtgctttgggcctgaaaccactggtcccaatatggtggtggatatgtgtaagggggttcagtacttgaatgaaattaaagattctgtggttgctgcattccaatgggcttccaaggaaggtgctcttgcagaagaaaacatgcgtggtatttgctttgaggtttgtgatgtggttttgcacactgacgctatccacaggggaggtggccaggttattccaacagccagaagggtcatgtatgcatctcagcttactgccaaaccaaggctgcttgagccagtatatcttgttgagattcaggctcctgagcaggcccttggtggtatatatggtgtgctgaaccagaagagaggtcacgtatttgaggaaatgcagaggccaggaactccattatataacatcaaggcatatctgccagtcgttgaatcatttggattctcaagtactctccgtgctgcaacttccggccaggctttcccacaatgtgtctttgaccactgggatatgatgggatctgatccattggaagctggttcccaagctgggcagcttgttacggatattcgcaagaggaagggtctcaaagagagtatgacccccttgtcagagtatgaagacaagctgtaaagcttttgctatgtttgcatgccggatggtgtcaagattgagggacctgctggagtattaaaatacagttttgtgtgttaggactagttaaatttaagctactaagatatttttgtgatctgttatttactttagagatagaagttgactcatcagaaccatttttaagtagattcgtcttttgaaattgcaaaatggcaagctgtattgcaatcagttcatttgtctcaagattgagggacctgctggagcattgaaatacagtcttgtgtgttaggactagttaaatttaagctactaagatatttttgtgatctgttatctactttagagatagaagtagactcttcagatccatttttttaatagatttgtcttttaaaaattgcaaaatgggaagctgaattgcaatcggttcatttgttttctgatacacaataatgtataccaattttgtaatactccatgggactaattattttgtataatataaatgccctatatatcacaa

SEQ ID NO: 2170 - DNA, 3137 bp, Helianthus annuus
atcgccgctcattttatctcttggtgctccaaaacctaaaccactgagaactctttgcagccgttttctctcgttttgtttggattttgtgagaagcaattcagctatatttctgtcagagctctaaaaactagccaaaatggtgaagtttaccgctgaagagcttcgaaggattatggactacaagcataacattcgtaatatgtctgttattgctcatgtcgatcatggaaaatccactttgactgattctcttgtggctgctgctggtattattgcccaagaagttgctggtgatgttcgtatgactgatacccgtgctgatgaagcagaacgtggtattacaatcaaatccactggtatctctctttactacgagatgaccgatgaagctttgaaaagcttcaagggagaaagaaatggaaacgagtacctgatcaatcttatcgactcacctgggcacgttgacttttcttccgaagtcactgctgctctacgtatcactgacggtgcactcgtggtggttgattgtatcgaaggtgtctgtgtgcaaaccgaaactgttcttcgacaagctctcggagaaagaatccgacctgtcttaactgtcaacaagatggacaggtgttttctcgagcttcaggttgatggtgaagaagcgtatcaaacgtttcagagggttattgaaaacgctaatgtcatcatggctacttatgaggacccacttcttggtgatgtcatggtttaccccgagaaaggaaccgttgctttctcagctgggctccacggttgggcttttacactaactaactttgctaagatgtacgcttcgaaattcggtgttgacgagtctaaaatgatggaaaggctttggggagagaactttttcgacccgaaaaccaagaagtggaccactaagagcaccggcaccgcaacctgcaaacgtgggttcgttcagttctgttacgagccaattaagcagattatcaacacatgcatgaatgaccagaaagatcagttgtggcctatgttgacaaagcttggtgtcaccatgaaatccgaagagaaagagttgatgggtaaggcgttgatgaagcgtgttatgcagaattggcttccggctgctaccgctttacttgaaatgatgatctttcatctgccttcacctcacactgcccaaagataccgtgttgagaatctttatgagggtcctttggacgatcaatatgctaacgctatcagaaactgcgaccccgatggtccccttatgctttatgtttctaagatgattcccgcttctgataaaggtagattcttcgcctttggtcgtgtttttgctggtagggtctctaccggtttgaaggttcggatcatgggtcccaactatgttcctggtgaaaagaaagatttgtacgttaagagtgttcagagaaccgtcatctggatgggaaagaagcaagaaaccgttgaagacgtaccgtgtggtaacacagtggctatggtcgatttggatcagttcatcaccaaaaacgcaacgttaacaaacgaaaaggaagtcgacgctcatcccatccgagccatgaagttttccgtctcacctgtggtgcgtgttgcggtccagtgcaaggtggcgtctgatctacccaagcttgttgaaggtctgaaacgtctggcgaaatctgaccctatggttgtgtgtactattgaggagtctggtgaacacatcattgctggtgccggtgagcttcatttggaaatctgtttgaaggacttgcaagatgatttcatgggtggtgcggaaatcgttgtttccgaccctgttgtgtctttccgtgaaaccgtcttggagaaatcatcccgaaccgtgatgagcaagtctcctaacaaacacaaccgtctctacatggaagctagacccatggaagatggtcttgctgaggctatagatgaaggcagggtgggcccacgtgatgaccccaaggttcgtgctaagatcttgtctgaggagttcggttgggataaggatttggctaagaagatctggtgttttgggcctgaaacaactggtcccaacatggttgtcgacatgtgtaagggagtccagtatcttaatgaaatcaaggattcggtggttgctggttttcagtgggcttctaaagaaggtgctttggctgaagagaacatgaggggtatttgctttgaagtgtgtgatgtcgttctccatgctgatgctatccacagaggtggtggtcaagttattccaaccgcaaggagagtcatatacgcgtctcagttgaccgcgaagccacgtttgctagagccggtctaccttgttgaaattcaagcacccgagcaagctttgggtggaatctacagtgtgctgaatcaaaggcgtggacacgtgtttgaagaaatgcagaggccgggtaccccactgtacaacatcaaggcttatcttccagtcgtggagtcattcgggttttctggtgccttgagagcttctacttcgggtcaagctttcccacaatgtgtgtttgaccattgggacatgatggggtcagatccattggaagctggttcgcaggcaagcacgctggtgacccagatccgtaagaggaagggtttgaaggagcagatgacaccactgtctgagtttgaggataagctgtaagcgctggatgcaagctgtaagtgctggatgagatgttatcgagaattactgtctgggtttcatgttatttttctacaatgttttttagtatgctggttgtactatgttatgttttgttgtcgtgagaaacacctacttgcagacgttgatgctgttaattttgacattcttgcttttaccattttcagtttttagttttctatatcttctgttgtgttctggctataggtgaattggagaacagataacaagccatgcttgttgcagttgatgaatgccaaaaggtttcttggacattgcgcccagcttttctatttggttgcattgttgacatgctttgtgcatcaatgatatctgtataacaccagataagtttgattcataatagtatcttacgttataacaagcatattaagtaatatactccccttagtcacaataagataagtttaaatcatacaatggc

SEQ ID NO: 2171 - DNA, 2712 bp, Trigonella foenum-graecum
ccggcacacagccaaccagccgctaatctcctcccaccactccgtctgtcggtggagatcagccatcgccttcatctttgaacaacactcttttttcttgtggattatttgaaagacttatcacaatggtgaagtttactgctgatgagttacgtcggattatggactacaaacacaacattcgtaacatgtctgtcattgctcatgttgatcacggaaaatcaactttgacagattcccttgttgctgccgctggaattatagcacaagaggttgctggagatgtccgaatgacagatacccgtgctgatgaagctgaacgtggtatcactattaagtccaccggaatctctctatactatgaaatgactgatgagtctctgcagagttttaagggggagcgcgatgggaatgagtatctcattaatctcattgattcccctgggcacgttgacttctcatctgaggttactgctgcacttcgaattactgatggagcactagtggtggtggattgtgtcgagggggtttgtgtgcagactgaaactgtgctgcgacaggctcttggagaaaggatcaggccggttctgactgttaataagatggacagatgcttccttgagctccaggtcgatggagaggaggcttatcagaccttctcgagagttattgagaatgctaatgtgatcatggctacatatgaagatccattgcttggtgatgttcaagtgtatcctgagaaaggaacagttgctttctctgctggtttgcacggttgggcttttacactgaccaactttgcaaagatgtatgcctccaaatttggtgttgatgagacaaagatgatggagaggctttggggtgaaaatttctttgaccctgccactaagaaatggaccaccaagaatactggttcagctacttgcaagcgtgggtttgttcagttctgttatgagcctatcaagcaggtcattaacacttgtatgaatgatcagaaggataagttgtggccgatgttgacaaagttagggatcaccatgaaatcagaggaaaaggacttgataggtaagcctttgatgaaacgtgtcatgcagacatggctcccagcaagcactgcacttcttgaaatgatgatctttcatcttccctctccatctacagctcagaggtatcgtgttgagaatttgtatgagggtccccttgatgatcaatatgctactgctatcagaaactgtgaccctgaaggacctctcatgctttatgtgtcaaagatgattcccgcttctgataaaggaaggttttttgcttttggtcgtgtatttgctggtaaagtttcaactggtttgaaggtcagaattatgggaccaaattatgtccctggtgagaagaaagatttgtatgtgaaaagtgttcagagaactgttatttggatgggaaagagacaagaaactgttgaggacgtgccttgtggtaacacagttgctatggttggtttggatcaatttattaccaagaatgctaccttgacaaatgagaaggaagttgatgcacaccctattcgtgccatgaagttttctgtctcacctgttgtgcgtgttgctgttcagtgcaaggttgcttcagatcttcctaagcttgttgaaggtctcaaacgtcttgctaagtcagatcctatggttgtttgtactattgaggagtctggagaacacattgttgctggtgcaggagagcttcatcttgagatctgtttgaaggatttggtggatgatttcatgggtggagctgagattatcgtatccgaccctgttgtgtccttcagagagactgttctagagagatcatgccgcacagtgatgagtaaatcacccaacaagcacaacagattgtacatggaagctagaccattggaggatgggcttgcagaggccattgatgatggcaagattggaccaagggacgaacctaagaatcgttccaaaatcttatcagaagagtacggttgggataaggatcttgccaagaaaatctggtgttttggacccgagactactggacccaacatggtggttgatatgtgtaagggagtccaatacttgaatgaaatcaaggattctgttgttgctggattccagtgggcatcaaaagaaggtgctttgtctgaagaaaacatgagagccgtatgctttgaagtatgcgatgttgtcctccacacggatgctatccacagaggaggtggtcagatcattcctactgctaggagagtcttctatgcctcacagctgacagccaaacccagacttcttgagcctgtttacatggtggaaatccaagctcctgagcaagcccttggtggtatctacagtgttcttaaccagaagcgtggacatgtctttgaagaaatgcagaggcctggtactccactttacaacatcaaagcataccttcctgtcatcgagtcctttggattctccagccaattgagggctgcaacatcagggcaggctttccctcagtgcgtgtttgatcattgggatatgatgtcatcagatccattggaggctggatcacaggctgcacaacttgtcaccgatattcgcaagaggaagggtttgaaggagcagatgacacccctatctgagtttgaagataagctttaaatggaagactttttatttttttatctatgagttagctgatgttctcgtcatttaa

SEQ ID NO: 2172 - DNA, 2848 bp, Vinca minor
aggttttatcggaacttttaaatcaatttttgtgtactctttaacgatccgtcaagatggtgaagttcacagctgaagggctccgtaggattatggactacaagcacaacatccgtaacatgtctgtcattgcccacgtggatcatgggaaatccacccttaccgattctcttgtcgctgcggccggtatcattgctcaggaagttgctggtgatgtcagaatgacagataccagggcagatgaagccgagcgtggtatcactatcaagtccactgggatttccctttattatgagatgactgatgatgctctcagaggcttccatggagagcgagaagggaatgagtacctcatcaaccttatcgattcccccggacacgttgacttctcatctgaagttacagctgcgctccgtattactgatggtgctttggttgtggttgattgtgttgagggagtttgtgtgcagactgaaactgtcctccgacaagcccttggtgagaggattcgacctgttctgactgtcaacaagatggacagatgtttccttgagcttcaggttgatggagaggaggcgtatcagactttccagaaggttattgagaatgctaatgttatcatggctacatatgaagatcctcttctaggagatgttatggtttatcccgagaaaggaacagttgctttttctgctgggttgcacggttgggcatttactttgagtaacttttcgaagatgtatgcctctaagtttggtgttgatgaatctaagatgatggaaagactttggggtgagaatttctttgatcctgctaccaagaagtggaccagtaagaacacaggttctccaacatgcaagcgtggtttcgtgcaattctgctatgagcccatcaagcagatcatcagcacttgcatgaatgatcagaaagataagctctggcccatgttgcagaagctcggcgtcaccatgaagtctgacgagaaagatttgatgggcaaggcactgatgaaacgtgtcatgcaaacttggcttccagcaagtaccgccctacttgaaatgatgatctatcatcttccatctccgtccaaggcccagaggtaccgtgttgagaatttgtacgaagggcctcttgatgatgtctatgctaatgctatcagaaactgtgaccccgatggccctcttatgctctacatttctaagatgattccagcatctgataaaggtcgattctttgcatttggccgtgtttttgctggaaaggtgtctactggtttaaaggtcagaattatgggtcctaactatgttcctggtgagaaaaaggatctctatgttaagaatgtccagagaaccgttatttggatgggtaagaggcaagaaaccgtggatgatgtgccttgtgggaacacagttgctttggttggtttggatcagttcattaccaagaacgcaaccttgacaaatgagaaggaaactgatgctcacccaattcgtgcaatgaagttctctgtctcgcccgttgtgcgtgttgcagtccaatgcaaggttgcatctgatcttcccaaacttgttgaaggtttgaaacgtttggccaaatctgatcctatggttgtctgtacaattgaagaatctggagaacatattattgctggtgctggtgaacttcacctcgagatttgtttgaaagatttggttgacgacttcatgggtggtgctgaaatcatcaagtctgatccagttgtgtctttccgtgagacagttcttgagaaatcttgccgtactgtgatgagtaaatctcctaacaagcataatcgtctgtacatggaagcaagacccttggaggaaggacttgcagaagctattgatgacggacgcattggtccaagagatgatcctaagctccgtgccaagattttgtcggaggagttcggttgggacaaggatcttgctaagaaaatctggtgctttggtcctgaaaccaccggtccaaacatggtggtcgatatgtgtaagggagtacaatacttgaatgaaattaaggattctgttgttgcaggtttccagtgggcttcaaaggaaggtgcattggctgaagaaaacatgagaggaatctgctttgaagtttgcgacgttgttcttcatactgatgccatccacagaggtggtggccaagttatcccaactgctaggagggttatttacgcctcccaaattactgccaagccccgccttcttgaacctgtctacctcgttgaaatccaagcacccgagcaagctcttggtggtatttacagtgtgctgaatcagaaacgcggacacgtctttgaggaaatgcagaggcccggcacacctctttacaacatcaaggcctaccttccagtcgtcgaatcatttggtttctccgctacattgagagctgctacttcaggtcaggccttcccgcaatgtgttttcgaccattgggaaatgatgtcttctgaccccatggaacctggttcccaagcttctcaacttgtgtccgagatcaggaagaggaagggtttgaaggagcaaatgaccccactatcagagttcgaagacaagctgtaaatcagcttaatacgttcttcaatacgctcatccatggaagctgggcagtataattttgtctctctgtttttaatttatctacctctacccggtactctattttagctgttttgagtcagttatatcccgcccatgttttcatatgagacgttcgtgggtttacttgatatattaggatggtgacttgaaaatattaatgatcgtcttgttttatgttatgcttttaattttcctgaaccattaaaacttgtatcgatctg

SEQ ID NO: 2173 - DNA, 2816 bp, Citrullus lanatus
gaaattgtgtgtgtgcaggtgaagtttacagccgaggagctccgtcggattatggactttaagcataacattcgtaatatgtctgttattgctcacgtcgatcatgggaagtcaacacttacggactctcttgtggctgctgcgggtatcattgcacaagaagttgccggtgatgtacgaatgacagacactcgccaagatgaggcagagcgtggtatcaccattaaatctactggaatctccctctactatgagatgtctgatgaatccttgaaaagttacaagggagagagacagggaaatgaatatcttatcaatcttattgattcacccgggcacgttgacttctcatctgaggttacagctgctttgcgtattaccgatggtgcccttgttgtggtggattgtgtcgaaggtgtttgtgtccaaacagagaccgtgctccgtcaggctttgggagagaggattagacctgtcttgactgttaacaagatggacaggtgcttccttgaactccaagtggatggagaagaggcttatcaaacatttcagagggtgatagagaatgccaatgtgattatggccacatacgaggatccacttcttggggatgttcaagtgtaccccgagaaaggaacagtcgctttctctgctggtctgcacggttgggcgtttaccctgactaactttgcgaagatgtatgcctccaagtttggagtagacgagtcaaagatgatggagagactttggggtgagaacttctttgatcctgcaaccaagaagtggacgagcaagaacactggctctccaacatgcaagcgtgggtttgtccagttctgctacgaacccatcaagcagatcattgcaacttgcatgaacgatcagaaggacaagctatggcccatgttgcagaagcttggagttgtgatgaagtctgaagagaaggatctgatgagtaaagcattgatgaagagggtcatgcaaacatggctcccagcaagcaatgctcttttggaaatgatgatctttcatcttccatcccctgccacggctcaaaagtaccgtgttgagaatttgtacgagggtccactagatgatgcttatgcgagtgccattagaagttgtgatcctgaaggacctcttatgctttatgtatcgaagatgattcctgcatcagacaagggcaggttctttgcctttggacgtgtcttctctgggaaagtttcaactggtttgaaagttagaattatgggaccaaactatgttcccggcgagaagaaagatttgtatgtgaagagtgtccagagaactgtcatttggatgggaaagaagcaagaaacggtggaggatgtgccgtgtggtaacactgttgccatggttggattggatcaattcatcacaaagaatgctactctgacaaacgagaaggaagttgatgcccatccaattcgagccatgaaattttctgtatcgcctgtggtgcgtgtggctgttcagtgcaaggtggcatctgatcttcccaagctcgtggaagggcttaaacgtctggcgaagtcagatcctatggttgtatgtacaatggaggaatctggtgagcacattgttgccggtgctggagaactgcatcttgagatctgtctgaaggatttgcaagatgacttcatgggtggagctgagatcataaaatctgaccctgttgtctctttccgtgaaactgtccttgagaggtcatgccgcacggtgatgagtaaatcccccaacaaacacaatcgtctatacatggaagcacgaccgatggaggaaggactggcagaagctattgacgatggccgcatcggaccacgggatgaccctaaagttaggtctaaaatcttgtcagaggagtttggttgggacaaagatcttgctaagaagatttggtgctttggtcctgagactaccggccctaacatggtggttgatatgtgtaagggagttcaatacctaaatgaaatcaaggattccgttgtcgccggtttccagtgggcgtcgaaagaaggtgcattggctgaagaaaacatgagaggcatctgttttgaagtttgtgatgtggtgcttcacgctgatgccatccacagaggaggtggtcaagtcattccgaccgctaggagggtaatttacgcttctcagctgaccgccaaaccaagacttcttgagcctgtgtacctagtggagattcaggctcctgagcaagctcttggtggtatctacagtgttcttaaccagaagcgtgggcacgtctttgaggaaatgcagaggcccggtacccctctttacaacatcaaggcgtatctccctgtcattgagtctttcgggttctcgagcacattgagagctgcaacttccgggcaggcgttcccacagtgtgttttcgaccattgggacatgatgtcgtcggatccattggaacctggttcccaggctgcacagttagttgcagatatccgcaagaggaagggattgaaggaacaaatgactccattgtctgagtttgaggacaagctgtagatcgtactcgtattgttggataatattttaagaagcgctcataaatctgcaggtgtgaggttcgaatttcctatgggaagctttttgtgtttctagaaaagattgttatgtttgactattttatttgcaattatttttatgaactattgttactccatttctgttaaagatgcgtgatgatgggcaaaattttggagtctgcaggattttcgcttgttttttgtttttgttttctttggaattaggtttaaatcttgatttagttctta

SEQ ID NO: 2174 - DNA, 2918 bp, Artemisia annua
tactccgacggggagggttggttgttgttgatatatttagggtttagggcattatcatacgccgctcactttatatccccctcattcactcacacttctcctctattcttctcagccgcctccctctttcctttcttcattttcatcttctaggaattttttctagaagttatattactacatttttgttagagatctaaaaactagtcaaaatggtgaagtttaccgctgaagagctccgtaggattatggactacaagcataacattcgtaatatgtctgttattgctcatgttgatcacggaaaatctaccttgaccgattctcttgtggctgctgctggtattattgcccaagaaactgctggtgatgttcgtatgactgatactcgtgctgatgaagcagagcgtggtatcaccatcaaatccactggtatctcactttactatgagatgactgatgaggctctcaagagcttcaagggagaacgtgacgggaatgagtacttgatcaatcttattgattcacccgggcacgttgacttttcatctgaagttactgctgctctacgtatcactgatggtgcccttgttgtggtcgattgtattgaaggtgtttgtgtccaaacagaaactgtccttcgacaggctcttggtgagaggatccgacctgtactgactgtcaacaagatggacaggtgtttccttgagcttcaggttgatggagaagaagcttatcaaaacttccagagggttattgaaaatgctaatgtcatcatggccacatatgaggacccacttctaggtgatgtcatggtttaccccgagaaaggtaccgttgctttttctgctgggctccacggctgggcttttaccctaaccaactttgctcagatgtacgcctcaaaattcggtgttgacgagtcaaagatgatggagaggctttggggagagaacttctttgaccccaagaccaagaagtggaccaccaagaacaccggcactgcaacatgcaagcgtgggtttgttcagttctgttatgagccaatcaagcagattatcaacacctgcatgaacgaccagaaggatatcttgtggcctatgttgagcaagcttggtatcaccatgaagtctgaagagaaagagttgatgggtaagactttgatgaagcgtgttatgcagaattggcttcctgctgctactgctctacttgaaatgatgatctttcatttgccttcccctcacactgcgcaaaggtaccgtgtcgagaatctgtatgagggtccacttgatgatcaatatgcaaatgccatcagaaactgtgatcctaatggtcctctcatgctctatgtttctaagatgattcccgcatctgacaaaggtagattttttgtggtcgtgtttttgctggaaaggtttcaactggtttgaaggtgaggatcatgggacctaactatgtccctggtgaaaagaaggatctgtatgtcaagagtgtgcaaagaaccgtcatctggatgggaaagaaacaagaaaccgtggaagatgtgccatgtggtaacactgttgctcttgtcggtttggatcagtttatcaccaaaaatgcaaccttgacaaatgagaaagaaactgatgctcacccgatccgtgctatgaagttttctgtctcacctgttgtgcgtgttgctgttcagtgcaagactgcatctgatcttcccaagcttgttgagggtctgaaacgtcttgctaaatctgaccctatggttgtctgtaccattgaggagtctggtgaacacatcattgctggtgccggagagttgcatctcgaaatctgtttgaaagatttgcaagatgacttcatgggtggtgccgaaattgttgtttcagacccagttgtgtccttccgtgaaactgtccttgagaaatcatcccgcactgtgatgagcaaatcccccaacaagcacaaccgtctctacatggaagctagacccttggaagatggtctcgctgaagctattgatgatgggagagtcggtccccgtgatgaccctaaggttcgttcaaagatcctgtctgaggaatttggatgggacaaggatcttgccaagaagatctggtgttttggtcctgaaacaactggtcccaacatggttgttgatatgtgtaagggagttcagtacttgaacgaaatcaaggattctgttgttgctggtttccagtgggcctcaaaggaaggtgcgttagctgaagagaacatgaggggtatctgctttgaagtgtgtgatgtcgttctccatgctgatgctattcatcgtggtggtggtcaagttatcccaaccgcaaggagagtcatctatgcttcccaactaactgccaagccacgacttcttgagccagtctaccttgttgaaatccaagcacccgagaatgcacttggtggtatctacagtgtgcttaatcaaaggcgtggacacgtgtttgaggagatgcagaggcccggtactccattgtacaacatcaaggcgtatctccctgtcgtggaatcctttgggttttctggtgctttgagagcttccacctctggtcaagctttcccacagtgtgtgtttgatcattgggacatgatgtcagcagatccattggatgctgggtctcaggcagccacacttgtgactcagatccgtaagaggaagggtttgaaggagcagatgacaccgctatctgagtttgaggacaagctgtaagcggcaaaagcacctgtggtctggggaattttcttggtcctctttctatccgttgtcatattttctataatgttttttctttagtgtgttggaggtactgtgttttgttctattgttaggctgtggtcgcgaaaacatgcaagacgattatgctgttaattttgacaatcttgtttta

SEQ ID NO: 2175 - DNA, 2778 bp, Cephalotaxus harringtonia
aagttgtcttttggtgaataaaagagttagcgaaaatggtgaagttcacagctgaagaactccgtaggattatggacttgaaacataacattcgaaatatgtctgtcattgcccatgttgaccatggaaagtcaactctcactgattctttagtggcagcagctggtatcattgctcaagaggttgccggtgatgttagaatgactgatactcgtgcagatgaagctgagcgtggcatcaccattaagtcgacaggaatatctttatattatgagatgtcagatgagtctcttaagagttacaaaggggagagaatgggcaacgagtatctgataaatttgattgattctccagggcatgttgacttctcttcagaagttacagcagccctgcgtatcactgatggtgcgttggttgtggtagattgtattgaaggtgtttgtgtacagactgaaaccgttcttcgacaggctcttggagaaaggattagaccggttcttaccgtgaacaagatggataggtgttttcttgagttgcaggttgaaggagaggaagcttatcagacatttctacgtgtgattgaaaatgcaaatgtgatcatggctacctacgaagatcctcttcttggtgattgccaagtgtatccagagaaaggaactgttgctttctcagctggtttgcatgggtgggcttttactttgacaaattttgctaaaatgtatgcttcaaagtttggagtagatgaatccaagatgatggagaggttgtggggtgagaacttttttgatccagctaccaaaaagtggacgtcgaaaaacacgggatctcctacttgcaaaagaggttttgttcaatttatatatgagcctattaagcagattataaacatttgtatgaatgatcaaaaggacaagttatggcctatgttgcagaaactgggagttgttatgaagagtgaggagaaggatctagcagggaaggccctaatgaaacgtgttatgcaaacctggctacctgcaagtagtgccctacttgagatgatgattttccatcttccatctccatctatagcacaaagatatcgtgtagaaaacttgtatgaaggccctcttgatgatgtgtatgcaactgcaattagaaattgtgaccctgaaggacccttgatgttgtatgtctcaaagatgattcctgcctctgacaaggggcgattctttgcctttggccgtgtttttgctgggaaagtatcgacaggacagaaagtaaggatcatgggccctaactatgtgcctggtcaaaagaaggacttgtatgtaaagagtgttcagaggactgtgatatggatgggtaaaaacaagagtctgttgaggatgtgccctgtggaaatacggtggctatggttgggttagaccagttcatcactaagaatgctactctcacaaatgagaaggaggttgatgctcatccaattaaggcaatgaagttctctgtctcacccgttgttcgtgttgctgtgcagtgcaaggtagcttctgaccttccaaaacttgtcgaagggttgaagcgtcttgctaagtcggatcctatggtcgtgtgtacaattgaggaatccggtgagcatattattgctggagcaggagaacttcaccttgagatttgtttaaaggatttgcaagatgattttatgggtggagctgagattgttgtgtctgatcctgttgtctcatttagagaaactgtgctggagaagtcagttcgtactgttatgagcaagtctccaaataaacacaacaggctttattttgaagcaaggcctcttgaagaaggtcttcctgaagcaattgatgatggccgcattggcccaagggatgatcccaaggctcgtgccaaaatccttgctgaggagtttggatgggacaaagatctggctaagaagatttggtgttttggtcctgaaaccactggtcccaacatggtggttgatatgtgtaagggagttcagtacttgaacgaaattaaggattctgtggttgcagcatttcagtgggcatccaaagaaggcgctcttgcagaggagaacatgcgtggcatttgctttgaggtttgtgatgttgttttacatactgatgccattcatagaggaggtggtcagattattccaacagccagaagggttatgtatgcagctcagattactgcaaaaccaaggcttcttgagccagtgtatcttgtggagattcaggctcctgaacaggcacttggaggtatttatggtgtgttgaatcagaagaggggtcatgtctttgaggaaatgcagaggccgggaactccactttataacattaaggcatatttgccagtcgttgaatcatttgggttctcaggtgcgcttcgagctgcaacatctggtcaggctttccctcaatgtgtgtttgatcactgggatatgatgggttcagatccattggagcatggtactcaagctgagaagcttgtttttgatatccgcaagaggaagggtctcaaggagcagatgactccattgtcagagtttgaggataagctttaaagctttcctatgtttaattaggtaaatatactattgagtttgacaatatcggaatatgtctggaggatggagagtctaaggatcaaatgactttcttgttgagtctagaaacttccattaagtttttgcatattaggatatttttgcaatattttattattacttagtttgagatatactttaagaatcattattatataactacctttccg

SEQ ID NO: 2176 - DNA, 2896 bp, Trigonella foenum-graecum
gccttgcctatcccctgttgcgtgtctcagctttcagtactaaaagactccttttttgcggactagaaagaccagtcaagatggtgaagttcacagctgatgagttacgtcgcattatggactacaagcacaacattcgtaatatgtctgtcattgctcatgttgaccatggaaaatctactctaacagactctctagtcgctgctgccggaattattgcccaagaagttgctggtgatgtccgtatgacggacacccgtgctgatgaagctgagcgtggtattacaatcaagtctaccggtatctcactctactatgaaatgactgatgagtctctctcgaggtacaagggagagcgcaatggaaatgagtatctcattaatctcattgattcccctgggcacgtcgacttctcatctgaggttactgctgcactccgtattacagacggagcacttgtggtggttgactggtgtggaaggtgtttgtgtccaaactgaaactgtgctgcgacaagctcttggagaaaggatcaggcctgttcttacagttaataagatggacagatgcttccttgagctccaggttgatggagaggaggcataccagacctttcaaagggtcattgagaatgctaatgtgattatggctacctatgaagatccacttcttggtgatgttcaggtgtatccagagaaaggaacagttgctttctctgctggtttgcatggttgggcttttactttgaccaactttgcaaaaatgtatgcctcaaaatttggtgttgatgagaccaagatgatggagaggctttggggtgaaaatttctttgatccagccacaaaaaaatggaccaccaagaatactggtgcagcttcttgcaagcgtgggtttgttcagttttgttatgagcctatcaagcagatcatcaacacttgtatgaatgatcagaaggataagttgtggcctatgcttcaaagctgggggtcaccatgaagtctgatgagaaagacctgatgggtaagccattgatgaaacgtgtcatgcagacctggctgccagcaagtactgcactcctagaaatgatgatctttcatcttccctcaccatcaactgcccagaggtaccgtgttgagaatttgtacgagggtccccttgacgatcaatatgcaaatgctatccgaaactgtgatcctgaaggacctctgatgctttatgtctcaaagatgattccagcatctgataaaggaaggttttttgcttttggccgtgtgtttgccggtaaggtttccacaggtatgaaggtcagaattatgggaccaaattatgtccctggggagaagaaggatttgtatgtgaaaagtgtccagagaactgttatttggatgggaaagagacaggagactgttgaggatgtgccttgtggtaacactgttgctatggttgggttggatcaatttatcacgaaaaatgctacattgacaaatgagaaggaagttgatgcccaccctatccgagctatgaagttttccgtctcacctgttgtgcgtgttgctgttcagtgcaaggttgcttcagatcttcccaagcttgttgaaggtctcaaacgtttggctaagtcagatcctatggttgtttgtactattgaggagtctggagaacacattgttgctggtgcaggagagcttcatcttgagatctgtttgaaggacttgcaggacgatttcatgggtggagctgagattattaaatctgaccctgttgtgtcattcagggagactgttatagatagatcaatccgcacagtgatgagtaaatcacctaacaagcacaaccggttgtacatggaagcaagacctttggaggatggacttgcagaggccattgatgaaggcacaataggaccaagggatgaccccaaaaatcggtctaaaatcttgtccgaacagtatggttgggataaggatcttgccaagaaaatctggtgttttggacctgagaccaccggacccaacatggttgttgatatgtgtaagggagttcagtacttgaatgaaatcaaggattctgtggttgctggattccagtgggcatcaaaagaaggtgctttgtcagaagaaaacatgagaggcatctgctttgaagtttgtgatgttgtcctgcacactgatgctatccacagaggaggtggtcagatcattcctactgctaggagagtcttctatgcctcccagctcacagccaaacccagacttctggagcctgtttacatggtggaaatccaagctcctgagcaagctcttggtggtatctacagtgttcttaatcagaaacgtggacatgtgtttgaagaaatgcagaggcctggtaccccactttacaacatcaaagcatacctccctgtcgttgagtcctttggattttccagccagttgagagctgcaacatctgggcaggctttcccccaatgtgtctttgatcattgggatacgatgggctcagatcctttggaggcaggaacacaatctgcacagcttgttatggacattcgcaagaggaagggtctcaaggagacgatgactccactttctgagttcgaagacaagctttaagttatttatgcaatttatatttatgaacttggctgttatgaaaactgttgccttattttgagttttgttattgtactttgaatcatttatctttgcatcaatgtatttttggtctgtagcatttgcattgatgtgggatagagtcttgctatttgtgttgaatttaagtgctttttaagaacacagctgtttcttgatggaaaaattactattttggcttctctttagtttagtgcttatggctgcatccagagtgtatctctgctatattctgtgaccagtcc

SEQ ID NO: 2177 - DNA, 3016 bp, Cajanus cajan
atttgtgtctgtatctgcaggtgaagttcacagctgaagaactacgtcgtattatggaccataagcataatatccgtaatatgtctgtcattgctcatgttgatcacggaaaatcaaccctcactgattctcttgtagctgctgctggtattattgctcaagaagtggcaggtgatgtccgtatgactgatacccgtgcagatgaagctgaacgtggtattacaatcaagtctacgggtatctcgctctactatgaaatgactgatgaagctctcaagaattataagggagagcgtaatgggaatgagtatctcattaatctcattgactcccctggacatgttgacttctcatctgaggtcactgctgcacttcggattactgatggagctctagttgtggtggattgtgttgaaggtgtctgtgttcaaacagaaactgtgctacgacaggcccttggagaaaggattaggcctgttctgactgtcaacaagatggatagatgcttccttgaactccaagtggatggagaggaggcctaccagacatttcaaagagttatagagaatgctaatgtgatcatggctacatatgaagatccactgcttggggatgtgcaggtctatccagagaaaggaacagttgccttttctgctggtttgcatggctgggcttttaccttgaccaactttgccaagatgtatgcttctaagtttggagttgatgaagggaagatgatggacaggctctggggtgaaaacttctttgatccagccaccaagaaatggaccagcaagaatactggttctgctacctgcaagcgtgggtttgttcagttctgttatgagcctatcaagcagataattaacacttgtatgaatgatcagaaggataagctgtggcctatgctgcagaagcttggggtcaacatgaaatctgatgagaaggaacttatgggtaaagcattgatgaagcgtgtcatgcaaacctggctccctgccagtagtgcactcttggaaatgatgatatttcaccttccctctccatccactgcccagaagtatcgtgtggaaaatttgtatgagggtccccttgatgatcaatatgctgctgctatcagaaactgtgatcctgaaggtcctcttatgctctatgtctcaaagatgattccagcatctgataagggtaggttttttgcttttggtcgagtgttctctggcagggtttcaactggtttgaaggtgagaattatgggaccaaattatgtccccggggagaagaaggatttgtatgttaaaagtgttcaaagaactgttatttggatgggcaagagacaggaaaccgtggaggatgtgccttgtggtaacacagttgctatggttggtctggatcaatttatcaccaagaatgctacattgacaaatgagaaggaagttgatgcccaccctattcgtgcaatgaagttctctgtctcccctgttgtccgtgtggctgttcagtgcaaggttgcatcagatcttcccaagcttgttgaaggtcttaaacgtttggccaagtcagatcctatggttgtttgtaccattgaggagtctggtgaacacattgttgctggtgcaggagagcttcatcttgagatctgtttgaaggacttgcaggaagatttcatgggtggagctgagatcattaaatctgaccctgttgtgtcattcagggagactgtcctagagaggtcctgccgcactgtgatgagtaagtcccccaacaagcacaaccgtctctacatggaagctaggccactggaggagggtcttgcagaagccattgatgatggcaagattggaccaagggatgaccccaaagtccgatccaagatcttgtctgaagagtttggttgggacaaggatcttgccaagaaaatctggtgcttcggccctgagacccttggacccaacatggtggttgatatgtgtaagggagtccagtacttgaatgaaatcaaggattctgtggttgctggattccaatgggcatctaaagaaggtgcattggctgaagaaaacatgagagccatctgctttgaagtatgtgatgttgtgctgcacgctgatgctatccacagaggtggtgggcagatcatccctactgctaggagagtgttctatgcttcacagctgactgctaaacccaggcttcttgagcctgtttacctggtggaaattcaggctcctgagcaagctcttggtggtatctacagtgttctgaatcagaaacgtggacatgtgtttgaggaaatgcagaggccaggtaccccactttacaacatcaaagcatacctccctgtcattgagtccttcggattctctagcacattgagggctgcaacatcaggccaggctttcccacagtgtgtctttgatcactgggatatgatgtcctcagatcctttggaggctggatcacaggctgcacagcttgtcactgacattcgcaagaggaagggattgaaggaacagatgactcctctctctgagtttgaagacaagctttaaattattattttaactctattatgaacttagctaaatctctcgtgctgaaaactttattactgtagttttaatttttctggagttttgtttgtggtttttgtcggtggattgttgtaccgtattatttatctttgcatcggtgtatttttgttctaggattttgcatcgatgctggtccaaactatttctgggaattttgctttgaagtcatcgctattttcaataattgtgtgttgcatttggttgtgtggcgagtgattgaatgctatagggaaatagtacgacaaagataatagatgtggtttaggaaaatagaaggtggtcgtgaatgaataggttattagtttgtttacagtgattgcctgttagagttgccttgtttggaagtttcattatgggttaacgaggttaatggtcagtgacatgtaatgtagtcaatgcatacacattacattatgaaattcttg

SEQ ID NO: 2178 - DNA, 2807 bp, Cicer arietinum
gaaaccagatctcatctcccttcaatttcttcactttgattgatactcgtttttgtttgtggactatacaaaagactagtcaaaatggtgaagtttacagccgatgagttgcgtcgtattatggactataagcataacattcgtaatatgtctgttattgctcatgtcgatcatggaaaatcaacattgacagattcccttgtcgctgctgctggaattattgcacaagaggtggctggtgatgtccggatgacagatactcgtgcagatgaggctgagcgtggtatcactattaagtctactggtatctctctatactatgaaatgtctgatgagtctctcaagagttacaagggagaacgtaatgggaatgagtatctcattaatctcattgattcccctggacacgttgacttctcatctgaggttactgctgcactccgtattactgatggagcactagttgtggtggattgtgttgagggtgtttgtgtccaaactgaaactgtgctgcgacaggctcttggtgaaaggattaggcctgttctgactgttaacaagatggacagatgcttccttgagctccaggtggatggagaggaggcttatcagacattccagagggttattgagaatgctaatgtgattatggctacctatgaagatccattgctcggtgatgttcaggtgtatcctgagaaaggtacagttgctttctctgctggtttgcacggttgggcatttactctgaccaactttgcaaaaatgtatgcctcaaagtttggcgttgatgaatccaagatgatggagaggctctggggtgaaaacttctttgatccagccacaaagaaatggaccacaaagaatactggttcaccttcttgcaagcgtggatttgttcaattctgttacgagcctatcaagcagattattaacacttgtatgaatgaccagaaggacaagttgtggcctatgctaacaaagctaggagtcaccatgaaatctgaagagaaagacttgatgggtaaggcattgatgaaacgtgtcatgcagacttggctcccagctagcagcgcactattggaaatgatgatctttcatcttccctctccatcaactgctcagaggtatcgtgttgagaatttgtatgagggtccccttgatgatcaatatgctaatgctatcagaaactgcgatcctgaaggacctcttatgctttatgtctctaagatgattcccgcatctgataagggaagttttttgcttttggtcgtgtatttgctggtaaggtttcaacaggtttgaaagtcagaattatgggaccaaattacgtccctggtgaaaagaaagacttgtatgtgaaaagtgttcagagaaccgtcatttggatgggaaagagacaggagaccgttgaagatgtgccttgtggtaacactgttgctatggttggtttggatcaatatatcaccaagaatgctacattgacaaatgagaaggaagttgatgctcatcctatccgagcaatgaaattttctgtctcacctgttgtgcgtgttgctgttcagtgcaaggttgcttcagatcttcccaagcttgttgaaggtctcaaacgtttggcaaagtcagatcctatggttgtttgtactattgaggaatctggagaacacattgttgctggtgcaggagagcttcatcttgagatttgtttgaaggacttgcaggatgatttcatgggtggggctgaaattattaaatctgaccccgttgtgtcattccgtgagactgttcttgacagatcatgccgcactgtgatgagtaaatcaccaaacaagcacaacaggttgtacatggaagcaagaccgttggaagatgggcttgcagaggccattgatgaaggcacaattggaccaagggatgaccccaaaatccgttctaaaatcttgtcagagcagtatggttgggataaggatcttgctaagaaaatttggtgttttggacctgagaccactggacccaacatggtggttgatatgtgtaagggagtccagtatttgaatgaaatcaaggattccgttgttgctggattccagtgggcatctaaagaaggtgctttggcagaagaaaacatgagagccatttgttttgaagtgtgtgatgttgtcctccacactgatgctatccatagaggaggtggtcagatcattcctactgccaggagagtgttctatgcctcacagctgacagccaaacccaggcttcttgagcctgtttaccttgtggaaatccaagctcctgagcaagctcttggtggtatctacagtgttcttaatcagaaacgtggacatgtgttcgaagaaatgcagaggcctggtactccactttacaacatcaaggcataccttcctgtcgtcgagtcctttggattctccagtcaattgagggctgcaacatcaggacaggctttcccacagtgtgtgtttgatcactgggatatgatgtcatcagatccattggaggctggatcacaagctgcaacacttgttactgatattcgtaagaggaagggtttgaaggagcaaatgactccactctccgagttcgaagacaagctttaaattatttaaactgttttcttttatttatcaacttagcttatgttctggtcattgaaactgttacctgagcttttaaagttcagtatcttgagttttttgtgtatgactatcagtctgtcttgtacttcgggattatttgttgttgaatcacttgatttttgggcttatgagttgcaggatttccgttcgtgc

SEQ ID NO: 2179 - DNA, 3107 bp, Cicer arietinum
caatttttataccgcaaatcagcaaccttataaggtcagtctgtatacgggtgttaatagttcgcaacttcagtttcacagttcactttttagggttttgtttcttgcggctgcgaaggggagctcttcttattcgttctcgccgcttccctgttctttctcgccgctataacagactcctttgcagactatagagactagtcaaaatggtgaagttcacagctgatgagttacgtcgcattatggactataagcacaacattcgtaatatgtctgtcattgctcatgttgatcacggaaaatcaactttgacagattcccttgttgctgctgctggaattattgcacaggaggttgctggagatgtccggatgacagatactcgtgcagatgaagctgagcgtggtatcactattaagtctaccggtatctctctatactatgaaatgtccgatgagtctttgaagagttacaaaggggagcgcaatggcaatgagtatctcattaatctcattgattcccctgggcacgtcgacttctcatctgaggttactgctgcactccgtattactgatggagctctagtggtggtggattgtgttgagggtgtttgtgtccaaactgaaactgtgctgcgacaggcccttggtgaaaggatcaggcctgttctaaccgttaacaagatggatagatgcttccttgaactccaggtggatggagaggaggcttatcagacatttcagagggttattgagaacgctaatgtgattatggctacttatgaagatccattgcttggtgatgttcaggtgtatcctgagaaaggaacagttgctttctctgctggtttgcatggttgggcttttactctgaccaactttgcaaaaatgtatgcctcaaagtttggtgttgatgaatccaagatgatggagaggctctggggtgaaaacttctttgatccagccacaaaaaaatggaccacaaagaatactggttcaccatcttgcaagcgtggatttgttcagttctgttatgagcctatcaagcagattattaacacttgtatgaatgatcagaaggataagttgtggcctatgctaacaaagctaggggtcaccatgaagtctgaggagaaagacctgatgggtaaggcgttgatgaaacgtgtcatgcaaacctggctcccagctagcagtgcactcttggaaatgatgatctttcatcttccctctccatcaactgctcagaggtatcgtgttgagaatttgtatgagggtccccttgatgatcaatatgctactgctatcagaaactgcgatcctgaaggacctcttatgctttatgtctcgaagatgattcccgcatctgataagggaaggttttttgcttttggtcgtgtatttgctggtaaggtttcaacaggtttgaaggtcagaattatgggaccaaattatgtccctggtgagaagaaagacttgtatgtgaaaagtgttcagagaactgtcatttggatgggaaagagacaggagactgttgaggatgtgccttgtggtaacaccgttgctatggttggtttggatcaatttatcaccaagaatgctacattgacaaatgagaaggaagttgatgcccaccctattcgagctatgaagttttctgtctcacctgttgtgcgtgttgctgttcagtgcaaggttgcttcagatcttcccaagctcgttgaaggtctcaaacgtctggctaagtcagatcctatggttgtttgtactattgaggaatctggggaacacattgttgctggtgcaggagagcttcatcttgagatttgtttgaaggacttgcaagatgatttcatgggtggagctgagattattaaatctgaccctgttgtgtcattccgagagactgttcttgacagatcatgccgcactgtgatgagtaaatcacccaacaagcacaataggttgtacatggaagcaagaccattggaagacgggcttgcagaggccatcgatgaaggcacaattggaccaagggatgaccccaaaatccggtctaaaatcttgtcagaacagtatggttgggataaggatcttgccaagaaaatttggtgttttggacctgagaccactggacccaacatggttgttgatatgtgtaagggagtccaatacttgaatgaaatcaaggattctgttgttgctggattccagtgggcatctaaagaaggtgctttggcagaagaaaacatgagagccatctgctttgaagtatgtgatgttgtcctccacactgatgctatccatagaggaggtggtcaaattattcctactgcccgaagagtcttctatgcctcacagttgacagccaaacccaggcttctcgagcctgtttatcttgtggaaatccaggctcctgagcaagctcttggtggtatctatagtgttcttaaccagaaacgtggacacgtctttgaagaaatgcagaggcctggtactcctctgtacaacatcaaagcataccttcctgtcgtcgagtcctttggattctctagccagttaagggctgcaacatctgggcaagcttttcctcagtgtgtgtttgatcactgggatatgatgtcatcagatccattggaggctggatcgcaagctgcaacacttgttattgatattcgcaagaggaagggtttgaaggagcagatgactccactttctgagtttgaagacaagctttaaacaattttggactatttttatgattttagcttattttctctttatgaaatcttttttactttagttttttaaagttcagtatctggagttttgtttgttcctttgccagttctgaactttgtaatataggtatttgcattgatgtatttttgctcaccgtgatttggatcaatgctgaaaaaacttgtgttaattttgttttaaacacactctttttagtggtgtttttatgaaatcatagtgttcaaatctaattgtgtttgataaatgattaaaggctagttactaaacgatgaaatttgatttgtcttggcacagagtcaaatacaagtaataacatgtagcaaagggacaataaatcgaaatgga

SEQ ID NO: 2180 - DNA, 3005 bp, Mimulus guttatus
ttcagttactccgcctccaaagctcgtcgttcttctctcggtttcatctgataggaagaaatcttctgaataattctgcagctgtgaaacttaagatcttgcaacgatggtgaagttcacagccgaagagctccggaggattatggacctcaaacacaatattagaaacatgtccgttattgcccatgtcgatcatgggaaatcaactcttaccgactcactggtcgctgctgcgggtattattgcccaagaagttgctggtgatgtcaggatgaccgatacccgtgctgatgaagctgagcgtggtatcacaatcaagtccaccggtatctctctgtactacgaaatgtcccccgaatctctggcgagctacaagggagagcgaagtggaaacgagtacctcatcaatcttattgactcccctgggcacgttgacttttcttctgaagtcactgctgctctgcgtatcactgacggtgcccttgttgtggtggattgtgttgagggtgtctgtgtgcagacagagactgttctcagacaggctctaggagagaggattcgccctgtcttgactgtcaacaagatggacaggtgtttccttgagctccaggttgatggagaggaggcttaccaaacattccagagggttattgagaacgcaaatgtcatcatggcaacttatgaagaccctctccttggtgatgtccaggtgtaccccgagaaaggaactgttgccttctctgctggtctgcacggatgggctttcactctaaccaactttgctaagatgtacgcctccaagttcggtgtggacgagagcaaaatgatggaaaggctgtggggtgagaatttcttcgatcccgccaccaagaaatggacaaccaagaacactggatctgcctcgtgcaaacgtgggtttgtccagttctgttatgagcccatcaagcagatcattgccacttgcatgaacgatctgaaagacaagctgtggcctatgttgaagaagctcggtgtgacaatgaagtccgacgagaaggacttgattggaaaggctttaatgaagcgtgtgatgcagacatggctgcctgccagcagtgcactattggaaatgatgatattccatctcccttctcccgccactgctcaaaggtaccgtgtggaaaacttgtacgagggtccccttgacgacatctacgccactgctatcagaaactgtgaccctgatggtcccctcatgctttacgtttccaagatgattcccgcttctgacaagggtagattctttgcctttggacgtgtgtttgctgggaaggtgtccactggtttgaaggtcagaatcatggggcctaactacgtacctggggagaagaaggacttgtatgtcaagagtgtgcagagaactgttatctggatgggcaagagacaggaaactgttgaagatgtgccgtgcggtaacacagttgctatggttggtttggatcagttcatcaccaagaatgctactttgaccaatgagaaggaagttgacgcacatccaatccgagccatgaaattttcagtctcacccgtcgtgcgtgtcgcagtgcagtgcaagcatgcctctgacttgccaaagctggtcgagggtttgaagcgtctggccaagtctgaccccatggttgtctgctccattgaggaatctggcgaacacatcattgccggagcaggagagctccacctcgagatctgcctgaaggatctggtggacgacttcatgggtggggctgagatcataaaatccgaccctgttgtgtccttccgtgaaacagttcttgatagatccgttcgcacggtgatgagtaagtcccccaacaagcacaaccgtctgtacatggaagctagaccattggaggacggtcttgctgaggccatagatgatggaaagatcggcccacgtgacgacccaaagatccgatccaagctcttgtctgaagaattcggctgggataaggagctcgccaagaagatttgggctttcggtcctgaaaccaccggcccgaacatggtggtggatatgtgtaagggagttcagtacttgaatgaaatcaaggactctgttgttgctggtttccagtgggcttcaaaggaaggcccgttggctgaggagaacatgaggggtgtctgctttgaggtgtgcgatgttgtgctgcacactgacgcgattcacaggggtggtggtcaggttatcccgactgccaggagggttatttacgcgtctatgattactgcaaagcccagactcttggagcccgtttatctcgtggagattcaggcgcccgagcaggcacttggtggtatttacagtgtgctgaatcagaagcgtggccacgtgttcgaggaaatgcagaggcccggcacaccgctgtacaacatcaaggcatacttgcctgtggttgagtcgttcgggttttcgagtactttgagggctgccacttctggacaggctttccctcagtgtgtgtttgaccattgggagatgatggcgtcggatcctctgcaggcggaatctcaggctgcagttcttgtggctgatatccgtaagaggaagggtttgaaggttacaatgacacctctttctgactttgaggacaagctgtaagtgggtggtggatttacgatattaccccttgctgacgtggaaatcgacggtgggtggaagttttgctgttgctatcgttttaattgctcttttttttttttattttaaatgtatggtttagtgtttggactatttaaattgttgttacgtactctattttaatttgtgtcggagtctcgtctagttgctgtttgagagctgcttttagatgaacaagaatattgtctgttttttcaatggatatttctgtatttgcagattgcttttttatttgagatgattttatattcattctatcgtctatcgttgttttcttaattaaatttctgccaatttggaagttggtgttatgtgaaattttatgttg

SEQ ID NO: 2181 - DNA, 3005 bp, Euonymus alatus
cggccgggggttcagcctcgcctttgaagactggagagccgtgacgcccaaagcctctctgctctctctttgtatatctgaacgacgtctctgttagttttacaaagttagttgggaaatttaaagagcagcgaagatggtgaagtttactgctgatgggcttcgcaggattatggacctgaagcataatattcgtaatatgtctgttattgctcatgttgatcatgggaagtcaacacttactgattctcttgtggctgctgctggtatcattgctcaagaagttgctggtgatgtacgtatgactgacacccgagcagatgaggctgagcgtggcattacgattaagtcaactggtatatctctttactatgagatgagtgatgagtctttgatgagctacaagggtgaaagaatggggaacgagtacctcatcaatctcattgactctcctgggcacgttgacttttcatctgaagtcacggctgcgcttcgtatcactgatggggcccttgttgtggttgattgtattgagggggtttgtgtccagacagaaactgttctcaggcaggcccttggtgaaaggatcagacctgttttgacagtaaacaagatggacaggtgttttctcgagctgcaggttgatggagaggaggcctaccaaacattccagagggtaattgagaatgctaatgtcatcatggctacgtatgaagatccactccttggtgatgttcaggtctatcctgagaaaggaactgttgctttctctgctggattgcatggttgggcttttacgctaaccaattttgccaagatgtatgcatccaaattcggagttgatgaggcgaagatgatggaaaggctctggggtgagaactactttgacccagcaacgagaaaatggaccaccaagaacactggcgcttcttcttgcaagcgtggttttgttcagttctgctatgaacccattaagcagattattaacacttgcatgaatgaccagaaagataagctttggcctatgttgcagaagcttggcgttaccatgaagtctgatgagaaagaattgatggggaagccactgatgaagcgtgtcatgcagacctggctcccggcaagtagagccctactggagatgatgatctttcaccttccctctccttccatggctcaaaggtatcgtgttgaaaacttgtatgagggtcccatggatgatcagtatgctactgctataaggaactgtgatcccgagggtcctctcatgctttatgtgtcaaagatgattcctgcttctgacaaaggtagattctttgcttttggtcgtgtgttctctggaaaggttgcaacaggtgcaaaagtccggatcatggggccaaattatgtccctggtgagaagaaagatttgtatgttaagaatgtgcagagaactgtcatctggatgggcaagaaacaagaaactgttgaagatgttccttgtggtaacacagtggcattggttggcttggatcagtttattactaagaatgctaccttgacaaatgaaaaggaagttgacgctcacccaatccgtgccatgaagttctctgtttcacctgttgttcgtgtggctgttcagtgcaaggttgcttctgacctgcccaagcttgttgaaggtttaaaacgtttgtccaagtcagatcctatggtcgtttgtagcattgaagagtctggggagcacattattgctggtgcaggagagctccatcttgaaatctgtttgaaggatctgcaggatgatttcatgggtggtgctgagatcataaagtcagatcccgttgtgtcattccgtgaaacagtgctcgagaagtccagccgcactgtgatgagcaagtcccccaacaagcacaatcgtctctacatggaagcacgtcccttggaggagggccttcctgaggccattgacgatggccgtattggtcctcgtgatgatcccaaggttcgatcgaagatattgtctgaggagtttgggtgggacaaggatcttgccaagaaaatttggtgttttgggcccgagacaactggccctaatatggtggttgacatgtgtaaaggggttcagtaccttaatgaaattaaggactctgtggttgctggtttccagtgggcatctaaggaaggtgcattggctgaagagaatatgaggggtatctgttttgaagtctgtgatgttgttcttcacgctgatgccattcacagaggtggtggtcaggtcattccaactgccaggagggttatttatgcttcgcagcttactgccaagcccaggctgcttgagcctgtgtatatggttgagatccaggccccagagcaggctcttggtggtatttatagtgttcttaaccagaaacgtggtcatgtctttgaagaaatacagaggcctggaaccccactctataacatcaaggcttaccttccagtcgtggagtcatttggtttctctgccaatttgagggctgcaacctctggccaggctttccctcagagtgtgttcgatcattgggatatgatgatgtcagatccattggatcccacatcacaggctggaattcttgttcatgatatccgtaagaggaagggattgaaggagcagatgacccctctgtcagagtttgaggacaagctgtaagcaataaaaaattattcttcccattgaacagtgttcacttacagaggtaattgttgggcagtatcatgtttcgctgccttgcatttttttttcccttggtgtttcagtggggagtttgtagagtcctagtcgtattcaaagtcacttgttctgtattagttttgaacactattatgtctttctgtttttcattagttctgcttttgttctaagcagagcagtgtcctactataaatgattttgttttctaatagtagttttggttttgataatcttctctcgtccccctcagacatttttgatatgtcaatggtagactgcattagtttttaagtca

SEQ ID NO: 2182 - DNA, 3139 bp, Vitis vinifera
ttccgagcctcctatcctcatttcttctcagtaaccctttggctggagactgagaagtgataagagccgcacctcctgcagccgccctcctgttctctcggtggtgtaacacctccgtactgaaactttgtgtttgtgatatttagagagcagtcaagatggtcaagtttacagttgaggagcttcgtaggattatggactacaagcataacattcgtaatatgtctgttattgctcatgttgatcatggaaagtcaaccctcacagattctttagtggctgctgctggtattattgctcaagaagttgctggtgatgttcggatgacagatacccgccaggatgaagctgagcgtggtatcacaattaagtctactggtatctctctctactatgagatgagtgatgagtctctcaagaactacaggggagagagacaagggaacgaataccttatcaatcttattgattcccctgggcacgtggacttctcatctgaggttactgctgctcttcgtattactgatggtgcacttgtggttgtggattgtgttgagggtgtttgtgtccagaccgaaactgttctgcggcaggccctgggtgaaaggatccgtcctgtcttaactgtcaataagatggacaggtgcttccttgagcttcaggttgatggagaggaggcttaccagacattctcaagggttattgagaatgcaaatgttatcatggctacttatgaagatccacttcttggtgatgttcaagtttaccctgaaaagggaacagttgcgttctctgctggtttgcatggttgggcttttactctaaccaactttgccaaaatgtatgcttccaaatttggagttgatgagtctaagatgatggaaaggctttggggtgagaatttctttgaccctagtaccagaaaatggaccaccaagaacactggtgctcccaactgcaagcgtggttttgttcagttctgttatgaacccatcaagcagatcatcaacacttgtatgaacgatcagaaggataaactgtggcctatgttgcagaagcttggtgtgaccatgaagtctgatgagaaggatttgatgggaaaggcactgatgaagcgtgtgatgcagacatggctcccagcaagtactgccctcctagaaatgatgattttccaccttccctcaccttccacagctcaaaaataccgtgtagagaacttgtatgagggacccttggatgatatctatgccactgctattagaaactgtgatcctgaaggccctctcatgctctatgtctcaaagatgattcctgcttctgacaaaggcagattctttgcttttggacgtgttttctctggcaaggtttcaactggtttgaaggtaagaatcatgggtccaaactatgtccctggtgagaagaaggatctgtatgtcaagagtgtgcagagaactgttatttggatgggaaagaggcaggaaactgttgaggatgtgccctgtggaaacactgtagctatggttggtttggatcagttcatcactaagaatgctacattgaccaatgagaaggagtctgatgcccatccaatcagagcaatgaagttctctgtctcacctgttgttcgtgttgcagtgcagtgcaaagttgcatctgaccttcctaaacttgttgaaggtttgaagcgtttggctaagtcagatcctatggtggtctgtagtattgaggaatctggggagcacatcattgctggtgctggtgaactccacctggagatctgtttgaaggatctgcaggatgatttcatgggtggtgctgagattgttaagtctgaccctgttgtgtccttccgtgagactgttcttgagaagtcttgcagaactgtgatgagcaagtcccctaacaagcacaaccgtctctacatggaggcccgacctttggaggaaggtcttgcagaggccattgacgatggtcgtgttggtccaagggatgatcccaaagctcgttccaagatcttgtctgaggagtttggttgggacaaggatcttgcaaagaaaatctggtgttttggacctgagaccactggccctaacatggtggttgatatgtgtaagggagttcagtatcttaatgaaattaaggattctgttgttgctgggttccagtgggcatcaaaggaaggtgcattggctgaagaaaacatgaggggtatttgctttgaagtctgtgatgtggtcctccatgctgatgcaattcacagaggtggtggtcaagtcattcccactgctaggagggtcatctatgcttcccagctgacagctaaaccccgactccttgagccagtctacttggtggagatccaagccccagagcaggcacttggtggaatctatagtgttctgaaccaaaagcgtgggcatgtattcgaggaaatgcagaggccgggtaccccactctacaacatcaaggcatacctccctgtcgtcgaatcctttggattttcaggcactttgagagctgcaacctcaggacaggcgttcccacagtgtgtgtttgatcactgggacgtaatgtcagctgacccgcttgaagctggttcaactgctgctcaacttgtagcagatatcagaaaaaggaagggcttgaaggagcagatgaccccgctatctgagttcgaggacaagctataagtggtccgtgatcattgtcaaataaagcaaaagaggaccatattggtggaatgtgacgatgatactcaaggtgagcataattttgttttgttttcattaatatttttaccgtggagtagtagtactttagtggtgttgaagttgtaacgggggatgtttcccgttttttcaaattatgttttcaatttagtcatggtcgacaagaacagcaaagttaatgttatctcgtctatatggttttgtcgtggaactatttcaaccaacattggtttggagagatgatactattttttttcttaaaccatggttgaatgtttttctatttgattggattctacctattgtgttgtgatatttttgcttggtggaagattgaaaatgaactcaggtactaaggacaacatgactgatggtgctcatcattagtggttgatcaccagttctcatca

SEQ ID NO: 2183 - DNA, 3008 bp, Mimulus guttatus
ccattcagttactccgcctccaaagctcgtcgttcttctctcggtttcatctgataggaagaaatcttctgaataattctgcagctgtgaaacttaagatcttgcaacgatggtgaagttcacagccgaagagctccggaggattatggacctcaaacacaatattagaaacatgtccgttattgcccatgtcgatcatgggaaatcaactcttaccgactcactggtcgctgctgcgggtattattgcccaagaagttgctggtgatgtcaggatgaccgatacccgtgctgatgaagctgagcgtggtatcacaatcaagtccaccggtatctctctgtactacgaaatgtcccccgaatctctggcgagctacaagggagagcgaagtggaaacgagtacctcatcaatcttattgactcccctgggcacgttgacttttcttctgaagtcactgctgctctgcgtatcactgacggtgcccttgttgtggtggattgtgttgagggtgtctgtgtgcagacagagactgttctcagacaggctctaggagagaggattcgccctgtcttgactgtcaacaagatggacaggtgtttccttgagctccaggttgatggagaggaggcttaccaaacattccagagggttattgagaacgcaaatgtcatcatggcaacttatgaagaccctctccttggtgatgtccaggtgtaccccgagaaaggaactgttgccttctctgctggtctgcacggatgggctttcactctaaccaactttgctaagatgtacgcctccaagttcggtgtggacgagagcaaaatgatggaaaggctgtggggtgagaatttcttcgatcccgccaccaagaaatggacaaccaagaacactggatctgcctcgtgcaaacgtgggtttgtccagttctgttatgagcccatcaagcagatcattgccacttgcatgaacgatctgaaagacaagctgtggcctatgttgaagaagctcggtgtgacaatgaagtccgacgagaaggacttgattggaaaggctttaatgaagcgtgtgatgcagacatggctgcctgccagcagtgcactattggaaatgatgatattccatctcccttctcccgccactgctcaaaggtaccgtgtggaaaacttgtacgagggtccccttgacgacatctacgccactgctatcagaaactgtgaccctgatggtcccctcatgctttacgtttccaagatgattcccgcttctgacaagggtagattctttgcctttggacgtgtgtttgctgggaaggtgtccactggtttgaaggtcagaatcatggggcctaactacgtacctggggagaagaaggacttgtatgtcaagagtgtgcagagaactgttatctggatgggcaagagacaggaaactgttgaagatgtgccgtgcggtaacacagttgctatggttggtttggatcagttcatcaccaagaatgctactttgaccaatgagaaggaagttgacgcacatccaatccgagccatgaaattttcagtctcacccgtcgtgcgtgtcgcagtgcagtgcaagcatgcctctgacttgccaaagctggtcgagggtttgaagcgtctggccaagtctgaccccatggttgtctgctccattgaggaatctggcgaacacatcattgccggagcaggagagctccacctcgagatctgcctgaaggatctggtggacgacttcatgggtggggctgagatcataaaatccgaccctgttgtgtccttccgtgaaacagttcttgatagatccgttcgcacggtgatgagtaagtcccccaacaagcacaaccgtctgtacatggaagctagaccattggaggacggtcttgctgaggccatagatgatggaaagatcggcccacgtgacgacccaaagatccgatccaagctcttgtctgaagaattcggctgggataaggagctcgccaagaagatttgggctttcggtcctgaaaccaccggcccgaacatggtggtggatatgtgtaagggagttcagtacttgaatgaaatcaaggactctgttgttgctggtttccagtgggcttcaaaggaaggcccgttggctgaggagaacatgaggggtgtctgctttgaggtgtgcgatgttgtgctgcacactgacgcgattcacaggggtggtggtcaggttatcccgactgccaggagggttatttacgcgtctatgattactgcaaagcccagactcttggagcccgtttatctcgtggagattcaggcgcccgagcaggcacttggtggtatttacagtgtgctgaatcagaagcgtggccacgtgttcgaggaaatgcagaggcccggcacaccgctgtacaacatcaaggcatacttgcctgtggttgagtcgttcgggttttcgagtactttgagggctgccacttctggacaggctttccctcagtgtgtgtttgaccattgggagatgatggcgtcggatcctctgcaggcggaatctcaggctgcagttcttgtggctgatatccgtaagaggaagggtttgaaggttacaatgacacctctttctgactttgaggacaagctgtaagtgggtggtggatttacgatattaccccttgctgacgtggaaatcgacggtgggtggaagttttgctgttgctatcgttttaattgctcttttttttttttattttaaatgtatggtttagtgtttggactatttaaattgttgttacgtactctattttaatttgtgtcggagtctcgtctagttgctgtttgagagctgcttttagatgaacaagaatattgtctgttttttcaatggatatttctgtatttgcagattgcttttttatttgagatgattttatattcattctatcgtctatcgttgttttcttaattaaatttctgccaatttggaagttggtgttatgtgaaattttatgttg

SEQ ID NO: 2184 - DNA, 3011 bp, Papaver somniferum
tcactaacttccttctattcttctctcaaggcgcagctctcctttctcttagggatttgtctgctgcaaatctgttcactgatattttgtagtagcggagttttgatttacagaaacaaagatggtgaagtttacagctgaagagcttcgtcggatcatggacctgaagcataatatcaggaacatgtccgtcattgctcatgtggatcatggaaaatcaacacttactgattctcttgtggctgctgctggtatcattgcccaagagactgctggtgatgttcggatgacagatacccgtgcagatgaggcagaacgtggtattacaattaaatctactggaatctctctctattacgagatgagtgatgagtctttgaaggcctacaagggtgaaagaatgggtaacgagtacctcatcaaccttattgattcacctggtcacgtcgacttctcttctgaagtcacagctgcattacgtatcactgatggtgcacttgttgtggttgactgtattgagggtgtttgcgtccaaaccgagactgtccttcgacaagctcttggagaaagaatcaggcctgttttgactgtcaacaagatggacagatgcttcctagagctacaggttgatggagaagaggcttatcagactttctccagagttattgagaatgccaatgttattatggccacttatgaagacccactcctcggtgatgtccaggtttaccctgaaaaaggaacagtcgccttctctgctggtttgcacggttgggctttcactctaaccaattttgcaaacatgtatgcttctaagttcggtgttgaacacagtaagatgatggagaggctttggggtgagaacttctttgacccagcaactaagaagtggactaataagagaacctcgtctcccacatgtaagcgtgggtttgtccagttctgttatgaacccatcaagcagatcattgccacttgcatgaatgaccaaaaggacaagttgtggcctatgttgcaaaagcttggtgttgtaatgaagaatgacgagaaggagttgattgggaagcccttgatgaagcgtgtgatgcagacttggctccctgcagctactgccctacttgaaatgatgatttatcatctcccctctccccacacagctcagaggtatcgtgtcgagaacttgtacgagggtcctcttgatgaccagtatgctaatgccatcagaaactgtgatcccgaaggtccacttatgctctacgtgtctaagatgattcctgcctccgacaagggtagattctttgcctttggtcgtgtctttgctggtaaggttgcaacaggtgctaaagtcagaatcatggggcctaactacgttcctggtgggaagaaggacttatacaccaagagtgtccagagaactgttatctggatgggaaagaaacaggagtcagttgaggatgtaccttgtggtaacacagttgccctggttggattagatcaatttatcaccaagaatgcaactctcacaaacgagaaggaagttgatgctcatcctatcagagccatgaagttttctgtctctcccgttgttcgtgttgctgttcagtgtaaggttgcctctgaccttcccaagctggttgaaggtcttaagcgtctgtccaaatctgatcccatggttgtctgtaccattgaggagtcgggcgagcacatcattgcaggtgctggagaactccatcttgagatctgtttgaaggatttgcaggatgatttcatgggtggtgcagaaatcgtgaagtctgaccctgtggtgtcattccgtgaaactgtgctagagaagtcttcaagaactgtgatgagcaagtctccaaacaagcacaaccgtctgtacatggaggcacgccctcttgaggatggacttgctgaagccattgatgatggtcgtattggtccaagagatgatcccaaaattcgttcaaagatcttatctgaagagtttggatgggacaaggatcttgcaaagaagatctggtgttttggtccggatactactggtccaaacatggttgtcgatatgtgtaagggagttcagtaccttaatgaaatcaaggattcagttgtcgcagggtttcagtgggcctcaaaggaaggtgtgctagcagaagagaacatgagaggtatatgctttgaagtatgtgatgtggttctccattctgatgccattcacagaggtggtggacaggttattcctaccgccaggagggttatgtatgcgtcacagctcacagctaaacctagacttctagaacctgtgtacctagtcgagatccaggctccggaaggtgctcttggtggtatttacggtgttctcaatcagaagcgtggacacgtctttgaggaaatgcagaggccaggaactcctctctacaacatcaaagcatatctacccgtcgtggagtcattcggtttctctgcccagcttagggctgccacatcagggcaggcttttcctcagtctgtgtttgatcattgggatatgatgatggctgatcctttggaggctggtactcaagccgcagagcttgtgacagacatcaggaagaggaagggtttgaaggcccagatgacccctctctccgattttgaggacaagctttaagtgttaaggttcttttttgaatgatgaattgagatggtgagttgttccaagtgtttaggcattaggtttaattatgttggcaaatggatattagttactcttgggtttgtaagtgttttggtaacagaatgatccaaactttaatttagtttatcatttaatctataattattagtgcaataaaattcctttaacttcagtgtctaatgcagaaggaaagtgtcttcctgcagtattgccatggttacaaaaggcaacacgaatcttgctgccaagtgactgtacaattctggtttgtgtttgaaacaattgaacaatgtacagaatgatagcactggcggttttttcttaaaaaaaa

SEQ ID NO: 2185 - DNA, 2804 bp, Amorphophallus konjac
ctggtcaggtcataatttacagcagtcaagatggtgaagtttacatcagaagaattgcgcaggatcatggacctgaagcacaacattagaaacatgtctgtcattgctcacgttgatcatggcaagtctactctcactgactctcttgtggcggctgctggaatcatcgcacaggaagttgctggagatgtccgaatgactgatactcgccaggatgaagctgagcgtggtatcacgatcaaatctacaggaatttctttgtattatgagatggatgatgataaattgaagaacttcaagggtgaaaggaatggaaatgagtatctcatcaaccttatcgattctcctgggcacgtggatttctcttctgaggtcacagcggctcttcgtatcactgatggtgcattagttgttgtcgactgtgtggaaggtgtgtgtgttcagactgagacagtccttcgccaagcccttggtgaaaggatcaggcctgtcttgactgttaataaaatggatagatgtttccttgagctccaggttgaaggtgaagaggcgtatcagacattccaacgtgtcattgagaatgctaatgttattatggctacttatgaagatccccttcttggtgatgtccaagtttacccggaaaaggggactgtggctttctctgctggtttgcatggttgggctttcactttgacaaactttgctaaaatgtatgcgtctagatttggtgttgatgagaacaagatgatggagcgtctttggggagaaaactacttcgatcctgctaccaaaaagtggactagcaagagtacaggttctcctagttgcaaacgaggttttgttcagttctgttatgaaccaattaagcagatcatcagtacttgcatgaatgaccaaaaggataagttatggcctatgcttcagaagctaaaagtgaccatgaaatctgacgagaaagagttgactggcaaggcattgatgaagcgtgtcatgcagacctggttgcctgcaagtgatgcccttcttgaaatgatgatcttccaccttccttctccttcaaaggcacagaagtatcgtgtggagaacttatatgagggtcctctggatgatatgtatgcaaatgctatcaggaactgtgatccagatgggcctcttatgctgtatgtgtctaagatgattcctgcctctgacaagggtagattctttgcctttggtcgagtcttctctgggaaggtgtccactggtatgaaggtcagaatcatgggtcccaactatgttcctggtcaaaagaaagatttgtatgtgaagagtgtgcagaggactgtcatttggatgggtaagaaacaagaatctgtagaggatgtgccgtgtggaaatactgtggccatggttggcttggatcaattcatcaccaaaaatgcaactttgacgaatgagaaggaagttgatgctcatccaattagggccatgaagttttctgtctctccagttgtccgtgttgcagtgcaatgtaaggttgcttctgaccttcctaaacttgttgaaggcttgaaacgattagctaaatcagatcccatggtgttgtgcatgatcgaggaatctggtgagcacattgttgcaggagctggggagcttcatcttgagatttgtttgaaagatctgcaggaggatttcatgggtggtgctgaaattattgtgtctgacccggtcgtctctttccgtgagaccgtgcttgaaaaatcttgtcgcactgtgatgagcaagtcacctaacaagcacaacaggctttacatggaagctcgcccaatggaagaaggccttgctgaggccatcgatgacggccgtattggccccgggacgatcctaaagtccgtgctaagatcctggccgaagagtttggctgggacaaggacctcgctaagaaaatctggtgttttggccccgaaaccaccggcccaacatggttgttgatatgtgtaagggagttcagtatctcaatgaaatcaaggactctgtggtggctggcttccagtgggcatccaaggaaggtgcagtggccgaagaaaacatgagagccatatgctttgaggtctgtgatgtggtcctacatgctgacgcgattcacaggggtggcgggcaggtcattcctacggcaagaagggtcatctatgctgctcagctgacggcaaaaccaaggctgttggagccagtttatctggtggagatccaggcaccggagcaagcactgggtggtatatacggtgttcttaaccagaagagaggccacgtcttcgaagagatgcagaggcccggcacccccctgtacaacatcaaggcgtatctcccagttatcgagtccttcggtttctcaagtaccctgagggcagcaacatcagggcaagcattcccccagtgtgtttttgatcactgggacatgatgtcctctgatccattggaggcaggcactcaggcagcccagatcgtggcggatgtacgcaagaggaagggcctgaaggagcagatcactccgctttccgagtacgaggacaagctgtgagctgtgcccacattctatgtacaccataaactcaaatctggttttatgttctccgcttctaaaaagcagacttctccgagtcggtctgctttgaggcgagttcttctcagtagtccagtttttattgatctgtctgtttttcaaaaaagttttgtttatgttgactttcttcagaggcattatcatttggcgagttgccaaagagttgttgatttgcatgtggacacaaatctctctttttttt

SEQ ID NO: 2186 - DNA, 2774 bp, Centaurea maculosa
ctcacccagacatcgccgcctcattctcttctcttctcatcggagtttttggctgatactttcaccgccttttttttagtgaatcttgaagccaggcacaatggtgaagtttacggctgaggagctccgtaggatcatggactacaagcacaacattcgtaacatgtctgttattgcccatgttgaccacgggaaatctaccttgacggattctcttgtggctgctgctggtattattgcacaagaagttgctggtgatgtgcggatgaccgatactcgtgctgatgaagcagaacgtggtatcactatcaagtccactggtatctctctttactatgagatgaccgatgcggctctcaagagtttcaagggagaacgtgacgggaatgagtaccttatcaatcttatcgattcgcctgggcacgttgacttttcttctgaggttactgctgccctacgtatcacggatggtgcattggttgttgttgattgtatcgaaggtgtctgtgtccagacggaaaccgttcttcgacaagcccttggagaaaggattcggccagtcttgactgtcaacaagatggacaggtgtttccttgagcttcaggttgatggagaggaggcatatcagacgttccagagggtcattgagaatgctaatgtcattatggcaacatatgaggacccacttcttggtgatgttatggtttaccccgagaaaggtactgttgctttctctgctgggttgcatggatgggcatttactctaacaaacttcgcaaagatgtatgcctccaagtttggtgtggatgagtcgaagatgatggaaaggctctggggcgagaacttctttgacccgaaaacaaagaagtggaccaccaagaatagtggttctccaacatgcaagcgaggttttgttcaattctgttatgagcccatcaagcagattatcaacacctgtatgaacgaccagaaggattcgttgtggccgatgttgacaaagcttggtgtcaccatgaagtctgatgagaaggagttgatgggcaaggcattgatgaagcgtgtcatgcagacatggcttcctgctgccactgctctacttgaaatgatgatctttcatctgccttctcctcacactgctcagaggtaccgtgttgagaacttgtacgagggtcctttggacgatgcttatgccaacgccattagaaactgtgaccctgatggccctctcatgctatatgtctcgaagatgattcccgcatccgacaaaggaagattctttgcttttggtcgtgtgtttgccgggaaggtatcgactggtttgaaggtaagaataatgggccccaattacgtcccgggtgaaaagaaagatctgtatgtgaagagtgttcaaaggactgtcatctggatggggaagaaacaagagactgtggaagatgtcccttgtggtaatacagttgcgttggttggtttggatcagttcattaccaagaatgcaacattgacaaacgagaaagaagttgacgcacatccaattcgtgccatgaagttctccgtgtcacctgtggtgcgtgttgctgttcagtgtaaggttgcatcagaccttcctaagcttgttgaagggctgaagcgacttgccaagtctgatcctatggttgtttgtaccattgaggagtctggggaacacatcatcgcaggtgcaggagagctccatcttgaaatatgtttgaaggacttgcaagatgatttcatgggtggtgcagagattgttgtttcggatccagttgtgtccttccgtgaaactgttctcgagaagtcatcccgaaccgtgatgagcaagtctcccaacaagcacaatcgtttgtacatggaagccaggccaatggagaaggacttgcagaggccattgatgaaggagagttgggcctcgggatgaccccaaggtgcgtggtaagatcttggctgaggagtttggatgggacaaggatctcgcaaagaaaatctggtgttttggtcctgagacgactgggcccaacatggtggtcgatatgtgtaagggagtgcagtacttgaacgaaataaaggattcggttgtggctgggttccagtgggcttcaaaggaaggtgcgttggcggaagagaacatgagaggcatatgctttgaagtgtgtgatgtggtactccatgccgatgctattcacaggggaggtggtcaagtgattccaaccgccaggagagttatctatgcttcgcagctcaccgccaagcccaggctgctcgagccagtgtacctggtggagatccaggcacctgagcaggctcttggtgggatctacagcgtgttgaatcagagacgtgggcatgtgtttgaggagatgcagaggcctggtacgccattgtacaacataaaggcttatctgccggttgttgaatcttttggattttctggtgcattgagggcgtctacttctgggcaagccttcccacaatgtgtgtttgatcattgggacatgatgtctgctgatccgttggaagctggttcccaggcaagcacgctggtgacccaaatccgcaagaggaaaggtctcaaggagcagatgacaccgctttctgagtttgaggacaagctttgatttcttattttagtttttctttcgttacctacaattcccgatcatgatgatatattacttgatgtgagatgatgctggtggtggctacagaccattttatgttttatcattctcagcagatgttctatttttgacaccttggtg

SEQ ID NO: 2187 - DNA, 2667 bp, Papaver somniferum
ttctttctagggtattttgtccttgtcttctagttgtattattttggtagtaacaaagttattttttacagaagcaaagatggtgaagtttacagctgaagagctgcgccggatcatggacctgaagcataatatcaggaacatgtccgtcattgctcatgtcgaccatggaaaatcaacacttactgattctcttgtggctgctgctggtattattgcccaagaaactgctggtgatgttcgtatgacagatacccgtgcagatgaggcagaacgtggtattacaattaaatctaactggtatctctctctattatgagatgtctgatgagtctttaaaggcctacaagggtgacagaatgggtaacagtacctcatcaaccttatcgattcacctggtcacgtcgacttttcttctgaagtcacagctgcattacgtattactgatggtgcacttgttgtggtggactgtattgagggtgtctgtgtccaaaccgagactgtccttcgacaagctcttggagaaaggattaggcctgtgttgactgtcaacaagatggacagatgtttcctagagctacaggttgatggagaagaggcttatcagaccttctccagagttattgagaatgccaatgttatcatggccacttatgaagacccactccttggtgacgtccaggtttatcctgaaaagggaactgtcgccttctctgctggtttgcacggttgggctttcactctaaccaatttcgcaaacatgtatgcttctaagttcggtgttgaacacagtaagatgatggagaggctttggggtgagaacttctttgacccagcaactaagaagtggactaataagagaaccgcgtctcctacatgtaagcgtgggtttgtccagttctgttatgaacccatcaagcggatcattgccacttgcatgaatgatcaaaaagacgagttgtggcctatgttgcaaaagcttggtgttacaatgaagaatgatgagaaggaattgattggaaagcccttgatgaagcgtgtgatgcagacttggctccctgcagctactgccctacttgaaatgatgatttatcatctcccctctccccacacagctcagaagtatcgtgttgagaacttgtacgagggtcctcttgatgaccagtatgctaatgccatcagaaactgtgatcctgaaggtcctcttatgctctacgtgtctaagatgattcccgcctccgacaagggtagattctttgccttcggtcgtgtctttgctggtaaggttgcaacaggtgctaaagtcagaatcatggggcctaactatgttcctggtgggaagaaggacttgtacaccaagagtgtccagagaactgttatctggatgggaaagaacaggagtctgttgaggatgttccttgtggtaacacagttgccctggtcggattggatcaatttatcaccaagaatgcaaccctcacaaacgagaaggaagttgatgctcatcctatcagagccatgaagttttctgtctctcccgttgttcgtgttgctgtccagtgtaaggttgcctctgacctgcccaagctggttgaagggcttaagcgtctatccaaatcagatcctatggtggtgtgtaccattgaggagtcaggcgagcacattattgcaggtgctggagaactccatcttgagatctgtttgaaggacttgcaggatgatttcatgggtggtgctgaaattattaagtctgaccctgtggtgtcattccgtgagactgtcctagagaagtcttcaagaacagtgatgagcaagtccccaaacaagcacaaccgtttgtacatggaggcacgtcctcttgaggatggacttgctgaagccatcgatgatggtcgtattggtccaagagatgatcccaaaattcgttcaaagatcttatctgaagagtttggatgggataaggatcttgcaaagaagatctggtgttttggtccagatactactggtccaaacatggttgtggatatgtgtaagggagttcagtaccttaatgaaatcaaggattcagttgtggcagggtttcagtgggcttcaaaggaaggtgtgctagcagaagagaacatgagaggtatatgctttgaagtatgtgacgtggttctccattctgatgccattcacagaggtggtggacaggttattcctaccgctaggagggttatgtatgcctcacagctcacagctaaacctagactgctagaacctgtgtatctagtcgagatccaggctcctgaaggtgctcttggtggtatttacggtgttctcaatcagaagcgtggtcatgtctttgaggaaatgcagaggccaggaactcctctctacaacattaaagcatatttacctgtcgttgagtcatttggtttctctgcccagcttagggctgccacatctggacaggctttcccccagtccgtgtttgatcattgggatatgatgatggctgatcctttggagcctggcactcaagctgcagatcttgtgacagacatcagaaagaggaagggtttgaaggctcagatgacccccctctctgattttgaggacaagctttaagtccgtggtatttgtctttaagttttagacattaggttaatttgtgctatggatctt

SEQ ID NO: 2188 - DNA, 2898 bp, Helianthus annuus
taaattagggtttcagaggagcctatccgccgctcaatttatatctcttggtgctcacaaaacctaaaccactgagaactctttgcagccgttttctctcgttttgtttggattttgtgagaagcaattcagctatatttctgtcagagctctaaaaactagccaaaatggtgaagtttaccgctgaagagcttcgaaggattatggactacaagcataacattcgtaatatgtctgttattgctcatgtcgatcacggaaaatccactttgactgattctcttgtggctgctgctggtattattgcccaagaagttgctggtgatgttcgtatgactgatacccgtgctgatgaagcagaacgtggtattacaatcaaatccactggtatctctctttactacgagatgaccgatgaagctttgaaaagcttcaagggagaaagaaacggaaacgagtacctgatcaatcttatcgactcacctgggcacgttgacttttcttccgaagtcactgctgctctacgtatcactgacggtgcactcgtggtggttgattgtatcgaaggtgtctgtgtgcaaaccgaaactgttcttcgacaagctctcggagaaagaatccgacctgtcttaaccgtcaacaagatggacaggtgttttctcgagcttcaggttgatggtgaagaagcgtatcaaacgtttcagagggttattgaaaacgctaatgtcatcatggctacttatgaggacccacttcttggtgatgtcatggtttaccccgagaaaggaaccgttgctttctcagctgggctccacggttgggcttttacgttaaccaactttgctaagatgtacgcttcgaaattcggtgttgatgagtctaaaatgatggaaaggctttggggagagaactttttcgacccgaaaaccaagagtggaccactaagagcaccggcactgcatcctgcaaacgtgggttcgttcagttctgttacgagccaattaagcagattatcaacacatgcatgaatgaccagaaagatcagttgtggcccatgttgacaaagcttggtgtcaccatgaaatccgaagagaaagagttgatgggtaaggcgttgatgaagcgtgttatgcagaattggcttccggctgctactgctttacttgaaatgatgatctttcatctgccttcacctcacactgcccaaagataccgtgttgagaatctttacgagggtcctttggatgatcaatacgctaacgctatcagaaactgtgaccccgatggtccccttatgctttatgtttctaagatgattcccgcttctgataaaggtagattcttcgcctttggtcgtgtttttgctggtagggtgtctaccggtttgaaggttcggatcatgggtcccaactacgttcccggtgaaaagaaagatttgtacgtgaagagtgttcagagaaccgtcatctggatgggaaagaagcaagaaaccgttgaagacgtaccccgtggtaacacagtggctatggttggtttggatcagttcatcaccaaaaacgcaacattaacaaacgaaaaggaagtcgacgcccaccccatccgagccatgaagttttccgtctcacctgtggtgcgtgttgcggtccagtgcaaggtcgcgtctgatctacccaagcttgttgaaggtctgaaacgtctggcgaaatctgaccctatggttgtgtgtaccattgaggagtccggtgaacacatcattgctggtgccggtgagcttcatttggaaatctgcttgaaggacttgcaagatgatttcatgggtggtgcggaaatcgttgtctccgaccctgttgtgtctttccgtgaaaccgtcttggagaaatcagccagaaccgtgatgagcaagtctcctaacaaacacaaccgtctctacatggaagctagacccatggaagatggtcttgctgaggctatagatgaaggcagggtgggcccacgtgatgaccccaaggttcgtggtaagatcttgtctgaggagttcggttgggacaaggatttggcaaagaagatctggtgttttgggcctgaaacaaccggtcccaacatggttgttgacatgtgtaagggagtccagtatcttaatgaaatcaaggattcggtggttgctggttttcagtgggcttctaaagaaggtgctttggctgaagagaacatgaggggtatttgctttgaagtgtgtgatgtcgttctccatgctgatgccatccacagaggtggtggtcaagttattccaaccgcaaggagagtcatatacgcgtctcagttgaccgcgaagccacgtttgctggagccggtctaccttgttgaaattcaagcacctgagcaagctttgggtggaatctacagtgtgctgaatcaaaggcgtggacacgtgtttgaagaaatgcagaggccgggtaccccactgtacaacatcaaggcttatcttccagtcgtggagtccttcgggttttctggtgccttgagagcttctacttcgggtcaagctttcccacaatgtgtgtttgaccattgggacatgatggggtcagatccattggaagttggttcgcaggcaagcactcttgtgacccagatccgtaagaggaagggtttgaaggagcagatgacaccactgtctgagtttgaggataagctgtaagctgtaagcgctggatgttagctgcatgcgctggatgagatggtataagaattactatctggatttcgtgttatattttctacaatgttttttagtatgctggttgtactatgttttgttttgttgtcgtgagaaactacctacttgcagacgttgatgctgttaattttgacattcatgtttttaccattttcagtttt

SEQ ID NO: 2189 - DNA, 2912 bp, Aquilegia formosa
aagcctccattcctctcctttctcttccacctctcaaacccaagaaagaaagaaagagaaagaaagaaagaaagaatccatttgtttctgagattttcaggagcaattttttttgagtttttattgtcgtgatattcggaagtatccaaaatggtgaagtttacagcagatgagcttcggaggattatggaccttaaacacaacattcgtaatatgtctgtgattgcccatgtcgatcacgggaaatctactcttactgattctcttgttgctgcggctggtattattgcccaggaaactgctggagatgtccggatgactgatacacgtgctgatgaagctgaacgtggtattacaattaagtctactggtatctctttgtattatgagatgagtgatgagtctctgaagcgatacaagggtgaaaaaatggggaacgactatctcatcaaccttatcgattctcctgggcacgttgacttctcatctgaagttacagctgctcttcgtattactgatggtgcacttgtcgtggttgattgtattgaaggagtctgtgtacaaactgaaactgttcttagacaagctcttggagaaaggatcaggcctgttttgactgttaataaaatggaccgctgcttccttgagctacaggtcgatggggaggaggcttatcagaatttccaacgggtgattgaaaatgccaatgttattatggccacttatgaagatcccctccttggcgatgtccaggtctatcctgaaaagggtactgttgcattctctgctggtttgcatggttgggcgtttacgctcacaaattttgcccagatgtatgcttctaagtttggagttgatgagtcaaagatgatggagagactttggggtgagaatttctttgacccagctacaaaaaagtggacaaccaagaacaccggtgctcctagttgcaaaagaggttttgttcagttctgttatgaacccatcaagcagattattaaaacttgtatgaatgatgagaaggccaagttgtggcctatgctgcaaaagcttggtgtcaccatgaagggagaggagaaggagttgatgggtaaacctttgatgaaacgtgtaatgcagacctggctccctgctagcactgccttgttggaaatgatgatatttcaccttccctctcctgctgtggctcagaagtaccgtgtcgagaacttgtacgagggtcccctagatgatcagtatgctaacgccatcagaaactgtgatcctgaagggcctctcatgttgtacgtgtcaaagatgattccagcatctgacaagggtagattctttgcatttggccgtgtttttgctgggaaggtctcaactggtatgaaggttagaatcatgggacccaactacattcctggacagaagaaagacttgtataccaagagtgttcaaagaactgttatctggatgggcaagagacaggaatctgtagaggatgtgccgtgcggtaacactgtcgcaatggttggtttggatcagttcataaccaagaatgcaaccctgacgagtgagaaggaagtggatgcccatcctatcagagcaatgaagttctcagtctcgcctgttgttcgtgttgctgtgcagtgtaaggttgcgtctgaccttcccaagcttgtcgaaggtctgaagcgtctagcgaagtcagatcctatggtggtgtgttcaattgaagagtcaggtgagcacattatagctggtgcaggtgaactccatcttgaaatctgcttgaaagacttggtagatgatttcatgggtggggcagaaattattcaatctccaccagtcgtatctttccgtgaaactgtgcttgaaaaatcttcccgaactgtgatgagcaagtcacccaacaagcacaaccggctgtacatggaagctcgcccacttgaagatggcctagctgaagccatagatgatggtcgtattggcccaagggatgatccaaagatccgttccaagattttgtccgaggaatttggttgggacaaggatcttgccaagaagatttggtgttttggtcctgagaccacgggacctaacatggttgtggatatgtgcaagggagttcaatacctgaatgaaatcaaggattctgttgttgctggttttcagtgggcctctaaggaaggagcactatgtgaggagaacatgaggggtatttgctttgaggtatgtgatgttgtactccatgctgatgctattcacagagggggcggtcaggtcattcctactgccaggagggtcatttatgcatcccagctcactgcaaagcccaggctcttggaaccagtttatatggtcgaaattcaggccccagagcaggcgcttggtggcatttatggtgttttgaatcagaagcgaggacatgtgtttgaggaaatgcagaggccaggtaccccgttgtacaacatcaaagcatacttgcctgtcattgaatcatttggtttctcaagccagctccgagctgcaacctctggacaggcctttcctcaatgtgtgttcgatcattgggacatgatgtcctctgatccactagaagcaggttctcaagcttctacactggttgctgatatccgcaagaggaagggtttgaaggagcaaatgaccccactttcagaattcgaggacaagctataaggtgcgggggtaattgttgttgttctgttttattgttagctgctacagcgagtgatggctgtccagtttattttggctgggtgctactcagattatgtttttgaatgcttttatgttgctactcagattatcttttaatatctttttgatgtataagtgcttgttacatcctttggtacttaacatctttgattagttcaccaagtttaaatctttcctagctatactgg

SEQ ID NO: 2190 - DNA, 2806 bp, Arabidopsis lyrata
agattttgtaggtgacaatcaaaagtttgacaaaatggtgaagtttacagctgatgagcttcgaaggattatggactacaaacacaacattcgtaatatgtccgttattgctcatgtcgatcacggaaaatccactctcactgattccttggttgctgctgctggtatcattgcccaagaggttgctggtgatgttcgtatgactgataccagagctgatgaggctgaacgtggtattactatcaagtccactggtatttctctctactacgagatgactgatgagtccttgaagagtttcactggagccagagatggcaacgaataccttatcaaccttatcgattctcctgggcacgttgacttttcttctgaggttactgctgctctccgtattactgatggtgctcttgtggtggtcgactgtattgagggtgtctgtgttcagactgagactgttctacgtcaggctcttggtgaaaggattcgacctgtcttgactgttaacaagatggacaggtgtttccttgagcttcaggttgatggtgaggaggcttaccagactttctccagggtcattgagaatgccaacgttatcatggctacatatgaggatcctctccttggtgatgttcaggtttacccagagaagggaactgtggcgttttctgctggtctccatggttgggcgtttacactgaccaactttgcaaagatgtatgcttccaagttcggtgttgatgaaactaagatgatggagaggctctggggtgagaatttctttgaccctgccaccaggaaatggagtggcaaaaacactggttccccgacctgcaagcgtgggtttgtccagttctgctatgaacccatcaagcaaatcatcgctacttgcatgaatgaccagaaggacaagttgtggcctatgttgcagaagcttggtgtcacaatgaagaatgatgagaaggagcttatgggtaaacctctaatgaagcgtgttatgcagacttggctccctgcaagtactgcactacttgagatgatgatctttcatttgccatctccccacactgcccagaggtaccgtgttgagaatctgtatgaaggtcctcttgatgatcagtatgcaaatgccatcaggaactgtgaccccaatggacctctcatgctctacgtatctaagatgattccagcctcggacaagggtaggttctttgcctttggtcgtgtctttgctggtaaggtttctactggtatgaaggtcagaatcatgggtcccaactatgtccctggtgagaagaaggatctgtatactaagagtgttcagaggactgttatttggatgggtaagaggcaagagacggtggaggatgtcccttgtggtaacactgttgctatggttgggctggatcagttcatcaccaagaatgctacattgactaatgagaaggaagttgatgctcaccccattcgtgccatgaagttttctgtgtctcctgttgttcgtgttgctgttcagtgtaaggttgcatctgaccttcccaagctggttgagggtctcaagaggctggccaagtctgatcctatggttgtgtgcacaatggaagaatctggtgagcacattgttgctggtgcaggagagctacatcttgagatttgtctgaaggatctgcaggatgatttcatgggtggtgctgaaattatcaagtcagaccctgtggtctccttccgtgagacagttagtgataggtctattcgcactgttatgagtaagtctcctaacaagcataaccgtctctacatggaagcaagacccatggaggatggtctagctgaggcgattgatgatggacgtattggcccaagggatgaccctaagatcaggtccaagatcttggctgaggagtttggatgggacaaggatcttgcaaagaagatctgggcatttggacctgaaaccacagggcctaacatggttgttgatatgtgtaagggagttcagtaccttaatgaaatcaaggactcagtggtggctggtttccagtgggcgtccaaggaaggtcctctatgtgaagagaacatgagaggcatctgtttcgaggtttgtgatgtggtgcttcactctgatgccatccacagaggaggtggtcaggttatcccaacagccagaagggtcatatacgcttcccagatcacagctaagcccaggcttttggagccagtttacatggttgagatccaggcaccagagggagctcttggaggaatctacagtgtgctgaatcagaagcgtggacacgtctttgaggagatgcagaggccaggaactccgctgtacaacatcaaggcgtacctgcctgttgtggagtctttcggattctcgagtcagcttagggcagcaacctcaggacaggctttcccacagtgtgtgtttgatcattgggaaatgatgtcttctgaccctcttgagccaggtactcaggcttcagttctggtggctgatatcaggaagaggaagggattgaaggaacagatgactccactatctgagttcgaagacaagctttaagctttcaccaagactagccttttgcactatggttactattccctctatcttatttttgtcgtgttttatgattactcttttggtatgacggatcgtgaagactttctctcgccatcccctcaatgtttttacttttttcttctagttgagaactttgttattgtgttcgcaaatatctgtgttgattttgtctctcttttttaatactctcttctcctcggatcattcatattcatgcat

SEQ ID NO: 2191 - DNA, 3038 bp, Brassica rapa
atatatcaaacacctcctctcaagctcctccctctcaagctcttccctctctctccctccttcccctccaagagatattgtaggtgaagaataagagttagtcaaaatggtgaagtttacggccgatgagcttcgtaggattatggattacaaacacaacatccgtaacatgtccgttattgcccatgtcgaccatggtaaatccaccctcactgactccttggttgctgctgcgggtatcattgcccaagaagttgctggagatgtccgtatgactgatactcgtgctgatgaggctgaacgcggtatcactatcaagtccacgggtatctctctctactacgagatgactgatgcttccttgaagagcttcactggtgctagagatggtaacgagtaccttatcaacctcatcgactctcctggccacgttgacttttcctctgaggtcactgctgctctccgtatcaccgatggtgcccttgtggtggtcgactgtatcgagggtgtctgtgttcagaccgagactgtgctacgtcaggcccttggtgagaggattaggcccgtgcttactgtgaacaagatggacaggtgtttccttgagcttcaggttgatggtgaggaggcttaccagactttccagagggtcattgagaatgccaatgtcatcatggcaacgtacgaggatcctctccttggtgatgttcaggtttaccctgagaagggaactgttgccttctctgctggtctccacggatgggctttcaccctgaccaactttgccaagatgtatgcttccaagttcggtgttgacgagactaagatgatggagaggctgtggggtgagaacttctttgaccctgccaccaggaaatggagcagcaagaacactgggtccgctacctgcaagcgtgggtttgtgcagttctgttatgaacccatcaagcagatcatcgccacttgcatgaacgaccagaaggataagttgtggcctatgttgcagaagcttggtgtccagatgaagtctgatgagaaggagcttatgggtaaacctttgatgaagcgtgtcatgcagacttggctccctgccagcactgcattgcttgagatgatgatctttcaccttccatccccccacactgcacagaggtaccgtgttgagaatttatatgaaggtcctctcgatgatcagtatgccactgccatcagaaactgtgatcctaatggtccgctcatgctctatgtttctaagatgattcccgcttcagacaagggaagattctttgcttttggtcgtgtattctctggtaaggtgtccactggtatgaaagtcagaatcatgggtcccaactttgttcctggtgagaagaaagatctttatgtcaagagtgttcagaggactgtcatctggatgggcaagaggcaagagactgttgaggatgttccctgtggtaacaccgttgctatggttggtcttgatcagttcatcaccaagaatgctacgctgacgaatgagaaagaagttgatgctcatcctatccgtgcaatgaagttctctgtgtcccctgttgtacgtgttgctgttcagtgcaaggtcgcttctgatcttcccaagcttgttgagggacttaagaggctggccaagtctgaccctatggttgtgtgcacaatggaggagtcaggtgagcacattgttgctggtgctggagagctccatcttgagatttgcttgaaggatcttcaggatgatttcatgggtggtgcggagattgtcaagtctgaccctgttgtctcattccgtgagactgttttggagcggtctgtgcgtaccgtgatgagcaaatcaccaaacaagcataaccgtctgtacatggaggctaggcccttggaggatggtcttgcggaggcaatagatgacggccgtattggtccaagagatgatcccaagatacgttccaagatattggctgaggagtttggttgggacaaggatcttgcaaagaagatatgggcgtttggaccagaaaccacagggcccaacatggttgttgacatgtgtaagggagtgcaatacctgaatgagatcaaggattctgttgttgctgggttccagtgggcttccaaggaaggtcctctttgtgatgagaatatgagaggaatctgctttgaggtctgcgatgttgtgctccactccgatgctatccacagaggtggtggtcaggttatcccaacagcgaggagagttatctacgcctcgcagctcactgccaagcccagattgttggaaccggtttacatggtggagatccaagcaccagagggagctcttggaggaatctacagcgtgctgaatcagaagcgtggacacgtctttgaggagatgcagaggccagggacaccgctgtataatatcaaggcgtacctgccagttgttgagtcatttggattctcaagtcagcttagagcagcaacctcaggacaggccttccctcagtgtgtgtttgatcattgggagatgatgtcgtctgacccattggaggcaggatcgcaggcttcaacgcttgtgactgacatcaggaagaggaagggtatgaaggaacagatgactcccttgtctgacttcgaagacaagctataagcagcagccaacaagactcactatggtcacctttttctctccatctctaccgtattttgtttactgttagctctgttttggtgttatgatatcactttatctgtggccacaatcctcttgaatgttttacttttttagttgaaaactggtttatctttgtgtttactcttttttgcactcttgttatcctgttttcattggaacgttgttatatctaccgtatttttgtttactctgttttggtgttatgactttatctgtgttgccacatccttatgtgtttactctttgcactcttgaagttgagaaaacttcttatgtgttcactctttgcactcttgttatcctgttatcactggaacgttgttatatgctgttatgcattgcaagcaataagatg

SEQ ID NO: 2192 - DNA, 2959 bp, Papaver somniferum
gcgacatcactaacttcattctcttcttctctcacggcgcagctttcccttctctaagggatttgtctgctgcaaaatctgttcattgatattttgtagtagcggagttttgatttacagaaacaaagatggtgaagtttacagctgaagagcttcgtcggatcatggacctgaagcataatatcaggaacatgtccgtcattgctcatgtggatcatggaaaatcaacacttactgattctcttgtggctgctgctggtatcattgcccaagagactgctggtgatgttcggatgacagatacccgtgcagatgaggcagaacgtggtattacaattaaatctactggtatctctctctattacgagatgagtgatgagtctttgaaggcctacaagggtgaaagaatgggtaacgagtacctcatcaaccttattgattcacctggtcacgttgacttctcttctgaagtcacagctgcattacgtatcactgatggtgcacttgttgtggtggactgtattgagggtgtttgcgtccaaaccgagactgtccttcgacaagctcttggagaaaggatcaggcctgttttgactgtcaacaagatggacagatgtttcctagagctacaggttgatggagaagaggcttatcagactttctccagagttattgagaatgccaatgttattatggccacttatgaagacccactcctcggtgatgtccaggtttaccctgaaaaaggaacagtcgccttctctgctggtttgcatggttgggctttcactctaaccaatttcgcaaacatgtatgcttctaagttcggtgttgaacacagtaagatgatggagaggctttggggtgagaacttctttgacccagcaactaagaagtggactaataagagaacctcgtctcccacatgtaagcgtgggtttgtccagttctgttatgaacccatcaagcagattattgccacttgcatgaatgaccaaaaggacaagttgtggcctatgttgcaaaagcttggtgttgtaatgaagaatgacgagaaggagttgattgggaagcccttgatgaagcgtgtgatgcagacttggctccctgcagctactgccctacttgaaatgatgatttatcatctcccctctccccacacagctcagaagtaccgtgtcgagaacttgtacgagggtcctcttgatgaccagtatgctaatgccatcagaaactgtgatcccgaaggtccacttatgctctacgtgtctaaaatgattcctgcctctgacaagggtagattctttgcctttggtcgtgtctttgctggtaaggttgcaacaggtgctaaagtcagaatcatggggcctaactacgttcctggtgggaagaaggacttgtacaccaagagtgtccagagaactgttatctggatgggaaagaaacaggagtcagttgaggatgtaccttgtggtaacacagttgccctggttggattagatcaatttatcaccaagaatgcaaccctcacaaacgagaaggaagttgatgctcatcctatcagagccatgaagttttctgtctctcccgttgttcgtgttgctgtacagtgtaaggttgcctctgaccttcccaagctggttgaaggtcttaagcgtctgtccaaatccgatcccatggttgtgtgtaccattgaggagtcgggcgagcacattattgcaggtgctggagaactccatcttgagatctgtttgaaggatttgcaggatgatttcatgggtggtgcagaaatcgtgaagtctgaccctgtggtgtcattccgtgaaactgtgctagagaagtcttcaagaactgtgatgagcaagtctccaaacaagcacaaccgtctgtacatggaggcacgccctcttgaggatggactcgctgaagccattgatgatggtcgtattggtccaagagatgatcccaaaattcgttcaaagatcttatctgaagagtttggatgggacaaggatcttgcaaagaagatctggtgttttggtccagatactactggtccaaacatggttgtggatatgtgtaagggagttcagtaccttaatgaaatcaaggattcagttgtcgctgggttccagtgggcgtcaaaggaaggtgtgctggcagaagagaacatgagaggtatatgcttcgaagtgtgtgatgtagttctccattctgatgccattcacagaggtggtggacaggttattcctactgctaggagggttatgtacgcatcacagctcacagctaaacctagacttctagaacctgtgtacctagtcgagatccaggctcctgaaggtgctcttggtggtatttacggtgttctcaatcagaagcgtggtcacgtctttgaggaaatgcagaggccaggaactcctctctacaacatcaaagcatatctacccgtcgtggagtctttcggtttctctgcccagcttagggcagccacatcagggcaggctttccctcagtctgtgtttgatcattgggatatgatgatggctgatcctttggaggctggtactcaagctgcagagcttgtgacggacatcagaaagaggaagggtttgaaggcccagatgacccctctctccgattttgaggacaagctttaagtcttaaggttcttttttgaatgatgaattgagatggtgagttgttctaagtgttaggcattaggtttaattatgttggcaaatggatattagttactcttgggtttgtaagtgttttggtaacagaatgatccaaactttaatcatttaatctataattgttggggcaataaaattcctttaacttgagtgtctaatgcagaaggaaagtgtcttcctgcagtattggcatggttacaaaaggcaacacggatcttgctgccaagtgactgtactattctggtaatggatgtcttgcc

SEQ ID NO: 2193 - DNA, 2917 bp, Papaver somniferum
cggcacttcctctcagggatttgcctgttcagtgatatttggtattgacaaagttatcttttacagaagcaaagatggtgaagtttacagctgaagagctgcgtcggatcatggacctgaagcataatatcaggaacatgtccgtcattgctcatgttgaccatggaaaatcaacacttactgattctcttgtggctgctgctggtattattgcccaagaaactgctggtgatgttcgtatgacagatacccgtgctgatgaggcagaacgtggtattacaattaaatctactggtatctctctctattatgagatgtctgatgcgtctttgaaggcctacaagggtgacagaatgggtaacgagtacctcatcaaccttattgattcacctggccacgtcgacttttcttctgaagtcacagctgcattacgtattactgatggtgcacttgttgtggtggattgtattgagggtgtttgtgtccaaaccgagactgtccttcgacaagctcttggagaaaggatcaggcctgtgttgactgtcaacaagatggacagatgtttcctagagctacaggttgatggagaagaggcttatcagactttctccagagttattgagaatgccaatgttattatggccacttatgaagacccactcctcggtgatgtccaggtttaccctgaaaagggaacagtcgccttctctgctggtttgcacggttgggctttcactctaaccaatttcgctaacatgtatgcttctaagttcggtgttgagcacagtaagatgatggagaggctttggggtgagaacttctttgacccagcaactaagaagtggactaataagagaacctcatctcctacatgtaagcgtgggtttgtccagttctgttatgaacccatcaagcagatcattgccacttgcatgaatgatcaaaaggacaagttgtggcctatgttgcaaaagcttggtgttgtaatgaagaatgacgagaaggaattgattggaaagcccttgatgaagcgtgtgatgcagacgtggctccctgcagctactgccctacttgaaatgatgatttatcatctcccctctccccacacagctcagaagtaccgtgttgagaacttgtacgaaggtcctcttgatgacaagtatgctaatgccatcagaaactgtgatcccgaaggtcctcttatgctctacgtgtctaagatgattcctgcctccgacaagggtagattctttgcctttggtcgtgtctttgctggtaaggttgcaactggtgctaaagtcagaatcatgggtcctaactatgttcctggtgggaagaaggacttgtacaccaagagtgtccagagaactgttatctggatgggaaagaaacaggagtctgttgaggatgttccttgtggtaacacagttgccctggttggattggatcaatttatcaccaagaatgcaaccctcacaaacgagaaggaagttgatgcccatcctatcagagccatgaagttttctgtctctcccgttgttcgtgttgctgtccagtgtaaggttgcgtctgacttgcccaagctggttgaagggctcaagcgtctgtccaaatctgatcctatggttgtgtgtaccattgaggagtcgggcgagcacattattgcaggtgctggagaactccatcttgagatctgtttgaaggatttgcaggatgatttcatgggtggtgctgaaattgtgaagtctgaccctgtggtgtctttccgtgagaccgtgcttgagaagtcttcaagaactgtgatgagcaaatctccaaacaagcataaccgtttgtacatggaggcacgccctcttgaggatggacttgctgaagccattgatgatggtcgtattggtccaagagatgatcctaaagttcgttcaaagatcttatctgaagagtttggatgggataaggatcttgcaaagaagatctggtgttttggtcccgatactactggtcctaacatggttgtggatatgtgtaagggagttcagtaccttaatgaaatcaaggattcagtcgttgcagggttccagtgggcgtcaaaggaaggtgtgctagcagaagagaacatgagaggtatatgcttcgaagtatgtgacgtggttctccattctgatgccattcacagaggtggtggacaggttattcctactgctaggagagttatgtatgcctcacagctcacagctaaacctagacttctagaacccgtgtacatggtcgagatccaggctcccgaaggtgctcttggtggtatctacggtgttctcaatcaaaagcgtggtcacgtctttgaggaaatgcagagaccaggaactcctctctacaacatcaaagcatatctaccagtcgttgagtcatttggtttctctgcccagcttagggctgccacatcaggacaggctttcccccagtcggtgttcgatcattgggatatgatgatggctgatcctttggaaccaggcactcaagctgctgatcttgtggctgacatcaggaagaggaagggtttgaaggctcagatgacccctctatcagatttcgaggacaagctttaatgaggttacttgtaaaagatcctggaagttaagagctagatgacattgttgatccgaaggagagttttggttgggagagtgttgatccgaaaagttcctcttttgttttccattttggtttctcttctgctgggtgtgtaacactattaatatttacaaaacattcacaatgtgttgtcgtgattttgatccatgaaacaacatttttcccagtagcaagtctttgtagtttataatagggatccatgaacatcaatgagatggtttttgtttgcagtttattattttggatgctgatagtaatgtttatt

SEQ ID NO: 2194 - DNA, 2923 bp, Papaver somniferum
ggcacttcctctcagggatttgcctgttcagtgatatttggtattgacaaagttatcttttacagaagcaaagatggtgaagtttacagctgaagagctgcgtcggatcatggacctgaagcataatatcaggaacatgtccgtcattgctcatgtcgaccatggaaaatcaacacttactgattctcttgtggctgctgctggtattattgcccaagaaactgctggggatgttcgtatgacagatacccgtgctgatgaggcagaacgtggtattacaattaaatctactggtatctctctctattatgagatgtctgatgcgtctttgaaggcctacaagggtgacagaatgggtaacgagtacctcatcaaccttattgattcacctggccacgtcgacttttcttctgaagtcacagctgcgttacgtattactgatggtgcacttgttgtggtggattgtattgagggtgtttgtgtccaaaccgagactgtccttcgacaagctcttggagaaaggatcaggcctgtgttgactgtcaacaagatggacagatgtttcctagagctacaggttgatggagaagaggcttatcagactttctccagagttattgagaatgccaatgttattatggccacttatgaagacccactccttggtgatgtccaggtttaccctgaaaagggaacagtcgccttctctgctggtttgcacggttgggctttcactctaaccaatttcgctaacatgtatgcttctaagttcggtgttgagcacagtaagatgatggagaggctttggggtgagaacttctttgacccagcaactaagaagtggactagtaagagaaccgcatctcctacatgtaagcgtgggtttgtccagttctgttatgaacccatcaagcagatcattgccacttgcatgaatgatcagaaggacaagttgtggcctatgttgcaaaagcttggtgttgtaatgaagaatgacgagaaggaattaattggaaagcccttgatgaagcgtgtgatgcagacgtggctccctgcagctactgccctacttgaaatgatgatttatcatctcccctctccccacacagctcagaagtaccgtgttgagaacttgtacgaaggtcctcttgatgacaagtatgctaatgccatcagaaactgtgatcccgaaggtcctcttatgctctacgtgtctaagatgattcctgcctccgacaagggtagattctttgcctttggtcgtgtctttgctggtaaggttgcaactggtgctaaagtcagaatcatggggcctaactatgttcctggtgggaagaaggacttgtacaccaagagtgtccagagaactgttatctggatgggaaagaaacaggagtctgttgaggatgttccttgtgggaacacagttgccctggttggattggatcaatttatcaccaagaatgcaaccctcacaaacgagaaggaagttgatgcccatcctatcagagccatgaagttttctgtctctcccgttgttcgtgttgctgtccagtgtaaggttgcgtctgacttgcccaagctggttgaagggctcaagcgtctgtccaaatctgatcctatggttgtgtgtaccattgaggagtcgggcgagcacattattgcaggtgctggagaactccatcttgagatctgtttgaaggatttgcaggatgatttcatgggtggtgctgaaattgtgaagtctgaccctgtggtgtctttccgtgagaccgtgcttgagaagtcttcaagaactgtgatgagcaaatctccaaacaagcataaccgtttgtacatggaggcacgccctcttgaggatggacttgctgaagccattgatgatggtcgtattggtccaagagatgatcctaaagttcgttcaaagatcttatctgaagagtttggatgggataaggatcttgcaaagaagatctggtgttttggtcccgatactactggtcctaacatggttgtggatatgtgtaagggagttcagtaccttaatgaaatcaaggattcagtagttgcagggttccagtgggcgtcaaaggaaggtgtgctagcagaagagaacatgagaggtatatgcttcgaagtatgtgacgtggttctccattctgatgccattcacagaggtggtggacaggttattcctactgctaggagagttatgtatgcctcacagatcacagctaaacctagacttctagaacctgtgtacatggtcgagatccaggctcccgaaggtgctcttggtggtatctacggtgttctcaatcaaaagcgtggtcacgtctttgaggaaatgcagagaccaggaactcctctctacaacatcaaagcatatctaccagtcgttgagtcatttggtttctctgcccagcttagggctgccacatcaggacaggctttcccccagtccgtgttcgatcattgggatatgatgatggctgatcctttggaaccaggcactcaagctgctgaacttgtggctgacatcaggaagaggaagggtttgaagattcagatgacccctctatcagatttcgaggacaagctttaagtctgaggttgcttgtaaaagattctggaagttaagagctaggtgacattgttgatccgaaggagagttttgatgggagtgtgttaatccgaaacattcctcttttgtttttcattttggtttttcttctgctgggtgtgtaacactatgaatatttacgaacttgaacatgtattcttgtgattttgatccttgaagcaacattttgcccagtaactagtctttgtagtttataataggatccatgaacatcaatgagatggtttttgtttgcagcttattcctttggattctgatagtaatgtttatagtgctttt

SEQ ID NO: 2195 - DNA, 2418 bp, Secale cereale
atctcccactctcacctctcggctcgggaggcggagaagcgaaaccccaaggaactatttttctagtgtgacactcaaacacagtcaagatggtgaagtttacagcggaggagctccgcggaatcatggacaagaagaacaatatcaggaacatgtcggttattgctcatgtagaccacggcaagtctacgcttacggattcccttgtggcagctgctgggattattgcccaggaagttgctggtgatgttcgcatgaccgatacccgtgcagatgaggcagagcgtggtattacaatcaaatccactggtatctctcttttctatcagatgactcctgaatcacttgagatgtacaagggcgatcgtgatggggacgaatacctgatcaaccttattgattcacctggccacgtcgacttttcttcggaagtcacagctgctcttcgtatcactgatggagctttggttgttgttgactgtattgagggtgtctgtgtgcagaccgaaactgtgctgcgccaagctcttggtgagaggattaggccagtccttactgtgaacaagatggacagatgcttccttgagcttcaggtggaaggtgaggaagcatatcagactttctcccgtgttatcgaaaatgccaatgtcatcatggcaacatatgaagatgtgctccttggtgatgtccaagtgtacccagaaaaggggactgttgcattctctgctggtctgcatgggtgggctttcacccttacaaacttcgctaagatgtatgcctccaagtttggagttgatgagtcaaagatgatggagaggctgtggggtgagaacttctttgacccagctacaaagaaatggacctccaagaacactgggacagctacctgcaagagaggttttgttcagttctgctatgagccaatcaagcaaatcatagccacctgcatgaatgatcagaaggataagttgtggcctatgttgaagaagcttggtgtgaccatgaagaatgacgagaaggacttgatgggcaaggctctcatgaagcgtgtgatgcaaacttggctgcctgccagtcgtgctctgcttgagatgatgatatttcacctcccctccccttcaaaggcacagaggtaccgtgtggagaacttatatgagggcccccttgatgatatatatgcaaatgctattagaaactgtgacccagatggtcctcttatgctgtatgtctccaagatgattccagcatctgacaagggtagattctttgcctttggacgtgtttttgctgggagggttgcaactggcatgaaggtccgcatcatgggtcccaactttgttcctggccagaagaaggatctgtatgtgaagagtgtccagcggactgtcatctggatgggaaagaagcaagagtctgttgaggatgttccctgtggtaacactgttgctttggttggtttggatcagttcatcacgaagaatgcaaccctaacaaatgagaaggaagttgatgcctgcccaatcagggcaatgaagttctctgtgtcccctgttgtgcgtgttgcagttcagtgcaaggtggcctctgatcttcccaagcttgttgagggtttgaagcgtctggcaaagtctgatcctatggttctctgtaccattgaagagtctggtgagcatatcattgctggagctggagagcttcaccttgaaatctgtttgaaggatctgcaggatgacttcatgggtggtgctgaaatcattgtttccccccctgtcgtctccttccgtgagactgttctggagaagtcctgccgtacagtcatgagcaagtccccgaacaagcacaaccgtctttacatggaagctcgccccttggaggagggcctggccgaggccattgatgatgggcgcattggcccacgtgatgatcctaaggtgcgctccaagatcctgtctgaggagtttgggtgggacaaggatcttgccaagaagatttggtgctttggacctgagacgactggccccaacatggttgttgacatgtgtaagggagtgcagtatcttaatgaaatcaaggactctgttgtggctgggttccagtgggcttccaaggaaggcgcgttggctgaggagaacatgcgtggcatttgcttcgaggtctgtgatgttgttctccacactgatgccatccacaggggtggtggtcaggtcattccaacggccaggagggtcatctatgcttcccagcttactgctaagccaaggctgctggagcctgtgtacctggttgagatccaggccccggagaatgcacttggtggcatctatggtgttctgaatcagaagagagggcacgtgttcgaggagatgcagaggcaaggtaccccgctctacaacatcaaggcctacctcccgttattga

SEQ ID NO: 2196 - DNA, 2834 bp, Valeriana officinalis
ttggcaagcataaggccgctgagagctctctaatttccttccgccgccgccgcctaggttttatcgtaggcttttcagaaggaacattttacttgaattgtgtttgcttaacaaacatccaaaatggttaagtttacagcagaagagctccgaaggattatggatttcaagcataacattcgtaatatgtctgttattgctcatgtggaccatggaaagtccactcttaccgactcgctggtggctgcagctggtatcatagcccaagaggttgccggtgatgtccgtatgactgatacacgtgctgatgaagctgaacgtggtatcaccatcaagtctaccggtatttctctgtactatgagatgaatgatgaatccatgagaaggtacaaaggagagaaaaatggcaatgattacctcatcaatcttatcgattcccctggtcacgttgacttttcatctgaagtcactgctgctctacgtatcactgacggtgccctagttgtggtcgactgtgttgaaggtgtctgtgtccaaacagaaaccgttcttcgtcaagctctaggagaaaggattcgtcctgttcttaccgtcaacaagatggacaggtgttttcttgagctccaagttgatggtgaggaagcgtatcaaactttctctagagttattgagaatgctaatgtcatcatggctacatatgaagacccacttttgggtgatgtccaagtataccctgagaagggaactgttgctttctccgcgggtctccatggttgggcttttaccctaaccaattttgccgagatgtatgcttctaaattcggtgttgatgaaactaagatgatggagaggctttggggtgagaatttctttgacccagcgaccaagaagtggaccaccaagaactctggctcacccacttgcaagcgtggttttgttcagttttgttatgagcccatcaagatggtcatcaacacttgcatgaacgaccagaaagataaattgtggcctatgttgaccaagcttaaagtaaccatgaagaacgaagagaaggatcttatgggcaaagctctgatgaagcgtgtcatgcaggcatggcttccagcaagtaaagctttacttgaaatgatgatataccacttgccgtctccttcgacggctcagcgttaccgtgttgagaatttatacgagggcccacttgatgatcagtacgctaatgcaattagaaactgtgaccctgaaggtcctcttatgctttacgtgtccaagatgattccagcttctgacaagggtcgtttctttgcttttggccgtgtgttctctggcaaaatctcaactggtatgaaagtcagaatcatgggacccaatttcgtacctggtgagaagaaagatctgtatacaaagagtgtgcagaggacggttatctggatgggaaagaggcaagaaactgtggaagatgtgccatgtggtaacacagtggccttggtcggtttggatcagtacatcacaaagaatgctactttgacaaatgagaaagaagttgatgctcatcctattcgtgctatgaagttctcagtctctccagttgtgcgtgttgctgttcagtgcaaggttgcgtcagacctgccgaagcttgttgaaggtcttaagcgtttggccaagtctgatcctatggttgtctgctctattgaagaatctggtgagcacatcattgctggagctggtgagcttcatttggaaatctgtctgaaagatcttgtagatgatttcatgggaggtgctgagatcatcaagtctgacccagtcgtgtctttccgtgaaactgttcttgagaaatctgttcgcactgttatgagtaagtcaccaaacaaacataaccggttgtacatggaagccagaccactagaagatggattagctgaggccattgatgatggccgtattggcccaagagatgacccgaaggtcaggtcaaagattctctcagaagaattcggctgggacaaggatctagccaagaagatctggtgtttcggacctgaaacaactggacccaacatggttgttgatatgtgcaagggtgtgcagtacttgaacgagataaaagattctgtggtggctggattccagtgggcttcaaaagaaggagcattggctgaagaaaacatgagaggtatctgctttgaagtgtgcgatgtggttctccatgctgatgcaatccacagaggtggtggtcaggtgatcccaactgcacgtagagttatttacgcatcacagatcacagccaagccaaggctgcttgagccagtctacttggttgagatccaggctcctgagcaggctcttggtggaatctacagcgtgttgaatcagaagcgtgggcatgtgtttgaggagatgcagaggcaaggaacaccgctctacaacatcaaagcttacttgccagtcgtggagtcgttcgggttctcgagcacattgagggcggctacttccgggcaagctttcccgcagtgcgtgtttgatcattgggatatgatgacttctgatccgatggaccccacttctcaagcggctgtgctggttatggatatccgtaagaggaagggtttgaagcaggccatgactcccttgtctgagtttgaggataagctataagcggaagcaggtatgaggatgatatgttggtggtttttcacaattatgaactataagttttgtctgtttttcatcgtttactactcgttgaactatattttttgttatgcttttgtttaaattttgatgtttcaagtatgttgctactttagttttgagatcttaaccagacttctgtt

SEQ ID NO: 2197 - DNA, 3089 bp, Abies balsamea
cgaatatgtccaccattcacggcatcttcttgtgctccgtcacggaatattcctaccctgtcacgtttcagggtaaaccctaacggagtcccagtgttcaaccgaaaccctattcaaccaagaaaagtcatccttttgtttctcttaagccgccctcacactccttgtctcagctgcaagagctcgtgatttcaaggttttagagaggcctgcagctcgagtccattccgtgtcgttctgcgatcgcaggtttcaggtactcattggtattctttcgatttttctgagaagagttttggtgaatataagagttagacaaaatggtgaagttcacagctgaagagcttcgtaagattatggacaggaaacataacatacgaaacatgtccgttattgcccatgttgaccatggaaaatccaccctcaccgactctttggtagcagcagctggtatcattgctcaagaagttgctggagatgtcaggatgactgatactcgtgcagatgaagctgaacgtggcattaccatcaagtcaactggaatctcactgtattatgagatggaggatgcagctgtaaaaaatttcaagggggatagagtgggaaatgaatatttgataaatcttattgattctccagggcacgttgacttctcttcagaggttacagcagccctgcgaatcacagatggtgcactggttgtggtagattgcattgaaggggtttgtgtccagactgaaaccgttcttcgtcaagctcttggagaaaggataaagccagttctcactgtgaataagatggacaggtgctttcttgagttacaggttgatggagaagaagcttaccagactttttcacgtgtcattgaaaatgcgaatgtgattatggctacttatgaagatcctcttcttggtgattgccaagtttatcctgaaaagggtacagttgcattctcggcaggtctgcatgggtgggcattcactttgacaaattttgcaaaaatgtatgcttcaaagtttggagtggatgaagtaaagatgatggagaggctgtggggtgaaaacttctttgatccagctaccaagaaatggacaaccaagaatacaggttcagcaacctgcaaaagaggatttgttcaattcatatatgaacctattaagcaaatcatcaatatttgtatgaatgatcaaaaggataagttgtggcccatgttgcaaaaattgggcgttgtgatgaagagtgaagagaaggagctaactgcaaaggcactcatgaagcgtgtcatgcaaacatggctacctgcaagtagtgctttacttgaaatgatgattttccatcttccttctccatcgaaggcacagagatatcgtgtggaaaacttgtatgaagggcctcttgatgatgtatatgcaactgcaattagaaattgtgaccctgagggaccactgatgttgtatgtttcaaaaatgattccagctgcagacaaaggacgtttctttgcctttggccgtgtttttgctgggagagtggcaacaggtatgaaggtaaggatcatgggtcccaactatgtgccaggccagaaaaaagatttatatgtaaagagtgttcaaaggactgtgatatggatgggaaagagacaagaatctgtcgaggatgtgccttgtggaaacacagtggctatggttgggttagaccagttcataaccaaaaatgctacgctgacaaatgagaaggaggttgatgctcatccaattagagcaatgaagttctctgtctcccctgttgtacgtgttgctgtgcagtgcaaggtggcttctgaccttccaaaacttgttgaagggctgaagcgtctttctaagtcagatcctatggttgtttgcacaattgaggaatctggagaacatattattgcaggtgcaggagagctccaccttgagatttgtttaaaagatctccaagaagattttatgggtggagctgagattgttgtttctgatcctgtcgtctcatttagagaaactgttttggagaaatcatgccgcactgttatgagcaagtctccaaacaaacacaacaggctttactttgaggcgagacctttggaagatggtcttgcagaagcaattgatgatggtcgcgttggcccgaaggatgatccaaaggctcgtgcaaaaatcctttctgaagagtttggatgggacaaagatttggctaagaagatctggtgttttgggcctgaaaccactggtcccaatatggtggtggacatgtgtaagggagttcagtacttgaatgaaattaaagattctgtggttgctgcattccaatgggcatccaaggaaggtgctcttgcagaagaaaacatgcgtggtatttgctttgaggtttgtgatgtggttttgcacactgatgctattcatagaggaggtggccagattataccaacagccagaagggttatgtatgcatctcaacttactgccaaaccaaggctgctcgagccagtatatcttgttgagattcaggctcctgagaatgccctcggtggtatttatggtgtgctgaaccagaagagaggccatgtatttgaggaaatgcagaggccaggaactcctctatataacatcaaggcatacctgccagtcgttgaatcatttggattttcaagtgccctccgagctgcaacttctggccaggctttccctcaatctatttttgaccactgggatatgatgggatcggatccattggaatctggttcccaagctgggcagcttgtgattgatatccgcaagaggaagggtctcaaggagaatatgactcccttgtcagagtttgaagacaagctgtaaagcttttgctatgtttgcatgtctgatggtgtcaagattgaggaccctccttgagtattaaaacacagttttgtgtgttaggattagttaaatttatactattaaggtatttttgtgatctcttgtctactttagaggtaaaagttctcttaagaaccatttattaataaatttgtcttttgaaaatgttgaatggcaagctgtatctccagtttgaatgttggtcaatttaaagct

SEQ ID NO: 2198 - DNA, 2786 bp, Brassica napus
agttatcgtaggtgacaaataagagttagtcaaaatggtgaagtttacggccgatgagcttcgtaggattatggattacaaacacaacatccgtaacatgtccgttattgcccatgtcgaccatggtaaatccaccctcactgactccttggttgctgctgcgggtatcattgcccaagaagttgctggagatgtccgtatgactgatactcgtgctgatgaggctgaacgtggtatcactatcaagtccacgggtatctctctctactacgagatgactgatgcttccttgaagagcttcactggtgccagagatggaaacgagtaccttatcaatctcatcgactctcctggccacgttgacttctcctctgaggtcactgctgcactccgtatcactgatggtgcccttgtggtggtcgactgtatcgagggtgtgtgtgttcagaccgagactgtgctacgtcaggctcttggtgagaggattaggcccgtgctgactgtcaacaagatggacaggtgtttccttgagcttcaggttgatggtgaggaggcttaccagactttccagagggtcattgagaatgccaatgtcatcatggcaacgtacgaggatcctctccttggtgatgttcaggtttaccctgagaagggaactgtcgccttctctgctggtctccacggatgggctttcaccctgaccaactttgccaagatgtatgcttccaagttcggtgttgacgagactaagatgatggagaggctgtggggtgagaacttctttgaccctgccaccaggaaatggagcagcaagaacactgggtccgctacctgcaagcgtgggtttgtgcagttctgttatgaacccatcaagcagatcatcgccacttgcatgaacgaccagaaggataagttgtggcctatgttgcagaagcttggtgtccagatgaagtctgatgagaaggagcttatgggtaaacctttgatgaagcgtgtcatgcagacttggctccctgccagtactgcgttgcttgagatgatgatctttcaccttccatctccccacactgcccagaggtaccgtgttgagaacctgtatgaaggtcctctcgatgatcagtatgccactgccatcagaaactgtgatcctaatggtccgctcatgctctatgtttctaagatgattcctgcttcagacaagggtagattctttgcttttgggcgtgtcttctctggaaaggtgtctaccggtatgaaggtcaggattatgggtcccaactttgttcctggtgagaagaaagatctttatgtcaagagtgttcagaggactgtcatctggatggggaagaggcaagagactgttgaggatgttccctgtggtaacaccgttgctatggttggtcttgatcagttcatcactaagaatgctacgctgacgaatgagaaagaagttgatgctcatcctatccgtgcgatgaagttctctgtgtcccctgttgtacgtgttgctgttcagtgcaaggtcgcttctgatcttcccaagcttgttgagggacttaagaggctggccaagtctgaccctatggttgtgtgcacgatggaggagtcaggtgagcacattgttgctggtgctggagaactccatcttgagatttgcttgaaggatcttcaggatgatttcatggggggtgctgagattgtcaagtcagaccctgtcgtctcattccgtgagactgttttggagagatctgtgcgtactgtgatgagcaagtccccgaacaagcacaaccgtctgtacatggaggctaggcccttggaggatggtcttgcggaggcgattgatgaaggccgtattggtccaagagatgatcccaagatacgttccaagatcttggctgaggagtttggctgggacaaggatctcgcaaagaagatatgggcgtttggacctgaaaccacagggcccaacatggttgttgacatgtgtaagggagttcaatacctgaatgagatcaaggattctgttgttgctgggttccagtgggcttccaaggaaggtcctctttgtgatgagaacatgagaggaatctgttttgaggtttgcgatgtggtgctccactctgatgctatccacagaggtggtggtcaggttatcccgacagcgaggagggttatctacgcctctcagctcactgccaagcccaggcttttggaaccggtttacatggttgagatccaagcaccagagggagctcttggaggaatctacagcgtgctgaatcagaagcgtggacacgtctttgaggagatgcagaggccaggaacaccgctgtacaacatcaaggcgtacctgccagttgttgagtcatttggattctcaagtcagcttagagcagcaacctcaggacaggccttccctcagtgtgtgtttgatcattgggagatgatgtcgtctgacccattggaggcaggatcgcaggcttcaacgcttgtgactgacatcaggaagaggaagggtatgaaggaacagatgactcccttgtctgacttcgaagacaagctataagcagcagccaacaagactcactatggtcacctttttctctccatctctaccgtattttgtttactgttagctctgttttggtgttatgatatcactttatctgtggccacaatcctcttgaatgttttacttttttagttgaaaactggtttatctctgtgtttactcttttttgcactcttgttatcctgttttcattggaacgttgttatatctaccg

SEQ ID NO: 2199 - DNA, 2977 bp, Cedrus atlantica
agaggtctgcagttctagtcccttccgtgccgttttgcgttcgcgggcactcattggtattctttcgatttgactgagaagagttttggtgaatataagagttagacaaaatggtgaagttcacagctgaagagctccgtaagattatggacaggaaacataatatacgaaacatgtctgttattgcccatgttgaccatgggaaatcaactctcaccgattctttggtagcagcagctggtatcattgctcaagaagttgctggagatgttaggatgactgatactcgtgcagatgaagctgaacgtggtatcaccatcaagtctactggaatctcattgtattatgtgatggaggatgatgctgtaaaaaatttcaagggggatagagagggacatgaatatttgataaatctgattgattctccagggcacgttgacttctcttcagaggttactgcagccctgcgaatcacagatggtgcactggttgtggtagattgcattgagggggtttgtgttcagactgaaactgttcttcgtcaagctcttggagaaaggattaggccagttctcactgtgaacaagatggacaggtgctttcttgagttacaggttgatggagaggaagcttaccagactttttcccgtgtcattgaaaatgcaaatgtgattacggctacttatgaagatcctcttcttggtgattgccaagtttatcctgaaaaaggtacagttgcgttctcggcaggtctgcatgggtgggctttcactttgacaaattttgcaaaaatgtatgcttcaaagtttggagtggatgaagcaaagatgatggagaggctgtggggtgaaaacttttttgatccagctactaagaaatggactaccaagaacacaggttcagcaacctgcaaaagaggatttgttcagtttgtatatgaacctattaagcaaatcattaatatttgcatgaatgatcagaaggataagttgtggccgatgttgcagaaattgggagttgtgatgaagagcgaagagaaggagctagttgcaaaggcactcatgaagcgtgtcatgcaaacctggctacctgcaagtagtgctttacttgaaatgatgattttccatcttccttctccagcgaaggcacagagatatcgtgtggaaaacttgtatgaaggacctcttgatgatatatatgcaactgcaattagaaattgtgatcccgaggggccactgatgttgtatgtctcaaaaatgattccagcctcggacaaaggacgtttctttgcctttggtcgtgtttttgctgggagagtggcaacaggtatgaaggtaagaatcatgggtcccaactatgtgccaggtcagaaaaaagatttatatgtaaagagtgttcagaggactgtgatatggatgggaaagaggcaagaatctgttgaggacgtgccttgtggaaatacagtggctatggttgggttagaccagttcataaccaaaaatgctacgctgacaaatgagaaggagtctgatgctcatccgattagagcaatgaagttctctgtctcccctgttgtacgtgttgctgtgcagtgcaaagtggcttctgaccttccaaaacttgttgaagggctgaagcgtcttgctaagtcagatcctatggttgtttgtacaattgaggaatctggtgaacatattattgcaggtgcaggagagcttcaccttgagatctgcttaaaagatctccaagatgattttatgggtggagctgagattgttgtttctgatcctgttgtctcatttagagaaactgttttggagaaatcatgccgcactgttatgagcaagtctccaaacaagcacaataggctttactttgaagcgagacctttggaagatggtctcgcagaggcaattgatgaaggtcgcattggtccgaaggatgatccaaaggctcgtgcaaaaatccttgcagaggagtttggatgggacaaagatttggctaagaagatctggtgttttgggcccgaaaccactggtcccaatctggtggtggatatgtgtaagggagttcagtacttgaatgaaattaaagattctgtggttgctgcattccaatgggcatccaaagaaggtgctcttgcagaagaaaacatgcgtggtatatgctttgaggtttgtgacgtggttttgcacactgatgctatccatagaggtggtggtcagattatcccaacagccagaagggttatgtatgcatctcagcttactgccaaaccaaggctgcttgagccagtatatcttgttgagattcaggctcctgagcaggcccttggtggtatttatggtgtgttgaaccagaagagaggccatgtatttgaggaattgcagaggccaggaactccactttataacatcaaggcatatctgccagttgttgaatcatttggattctcaagtactctccgagcttcaacttctggccaggctttccctcaatgtgtgtttgaccactgggatatgatgtcatctgacccattggaagctggttcccaagctgggcagcttgtgactgatatccgcaagaggaaaggtctcaaggagagtatgactcccttgtcagagttcgaagacaagctgtaaagctttgccacgtttgcatgcctgatggtgtcaagattgagggccctccttaagtattaaaacacagttttgtgtgctaggattagttaatttttaattttatgctattaaggtatttttgtgagttatctactttagagataaaagttaactcttaagaaccatttattgatagatttgtcttttgaaattgttgaatggcaatctgtatctccactttgaatgttggataatttgaagcttgatttcttgttatcgtggttcaaattattaggtagggttcggttctgagtgcccatttagtctgaatagagttgttatttggcagattttgt

SEQ ID NO: 2200 - DNA, 3091 bp, Elaeis guineensis
gtctacctcggagctctctgtctcttctccgccgatcaccatccgatcaggaattttcttgcacaactgcagtttacctggtgacttttaagtgcattcaagatggtgaagtttacggcagaagagctccgcaaaattatggacttcaagcacaatatccgtaatatgtcagtcattgcacatgttgatcatggaaaatctactcttactgactctcttgtggcggctgctggtatcattgcacaagaagtggcaggtgatgtgcgtatgactgatacacgccaggatgaagctgaacgtggcatcaccatcaagtccactggaatttctctctattatgagatgtctgatgagtcactaaaaaactacaagggtgaaaggaatggaaatgagtacttgatcaacctcattgattcgcctgggcatgttgacttctcttcagaggtcactgctgctctccgtatcactgatggtgcattggttgtggtagactgtatcgagggtgtctgtgttcagactgaaactgtcctacgacaggctcttggagaaaggattagaccagttttgactgtcaacaagatggaccgctgcttccttgagctccaagttgatggagaggaagcctaccagacctttcaacgtgtgattgaaaatgccaatgtgatcatggctacatatgaagattctcttcttggtgattgccaagtttatccagagaaaggaactgtggctttttctgctggcttgcatggttgggctttcacgttgactaactttgccaagatgtatgcatccaagtttggagttgatgagggaaaaatgatggagagactctggggagagaattactttgattctgccacaaggaagtggacttccagaaacacaggttcacctacttgcaagaggggatttgttcagttctgctatgaacctatcaaacaaattataagtacatgcatgaatgatcagaaggacaagttgtggcccatgttgcagaagctaggtgttaccatgaaggctgaggagaaagatttgaatgggaaagcactgatgaaacgtgtgatgcagacctggctgcctgcaagtacagcccttcttgaaatgatgatcttccaccttccatctccagctaaggcacagaaataccgtgtggagaatttgtacgaaggccctcttgatgacatatatgcaaatgccatcagaaactgtgacccagatgggcctctgatgctttacgtctccaagatgattccagcatcagataaaggtaggttctttgcctttggccgagtcttctctgggagggtaaacactggtttgaaggttaggataatggggcctaactatgttcctggtgagaagaaggatctgtatgttaagagtgtgcagcgaactgttatttggatgggtaagaagcaagagtccgtggaggatgtgccatgtggaaacactgttgctatggttggtctggatcagttcattacaaagaatgctactctaaccaatgagaaggaagtggatgctcatccaatcagggcaatgaagttctcagtgtcacctgttgttcgtgttgctgtgcagtgtaaggttgcctctgaccttcctaagcttgttgagggcttgaaacgacttgccaaatctgatcccatggtggtgtgtacaattgaggaatctggtgagcacattattgctggagctggagaactccaccttgagatctgcttgaaggacctgcaagaagacttcatgggcggtgcagagattattaagtctgatcctgttgtgtctttccgtgaaacagttcttgagaggtcttgtcgtacagtgatgagcaagtctcctaacaagcacaaccgtttgtacatggaggcccgacctttggaggatggacttgctgaggctattgatgatgggcgtattggccccagggatgatcccaaaagccggtccaaaatcctatcagaagagtttggatgggataaagagcttgcaaagaagatctggtgctttgggccggaaaccaccggtcctaacatggttgttgacatgtgtaagggagttcagtatctgaatgaaatcaaagactctgtggttgctgggttccaatgggcttctaaagaagggccattagctgaagaaaatatgcgaggcatttgctttgaagtctgtgatgttgttctccatgctgatgccatccaccgaggtggcgggcagattattccaactgcaaggagggtcatatatgcagcccagatgactgccaaacctaggcttttggagcctgtttatcttgttgaaattcaggcaccagaacaggcacttggaggcatatatagtgttcttaatcaaaagagaggacatgtctttgaggagatgcagaggccaggtactccactttataatgtcaaggcttacctgcctgtcatcgagtcctttggattctcgggcactctgagggctgcaacttctggtcaggcgttcccacaggctgtctttgatcactgggatatgatgtcttctgacccattagagcctgggtcccagactgcaaacctggttgctgatattcgcaagaggaagggtctcaagcaacagattacaccactctccgagtacgaggacaggctataaggaatccaatatcagagacatgttttggctggtctgttttaatttttttttccttgaatggtttattcggcatccaatttttagtcactgagttgtgcatccaggcaagtatctggggtgcattttttccgcgagggtcacattttttaatcacattttttatcttttggtcggaaaacttatagttggtttgagagagttttgttatggtacttttcttctggcattttatgccagagttactatattgattttacatgactggaaatttggggatcaaaattcagaataataatacagtactatatatttggagattgtgcattcaacctttgtttatgcacttatttgatgaatcatctgcattttaaaatcgatttatctgaaacaagcgataggatttatctggatggcttagttgcttgttgtaggttctgcagttaggagtctccatttg

SEQ ID NO: 2201 - DNA, 2894 bp, Papaver somniferum
cggcgcagcttccccttctctaagggatttgtctgctgcaaaatctgttcattgatattttgtagtagcggagttttgatttacagaaacaaagatggtgaagtttacagctgaagagcttcgtcggatcatggacctgaagcataatatcaggaacatgtccgtcattgctcatgtggatcatggaaaatcaacacttactgattctcttgtggctgctgctggtatcattgcccaagagactgctggtgatgttcggatgacagatacccgtgcagatgaggcagaacgtggtattacaattaaatctaactggtatctctctctattacgagatgagtgatgagtctttgaaggcctacaagggtgaaagaatgggtaacgagtacctcatcaaccttattgattcacctggtcacgtcgacttctcttctgaagtcacagctgcattacgtattactgatggtgcacttgttgtggtggactgtattgagggtgtttgcgtccaaaccgagactgtccttcgacaagctcttggagaaaggatcaggcctgttttgactgtcaacaagatggacagatgtttcctagagctacaagttgatggagaagaggcttatcagactttctccagagttattgagaatgccaatgttattatggccacttatgaagacccactcctcggtgatgtccaggtttaccctgaaaaggaacagtcgccttctctgctggtttgcatggttgggctttcactctaaccaatttcgcaaacatgtatgcttctaagttcggtgttgaacacagtaagatgatggagaggctttggggtgagaacttctttgacccagtcaactaagaagtggactaataagagaaccgcgtctcctacatgtaagcgtgggtttgtccagttctgttatgaacccatcaagcagatcattgccacttgcatgaatgatcaaaaggacaagttgtggcctatgttgcaaaagcttggtgttgtaatgaagaatgacgagaaggaattgattggaaagcccttgatgaagcgtgtgatgcagacttggctccctgcagctactgccctacttgaaatgatgatttatcatctcccctctccccacacagctcagaggtatcgtgtcgagaacttgtacgagggtcctcttgatgaccagtatgctaatgccatcagaaactgtgatcccgaaggtccacttatgctctacgtgtctaagatgattcctgcctccgacaagggtagattctttgcctttggtcgtgtctttgctggtaaggttgcaacaggtgctaaagtcagaatcatggggcctaactacgttcctggtgggaagaaggacttatacaccaagagtgtccagagaactgttatctggatgggaaagaaacaggagtcagttgaggatgtaccttgtggtaacacagttgccctggttggattagatcaatttatcaccaagaatgcaactctcacaaacgagaaggaagttgatgctcatcctatcagagccatgaagttttctgtctctcccgttgttcgtgttgctgtccagtgtaaggttgcctctgacctgcccaagctggttgaagggcttaagcgtctgtccaaatctgatcctatggttgtgtgtaccattgaggagtcgggcgagcacattattgcaggtgctggagaactccatcttgagatctgtttgaaggatttgcaggatgatttcatgggtggtgctgaaattgtgaagtccgaccccgtggtgtctttccgtgagactgtgcttgaaaagtcttcaagaactgtgatgagcaaatctccaaacaagcacaaccgtttgtacatggaggcacgtcctcttgaggatggacttgctgaagccattgatgatggtcgtattggtccaagagatgatcctaaagttcgttcaaagatcttatctgaagagtttggatgggataaggatcttgcaaagaagatctggtgttttggtcccgatactactggtccaaacatggttgtggatatgtgtaagggagttcagtaccttaatgaaatcaaggattcagttgttgcaggttttcagtgggcgtcaaaggaaggtgtgttggcggaagagaacatgagaggtatatgcttcgaagtatgtgatgtggttctccattctgatgccattcacagaggtggtggacaggttattcctactgctaggagggttatgtatgcctcccagctcacagctaaacccagacttttagaacctgtgtacctagtcgaaatccaggctcccgaaggtgctcttggtggtatctacggtgttctcaatcagaagcgtggtcacgtctttgaggaaatgcagagaccaggaactcctctctacaacatcaaagcatatctaccagtcgttgagtcatttggtttctctgcccagcttagggctgccacatcaggacaggctttcccccagtctgtttttgatcattgggatatgatgatggctgatcctttggaacaaggcactcaaggcttcagatcttgtgactgagatcaggaggaggaagggtttgaaggctcagatgacccctctatctgatttcgaggacaagctttaagtatgaggttactcgtaaaagttcctggaagtcaagagctagatgacattgttgatccgaactagagttttggttgggagagtgttaatccgaaaagttcctcttttgtttttcattttggtttttcttctgctgtgtgtaacactattaatatttacgaaaactttcacaatgttgattttgatccatgaaacaacatttttcccagtagcaagtctttgtagtttataatagggatccatgaacatcaatgagatggtttttgt

SEQ ID NO: 2202 - DNA, 2773 bp, Helianthus annuus
atatctctcagtcgacaccgatcaagtgttactgagatcacgccgcctcattttgaccggacctgtgacagatagtttgtttgttgttgactctttaagggagtcaaaatggtgaagtttacggcggaggagcttcgtcggatcatggactacaagcataacatccgtaacatgtccgttattgctcatgttgatcacgggaagtcaacgttgaccgactctcttgtggctgctgctggtattatcgcacaagaagttgctggtgatgtacgaatgaccgatacacgtgctgatgaagcagaacgcggtatcacgatcaagtcaactgggatctcactttactatgaaatgactgatgaggctctcaagagctttaaaggagaacgtaacgggaatgagtacctcatcaatctcattgactcacccgggcacgttgacttctcatctgaagttactgctgcactccgtatcactgacggtgcattggtggtggttgattgtatcgaaggtgtctgtgtccagaccgaaaccgtccttcgtcaagctctcggtgaaaggattcgacccgtgttgaccgtcaacaaaatggaccgttgtttccttgagcttcaagttgacggagaagaagcataccagacgtttcaaagggttatcgaaaacgctaatgtcatcatggctacttatgaggacccgcttctcggtgatgtcatggtttaccctgagaaaggtaccgttgctttctctgctgggttacacggttgggcttttactttgaccaacttcgcgaaaatgtatgcttcgaagtttggtgttgatgaggcgaagatgatggaaaggctctggggtgagaactttttcgacccgaaaaccaaaaagtggacgacgaagaatactggttctgcttcatgccaacgtggtttcgttcagttctgttacgagcccatcaagatgattattaacacgtgcacgaacgaccagaaagataaactctggcctatgttgaccaaactcggtgttacaatgaagtccgaagagaaggagttaatgggaaaagctttgatgaaacgcgttatgcaaaactggcttccggctgctactgctttacttgaaatgatgatatttcatttaccgtctcctcatacggcccaaaaataccgtgttgagaatttgtatgaaggtccgttggatgatatgtacgccaatgctattaggaactgcgatccggatggcccgcttatgttatatgtgtcgaagatgattcccgcttctgataaaggaaggtttttcgcttttggtcgtgtgtttgctggaaaggtttcgaccggtttgaaggttagaatcatgggtccgaattatgttccaggtgagaagaaagatctgtacgttaaaagtgttcaaaggactgttatttggatgggaaagaaacaagaaactgttgaagatgttccttgtggaaacacagttgcgatggttggtttggatcagtttattaccaaaaacgctacgctaactaacgagaaggaagtcgacgcacacccgattcgagccatgaaattctccgtctcacctgtcgttcgtgttgcggttcagtgtaaggtcgcatccgacttaccaaagctcgtcgaaggtttgaaacggttagctaaatctgaccctatggttgtttgcaccatcgaagagtccggtgaacacatcatcgcaggtgccggtgagcttcatctcgaaatctgtttgaaagatctgcaagatgatttcatgggcggtgccgagatcgttgtttctgatcccgtcgtctccttccgtgagacagtgttagaaaaatcatcccgaactgttatgagcaagtccccgaacaaacacaaccgtttgtacatggaagctaggccgatggaagaagggctagcggaggctatagacgagggtcgggtcggtccacgtgacgacccgaaagttcgcggaaaaattttatccgaagagttcggttgggataaggatctcgctaagaaaatctggtgttttgggccggaaaccacgggtccgaacatggtggttgatatgtgtaagggagtgcagtacttgaacgaaattaaagattcggtcgttgcgggtttccaatgggcatcaaaggaaggtgcgttagccgaagagaacatgcggggcatctgttttgaagtgtgcgatgtcgtcctccacgctgacgccattcaccgtggcggcggtcaagtgatcccaaccgctaggcgtgtcatctatgcatcacagctgactgccaaaccccgactgctcgagccggtgtatttggttgagattcaggcgccggaacaagctcttggtggaatctacagcgtgctgaaccagaggcgtgggcacgtgttcgaagaaatgcagaggccgggcacaccgttgtacaacatcaaggcttatttacctgtggttgagtcttttgggttttcgggcgcgttgagggcgtctacttctggtcaagctttcccgcaatgtgtgtttgatcattgggacatgatgtcatccgacccgttggaagtcgggtcacaggcgagtacactcgtgacgcagattcgtaagaggaagggtttgaaggagcagatgacaccgctttcggagtttgaggacaagctgtaagtcacaagagaattcttgtttggttttgttttacaactttgctatgttttattttagttttgacattttgatcttattatattgttggtcattgtgctttaaaggctttggatattatgtttcgatttgagta

SEQ ID NO: 2203 - DNA, 2694 bp, Brassica napus
cttcccctccaatagatattgtaggtgaagaaataagagttagtcaaaatggtgaagtttacctccgacgagcttcggaggattatggattacaaacacaacatccgtaacatgtccgttattgcccatgtcgaccatggtaaatccacactcactgactccttggttgctgctgctggtatcattgctcaagaagttgctggtgatgtccgtatgactgatacccgtgctgatgaggctgaacgtggtatcactatcaagtccacgggtatctctctctactacgagatgaccgatgcttccttgaagagcttcactggtgccagagatggaaacgagtaccttatcaatctcatcgactctcctggccacgttgacttctcctctgaggtcactgctgcactccgtatcactgatggtgcccttgtggtggtcgactgtatcgagggtgtgtgtgttcagaccgagactgtgctacgtcaggctcttggtgagaggattaggcccgtgctgactgtcaacaagatggacaggtgtttccttgagcttcaggttgatggtgaggaggcttaccagactttccagagggttattgagaatgccaatgtcatcatggctacgtatgaggatcctctccttggtgatgttcaggtttaccctgagaagggaactgttgccttctctgctggtctccacggatgggctttcaccctgaccaactttgccaagatgtatgcttctaagtttggtgttgacgagactaagatgatggagaggctgtggggtgagaacttctttgaccctgccaccaggaaatggagcagcaagaacactgggtccgctacctgcaagcgtgggtttgtgcagttctgttatgaacccatcaagcagatcatcgccacttgcatgaacgaccagaaggataagttgtggcctatgttgcagaagcttggtgtccagatgaagtctgatgagaaggaccttatgggtaaacctttgatgaagcgtgttatgcagacttggctccctgcgagtactgcattgcttgagatgatgatctttcaccttccatctccccacactgcccagaggtaccgtgttgagaacctgtatgaaggtcctctcgatgatcagtatgccactgccatcagaaactgtgatcctaatggtccgctcatgctctatgtttctaagatgattcccgcttcagacaagggaagattctttgcttttgggcgtgtcttctctggaaaggtgtctaccggtatgaaggtcaggatcatgggtcccaactttgttcctggtgagaagaaagatctttatgtcaagagtgttcagaggactgtcatctggatgggcaagaggcaagagactgttgaggatgttccctgtggtaacaccgttgctatggttggtcttgatcagttcatcactaagaatgctacgctgacgaatgagaaagaagttgatgctcatcctatccgtgcgatgaagttctctgtgtcccctgttgtacgtgttgctgttcagtgcaaggtcgcttctgatcttcccaagcttgttgagggacttaagaggctggccaagtctgaccctatggttgtgtgcacaatggaggagtcaggcgagcacattgttgctggtgctggagaactgcatcttgagatttgcttgaaggaccttcaggatgatttcatgggtggtgctgagattgtcaagtcagaccctgtcgtctcattccgtgagactgttttggagcgatctgtgcgtactgtgatgagcaagtccccgaacaagcacaaccgtctgtacatggaggctaggcccttggaggatggtcttgcggaggcgattgatgaaggccgtattggtccaagagatgatcccaagatacgttccaagatcttggctgaggagtttggctgggacaaggatctcgcaaagaagatatgggcgtttggacctgaaaccacagggcccaacatggttgttgacatgtgtaagggagttcaatacctgaatgagatcaaggattctgttgttgctgggttccagtgggcttccaaggaaggtcctctttgtgatgagaacatgagaggaatctgttttgaggtttgcgatgtggtgctccactctgatgctatccacagaggtggtggtcaggttatcccgacagcgaggagggttatctacgcctctcagatcactgccaagcccaggcttttggaaccggtttacatggttgagatccaagcaccagagggagctcttggaggaatctacagcgtgctgaatcagaagcgtggacacgtctttgaggagatgcagaggccaggaacaccgctttacaacatcaaggcgtacctgccagttgttgagtcatttggattctcaagtcagcttagagcagcaacctcaggacaggccttccctcagtgtgtgtttgatcattgggagatgatgtcgtctgacccattggaggcaggatcgcaggcttcaacgcttgtgactgacatcaggaagaggaagggtatgaaggaacagatgactcccttgtctgattttgaagacaagctgtaagcagccagccaagaagactactcgctatggtcacccttttctctctatctctaccgtattttgttttctgttttaatgttatgactttatctgtgttgccaaatccttttgaaa

SEQ ID NO: 2204 - DNA, 2803 bp, Brassica napus
ccaagagatatcgtagggtatctacaaatcagagtttgtcaaaatggtgaagtttacggccgatgagcttcgtaggattatggattacaaacacaacatccgtaacatgtccgttattgcccatgtcgaccatggtaaatccaccctgactgactccttggttgctgctgctggtatcattgcgcaagaagttgctggtgatgtccgtatgactgatactcgtgctgacgaggctgaacgtggtatcaccatcaagtccacgggtatctctctctactacgagatgaccgatgcttccttgaagagcttcactggcgccagagatgggaacgagtaccttatcaacctcatcgactctcctggccacgttgacttctcctctgaggtcactgctgcgctccgtattaccgatggtgcccttgtggtggttgactgtattgagggtgtctgtgttcagactgagactgtgctgcgtcaggctcttggtgagaggattaggcccgtgctgactgtgaacaagatggacaggtgtttccttgagcttcaggttgatggtgaggaggcttaccagacgttccagagggtcattgagaacgctaatgtcatcatggcaacgtatgaggatcctctccttggtgatgttcaggtctaccctgagaaaggaaccgtcgccttctctgctggtctccatggctgggctttcaccctgaccaactttgcgaagatgtatgcttccaagttcggtgttgacgagactaagatgatggagaggctgtggggtgagaatttctttgaccctgccaccaggaaatggagcggcaagaacactgggtcggctacttgcaagcgtgggtttgtgcagttctgttatgagcccatcaagcagatcattgccacttgcatgaatgaccagaaggacaagctgtggcctatgttgcagaagcttggtgtccagatgaagtctgatgagaaggagctcatgggtaaacctttgatgaagcgtgtcatgcagacttggctccctgcaagtaccgcattgcttgagatgatgatctttcaccttccgtcgccccacactgcacagaggtaccgtgttgagaacctgtatgaaggtcctctcgatgatcagtacgccaccgccatcagaaactgtgatcctaatggccctctcatgctctatgtttctaagatgattcctgcctcagacaaggggaggttctttgcttttggtcgtgtcttctctggaaaggtgtccactggtatgaaagtcaggatcatgggtcccaactttgttcctggtgagaagaaagacctttacgtcaagagtgttcagaggactgtcatctggatgggtaagaggcaagagactgttgaggatgttccctgtggtaacaccgttgctatggttggtcttgatcagttcatcaccaagaatgccacgctgacgaatgagaaagaagttgatgctcatcctatccgtgcgatgaagttctccgtgtcccctgttgtacgtgttgctgttcagtgcaaggtcgcttctgatcttcccaagcttgttgagggacttaagaggctggccaagtctgatcctatggttgtctgcacaatggaggagtcaggtgagcacattgttgctggtgctggagaactccatcttgagatttgcttgaaggatcttcaggatgatttcatgggtggtgctgagattgtcaagtcagaccctgtcgtctcgttccgtgagactgttttggagcggtctgtgcgtaccgtgatgagcaaatcaccaaacaagcataaccgtctgtacatggaggctaggcccttggaggatggtcttgcggaggctattgatgatggccgtattggtccaagagatgatcccaagatacgttccaagatcttggcagaggagttcggttgggacaaggatcttgcaaagaagatatgggcgtttggacctgaaaccacagggcccaacatggttgttgacatgtgtaagggagttcaatacctgaatgaaatcaaggattctgttgttgctgggttccagtgggcttccaaggaaggtcctctttgcgatgagaacatgagagggatctgctttgaggtttgcgacgtggtgctccactctgatgctatccacagaggtggtggtcaggttatcccgacggcgaggagggttatctacgcctcgcagatcaccgccaagcccaggctgttggagccggtttacatggtggagatccaagcaccagaaggagctctgggaggaatctacagcgtgctgaatcagaagcgtggacacgtgtttgaggagatgcagaggccaggaacaccgctgtacaacatcaaggcgtacctgccagtcgtcgagtcatttggattctcaagtcagcttagagcggcaacctcaggacaggccttccctcagtgtgtgtttgatcattgggagatgatgtcgtctgacccattggaggcagggtcgcaggcttcaacgctggtgactgacatcaggaagaggaagggtatgaaggaacagatgactccattgtctgatttcgaagacaagctgtgagcagcaagcaagcagccaacaaggctcactatggtcaccctttttctctcgatctctactgcattttgtttactgtttactctgttttggtggttatgatgatgatatgacttttatctgcggccacatccgcttgaatgttttgcttttttttagttgagaactggtttatctttgtgtttactctttgcgcactctcttattatcctgtttgcattggaacgttgt

SEQ ID NO: 2205 - DNA, 2982 bp, Vitis vinifera
tgatgagaactggtgatcaaccactaatgatgagcaccatcagtcatgttgtccttagtacctgagttcattttcaatcttccaccaagcaaaaatatcacaacacaataggtagaatccaatcaaatagaaaaacattcaaccatggtttaagaaaaaaaatagtatcatctctccaaaccaatgttggttgaaatagttccacgacaaaaccatatagacgagataacattaactttgctgttcttgtcgaccatgactaaattgaaaacataatttgaaaaaacgggaaacatcccccgttacaacttcaacaccactaaagtactactactccacggtaaaaatattaatgaaaacaaaacaaaattatgctcaccttgagtatcatcgtcacattccaccaatatggtcctcttttgctttatttgacaatgatcacggaccacttatagcttgtcctcgaactcagatagcggggtcatctgctccttcaagcccttcctttttctgatatctgctacaagttgagcagcagttgaaccagcttcaagcgggtcagctgacattacgtcccagtgatcaaacacacactgtgggaacgcctgtcctgaggttgcagctctcaaagtgcctgaaaatccaaaggattcgacgacagggaggtatgccttgatgttgtagagtggggtacccggcctctgcatttcctcgaatacatgcccacgcttttggttcagaacactatagattccaccaagtgcctgctctggggcttggatctccaccaagtagactggctcaaggagtcggggtttagctgtcagctgggaagcatagatgaccctcctagcagtgggaatgacttgaccaccacctctgtgaattgcatcagcatggaggaccacatcacagacttcaaagcaaatacccctcatgttttcttcagccaatgcaccttcctttgatgcccactggaacccagcaacaacagaatccttaatttcattaagatactgaactcccttacacatatcaaccaccatgttagggccagtggtctcaggtccaaaacaccagattttctttgcaagatccttgtcccaaccaaactcctcagacaagatcttggaacgagctttgggatcatcccttggaccaacacgaccatcgtcaatggcctctgcaagaccttcctccaaaggtcgggcctccatgtagagacggttgtgcttgttaggggacttgctcatcacagttctgcaagacttctcaagaacagtctcacggaaggacacaacagggtcagacttaacaatctcagcaccacccatgaaatcatcctgcagatccttcaaacagatctccaggtggagttcaccagcaccagcaatgatgtgctccccagattcctcaatactacagaccaccataggatctgacttagccaaacgcttcaaaccttcaacaagtttaggaaggtcagatgcaactttgcactgcactgcaacacgaacaacaggtgagacagagaacttcattgctctgattggatgggcatcagactccttctcattggtcaatgtagcattcttagtgatgaactgatccaaaccaaccatagctacagtgtttccacagggcacatcctcaacagtttcctgcctctttcccatccaaataacagttctctgcacactcttgacatacagatccttcttctcaccagggacatagtttggacccatgattcttaccttcaaaccagttgaaaccttgccagagaaaacacgtccaaaagcaaagaatctgcctttgtcagaagcaggaatcatctttgagacatagagcatgagagggccttcaggatcacagtttctaatagcagtggcatagatatcatccaagggtccctcatacaagttctctacacggtatttttgagctgtggaaggtgagggaaggtggaaaatcatcatttctaggagggcagtacttgctgggagccatgtctgcatcacacgcttcatcagtgcctttcccatcaaatccttctcatcagacttcatggtcacaccaagcttctgcaacataggccacagtttatccttctgatcgttcatacaagtgttgatgatctgcttgatgggttcataacagaactgaacaaaaccacgcttgcagttgggagcaccagtgttcttggtggtccattttctggtactagggtcaaagaaattctcaccccaaagcctttccatcatcttagactcatcaactccaaatttggaagcatacattttggcaaagttggttagagtaaaagcccaaccatgcaaaccagcagagaacgcaactgttcccttttcagggtaaacttgaacatcaccaagaagtggatcttcataagtagccatgataacatttgcattctcaataacccttgagaatgtctggtaagcctcctctccatcaacctgaagctcaaggaagcacctgtccatcttattgacagttaagacaggacggatcctttcacccagggcctgccgcagaacagtttcggtctggacacaaacaccctcaacacaatccacaaccacaagtgcaccatcagtaatacgaagagcagcagtaacctcagatgagaagtccacgtgcccaggggaatcaataagattgataaggtattcgttcccttgtctctctcccctgtagttcttgagagactcatcactcatctcatagtagagagagataccagtagacttaattgtgataccacgctcagcttcatcctggcgggtatctgtcatccgaacatcaccagcaacttcttgagcaataataccagcagcagccactaaagaatctgtgaggatgatttaataccatgatcaacatgagcaataacagacatattacgaatgttatgcttgtagtccataatcctacgaagctcctcaactgtaaacttgacct

SEQ ID NO: 2206 - DNA, 2863 bp, Eutrema halophilum
gtcgctacttttctctctcgctcaatctttcctttcattctcctctaagagattttgtaggtgacagtcaaaagttagccaaaatggtgaagttcacagccgatgagcttcgtaggattatggactataagcacaacatccgtaatatgtctgttattgcccatgtcgaccatgggaaatctaccctcactgactccctggtcgctgccgctggtattattgcccaagaagttgctggtgatgttcgtatgactgatacccgtgctgatgaggcagaacgtggtattacaatcaagtccaccggtatttctctctactacgagatgtccgatgcttccttgaagagtttcactggagcgagagatggaaacgaatacctcatcaatcttatcgactcccctgggcacgttgacttttcgtccgaggtcactgccgctctccgtattacagatggtgctcttgtcgtggtcgactgcattgagggtgtctgtgtgcagactgagaccgtgctccgtcaagctcttggtgaaaggattaggcctgtcttgactgttaacaagatggacaggtgtttccttgaactccaggttgatggtgaggaggcttaccagactttccagagggtcattgagaatgctaatgtcatcatggcaacctatgaggatcctctcctcggtgatgttcaggtctacccagaaaagggaaccgtggctttctctgctggtctccacggatgggctttcactctgaccaactttgctaagatgtacgcttcaaagtttggtgttgacgaatctaaaatgatggagaggctctggggtgagaatttctttgaccctgccaccaggaagtggaccggcaaaaacactggttccccgacctgcaagcgtgggtttgtccagttctgttacgaacccatcaagcaaatcattgccacttgcatgaacgaccagaaggacaagttgtggcctatgttgcagaagcttggtgtccagatgaagaatgatgagaaggagctcatgggtaaacctttgatgaagcgtgtcatgcagacatggcttcctgcaagtaccgcactacttgagatgatgatctttcacctgccatctccccacactgctcagaggtaccgtgttgagaacttgtacgaaggtcccctcgatgatcagtatgccacggccatcagaaactgtgatccaaatggtcccctcatgctttacgtttctaagatgattcccgcctcagacaagggtagattctttgcctttggacgtgtctttgctggtaaggtgtctactggtatgaaggtcaggatcatgggacccaactttgtccctggtgagaagaaagatttgtatgtcaagagtgtccagagaaccgtcatttggatgggtaagaggcaggagactgttgaagacgttccctgtggtaacaccgttgccatggttgggctggatcagttcatcaccaagaatgccaccctgacgaatgagaaagaagttgatgcccaccctattcgtgcaatgaagttttccgtctcccccgttgtccgtgttgctgttcagtgcaaggttgcatccgaccttcccaagcttgtggaaggactcaagaggctggccaagtctgatcctatggttgtgtgcacaatggaagagtcaggtgagcacattgttgctggtgctggagaactccatcttgagatttgtctcaaggatcttcaggatgatttcatgggtggagctgagatcatcaagtcagaccctgttgtgtcgttccgtgagactgtcctcgagagatctgtccgcactgtgatgagcaaatcccctaacaagcacaaccgtctttacatggaggccaggccgatggaggaaggtctagcagaggcaattgatgacggccgtatcggcccaagagacgaccccaagatccgatcaaagatcttggcagaggagtttggatgggacaaggatcttgcaaagaagatctgggcgtttggacctgaaaccacggggcctaacatggtggttgacatgtgtaagggagttcagtaccttaatgaaatcaaggattcagttgttgctgggttccagtgggcgtccaaggaaggtcctttggcagaagagaacatgagaggtatttgttttgaggtttgcgatgtggtgctccactctgatgccatccacagaggtggtggtcaggttatccccacagccagaagggttatctacgcctctcagatcactgccaagcccagactcttggagccggtttacatggtggagatccaagcaccagagggagctcttggaggaatctacagcgtgctgaatcagaagcgtggacacgtctttgaggagatgcagaggcccggaacaccactgtacaacatcaaggcatacttgccagtcgtggagtcttttggattctcgagtcagcttagggcagcaacctcaggacaggccttcccgcagtgtgtgttcgatcactgggaaatgatgtcatctgaccctctcgaggcaggaactcaggcttcagtgctggtggctgacatcaggaagaggaagggtttgaaggaagcgatgactccactctctgagtttgaagataagctgtaagcagccagcactctccatttgctgtttgctctctccgtctctctaccttatttttgtctttgtttttttttttgtttactattttggtatgatggatttgatactcttttatctcccctcctcgatgttttacttttagttgagaagaacttaattatgtgttcgcaaatattttgctcttgattatttgccttgcactcttatattctgtgttcgtttggtcatattcatatgcttaggttgatgat

SEQ ID NO: 2207 - DNA, 2886 bp, Taraxacum officinale
tcccgggatctcggtgtagaccaaagcaaagggtctctgagagctcatcaaattctgccgccgctccttccccttctccttctttactaggatttctcttaaaagcaatcaaactacacttctgttgtagtcactcaaaagccagtcaaaatggtgaagtttacagctgaagagcttcgtaggattatggactacaagcacaacatccgtaacatgtccgttattgctcatgtcgatcacggaaaatccactctgactgattctctagtggcagctgctggaatcattgcccaagaagtcgccggggatgtccggatgaccgacacccgtgccgacgaagccgaacgtggtatcacaatcaagtccaccggaatctccctctactacgaaatgaccgatgctgccctcaaggccttcaagggagaaagaaacggaaacgagtacctcatcaacctaatcgactcccccggacacgtcgacttctcctccgaagtcaccgccgccctccgtatcaccgatggcgcgctcgtggttgtcgactgcatcgagggcgtttgcgtccaaaccgaaaccgtcctccgccaagccctcggtgaaagaatccgacccgtgctaaccgtcaacaaaatggaccgatgtttccttgagctccaagtcgacggtgaagaagcttaccagaccttccaaagagtcattgaaaacgcaaatgtcatcatggctacttacgaagaccctttattgggtgatgtcatggtgtaccccgagaaaggaaccgtcgcgttttccgcggggctccacgggtgggctttcaccctaacaacttcgcgaaaatgtacgcgtccaaattcggtgttgacgagtccaagatgatggagaggctatggggtgagaattacttcgacccgaaaacaaagaaatggaccacgaaaagcactggagccccaacatgcaaacgtggattcgtccagttttgctatgaaccaatcaagcagatcatcaacacttgcatgaacgaccagaaggacatcctatggcctatgttgactaaactcggagtcacaatgaaaggagaggaaaaagagctaatgggaaaagctctaatgaaacgtgtcatgcaaacatggcttccagctgctactgctctacttgaaatgatgatattccacctcccgtccccccacactgctcagagataccgtgtcgagaatctttacgaaggcccgcttgatgaccagtatgctaacgcgatcaggaactgtgacccggaaggtcctctcatgctttacgtttccaagatgattcccgcatccgacaaaggtcggtttttcgctttcgggcgggtgttcgcgggtcgggtgtccaccgggttgaaggtccggatcatgggtccgaactacgtacccggcgagaaaaaagatctttacgtgaaatccgtccagagaaccgttatctggatggggaaaaagcaggaaacagtcgaagatgttccatgtggtaacactgtcgctttggtcggtctcgaccagtttattaccaaaaacgccactctaactaacgagaaggaaaccgaagcccacccgatccgtgccatgaagttttccgtctccccggttgtccgtgttgcggtccagtgtaaggtcgcgtctgacttacccaaactagtcgaagggctaaaacgtctggcgaaatccgatcctatggttgtgtgtactattgaagaatccggtgaacacatcatcgctggtgcgggtgagcttcatctggaaatctgtttgaaggatctgcaggacgacttcatgggcggggcggaaatcgtggtatccgacccggttgtctccttccgtgaaaccgttctagaaaaatcttctcgtactgtcatgtccaaatcccccaacaaacataaccgtttgtacatggaggctagaccaatggaagaagggttggcggaagctattgacgacgggcgggtcggcccacgtgacgacccgaagatccgtggaaagattctgtctgaagaattcggttgggataaggatctggcgaagaaaatctggtgttttggaccggaaactaccggacccaacatggttgttgatatgtgtaagggagtccagtacttgaacgaaatcaaggactctgtggttgctgggtttcaatgggcatcaaaggaaggtgctctagctgaggaaaacatgagaggaatctgtttcgaagtctgtgatgtggtccttcacgctgacgctatccaccgtggtggcggacaggttatccctaccgcgcgtcgtgtcatctacgcttctcagttgaccgcgaaaccgcgtctgttggaacccgtctatcttgtggaaatccaagcacctgaacaggcacttggagggatttactctgtactgaatcagagacgtgggcatgtgtttgaggaaatgcaaaggcctggaactcctttgtacaacattaaagcttacttgcctgtggtggagtctttcgggttttctggggctttgagggcgtctacatctggacaggctttcccacaatgtgtgtttgatcattgggacatgatggggtcggacccacttgaggctgggtcacaagccagcacccttgtgggacagattaggaagaggaaggggttgaaggagcagatgacaccgttgtctgactttgaggataagctgtaagcgggagaggctgagttggagagaagaggaggtataatttttaagtttcgtttgcttttttcttgtcgtgttttttagtatgatgtttgtggacaagttatgatggtactgtgtcggtatgtttttctatttttgttggtgacgtgagaactttgcttgcgtaacgatgatgttaattttggatgttacttttttactatttttg

SEQ ID NO: 2208 - DNA, 2666 bp, Papaver somniferum
gtttacagctgaggagcttcgtcggatcatggacctgaagcataatatcaggaacatgtctgtcattgctcatgtggatcatggaaaatcaacacttactgattctcttgtggctgctgctggtatcattgcccaagagactgctggtgatgttcggatgacagatacccgtgcagatgaggcagaacgtggtattacaattaaatctactggtatctctctctattatgagatgagtgatgagtctttgaaggcctacaagggtgatagaatgggtaatgagtacctcatcaaccttattgattcacctggtcacgtcgacttctcttctgaagtcacagctgcattacgtatcactgatggtgcacttgttgtggtggactgtattgagggtgtttgcgtccaaaccgagactgtccttcgacaagctcttggagaaaggatcaggcctgttttgactgtcaacaagatggacagatgtttcctagagctacaggttgatggagaagaagcttatcagactttctccagagttattgagaatgccaatgttattatggccacgtatgaagacccactccttggtgatgtccaggtttaccctgaaaaaggaacagtcgccttctctgctggtttgcacggttgggctttcactctaaccaatttcgcaaacatgtatgcttctaagttcggtgttgaacacagtaagatgatggagaggctttggggtgagaacttctttgacccagcaactaagaagtggactaataagagaacctcgtctcccacatgtaagcgtggattcgtccagttctgttatgaacccatcaagcagatcattgccacttgcatgaatgaccaaaaggacaagttgtggcctatgttgcaaaagcttggtgttgtaatgaagaatgacgagaaggagttgattgggaaacccttgatgaagcgtgtgatgcagacttggctccctgcagctactgccctacttgaaatgatgatttatcatctcccctctccccacacagctcagaagtatcgtgtcgagaacttgtatgagggtcctcttgatgaccagtatgctaatgccatcagaaactgtgatcccgaaggtccacttatgctctacgtgtctaagatgattcctgcctccgacaaggtagattctttgcctttggtcgtgtctttgctggtaaggttgcaacaggtgctaaagtcagaatcatggggcctaactacgttcctggtgggaagaaggacttgtacaccaagagtgtccagagaactgttatctggatgggaaagaaacaggagtcagttgaggatgtaccttgtggtaacacagttgccctggttggattggatcaatttattaccaagaatgcaaccctcacaaacgagaaggaagttgatgctcatcctatcagagccatgaagttttctgtctctcctgttgttcgtgttgctgttcagtgtaaggttgcctctgaccttcccaagctggttgaagggcttaagcgtctgtccaaatctgatcccatggttgtgtgtaccattgaggagtcaggcgagcacattatcgcaggtgctggagaactccatcttgagatctgtttgaaggatttgcaggatgatttcatggggggtgcagaaatcgtgaagtctgaccctgtggtgtcattccgtgaaactgtgctagagaagtcttcaagaactgtgatgagcaagtctccaaacaagcacaaccgtctgtacatggaggcacgccctcttgaggatggacttgctgaagccattgatgatggtcgtattggtccaagagatgatcctaaaattcgttcaaagatcttatctgaagagtttggatgggacaaggatcttgcaaagaagatctggtgttttggtccagatactactggtccaaacatggttgtggatatgtgtaagggagttcagtaccttaatgaaatcaaggattcagttgttgcagggtttcagtgggcgtcaaaggaaggtgtgctagcagaagagaacatgagaggtatatgcttcgaagtatgtgacgtggttctccattctgatgccattcacagaggtggtggacaggttattcctaccgctaggagggttatgtatgcatcacagctcacagctaaacctagacttctagaacctgtgtacctagttgagatccaggctcctgaaggtgctcttggtggtatttacggtgttctcaatcagaagcgtggtcacgtctttgaggaaatgcagaggccaggaactcctctctacaacatcaaagcatatctacccgtggtggagtcattcggtttctctgcccagcttagggctgccacatcaggacaggctttcccccagtctgtgtttgatcattgggatatgatgatggctgatcccctggagccaggtactcaagctgcagagcttgtgacagacatcaggaagaggaagggtttgaaggcccagatgacccctctctccgattttgaggacaagctttaagtcataaggttcttttttgaatgatgaattgagatggtgagttgttctaagtgtttaggcattaggtttaattatgttggcaaatggatattagttactcttgggtttgtaagtgttttggtaacagaatgatccaaacttta

SEQ ID NO: 2209 - DNA, 2976 bp, Amorphophallus konjac
ctgctgcctgagccgccatttactgcgaagaggagttgggaacaaattaatcagttggtgctgatttgttgattacttgcagcagtcaagatggtgaagtttacagcagaagggcttcggaggatcatggatctgaagcacaatatccgtaacatgtctgtcattgcccatgttgatcatggcaagtctactcttacagattctcttgtcgcggctgctggaatcattgctcaggaggttgccggagatgtccgaatgacagatactcgccaagatgaagcagaacgtggtatcacaatcaaatccactggaatttctctgtactatgagatggaggaggaaactttaaagggcttcaagggtgaaagacaaggaaatgagtatcttatcaacctcatcgattcacctgggcatgttgatttttcttctgaagtcacagctgctctccgtatcactgatggtgcactggtggtggttgactgtgtggaaggtgtgtgtgtccagactgagactgtgcttcgacaagcccttggagaaaggattaggcctgtcttaactgtcaataaaatggacaggtgtttccttgagcttcaggttgaaggtgaggaggcctatcagaccttccaacgtgtgattgagaatgctaatgttattatggccacttatgaggatccccttcttggagatgtccaagtttacccagagaagggaactgttgctttctctgctggtttgcacggatgggctttcacattgtcaaacttcgccaaaatgtatgcctcaagatttggtgtggatgagaaaaagatgatggagaggctttggggagaaaactactttgatcctgccacaaaaaagtggactactaagaacactggttctcctacttgcaagagaggttttgttcagttctgttatgaaccaattaagcagattatcagcacttgcatgaatgatcaaaaggataagctgtggcctatgcttcagaagctcaaagttaacatgaaagctgatgagaaggagctgattgggaaggcattgatgaaacgtgtcatgcagacctggttgccagcaagtgatgcccttcttgagatgatgatctttcaccttccttctcctgcaaaagcacagaagtatcgtgttgaaaacttgtatgaaggtcctttggatgacatatatgcaaatgcaattcgtaactgcgatccggaagggcctctaatgctttatgtgtcaaaaatgattcctgcttctgataagggtagattctttgcctttggtcgggtattctctgggagagtttctacgggtatgaaggttagaatcatgggtccaaactatgttcctggtcagaagaaagacttgtatgtgaagagtgtgcaaagaactgtcatttggatgggtaagaagcaggaatctgttgaggatgtaccttgtggaaatactgtggcgatggttggcctggatcaatttatcaccaaaaatgcaacattgacaaatgagaaggaagttgatgctcatccaatcagggcaatgaagttttctgtttctccagttgtccgtgtagcggtgcaatgtaaggttgcctctgaccttcctaagcttgttgagggtttgaaacgtttggccaagtcagatcctatggttgtctgcacaattgaagaatctggtgagcacatcgttgcaggggctggggagctccaccttgagatctgcttgaaggatttgcaggaagatttcatgggaggtgcagagatcattgtctctgatcctgttgtttctttccgtgagactgtgcttgagaaatcttgcaggactgtcatgagcaagtcccctaacaagcacaaccgaatttatatggaagctcgtccaatggaagagggtctggctgaagccatagacgaggggcgaattggcccaagggatgatcctaaagctcgtgcgaagattctttcagaagagtttggatgggacaaggatcttgcaaagaagatttggtgcttcggtcctgaaaccacaggtccaaacatggttgttgatatgtgcaagggagttcaatatctcaatgaaatcaaggattcagttgttgctggcttccagtgggcatcaaaggaaggtgcagtggctgaagagaacatgcgagctatatgctttgaggtgtgcgatgtggttctacatgctgatgccatacacagaggtggtggacagatcattcctactgcaagaagagtcatatatgcttctcagttgactgctaaaccgaggttgttggagccagtttatttggtggagatccaggcaccagagcaagctcttggtggtatatatggtgttctcaaccagaaaagaggtcatgtgtttgaagaaatgcagaggcctggtactcccctttacaacatcaaggcatacctcccggttattgagtctttcggtttttcgagtaccctgagggcagcaacatcagggcaggcattcccccagtgtgttttcgatcactgggatatgttgtcctcggatccattggaacccggttctcaggcatggcagattacttctgacatacgcaaaaggaagggcctcaaggatcaaattaccccactttccgagtatgaagacaagctgtaggctgcgtatatactgtcgacctatgggtctgttttaaggcagtttgagctttgtttttagtctgccttaaggcgagttcttaaaagttacatgggcgtctgttttttttcttttttacatttttattgactttcataagaggcgacattggcttaaacgccaaatagtcgttgtgcatgtctgtaattgtctagacgtctcattgggtagctagtactgtctaatggtatgtttctcggagttttccagtgaggaatggcatatggtcgagattatgtatcggtgatttttgtttgggatggttaattttagttcttcctgcatacagctgcgcaactgcttatgccgctgacg

SEQ ID NO: 2210 - DNA, 2804 bp, Brassica napus
gacatatcgtacggtgtctacaaatcagagtttgtcaaaatggtgaagtttacatccgatgagcttcgtcggatcatggattacaaacacaacatccgtaacatgtccgttattgcccatgtcgaccatggtaaatccaccctcactgactccttggttgctgctgctggtatcattgctcaagaagttgctggtgacgtccgtatgactgatactcgtgctgacgaggctgaacgtggtatcactatcaagtcaacgggtatctctctctactacgagatgaccgatgcttccttgaagagcttcactggcgccagagatgggaacgagtatcttatcaacctcattgactctcctggccacgttgacttctcctctgaggtcactgctgctctccgtatcaccgatggtgcccttgttgtcgtcgactgtattgagggtgtgtgtgttcagactgagactgtgcttcgtcaggctcttggtgagaggattaggcccgtgctgactgtgaacaagatggacaggtgtttccttgagcttcaggttgatggtgaggaggcttaccagacgttccagagggttattgagaacgctaatgtgatcatggcgacgtatgaggatcctctccttggtgatgttcaggtttaccctgagaagggaactgtcgccttctctgctggtctccatggatgggccttcacgctgaccaactttgcgaagatgtatgcttctaagtttggtgtggacgagactaagatgatggagaggctgtggggtgagaatttctttgaccctgctacaaggaagtggagcggcaagaacactgggtccgctacttgcaagcgtgggtttgtgcagttctgttatgagcccatcaagcagatcattgccacttgcatgaatgaccagaaggataagttgtggcctatgttgcagaagcttggtgtgcagatgaagtctgatgagaaggagctcatgggtaagcctttgatgaagcgtgtcatgcagacttggctccctgcaagtactgcgttgcttgagatgatgatctttcaccttccgtcgccccacactgcacagaggtaccgtgttgagaatctctatgaaggtcctctcgatgatcagtacgccactgccatcagaaactgtgatcctaatggccctctcatgctctatgtttctaagatgattcctgcctcagacaaggggagattctttgcttttggtcgtgtcttctctggaaaggtgtccaccggtatgaaggtcagaatcatgggtcccaactttgttcctggtgagaagaaggatctttacgtcaagagtgttcagaggactgtcatctggatgggtaagaggcaagagactgttgaggatgttccctgtggtaacaccgttgctatggttggtcttgatcagtttatcaccaagaatgctacgctgacgaatgagaaagaagtcgatgctcatcctatccgtgcgatgaagttctctgtgtcccctgttgtacgtgttgctgttcagtgcaaggtcgcttccgatcttcccaagcttgttgagggacttaagaggctggccaagtctgatcctatggttgtctgcacaatggaggagtcaggtgagcacattgttgctggtgctggagagctccatcttgagatttgcttgaaggatcttcaggatgatttcatgggtggtgcggagattgtcaagtcagaccctgtcgtctcattccgtgagactgttttggagcggtctgtgcgtaccgtgatgagcaaatcaccaaacaagcataaccgtttgtacatggaggctaggcccttggaggatggtcttgcggaggctattgatgacggccgtattggtccaagagatgatcccaagatacgttccaagatcttggctgaggagtttggttgggacaaggatcttgcaaagaagatatgggcgtttggacctgaaaccacagggcccaacatggttgttgacatgtgtaagggagttcaatacctgaatgaaatcaaggattctgttgttgctgggttccagtgggcttccaaggaaggtcctctttgtgatgagaacatgagaggaatctgctttgaggtttgcgatgtggtgctccactctgatgctatccacagaggtggtggtcaggttatcccaacggcgaggagggttatctacgcttctcagctcactgccaagcccaggctgttggagccggtttacatggtggagatccaagcaccagaaggagctcttggaggaatctacagcgtgctgaatcagaagcgtggacacgtgtttgaggagatgcagaggccaggaacaccgctgtacaacatcaaggcgtacttgccagtcgttgagtcatttggattctcgagtcagcttagagcagcaacctcaggacaggccttccctcagtgtgtgtttgatcattgggagatgatgtcgtctgacccattggaggtaggatcgcaggcttcaacgctggtggctgacatcaggaagaggaagggtatgaaggaacagatgactccattgtctgatttcgaagacaagctgtaagcagcaagcagccaacaagggtcactatggtcaacccttttctctcgatctctactgcattttgtttactgtttactctgttttggtggttatgatatgacttttatctgcggccacgtccgcttgaatgttttgctttttttagttgagaactggtttatctctgtgtttactctttgcactactactctcttattatcctgtttgtattggaacgttgttataattcgagc

SEQ ID NO: 2211 - DNA, 2990 bp, Gossypium raimondii
ctgggttttttttatttttttattatacttgttttgataattttatttgggagatataagaattgtgtttgtttggcttttgtataggttttaatagttcggggcattttaaagattattcaagatggtgagtttaatgaatatattatgttatgttcttaattttgttgaatttgtttttattaaaatatatttttgctgtgattttttttaatgatttgtgttatgctggatatgattacaggtgaagtttacagctgaggagctccgttctattatggaccggaaacacaacatccgtaatatgtctgttattgcccatgtcgatcacgggaaatcgactcttactgattctcttgtcgctgctgctggtatcattgcgcaagaagttgctggtgatgtacgtatgacagatactcgtgccgatgaggcagagcgtggtatcacaattaagtctaccggtatctccttgtattatgaaatggctgatgaatctgtgaagagtttcaaaggagataggcaagggaatgaatacctcatcaatcttattgattctcccgggcatgttgacttctcatcggaggttacagctgctcttcgtattactgatggtgcccttgtggttgttgactgtattgaaggtgtctgtgtgcagaccgagactgttctccgtcaggctcttggagaaaggatcaggcccgtcttgactgttaacaagatggaccgatgtttccttgagctccaggttgatggagaggaggcttaccagacattccagagagtgatcgaaaatgctaatgtcatcatggccacgtatgaagatcctcttctgggtgatgttcaagtctaccccgagaagggaacagttgcgttctctgctggtttgcatggttgggcatttaccctgaccaactttgctaaaatgtatgcctcgaagttcggagttgatgagtcaaaaatgatggaaagactttggggtgagaactactttgatccagcttccaagaagtggactaccaagagcaccggcactgccagctgcaagcgtggatttgttcaattctgttatgaacccatcaagcagattataaacacatgtatgaatgaccagaaagataagctctggccaatgttgcaaaagctcggtgtcaccatgaagtctgatgagaaggatttgatgggaaaggccctaatgaagcgtgtaatgcagacttggcttcctgcaagcagtgctctcctcgaaatgatgatctttcacttgccttctcctactaaggctcagaagtaccgtgttgagaacttgtatgagggtcctctcgatgatatttatgctaacgccatcaggaactgcgatcctgagggtccccttatgctctatgtttcaaagatgattcctgcttctgataagggtagattctttgctttcggacgtgtattttccggcaaagttgcaactggtatgaaggtcagaatcatgggcccaaactatgttccaggtgagaagaaagatttatacgttaagagtgtacagagaactgttatttggatgggaaagaagcaggaaaccgttgaggatgtgccttgcggtaacacagttgctatggtcggcttggatcaatttatcacgaagaacgcaactttaactaatgagaaggaagttgaagcccacccaattcgtgctatgaagttctctgtctcacctgttgtccgcgttgctgttcagtgtaaggttgcatccgatcttcccaaactcgttgaagggttgaagcgtttagctaagtctgatcctatggtggtttgtactattgaagagtcgggagagcacattgttgcaggcgctggtgaactccatctcgagatctgtctcaaggatttacaagaagattttatgggtggcgctgagattgttaaatcggaccctgttgtgtcttttcgtgagactgtacttgagagatcttgtaggactgtgatgagcaagtctcctaacaagcacaaccgtctctacatggaagctcgacccctggaggaaggtcttgctgaggccatagatgacgggcgtatcggtccaagagatgaccccaaggtacgttccaagatcttggctgaggagtttggttgggacaaagatcttgctaagaagatttggtgttttggccccgagaccactggtcctaacatggttgtcgatatgtgtaaaggagttcagtaccttaatgaaattaaggattctgttgtcgctgggttccagtgggcatcaaaggaaggtgcactctccgaagagaacatgagaggtatctgcttcgaagtctgtgatgtggttctccacgctgatgcaatccacagaggtggtggtcagatcattccaactgctcgacgagttttctatgcatctcagcttacggccaagccaaggcttctcgagcccgtttacttagtcgagatccaagctcctgagcaagcacttggtggtatttacagtgttcttaaccagaaacgtggacacgtcttcgaggaaatgcagaggcctggaacaccactctacaacataaaagcttaccttccagtcatcgagtcattcggattctccagcacactaagggctgcaacatcaggacaggctttcccacaatgtgtgttcgatcactgggatatgatgccatcggatccattagaacccaattctcaggcagcaaaccatgttgcggagatccgcaagaggaagggattgaaggagcaaatgaccccgctttccgagtacgaagacaagctgtaagctaaagaaaaaaatgaagggtatgggggtgctttctctcccatttgtcaatttagtttttccttagattatgtttttctttttttcaattttcttacaatgaatcggataattgtcatgggatgttacaattttcatgttttttgaatggtatatcacataattccaatcgacattgatggtgttaaaagctataattttgatgtttggtttgctt

SEQ ID NO: 2212 - DNA, 2770 bp, Silene vulgaris
ccctcattggagtatttgcttattggctttgcccgtgaattatctaaacagcgaaaatggtgaagtttacggcagagggactacgtgccattatggacaagaaagagaacatccgtaacatgtctgtcattgcccatgttgaccatggaaaatcaactctcaccgattctttggtggctgctgctggtattattgcccaagaagttgctggtgatgttaggatgactgatactcgtgcagatgaagctgagcgtggtatcactatcaagtcaactggaatctctttgtactatgagatgacagatgcggctttggaagcatacaaggggaagcgcgcaggaaatgagtatttgattaaccttatcgattcccctgggcacgttgacttttcatctgaggttacagctgctttgcgtatcacagatggtgcacttgttgttgttgactgtattgagggtgtctgtgtccagaccgaaactgttcttcgccaagcacttggtgagagaatcaggcctgttttgacggttaacaagatggaccgttgtttccttgagcttcaggttgatggagaggaggcgtacacaaccttccagaaggttattgagaatgctaatgttattatggctacctatgaagatcctcttcttggtgatgtccaagtttaccctgagaaaggaacagttgctttctctgctggtcttcatgggtgggcatttactctcaccaactttgctaagatgtatgcctccaagtttggagttgatgagactaagatgatggagcgtctttggggagagaactactttgacccagccaccaggaagtggactaccaagaattctgggtctgccacctgcaagcgtggttttgttcagttttgttatgagcccatcaagcaaatcatcaacatttgcatgaatgatcagaaggagaagttgtggccaatgttgacaaagcttggtgtccagctgaagtctgatgagaaggatctgatgggtaaagcgttgatgaagcgtgttatgcagacttggctgccagcaagcagtgctttgcttgaaatgatgatctatcacttgccatcaccggcaactgctcagaggtatcgtgttgagaatttgtatgaagggcccatggatgatcagtatgctactgccatcaggaactgtgatcctgatggccctctgatgctttatgtttctaagatgattccagcctctgacaagggcagattctttgcctttggtcgtgtgtttgctgggaaggtatcaactggtgttaaagttaggatcatgggccctaactatgttcctggtgagaagaaagatctttatatcaaaaatgtccagagaaccgtcatttggatgggaaagaagcaggaaacagttgaagatgtgccttgtggaaacactgttgctttggttggtctagatcagtttatcacaaagaatgccactttgaccaacgagaaggaggttgatgctcacccaatccgagcaatgaagttctctgtctcacctgttgttcgtgttgctgttcagtgtaaggttgcatctgaccttcccaagcttgttgaaggtttaaaacgtcttgcaaagtcagaccctatggttgtctgtagtattgaggagtctggtgaacacatcattgctggtgctggtgaactccatcttgagatctgtttgaaggatcttcaagatgatttcatgggtggagctgaaatcatcaaatctgaccctgttgtctccttccgtgagactgttattgacagatctgttcgcactgtgatgagtaagtcccctaacaagcacaaccgtctttacatggaagctaggccacttgaagatggtcttgctgaggccattgatgatggaaggattggcccaagggatgacccaaagatcaggtccaagatccttgctgaagagtttggttgggacaaggatcttgctaagaaaatctggtgttttggtccggaaaccacaggcccaaacatggtggttgatatgtgtaagggagtccagtacttgaatgaaattaaggactctgttgttgctggtttccaatgggcttccaaagaaggtgcgttggctgatgagaacatgaggggtatctgctttgaagtatgtgatgtggttctccacactgatgccatccatcgtggtggaggacaagtgattccaactgctagaagggtcatctttgcttctcagttgaccgccaagccgaggttgatggagcctgtataccttgttgagatccaagccccagaaggtgctcttggtggcatctacagtgtgttgaatcagaagcgtggacacgtgtttgaggagatgcagagacccggaaccccactgtacaacatcaaggcctatcttcctgtggttgagtctttcggtttctccagcaccttgagagctgcaacctctggtcaggctttcccgcaatgtgtgtttgatcattgggatactttgggttcagatcctctggatccaacctctcagtcagcaactcttgtttccgacattcgtaagaggaagggaatgaagcaacagatgaccccgctttctgatttcgaagacaagctctgagctttcctatgatttactcgttttgtagtttgttagtcatgaacttgcttttggtacgtttgttttactgaaactatgttatggagattattgctactgttaatccatttgaggaattttgtgatgttacaatttgtgcttgattatcgctgttatctgtcatttgttcgtatttgtctagt

SEQ ID NO: 2213 - DNA, 2841 bp, Phalaenopsis aphrodite
ccgcactgcgttagggttttggaaatccttcctcgtcgccgcacgtcttagattttaattatctatttacctgttgatcatttacattagacaagatggtgaagttcacagctgaagagcttcgaaggattatggatcttaagcataatattcgaaacatgtctgttatcgctcatgttgatcatggaaaatcaactctgactgattctcttgtggcggctgcgggcattattgcacaggaagttgctggcgatgttcgaatgacggatactcgtcaagatgaggctgaccgaggcatcactatcaagtctaccggcatctcgctctactatgagatggcagacgaaactctaaagaactacaagggtgagagggtaggaaatgaatatcttatcaatctgattgactcgccaggacacgtggatttctcatccgaagttacagccgcactacgaattactgatggcgctctcgttgtcgtcgactgtgttgagggtgtctgcgtccagacggaaacagtcctgcgacaagctctcggagaaagaatcagacccgtcttaaccgttaacaagatggatcgatgtttcctcgagcttcaggttgaaggtgaagaagcttaccagacttttcagcgggtcatcgagagcgcaaatgttattatggctacatatgaggatcctcttctgggtgatgtccaagtctaccccgagaagggtactgtcgcattctccgcagggctgcatggctgggcttttacgctgacaaattttgctaaaatgtatgcttcgaagtttggggtggatgagagcaagatgatggagcggctttggggtgagaatttctttgatccggctacgaagaagtggactaccaagaacaccggctcgcccacttgcaagcgtggtttcgtccagttctgctacgaaccgatcaagcagattattaagacctgcatgaatgatcagaaggacaagttgtggccgatgctgtcgaagcttggggtctcaatgaaagctgaagagaaggaactggttgggaaggcactgatgaagcgggtgatgcagacttggttgccagctagcaacgctcttcttgagatgatgatatttcacctcccatctccggcgaaggccccagaagtatcgtgttgagaatctatacgaaggtcctcttgatgatcaatatgctaatgctatcagaaactgtgatcctgaaggtcctctaatgctttatgtttcaaaaatgattcctgcatcggataagggcaggttctttgcttttggccgggttttttcaggcaaagtatcgactggtttgaaggtgagaatcatgggaccaaactatgttccaggccagaagaaggatttatatgtcaagagcgtccaacgaactgttatctggatggggaagaagcaagagtctgtggaggatgtgccctgcggtaacaccgtcgccatggttggactcgatcaattcatcacgaagaatgctactcttactaatgagaaggaggttgatgcccatcctatcagagccatgaaattctccgtctctcccgtcgttcgtgtcgctgtgagctgcaaggttgcctctgatctcccaaagctcgtggaaggtttaaagcggctctcaaaatctgatcccatggtcgtctgtgccatcgaggaatccggcgagcatattgtcgcaggggccggcgagctccacctcgagatctgcctgaaagatttgcaggaggatttcatgggtggcgcggagattgtggtgtccgaccctgttgtctctttccgtgaaaccgttattgacaaatccagcagaacagtgatgagcaagtctcctaacaagcataaccggctttacatggaagcacgacccttggaagagggcttagcagaggccattgatgatggccgcattggtccgcgcgatgaccccaaggtccgtgccaaggtgctgtctgaagaatttgggtgggacaaagatctagcaaagaagatctggtgttttggcccggagaccactggaccaaacttggtggtcgacatgtgcaagggagtccagtacttgaacgaaatcaaggactccgtcgtcgctggttttcagtgggcgtcgaaggagggtgccctcgcagaggagaacatgcgagggatatgctttgaagtatgtgacgtcgtactccatgccgacgcgattcacagaggcggcgggcaagtgattccgaccgcaaggagagttatatacgcctctcaactgacggcgaaacccaggcttctggagcctgtatatctggtggagatccaagctccggagcaggctcttggaggcatatatggcgttctgaaccagaaaagaggccatgtgtttgaagaaatgcagaggccgggcactcctctctacaacatcaaagcttacttacccgtcgttgagtcgttcggtttctcgacggctctgagggcgtcgacctctggccaggccttcccgcagtgtgtgttcgatcactgggacatcatgtcatcggatccgttggaggcgaattcgcaggcggggcaactcgtaacagacattcggaagaggaagggtctgaaggagcagatgacccctctttcggaattcgaagataagctgtaagagaaattttgcaactccaatttgtaggttggtggttatgagtcctctttgaaggtttgtctgtccctttcttttaccctgtttctctgtttttgttctgcgggttattttatgaactatttttattgttgcactaattttatttgtggttggacttgtatgtcacatacttgctgtattctaagttaattttgaacatgttattgtcttttt

SEQ ID NO: 2214 - DNA, 2759 bp, Aquilegia formosa
ggcgacgaagcgcagagaaaaaaagaagaagaaaccatttctactgcttcgtttgaggagctcttctttgtccagtgcattgctgtgatacacacaagcagcaaaaatggtgaagtttacagcggaggaacttcgcaggattatggacctgaaacataacatccgaaatatgtctgtgattgcccacgttgaccatggaaaatctactctcaccgactctctggtggctgctgccggtatcattgcccaggaagtggctggagatgtgaggatgactgatacacgagcagatgaagctgagcgtggtatcacaatcaaatctactggtatctctctgtactacgagatgactgacgagtctcttaagagcttcaagggggaaagaatgggaaacgaatatctcatcaatctgattgattctcctgggcacgtcgacttctcatctgaagttactgctgctctccgaatcactgatggtgcccttgtggtggttgactgcattgaaggtgtctgtgtccagactgaaactgttctgcgccaagctctaggtgaaagaatcaggcctgtcttgacagtgaataagatggaccgttgcttccttgagctccaggttgatggggaggaggcttaccagacattccaacgggtgattgagaatgcgaatgttatcatggctacatacgaagaccctctacttggtgatgtccaggtttatcctgaaaagggaaccgttgccttctccgctggtttgcatggttgggctttcactcttaccaactttgctaagatgtatgcttctaagtttggagttgacgagtccaagatgatggaaaggctttggggtgagaattactttgatccagctaccaaaaaatggacaagcaagaacactggttcttcgacctgcaagagaggctttgttcagttctgttatgaacccattaaacagatcattaatacttgtatgaatgaccagaaggacaagctgtggcctatgcttcaaaagcttggtgtcaccatgaagggagaggagaaggagttactcgggaaagctttgatgaagcgtgtgatgcaaacctggctccctgctagcaccgccctattggaaatgatgatctttcacctgccctctccttccacagctcagaggtaccgtgtcgagaacttgtatgagggtcctctggatgatcagtatgctaacgctatcagaaactgtgatcctgaagggcctctcatgttgtacgtgtcaaagatgattccagcatctgacaagggtagattctttgcttttggacgtgtttttgctggaaaggtctcaactggaatgaaggtcagaattatgggacctaactatgttcctggccagaagaaagacctttatactaagagtgttcagagaactgttatctggatggggaagaggcaagagtcggtggaggatgtgccgtgcggtaatacagtcgcaatggttggtttggatcagttcataaccaagaatgcaacccttacaaatgagaaagaagttgatgcccatcctatccgagccatgaagttctctgtctcccctgttgttcgtgttgctgttcagtgtaaggttgcctctgacctacccaagcttgttgaaggcctcaagcgtcttgccaagtccgatcctatggtggtgtgttcgattgaggagtcgggtgagcacatcatagctggggcaggggagctccatcttgagatctgcattaaagacttggtggacgatttcatgggaggggcagaaattatacaatctcctccagttgtatcattccgtgaaactgttcttgagaagtctctcagaactgtgatgagcaagtcaccaaataagcacaaccgtttgtacatggaagcacgtcctctggaggagggtcttgctgaggcaattgatgaaggccgcattggcccaagagatgatcctaaggtccgctccaagatcttgtctgaagagtttggatgggacaaggatcttgccaagaagatctggtgttttggtcctgagaccactggacctaacatggttgtggatatgtgcaagggagttcagtacctgaatgaaatcaaggactcagttgtggctggtttccaatgggcgtctaaagagggtgcgttgtgtgaggagaatatgaggggtatttgctttgaggtatgtgatgttgtacttcatgctgatgctattcacagaggaggtggtcaggtcattcctactgcaaggagggtcatctatgcatcacagctcactgcgaagcctagactcttggaacctgtctacttggtcgaaatccaagctccggagcaggcacttggtggcatctacggtgttctgaatcagaagagaggacatgtgtttgaggaaatgcagaggcctggtaccccattgtacaacatcaaagcgtacttgccggttattgagtcattcgggttctctagccaacttagagctgcaacctctgggcaagcttttccccagtgtgtgtttgaccactgggacatgatgtcctctgatccactggaggcagggtctcaagcttcaacattggttactgaaatccgtaaaaggaagggtttgaaggacgcaaatgcaccccactttccgaatttgaggacaagctttaattttagggcttggttatcacagtaatggaattttgatctgttttgttttgacatctgttgttatgactgcggacagatgtagattactgcccaatattatacttttatgtttacttgtg

SEQ ID NO: 2215 - DNA, 2766 bp, Brassica rapa
aaacaaaaatacggtagatataacaacgttccaatgaaaacaggataacaagagtgcaaaaaagagtaaacacaaagataaaccagttttcaactaaaaaagtaaaacattcaagaggattgtggccacagataaagtgatatcataacaccaaaacagagctaacagtaaacaaaatacggtagagatggagagaaaaaggtgaccatagtgagtcttgttggctgctgcttatagcttgtcttcgaagtcagacaagggagtcatctgttccttcatacccttcctcttcctgatgtcagtcacaagcgttgaagcctgcgatcctgcctccaatgggtcagacgacatcatctcccaatgatcaaacacacactgagggaaggcctgtcctgaggttgctgctctaagctgacttgagaatccaaatgactcaacaactggcaggtacgccttgatattatacagcggtgtccctggcctctgcatctcctcaaagacgtgtccacgcttctgattcagcacgctgtagattcctccaagagctccctctggtgcttggatctccaccatgtaaaccggttccaacaatctgggcttggcagtgagctgcgaggcgtagataactctcctcgctgttgggataacctgaccaccacctctgtggatagcatcggagtggagcacaacatcgcagacctcaaagcagattcctctcatattctcatcacaaagaggaccttccttggaagcccactggaacccagcaacaacagaatccttgatctcattcaggtattgcactcccttacacatgtcaacaaccatgttgggccctgtggtttctggtccaaacgcccatatcttctttgcaagatccttgtcccaaccaaactcctcagccaatatcttggaacgtatcttgggatcatctcttggaccaatacggccgtcatctattgcctccgcaagaccatcctccaagggcctagcctccatgtacagacggttatgcttgtttggtgatttgctcatcacggtacgcacagaccgctccaaaacagtctcacggaatgagacaacagggtcagacttgacaatctccgcaccacccatgaaatcatcctgaagatccttcaagcaaatctcaagatggagctctccagcaccagcaacaatgtgctcacctgactcctccattgtgcacacaaccatagggtcagacttggccagcctcttaagtccctcaacaagcttgggaagatcagaagcgaccttgcactgaacagcaacacgtacaacaggggacacagagaacttcattgcacggataggatgagcatcaacttctttctcattcgtcagcgtagcattcttggtgatgaactgatcaagaccaaccatagcaacggtgttaccacagggaacatcctcaacagtctcttgcctcttgcccatccagatgacagtcctctgaacactcttgacataaagatctttcttctcaccaggaacaaagttgggacccatgattctgactttcataccagtggacaccttaccagagaatacacgaccaaaagcaaagaatcttcccttgtctgaagcgggaatcatcttagaaacatagagcatgagcggaccattaggatcacagtttctgatggcagtggcatactgatcatcgagaggaccttcatataaattctcaacacggtacctctgtgcagtgtggggggatggaaggtgaaagatcatcatctcaagcaatgcagtgctggcagggagccaagtctgcatgacacgcttcatcaaaggtttacccataagctccttctcatcagacttcatctggacaccaagcttctgcaacataggccacaacttatccttctggtcgttcatgcaagtggcgatgatctgcttgatgggttcataacagaactgcacaaacccacgcttgcaggtagcggacccagtgttcttgctgctccatttcctggtggcagggtcaaagaagttctcaccccacagcctctccatcatcttagtctcgtcaacaccgaacttggaagcatacatcttggcaaagttggtcagggtgaaagcccatccgtggagaccagcagagaaggcaacagttcccttctcagggtaaacctgaacatcaccaaggagaggatcctcgtacgttgccatgatgacattggcattctcaatgaccctctggaaagtctggtaagcctcctcaccatcaacctgaagctcaaggaaacacctgtccatcttgttcacagtaagcacgggcctaatcctctcaccaagggcctgacgtagcacagtctcggtctgaacacagacaccctcgatacagtcgaccaccacaagggcaccatcggtgatacggagagcagcagtgacctcagaggaaaagtcaacgtggccaggagagtcgatgaggttgataaggtactcgttaccatctctagcaccagtgaagctcttcaaggaagcatcagtcatctcgtagtagagagagatacccgtggacttgatagtgataccgcgttcagcctcatcagcacgagtatcagtcatacggacatctccagcaacttcttgggcaatgatacccgcagcagcaaccaaggagtcagtgagggtggatttaccttaccatggtcgacatgggcaataacggacatgttacggatgttgtgtttgtaatccataatcctacgaagctcatcggccgtaaacttcacc

SEQ ID NO: 2216 - DNA, 3050 bp, Brassica rapa
atagtattgggccaacgaggctcacgagaaaacagagctaaaaccctagaagagattaggaaagtacatatcgaacgcctcctctcacttccaagctcctctctctctctcttccccaatcccttctctctctccaagagatatcgtaggtgaagaatataagagttagtcaaaatggtaaagtttacatccgatgagcttcgtcggatcatggattacaaacacaacatccgtaacatgtccgttattgctcatgtggaccatggtaaatccaccctcactgactccttggttgctgctgctggtatcattgctcaagaagttgctggtgatgtccgtatgactgatacacgtgccgatgaggctgaacgtggtatcaccatcaagtccacgggtatctctctctactacgagatgactgatgcttccttgaagagcttcactggtgccagagatggaaacgagtaccttatcaacctcatcgactctcctggccacgttgacttctcctctgaggtcactgctgcgctccgtatcactgatggtgcccttgttgtcgtcgactgtatcgagggtgtctgtgttcagacggagactgtgctgcgtcaggctcttggtgagaggattaggcccgtgctgactgtgaacaagatggacaggtgtttccttgagcttcaggttgacggtgaggaggcttaccagacgttccagagggttattgagaacgctaatgtgatcatggcgacgtatgaggatcctctccttggtgatgttcaggtttaccctgagaagggaactgtcgccttctctgccggtctccatggatgggccttcacgctgaccaactttgcgaagatgtatgcttctaagtttggtgtggacgagactaagatgatggagaggctgtggggtgagaatttctttgaccctgctacaaggaagtggagcggcaagaacactgggtccgctacttgcaagccgtgggtttgtgcagttctgttatgagcccatcaagcagatcattgccacttgcatgaatgaccagaaggataagttgtggcctatgttgcagaagcttggagtccagatgaagtctgacgagaaggagcttatgggtaaacctttgatgaagcgtgtcatgcagacttggctccctgcgagtactgctttgcttgagatgatgatctttcaccttccatctccccacactgcccagaggtaccgtgttgagaacctgtatgaaggtcctctcgatgatcagtatgccactgccatcagaaactgtgatcctaatggccctctcatgctctatgtctctaagatgattcctgcttcagacaagggaagattctttgcttttggtcgtgtattctctggtaaggtgtccactggtatgaaagtcaggatcatgggtcccaactttgttcctggtgagaagaaagatctttatgtcaagagtgttcagaggactgtcatctggatgggcaagaggcaagagactgttgaggatgttccctgtggtaacaccgttgctatggttggtcttgatcagttcatcactaagaatgctacgctgacgaacgagaaagaagttgatgctcatcctatccgtgcgatgaagttctctgtgtcccctgttgtacgtgttgctgttcagtgcaaggtcgcttctgatcttcccaagcttgttgagggacttaagaggctggccaagtctgaccctatggttgtgtgcacaatggaggagtcaggtgagcacattgttgctggtgctggagaactccatcttgagatttgcttgaaggatcttcaggatgatttcatgggtggtgcggagattgtcaagtctgaccctgttgtctcattccgtgagactgttttggagcgatctgtgcgtactgtgatgagcaagtccccaaacaagcacaaccgtctgtacatggaggctaggcccttggaggatggtcttgcggaggcaatagatgaaggccgtattggtccaagagatgatcccaagatacgttccaagatattggctgaggagtttggttgggacaaggatcttgcaaagaagatatgggcgtttggaccagaaaccacagggcccaacatggttgttgacatgtgtaagggagttcaatacctgaatgagatcaaggattctgttgttgctgggttccagtgggcttccaaggaaggtcctctttgtgatgagaacatgagaggaatctgctttgaggtttgcgatgttgtgctccactctgatgctatccacagaggtggtggtcaggttatcccaacagcgaggagggttatttacgcgtcacagctcactgccaagcccagactgttggaaccggtttacatggtggagatccaagcaccagaaggagctcttggaggaatctacagcgtgctgaatcagaagcgtggacacgtctttgaggagatgcagaggccagggacaccgctgtataatatcaaggcgtacctgccagttgttgagtcatttggattctcaagtcagcttagagcagcaacctcaggacaggctttccctcagtgtgtgtttgatcactgggagatgatgtcatctgaccctttggagacaggatcgcaagcttcaacgctggtggctgacatcaggaagaggaagggtatgaaggaacagatgactcctttgtctgattttgaagacaagctttaagcagccagccaacaagactactcactatgttcacccttatctctctatctctaccgtattttgtttactctgttttggtgttatgatacgactgaatttttcgcttttgaagttgagagaactggttatctctatgtgtgttcccatgtattttactctttgcattctctcttattggaacattgttatatgctgttgtgcattgcaagcaataagatgctagtctccaagccaaaccattaggttgaagctttgcaggtgtagggaagatgaggttttgttaggtcagattttgaatccctttattgcggtctttgaagttaagacaactaaaaacttatga

SEQ ID NO: 2217 - DNA, 2825 bp, Brassica napus
agatattgtaggtgaagaataagagttagtcaaaatggtgaagttcacatccgatgagcttcggaggattatggattacaaacacaacatccgtaacatgtccgttattgcccatgtcgaccatggtaaatccacactcactgactccttggttgctgctgctggtatcattgctcaagaagttgctggtgatgtccgtatgactgatacccgtgctgatgaggctgaacgtggtatcactatcaagtccacgggtatctctctctactacgagatgactgatgcttccttgaagagcttcactggtgccagagatggaaacgagtaccttatcaatctcatcgactctcctggccacgttgacttctcctctgaggtcactgctgcgctccgtattaccgatggtgcgcttgtggtggtcgattgtatcgagggtgtgtgtgttcagaccgagactgtgctacgtcaggctcttggggagaggattaggcccgttctgactgtgaacaagatggacaggtgtttccttgagcttcaggttgatggtgaggaggcttaccagactttccagagggttattgagaatgctaatgtcatcatggcaacgtacgaggatcctctccttggtgatgttcaggtttaccctgagaagggaactgtcgccttctctgctggtctccacggatgggctttcacccttaccaactttgccaagatgtatgcttccaagttcggtgttgacgagactaagatgatggagaggctgtggggtgagaacttctttgaccccgccaccaggaaatggagcagcaagaacactgggtccgctacctgcaagcgtgggtttgtgcagttctgttatgaacccatcaagcagatcatcgccacttgcatgaacgaccagaaggataagttgtggcctatgttgcagaagcttggtgtccagatgaagtctgatgagaaggagcttatgggtaaacctttgatgaagcgtgtcatgcagacttggctccctgccagcactgcattgcttgagatgatgatctttcaccttccatccccccacactgcacagaggtaccgtgttgagaatttatatgaaggtcctctcgatgatcagtatgccactgccatcagaaactgtgatcctaatggtccgctcatgctctatgtttctaagatgattcccgctcagacaagggaagattctttgcttttgggcgtgtcttctctggaaaggtgtctaccggtatgaaggtcaggatcatgggtcccaactttgttcctggtgagaagaaagatctttatgtcaagagtgttcagaggactgtcatctggatgggcaagaggcaagagactgttgaggatgttccctgtggtaacaccgttgctatggttggtcttgatcagttcatcactaagaatgctacgctgacgaatgagaaagaagttgatgctcatcctatccgtgcgatgaagttctctgtgtcccctgttgtacgtgttgctgttcagtgcaaggtcgcttctgatcttcccaagcttgttgagggacttaagaggctggccaagtctgaccctatggttgtgtgcacaatggaggagtcaggcgagcacattgttgctggtgctggagaactccatcttgagatttgcttgaaggatcttcaggatgatttcatgggtggtgctgagattgtcaagtcagaccctgtcgtctcattccgtgagactgttttggagcgatctgtgcgtactgtgatgagcaagtccccgaacaagcacaaccgtctgtacatggaggctaggcccttggaggatggtcttgcggaggcgattgatgaaggccgtattggtccaagagatgatcccaagatacgttccaagatcttggctgaggagtttggctgggacaaggatctcgcaaagaagatatgggcgtttggacctgaaaccacagggcccaacatggttgttgacatgtgtaagggagtgcaatacctgaatgagatcaaggattctgttgttgctgggttccagtgggcttccaaggaaggtcctctttgtgatgagaacatgagaggaatctgttttgaggtttgcgatgtggtgctccactctgatgctatccacagaggtggtggtcaggttatcccgacagcgaggagggttatctacgcctctcagatcactgccaagcccaggcttttggaaccggtttacatggttgagatccaagcaccagagggagctcttggaggaatctacagcgtgctgaatcagaagcgtggacacgtctttgaggagatgcagaggccaggaacaccgctttacaacatcaaggcgtacctgccagttgtcgagtcatttggattctcaagtcagcttagagcagcaacctcaggacaggccttccctcagtgtgtgtttgatcattgggagatgatgtcgtctgacccattggaggcaggatcgcaggcttcaacgcttgtgactgacatcaggaagaggaagggtatgaaggaacagatgactcccttgtctgattttgaagacaagctgtaagcagccagccaagaagactactcgctatggtcacccttttctctctatctctaccgtattttgttttctgttttaatgttatgactttatctgtgttgccaaatccttttgaaatactcttttgaagttgagaaaactagtttatctctgtgtgttcgcatgtatttactctttgcattctctcttattatcctgtttatctatttggaaccttgttatatgtcttgtttgttatgtctattgactaagcaattgagtag

SEQ ID NO: 2218 - DNA, 2828 bp, Brassica napus
ggacacaagctcttctctctctctccccttcccctccaagacatatcgtacggtgtctacaaatcagagtttgtcaaaatggtgaagtttacatccgatgagcttcgtcggatcatggattacaaacacaacatccgtaacatgtccgttattgcccatgtcgaccatggtaaatccaccctcactgactccttggttgctgctgctggtatcattgcccaagaagttgctggtgatgtccgtatgactgatactcgtgctgacgaggctgaacgtggtatcaccatcaagtcaacgggtatctctctctactacgagatgaccgatgcttccttgaagagcttcactggcgccagagatggaaacgagtatcttatcaacctcatcgactctcctggccacgttgacttctcctctgaggtcactgctgctctccgtatcaccgatggtgcccttgttgtcgtcgactgtattgagggtgtgtgtgttcagactgagactgtgcttcgtcaggctcttggtgagaggattaggcccgtgctgactgtgaacaagatggacaggtgtttccttgagcttcaggttgatggtgaggaggcttaccagacgttccagagggttattgagaacgctaatgtgatcatggcgacgtatgaggatcctctccttggtgatgttcaggtttaccctgagaagggaactgtcgccttctctgctggtctccatggatgggccttcacgctgaccaactttgcgaagatgtatgcttctaagtttggtgtggacgagactaagatgatggagaggctgtggggtgagaatttctttgaccctgctacaaggaagtggagcggcaagaacactgggtccgctacttgcaagcgtgggtttgtgcagttctgttatgagcccatcaagcagatcattgccacttgcatgaatgaccagaaggataagttgtggcctatgttgcagaagcttggtgtgcagatgaagtctgatgagaaggagctcatgggtaagcctttgatgaagcgtgtcatgcagacttggctccctgcaagtactgcgttgcttgagatgatgatctttcaccttccgtcgccccacactgcacagaggtaccgtgttgagaatctctatgaaggtcctctcgatgatcagtacgccactgccatcagaaactgtgatcctaatggccctctcatgctctatgtttctaagatgattcctgcctcagacaaggggagattctttgcttttggtcgtgtcttctctggaaaggtgtccaccggtatgaaggtcagaatcatgggtcccaactttgttcctggtgagaagaaggatctttacgtcaagagtgttcagaggactgtcatctggatgggtaagaggcaagagactgttgaggatgttccctgtggtaacaccgttgctatggttggtcttgatcagtttatcaccaagaatgctacgctgacgaatgagaaagaagtcgatgctcatcctatccgtgcgatgaagttctctgtgtcccctgttgtacgtgttgctgttcagtgcaaggtcgcttccgatctcccaagcttgttgagggacttaagaggctggccaagtctgatcctatggttgtctgcacaatggaggagtcaggtgagcacattgttgctggtgctggagagctccatcttgagatttgcttgaaggatcttcaggatgatttcatgggtggtgcggagattgtcaagtcagaccctgtcgtctcattccgtgagactgttttggagcggtctgtgcgtaccgtgatgagcaaatcaccaaacaagcataaccgtttgtacatggaggctaggcccttggaggatggtcttgcggaggctattgatgacggccgtattggtccaagagatgatcccaagatacgttccaagatcttggctgaggagtttggttgggacaaggatcttgcaaagaagatatgggcgtttggacctgaaaccacagggcccaacatggttgttgacatgtgtaagggagttcaatacctgaatgagatcaaggattctgttgttgctgggttccagtgggcttccaaggaaggtcctctctgtgatgagaacatgagaggaatctgctttgaggtttgcgacgtggtgctccactctgatgctatccacagaggtggtggtcaggttatcccgacggcgaggagggttatctacgcctcgcagctcaccgccaagcccaggctgttggagccggtttacatggtggagatccaagcaccagaaggagctcttggaggaatctacagcgtgctgaatcagaagcgtggacacgtgtttgaggagatgcagaggccaggaacaccgctgtacaacatcaaggcgtacctgcctgttgttgagtcatttggattctcaagtcagcttagagcagcaacctcaggacaggccttccctcagtgtgtgtttgatcattgggagatgatgtcgtctgacccactggaggtaggatcgcaggcttcaacgctggtggctgacatcaggaagaggaagggtatgaaggaacagatgactccattgtctgatttcgaagacaagctgtaagcagcaagcagccaacaagggtcactatggtcaacccttttctctccatctctactgcattttgtttactgtttattctgttttggtggttatgatatgacttttatctgcggccacgtccgcttgaatgttttgctttttttagttgagaactggtttatctctgtgtttactctttgcactactactactactcttattatcctgtttgtattggaa

SEQ ID NO: 2219 - DNA, 3455 bp, Pinus taeda
aaaacttctggaacagggtttcgattcgctacccgtttagcgtccaagtattgcatcaatccacggcatcttattctcgcccctcacagaatattcgatcaccgtcctgctccaccataaaccctaacggagttacggtcttcaaccaaaagcctactccaccgagcaaagtcatccttttgtttgtctaaggccgccggggtcattcttttatcttagtactcgcgtgctttgcctgagctgcgagagtccgtgatttgaaggtttcagaggtttgcagctcgaatccattctgtgccgttctgctttggcgggctcattggtattcttttgatttggctgagaagagttttggtgaatataaaagttgggaaaaatggtgaagttcacggccgaagagcttcgtaaaatcatggacaggaagcataacatacgaaacatgtctgttattgcccatgttgatcacggaaaatccactctcactgattctttggtagcagcagctggtatcattgctcaagaagttgccggagatgtcagaatgactgatactcgggcagatgaagctgaacgtggcatcaccatcaagtcaactggtactatgtgatggaggatgcagctgtgaaaaatttcaagggggatagagaaggacatgaatatttgataaatctgattgattctccagggcacgttgacttttcttcagaagttacagcagccctgcgaatcacagatggtgcactggttgtggtagattgtattgaaggtgtttgtgtccagactgagactgttcttcgtcaagctcttggagaaagtctcactgtgaacaagatggacaggtgctttcttgagttgcaggttgatggagaggaagcttaccaaaccttctcacgtgtcattgaaaatgcaaatgtaattatggctacttatgaagatcctcttcttggtgactgccaagtttatcctgaaaaaggtacagttgcattctcggcaggtctgcacgggtgggcatttaccctcacaaattttgcaaaaatgtatgcttcaaagtttggagtggatgaagcaaagatgatggagaggctttggggtgaaaacttttttgatccagctacaaagaaatggacaaccaagaatacaggttctgcaacttgcaaaagaggatttgttcaattcatatatgaacctattaagcaaattatcaatatttgtatgaatgatcaaaaggataagttgtggcccatgttgcagaaattgggagttgtaatgaaaagtgatgagaaggagctggttgcaaaagcactcatgaagcgtgtcatgcaaacctggctacctgcaagtagtgctttacttgaaatgatgattttccatcttccttctccagcgaaggcacagagatatcgtgtggaaaacttgtatgaaggacctcttgatgatgtatatgcaactgcaataagaaactgtgaccctgagggtccactgatgttgtatgtttcaaaaatgattccagcttcggacaaaggacgtttctttgcctttggtcgtgtttttgctgggagagttgcaacaggtatgaaggtaaggatcatgggtcccaactatgtgccgggtcagaagaaagatttatatacaaagagtgttcaaaggactgtgatatggatgggaaagaaacaagaatctgttgaggatgtgccttgtggaaatacagtggctttggttgggttagaccagttcataccaaaaatgctacactgacaaacgagaaggaggctgatgctcatccgatcagagcaatgaagttttctgtgtcccctgttgtacgtgttgctgtgcagtgcaaaaaacttgttgaagggctgaagcgtcttgctaagtcggatcctatggtggtttgtacaattgaggaatctggagaacatattattgcaggtgcaggagagcttcatcttgagatttgcttaaaagatctccaagatgattttatgggtggagctgagattgttgtttctgatcctgttgtctcatttagggaaactgttttggagaaatcatgccgtactgttatgagcaagtctccaaataaacataacaggctttactttgaagcaagacctttagaagaaggtcttgcagaagcaattgatgatggtcgcattggcccgaaggatgatccaaaggctcgcgcaaaaatcctttctgaggaatttggatgggacaaagatttggctaagaagatctggtgttttggacctgaaaccactggccccaatatggtggtggatatgtgtaagggagttcaatacttgaatgaaattaaagattctgtggttgctgcattccaatgggcatctaaggaaggtgctcttgcagaagaaaacatgcgtggtatttgctttgaggtttgtgacgtggttttgcacactgatgctatccatagaggaggtggccaggtgatcccaacggccagaagggttatgtatgcatctcagcttactgccaaaccacggcttcttgagccagtatatcttgttgagattcaggctcctgagaatgcccttggtggtatttatggtgtgctgaaccagaagagaggtcatgtttttgaagaaatgcagaggccaggtactccactatacaacatcaaggcatatctgccggttgttgaatcattcggattctcaagcactctccgtgccgcaacttctggccaggctttccctcaatgtgtgtttgaccactgggatatgatgggatctgatccattggaacctggttcccaagctgggcagcttgtgactgatatccgtaagaggaagggtcttaaggagagtatgactcccttgtcagagttcgaagacaagctgtagagctttgctatgtttgcatgtcggatgctgtcaagattgaggaacctccgagtattaaaacacagttttgtgtgctaggactatttaaatttatgctattcaggtatttttgtgatctgttatttatgttattcaggtatttttgattggaaaatactttttacaaggtacatccattaatcttttaaatgttacataattctcacttgtcaatttcaccgtatgtgcggtagtttgaattgcttgcataattatgtatgtcacagaaaagccgggctgagatttgggtagacgttggtttaaaaacacattcacctggccgttggtttaaaaattgttgtatataattgtgctccatctattattctcctctctagtttcccaatccatccacgtagtattgtgcctgctgtgtctttggggtcaatgggttttccctgttagtcttgtgttgttatccatctgtgtccagttcaaagagaagcaaaaggaatccacacgctaacctgattaattttttttttgtttttaatcgaagatactggtttttacagataatgaaatctggatttggtagggttggatgtt

SEQ ID NO: 2220 - DNA, 3072 bp, Amborella trichopoda
gtcataactctctgaggcggcacgagacgtatctctgccgttggaggaacttttctgttggaattctttgtgtagggcgaacttgaaaactagtcaaaatggtgaagtttacagcagaagagctccgccgcataatggacctgaagcataatattcgtaacatgtcggtcattgcgcatgtggatcatggtaaatccacactcactgacagtctcgtggctgctgccggtattattgcacaagaggttgctggagatgtgaggatgactgatacccgtgcagatgaggcggaacgtggtatcaccatcaagtccaccggtatctccctctactacgaaatgaccgaagaatcactcaagagcttcaagggggaaagaaatggcaatgagtacctcatcaatcttattgattcaccagggcacgtcgacttctcctctgaggttactgccgcccttcgaatcactgatggtgctcttgttgtggttgattgtattgagggtgtttgtgtccaaactgaaacagtgcttagacaagcacttggtgagaggatcaggccagttctcactgtgaacaagatggaccgatgctttcttgagctccaagttgatggggaggaggcctaccaaactttccaaaaggtgattgagaatgctaatgtgatcatggccacttatgaagacccacttcttggagatgttcaggtataccctgaaaagggtacagttgccttttcagctggtcttcatggttgggccttcactttgaccaattttgctaagatgtatgcctccaagtttggtgttgatgaggctaagatgatggagaggctttggggtgagaactacttcgaccctgccaccaagaagtggaccggcaagaacactggatcccccacttgcaagaggggtttcgttcagttttgttatgaaccgattaagcaaataatcaacacatgcatgaatgaccagaaaactaagctttggcctatgcttcaaaagcttggggtctcaatgaaggctgatgagaaggaacttgtgggcaaggccctaatgaagagggtcatgcaaacatggcttcctgcgagcgaagctttgttggagatgatggtattccatctcccttcccctgcaaaggcccaaagatatcgtgttgagaacctttatgagggtccacttgatgatgtttatgcaaatgctattaggaactgtgatccagagggccctctcatgctctatgtgtctaagatgattcctgcctctgataaggggcgattctttgcttttggccgtgtcttcgcgggcaaggtctcaactgggctcaaggtccgaatcatgggccccaactatgtgcctggccagaagaaggacctgtatgtgaagagcgttcagaggacagttatttggatgggaaaaaagcaagagtcggtcgaagatgtgccctgcggtaacacagttgccttggttgggctggatcaattcatcactaagaatgcgaccataaccaatgagactgaggttgatgcccacccaatccgggccatgaagttctctgtgtcccctgttgttcgtgttgctgttcagtgcaaggtggcctctgatcttcctaagcttgttgaagggctcaagcgtttggcgaagtccgatcctatggtgatttgcacgattgaagagtctggggagcacatcattgctggtgcaggtgagctccatctcgagatttgcctcaaggacttgcaagaagacttcatgggtggagctgagatcaatgtttcacctcctgtggtctcatttagagagactgtcaaggataaatcatgccgaactgttatgagcaagtcccccaacaagcacaacaggctctacatggaagccaggccattggaagaggggcttcctgaggccattgatgagggtcgcgtgggcccaagagatgaccccaaggttagatccaagattttgtccgaggaatttgggtgggataaggaccttgcgaggaagatttggtgttttggacccgagaccactggccccaacatggtggtggacatgtgtaagggagttcaatacctcaatgaaatcaaggactcagtggctgctggttttcaatgggcttcaaaagaaggagccttagctgaagagaacatgagaggcatatgcttcgaggtttgtgatgttgttcttcacgccgatgccattcataggggtggtggccagattatccccactgctcgtagggtcatctatgcttcccaattgactgcaacaccgaggatgctggagcccatctacttggtcgaaattcaggcacctgagcaagctctgggtggtatctatggggttttgaataagaatagagggcatgtttttgaagaaatgcaaaggccagggactcctctatataacatcaaagcttacttgcctgtcgttgagtcgtttggtttttcgagcactctcagggctgcaacttcagggcaggctttccctcagtgcgtgtttgatcactgggagatgatgaattccgacccattcgatccaacctctgaagcattcagaatagtaactgaggttcgaaagaggaaggggctcaaagaacagattactcctctctctgactatgaagacaagctgtgagcagggaactgggtcctctctttctctctatagtatgatttctctattctcgtgtctatgggtaagtcttttttcccgtgagatactatttttcatgatgttttagatttttcttgggttttggtcattggaatttctatatggagtctaaattttgcagtgagctacttttaattggtttgtttaaggggatgcttcaaatcggaacatgaatatgtgatgtttgagcaacaattgttacgtgttaagttgttcgactactaatgcctaaaaatcatgggtatgttagttgaatgttttgtgccctttcctgctctcttttgatttgacttgtagaaatgttttgtgccctatcctactctcttttgatctgacttgtacaaaaaggaaaactgcttgtggtgcggtgaatttgtttatggtttgagaatatgatttttaa

SEQ ID NO: 2221 - DNA, 2958 bp, Arabidopsis thaliana
ataataagctttaggctgctagacgcctgcctccttgcacctcttttctttctctcgttctcatctttctctctaagagattttgtaggtgacaatcaaaagtttgacaaaatggtgaagtttacagctgatgagcttcgaaggattatggactacaaacacaacatccgtaatatgtctgttattgctcatgtcgaccacgggaaatccactcttactgattctttggttgctgctgctggtatcattgcccaagaggttgctggtgatgttcgtatgactgataccagagctgatgaggctgaacgtggtatcactatcaagtccactggtatttctctctactacgagatgactgatgaatccttgaagagtttcactggagccagagacggaaacgagtacctcatcaatcttattgattcacctgggcacgttgacttttcttctgaggttactgctgctctccgtattactgatggtgctcttgtggtggtcgactgcattgagggtgtgtgtgttcagactgagactgttctacgtcaggctcttggtgagaggattcgacctgtcttgactgtcaacaagatggacaggtgtttccttgagcttcaggttgatggtgaggaggcttaccagactttctcgagggttattgagaacgctaatgtcatcatggctacatacgaggatcctctccttggtgatgttcaggtttacccagagaagggaactgtggcgttttctgctggtctccatggatgggcgtttacactgaccaacttcgccaagatgtatgcttccaagttcggtgttgttgaatctaagatgatggagaggctctggggtgagaatttctttgaccctgccaccaggaagtggagtggcaaaaacactggttccccgacctgcaagcgtgggtttgttcagttctgctatgaacccatcaagcaaattattgctacttgcatgaatgaccagaaggataagttgtggcctatgttggcgaagcttggtgtctcaatgaagaatgatgagaaggagcttatgggtaaacctctaatgaagcgtgttatgcagacttggctccctgcaagtactgcactacttgagatgatgatctttcatttgccatctccccacactgcccagaggtaccgtgttgagaatctgtatgaaggtcctcttgatgatcagtatgcaaatgccatcaggaactgtgaccccaatggacctctcatgctctacgtatccaagatgattccagcctctgacaagggtagattctttgccttcggtcgtgtctttgctggtaaggtttctactggtatgaaggtcagaatcatgggtcccaactatatccctggtgagaagaaggatctgtacactaagagtgttcagaggactgtcatttggatgggtaagaggcaagagacagtggaggatgtcccttgtggtaacactgttgctatggttgggctggatcagttcatcaccaagaatgctacattgactaatgagaaggaagttgatgctcaccccattcgtgctatgaagttttctgtgtctcctgttgttcgtgttgctgttcagtgtaaggttgcgtctgaccttcccaagttggttgagggtctcaagaggttggccaagtctgatcctatggttgtgtgtacaatggaggaatcaggtgagcacattgttgctggtgcaggagaactccatcttgagatttgtcttaaggatcttcaggatgatttcatgggtggtgctgaaattatcaagtcagaccctgtggtctccttccgtgagacagtttgtgatagatctactcgcacagttatgagtaagtctcctaacaagcataaccgtctgtacatggaagcaagacccatggaggaaggtctagctgaggctattgatgatggacgtattggcccaagggatgaccctaagatcagatccaagatcttggctgaggagtttggatgggacaaggatcttgcaaagaagatctgggcttttggacctgaaaccacagggcctaacatggttgtcgatatgtgtaagggagttcagtaccttaacgaaatcaaggattcagttgttgctggtttccagtgggcgtccaaggaaggtcctcttgctgaagagaacatgagaggtatctgttttgaggtatgtgatgtggtgcttcactctgatgccatccacagaggaggtggtcaggttatccccacagccagaagggtcatatacgcttcccagatcacagctaagcccagacttttggagccggtttacatggttgagatccaggcaccagagggagctcttggaggaatctacagtgtgctgaatcagaagcgtggacacgtgttcgaggagatgcagaggccaggaactcccttgtacaacatcaaggcatacctgcctgttgtggagtctttcggattctcaagtcagcttagggcagcaacctcaggacaggcattcccacagtgtgtgtttgatcattgggaaatgatgtcttctgaccctcttgagccaggtactcaggcttcagttttggtggctgatatcaggaagaggaagggattgaaggaagcgatgactccactatctgagttcgaagacaagctttaagcttcaccaagactcgtactagcctttttcccaatggttgctactctctctatcttaattttgtcttgttttattaatactcttatggtatgacggattgtgaagacttttctctcgccatcccctgaatgttttttacttttttcctagttgagaactttgttattgtgttcgcaaatatcttggttttgattctgtcttgctctttttttttatattcttttctcttccgatcattcatatattcatgcatattatttaggttacttaccggaacacaggatgtaattgtgttaagtctcagactgttttatc

SEQ ID NO: 2222 - DNA, 2813 bp, Arnica chamissonis
ggtgcaaggttacgtactgtgagcctctctcatttcgccgccgcgtcgccgccgccgccgccgcggcttcctctcgtttctttgcaggaattttgttagaatcatttcaattacattttggcagagatctaaaaactcgccaaaatggtgaagtttactgctgaagagcttcgcaggattatggacctcaagcataacattcgtaatatgtctgttatcgctcatgttgaccatgggaaatctaccttgactgattcccttgtggctgctgctggtattattgcccaagaagttgctggtgatgtccgtatgacagatactcgtgctgatgaagcagaacgtggtatcaccatcaaatctactggtatctcactttactatgagatgactgatgaagctctaaaaagcttcaaaggagaacgtaatggaaacgagtacctgatcaaccttattgactcacctgggcacgttgacttttcttcagaagtcactgctgccctacgtatcactgatggtgccctggtcgtggtagattgtattgagggtgtttgtgttcaaacagaaacagtccttcgacaggctcttggagaaagaattcgacctgttttaacagtcaacaagatggacaggtgtttccttgagcttcaagttgatggtgaagaagcatatcaaacttttcaacgggttattgaaaatgctaatgtgataatggccacatatgaggacccacttcttggtgatgttatggtctaccctgagaaaggtactgttgctttctctgctgggctgcatggttgggcttttactttaacaaactttgcaaagatgtatgcctcaaaatttggtgtcgatgagtcaaaaatgatggaaaggctttggggagagaattactttgacccgaaaccaaaaaaatggactaccaagagcactggttctgcaacatgtaagcgtggatttgttcagttctgctatgagccaattaagcagattattaacacgtgcatgaacgacaagaaagaccagttgtggccaatgttgactaagctcggtgtcaccatgaagtctgaagagaaagagttgatgggtaaggcattaatgaaacgtgttatgcagaattggcttcctgctgctactgccttgctagaaatgatgatatttcacttgccttctccccacaccgcccaaagataccgtgttgagaatctttatgagggcccactagatgaccaatatgctaatgccatcagaaactgtgaccccgagggcccacttatgctttatgtttccaagatgattcctgcttccgacaagggtcgattctttgcatttggtcgtgtttttgccgggcgggttgctactggtatgaaagttagaatcatgggtcctaactatgtcccgggtgagaagaaggatctgtatgtaaaaagtgttcagagaactgtcatctggatgggaaagaagcaagaaacagttgaggatgtgccatgtgggaacacagttgctatggttggtttggatcaattcatcaccaaaaatgcaacacttacaaacgaaaaggaggttgatgcccatccaattcgagccatgaagttttctgtctcaccagtggttcgtgttgcggtacagtgcaaggttgcatctgatctacccaagctggttgaaggtctgaaacgtcttgctaagtctgaccctatggttgtgtgtaccatggaggagtctggtgaacacattattgctggtgctggtgagctgcatcttgaaatctgtttgaaggacttgcaagatgatttcatgggtggtgctgaaattgttgtttcagacccggttgtctccttccgtgaaaccgttcttgagaaatcgtcccgaactgtgatgagcaagtctcccaacaaacacaaccgtctctacatggaagctagacctatggaggatggtctagccgaggctatagatgaaggcaggatcggtccacgtgatgaccccaaggttcgtggcaagatcctagccgaagagtttggttgggacaaggatttggctaagaagatctggtgttttggtcctgaaaccacagggcctaacatggtggttgatatgtgtaagggagttcagtatttgaacgaaatcaaggattcagtggtggctgggtttcaatgggcttctaaagaaggtgctttggctgaagagaacatgaggggtatctgttttgaagtgtgtgatgtggttctccatgctgatgctattcacagaggtggtggtcaagttattcccaccgccaggagagtgatatacgccgcccagcttacctccaagccacgtttacttgagccggtttacttggttgaaattcaagcgcctgaacaagccttgggtggaatctacagtgtgctgaatcaaaggcgtggacatgtgtttgaagagatgcagaggccgggtaccccactttacaacatcaaggcttatctccctgttgttgaatcatttgggttttctggtgctttgagagcatcaacttctggtcaagctttcccacaatctgtgtttgatcactgggacatgatggggtctgatccattggaagctgggtcgcaggcaagcacactcgtgacccagatccgtaagaggaagggtttgaaggagcagatgacaccactctctgaatttgaggacaagctgtgagctgtcagaacattggttctatttttgcctttgagatattattatcaggtatccttgtttctctttttacggtcggtcatattttcatctaacgttaacttggtctgtactggtgatgttttttttagaattggaca

SEQ ID NO: 2223 - DNA, 2975 bp, Brassica rapa
gggccaaaacttttattgggccacaaagggtcgcgaaaaagcaggggaaaccctaggcatatatcaatcgcctcctctccagctcctctctctcacaagctcttctctctctctccccttcccctccaagacatatcgtacggtgtctacaaatcagagtttgtcaaaatggtgaagtttacatccgatgagcttcgtcggatcatggattacaaacacaacatccgtaacatgtccgttattgcccatgtcgaccatggtaaatccaccctcactgactccttggttgctgctgctggtatcattgctcaagaagttgctggtgacgtccgtatgactgatactcgtgctgacgaggctgaacgtggtatcactatcaagtccacgggtatctctctctactacgagatgaccgatgcttccttgaagagcttcactggcgccagagatggaaacgagtatcttatcaacctcattgactctcctggccacgttgacttctcctctgaggtcactgctgctctccgtatcaccgatggtgcccttgttgtcgtcgactgtattgagggtgtctgtgttcagactgagactgtgcttcgtcaggctcttggtgagaggattaggcccgtgctgactgtgaacaagatggacaggtgtttccttgagcttcaggttgacggtgaggaggcttaccagacgttccagagggttattgagaacgctaatgtgatcatggcgacgtatgaggatcctctccttggtgatgttcaggtttcccctgagaagggaactgtcgccttctctgccggtctccatggatgggccttcacgctgaccaactttgcgaagatgtatgcttctaagtttggtgtggacgagactaagatgatggagaggctgtggggtgagaatttctttgaccctgctacaaggaagtggagcggcaagaacactgggtccgctacttgcaagcgtgggtttgtgcagttctgttatgagcccatcaagcagatcattgccacttgcatgaatgaccagaaggataagttgtggcctatgttgcagaagcttggtgtgcagatgaagtctgatgagaaggagctcatgggtaagcctttgatgaagcgtgtcatgcagacttggctccctgcaagtactgcgttgcttgagatgatgatctttcaccttccgtcgccccacactgcacagaggtaccgtgttgagaatctctatgaaggtcctcttgatgatcagtacgccactgccatcagaaactgtgatcctaatggccctctcatgctctatgtttctaagatgattcctgcctcagacaaggggagattctttgcttttggtcgtgtcttctctggaaaggtgtccaccggtatgaaggtcagaatcatgggtcccaactttgttcctggtgagaagaaggatctttacgtcaagagtgttcagaggactgtcatctggatgggtaagaggcaagagactgttgaggatgttccctgtggtaacaccgttgctatggttggtcttgatcagttcatcaccaagaatgctacgctgacgaacgagaaagaagttgatgctcatcctatccgtgcgatgaagttctctgtgtcccctgttgtacgtgttgctgttcagtgcaaggtcgcttctgatcttcccaagcttgttgagggacttaagaggctggccaagtctgaccctatggttgtgtgcacaatggaggagtcaggtgagcacattgttgctggtgctggagagctccatcttgagatttgcttgaaggatcttcaggatgatttcatgggtggtgcggagattgtcaagtctgaccctgttgtctcattccgtgagactgttttggagcggtctgtgcgtaccgtgatgagcaaatcaccaaacaagcataaccgtctgtacatggaggctaggcccttggaggatggtcttgcggaggcaatagatgacggccgtattggtccaagagatgatcccaagatacgttccaagatattggctgaggagtttggttgggacaaggatcttgcaaagaagatatgggcgtttggacctgaaaccacagggcccaacatggttgttgacatgtgtaagggagttcaatacctgaatgaaatcaaggactctgttgttgctgggttccagtgggcttccaaggaaggtcctctttgtgatgagaacatgagaggaatctgttttgaggtttgcgatgtggtgctccactctgatgctatccacagaggtggtggtcaggttatcccaacagcgaggagggttatttacgcgtcacagctcactgccaagcccagactgttggaaccggtttacatggtggagatccaagcaccagaaggagctcttggaggaatctacagcgtgctgaatcagaagcgtggacacgtctttgaggagatgcagaggccaggaacaccgctgtacaacatcaaggcgtacctgccagtcgttgagtcatttggattctcgagtcagcttagagcagcaacctcaggacaggccttccctcagtgtgtgtttgatcattgggagatgatgtcgtctgacccactggaggcaggatcgcaggcttcaacgttggtggctgacatcaggaagaggaagggtatgaaggaacagatgactccattgtctgatttcgaagacaagctgtaagcagcaagcagccaacaagggtcactatggtcaacccttttctctcgatctctactgcattttgtttactgtttactctgttttggtggttatgatatgacttttatctgcggccaagtccgcttgaatgttttgctttttttagttgagaactggtttatctctgtgtttactctttgcactactactctcttattatcctgtttgtattggaacgttgttataattcgagcttgttaccagcaatgacatgaagatattaggccagaaacaac

SEQ ID NO: 2224 - DNA, 2875 bp, Flaveria ramosissima
ctttatatctcgagagctgaggcactgagagcagctatcgtctagctgccgctttctctcgttttcgcgttggattgtgttagaagctattctgagtgcgttctgaaaaccaggcaaaatggtgaagtttaccgcggaagagcttcggaggattatggactataagcataacattcgtaatatgtctgtgattgctcatgttgaccatgggaaatccaccttgactgattctcttgtggctgctgctggtattattgcccaagaagttgctggtgatgttcgtatgactgatacccgtgctgatgaagcagaacgcggtatcacaatcaaatccactggtatctccctttactatgagatgaccgctgatgctttaaagagcttcaagggagaaagaaacgggaatgagtacctgattaatcttatcgattcacctgggcacgttgacttttcttctgaagttactgctgcactacgtatcactgatggtgccctggtggtggttgattgtattgaaggtgtttgtgtgcaaacagagactgttcttagacaagctcttggagaaagaattcggcctgttttaaccgttaacaagatggacaggtgttttcttgagctccaggttgatggtgaagaagcatatcaaacctttcaaagggttattgaaaatgctaatgtcatcatggcaacctatgaggacccacttcttggtgatgtcatggtttatcctgagaaaggtactgttgctttctcagctgggctccatggttgggcttttactctgaccaactttgcaaagatgtacgcctccaaatttggtgttgacgagtctaaaatgatggaaaggctttggggagagaactactttgacccgaaaaccaaaaagtggaccacaaagagcaccggctctccatcttgcaaacgtgggtttgttcagttctgttatgagccaatcaagcagattattaatacgtgcatgaatgatcaaaaagatcagttgtggcctatgttggctaagcttggtgtcaccatgaaatccgaagagaaagagttgatgggtaaggcattgatgaagcgtgttatgcagaattggcttccagctgctactgctttacttgaaatgatgatctttcatctgccttcaccccacactgcccagaaataccgtgttgagaatctgtatgagggtccgttggacgatcaatatgctaatgctattagaaactgtgacccagatggtcctctcatgctttatgtttctaagatgattcccgcttctgataaaggaagattctttgcatttggtcgtgtttttgctggtaaggtttctactggtttgaaagttaggatcatgggtccaaattatgtccctggcgaaaagaaagatttgtacgtcaagagtgttcagaggactgtcatctggatgggaaagaagcaagaaactgttgaagatgtgccatgtggtaacacagtggctatggttggtttggatcaattcatcacaaaaaacgcaacattgacaaatgaaaaggaggttgatgctcacccgattagagccatgaagttttctgtttcccctgtggtgcgtgttgcggttcagtgtaaggttgcatctgatcttcccaagcttgtcgaaggtcttaaacgtctggctaaatctgaccctatggttgtttgtaccattgaggagtctggtgagcacatcattgctggtgctggtgagctgcatcttgaaatctgtttgaaggacttgcaagatgatttcatgggtggtgctgaaatcgttgtctctgacccggttgtgtcgttccgtgaaaccgtcttggagaaatcctcccgaaccgtgatgagcaagtctccaaacaagcacaaccgtctctacatggaagctaggcctctggaagatggtcttcccgaggctattgacgaaggaaggattggcccacgtgatgaccccaagattcgtggaaagatcttatctgaagaatttggttgggacaaggatctggctaaaaagatctggtgttttggtcctgaaacaaccggacccaacatggttgttgatatgtgtaagggagttcagtatcttaatgaaatcaaggattcagtggttgctgggttccaatgggcttctaaggaaggtgctttggctgaagagaacatgagaggtatttgctttgaagtgtgtgatgttgttctccatgctgatgccattcacagaggtggtggtcaagtcattccaaccgctaggagagtcatctacgccgctcaactcaccgccaagccacgtttacttgagcctgtttacctggtcgaaatccaggccccggagcaagcattgggtggaatctacagtgtgctgaatcaaaggcgtgggcatgtgtttgaagaaatgcagaggccaggtacccctctgtacaacattaaggcatatctcccggtggtagaatcattcgggttctctggtgcgttgagagctgccacttcgggtcaagccttcccacaatgtgtgtttgatcactgggacatgatgggatcagacccattggaagctgggtcccaggcgagcacacttgtgactcagatccgtaagaggaagggtttgaaggagcagatgacaccgctatctgagttcgaggataagctgtaagcggctgaaatgctggccgagatactatcattataatcctcgtagggttcgttggtttactattattttctattaatttgtttttagtctaatgctggtagttctaccggttgtttattgttttattgttgttgacgtaacctgcggacaatggatgctgtctttagtttttcgacgtatttacttttgttttactttattttacggaatttcgttttagaaact

SEQ ID NO: 2225 - DNA, 3001 bp, Podocarpus macrophillus
caaaccctaacgggaaagtgagctgcttctaccgaaaccctagcgtggaataatcatctttattttattttaatatttgggtgtcctaaaggctgccgactctctttatctatttcttgttcgccctctcatatcttatcgttcgtagccgctggaaccgagagcaattttggaaggtctgcagatcgaatacgtgcggtgctactgcctctgcgcggatttcggtcattgctggtttacatctagcaagtgttgttttagtgaatattaaagttagcaaaaatggtgaagtttacagctgaagaactccgtaggattatggacttcaaacataacatacggaatatgtctgttatcgcccatgttgaccatggaaagtccacactcacagattcgttggttgcagctgctggtatcattgcacaagaagttgctggcgatgttagaatgactgatactcgtcaagatgaagctgagcgtggtatcacaattaagtcaactggaatctccctctattacgagatgtctgatgaatctctgaaaagatacacaggcgagaggaatggtaacgagtatttgattaacctgattgattctccagggcatgttgacttctcttcagaggttacagcagccttgcgtatcacagatggtgcattggttgttgtagattgtattgaaggagtttgtgtacagactgaaactgtactacgacaggctcttggtgaaaggattaggccagttcttactgtgaacaagatggacaggtgctttcttgagttgcaagttgagggagaggaagcgtatcagacatttttacgtgtgattgaaaatgcaaatgtcattatggctacttacgaggatcctcttcttggcgattgtcaagtatatccagaaaaaggtactgttgcattctcagctggtctgcatgggtgggcatttactttaacaaattttgcaaaaatgtatgcatcaaaatttggagtggatgaagccaaaatgatggagaggttgtggggtgaaaacttttttgatccagccaccaagaaatggacaaccaaaaacacaggatccaccacatgcaaaagaggctttgttcaattcatttatgagcccattaagcaaattataaacatttgcatgaatgaccaaaaggataagttatggccaatgttgcagaaactaggagttgtaatgaagagtgaagaaaaggatcttgttggaaaggctcttatgaaacgtgtcatgcaaacctggctacctgccagcactgctctacttgagatgatgatattccatcttccttctccatcaaaagcacagagatatagagtagagaacttgtatgaagggcctttggatgatatttatgcaaatgcaatcagaaattgtgatccggaaggtcccttgatgttgtacgtatcaaagatgattcctgcctctgacaaaggacgattctttgcatttggccgtgtttttgcgggtaaagtttccacaggaatgaaggtaaggatcatgggtcctaactatgtccctggccaaaaagaaggacttgtatgtaaaaaagtgtccagagaactgtcatttggatggggaaaaagacaagaatcagttgaggatgtgccttgtggaaatacagttgctatggttggcttggaccagtacattactaagaatgctactctgacaaatgagaaagaggttgatgcccatcccattagagcaatgaagttctctgtgtcacctgttgttcgagttgctgtacagtgcaaggtggcctctgatcttccaaagcttgttgaaggtttgaagcgtcttgccaagtctgatcctatggttgtgtgcaccatcgaggaatctggtgaacatattattgcaggagcaggtgaacttcatcttgagatttgcttgaaggatttgcaggaagattttatgggtggagctgagattgttgtgtctgatccagttgtctcgtttagggaaactgtgttggagaagtcaatccgtactgtgatgagcaagtctccaaataagcataaccgtctctactttgaagcaagacctttggaagaaggtcttcctgaagcaattgatgagggccgcattggtccaagggatgatcctaaggctcgtgccaagattctttccgaagagtttgggtgggataaagatctggctaagaagatttggtgctttggtccagaaaccactggtcccaacatggtggtggatatgtgtaagggagtacaatacctgaatgaaattaaagattcagtggttgctgccttccagtgggcatccaaggaaggtgctcttgctgaagaaaacatgcgtggtatttgctttgaggtttgtgatgttgttttgcatactgatgccatacatagaggaggtggtcagattattccaacagccaggagggttatgtatgcagctcagctgactgcaaaaccaagacttctcgagccagtgtatcttgtggagattcaggcccctgaacaggcgcttggaggtatttatggtgtgctgaatcaaaagaggggtcatgtctttgaggaaatgcagaggccaggaacaccactctataacatcaaagcttacttgcctgttatagagtcatttgggttctctggtactctacgagctgcaacatctgggcaggcattccctcaatgtgtgtttgatcactgggatatgatgaattctgacccaatggatccaggtacacaagcacacaatcttgtgcttgatattcgcaagagaaagggtctgaaagaacagatgacaccactctccgattttgaggataagctttaaagctttcttgttttgcatggtatcttagtagatcatactagtatttgatcaagtccggcagatttcaggaagatgaagggtcaaggattaaatggctctcttgttgagcatgattttttaggttgtgtgttgacaattttagaccctctcaggaacaaattttatatatttgcttactttgact

SEQ ID NO: 2226 - DNA, 2702 bp, Ambrosia trifida
catttctgtcgtagagactctacactagcaaataggtgagttaactgctgaagagctccgtaggattatggactacaagcataacattcgtaatatgtctgttattgctcacgtcgatcatggaaaatccactttgactgattctcttgtggctgctgctggtatcattgcccaagaagttgctggtgatgttcgtatgactgatacccgtgctgatgaagcagaacgtggtatcacaatcaaatccactggtatctcactttactatgagatgactgatgaagctttaaaaagctttaagggagaaaggaacggaaatgagtacctgattaatcttattgactctcccgggcacgttgacttttcctctgaagtcactgctgctctacgtattactgatggtgccctggtggtggttgattgtattgagggcgtctgtgtgcaaacagaaactgttcttagacaagctcttggtgaaagaatccggcctgttttaactgtcaacaagatggacaggtgtttccttgagcttcaggttgatggtgaagaagcataccaaacattccaaagggttattgaaaatgctaacgtcatcatggccacttatgaggacccacttcttggtgatgtcatggtttaccctgagaaaggtactgttgctttctcagctggtctccacggttgggcatttactttaaccaactttgcaaagatgtatgcttccaaattcggtgttgacgagtctaaaatgatggaaagactctggggagagaacttctttgacccaaaaaccaggaagtggaccaccaagagcactggtgcagcaagttgcaaacgtgggtttgttcagttttgctatgagcccattaagcagattatcaacacgtgcatgaacgaccaaaaagatcagttgtggcctatgttgactaagcttggtgtcaccatgaaatctgaagagaaagagttgatgggtaaggcattgatgaagcgtgttatgcagaattggcttcctgctgctaccgctttacttgaaatgatgatctttcatttgccttcacctcacactgcccaaagataccgtgttgagaatctttatgagggtccgttggacgatcaatatgctaatgctattagaaactgtgacccggacggtccccttatgctttatgtttctaagatgattcccgcttctgataagggtcgattctttgcctttggtcgtgtttcgccggtagggtttctactggtctgaaggttaggatcatgggtcccaactatgtccctggtgaaaagaaagacttgtatgtgaagagtgttcagaggactgtcatctggatgggaaagaagcaagaaactgttgaagacgtgccatgtggtaacactgtggctatggttggtttggatcaattcatcaccaaaaacgcaaccctaaccaatgaaaaagaggttgatgctcaccccattcgagccatgaagttttccgtctcacctgtggtgcgtgttgcagttcagtgcaaggtcgcatctgatctccccaagcttgttgaaggtcttaaacgtctggctaaatctgaccctatggttgtctgtaccattgaggagtcaggtgaacacatcattgctggtgctggtgaactgcatcttgaaatctgtttgaaggatcttcaagacgatttcatgggtggtgctgaaattgttgtttcagaccctgttgtgtctttccgtgaaaccgtcttggagaaatcatcccgaaccgtgatgagcaagtctccaaacaagcataaccgtctctacatggaagctagacccatggaggacggtcttgccgaggctattgatgaaggcagggttggtccacgtgatgaccccaaggttcgtggaaagatcttgtctgaggaattcggctgggacaaggatttggctaagaagatctggtgttttggacctgaaacaaccgggcccaacatggttgttgatatgtgtaagggagttcaatatcttaatgaaatcaaggattcagtggttgcaggttttcagtgggcttctaaagaaggcgctttggctgaagagaacatgagaggtatttgttttgaagtgtgcgatgtcgttctccatgctgatgccattcacagaggtggtggtcaagttattccaacagccaggagagtcatctacgcctcccagttgaccgcgaagccacgtctacttgagccagtttacttggttgaaattcaggcaccagagcaagcccttggtggaatctacagcgtgctgaatcaaaggcgtggacacgtgtttgaagaaatgcagaggccgggtacaccactgtacaacatcaaggcttatctccctgtggtggaatccttcgggttctctggtgctttgagagcttcaacttctggtcaagctttcccacaatgtgtgtttgatcattgggacatgatgggttctgatccgttggaagctgggtctcaggcaagcacactcgtgacccagatccgtaagaggaagggtttgaaggagcagatgactccactctctgagtttgaggacaagctgtgagcgctggctgaaatgttatctcctccgggtttcatcatattttctataatgttttttagcttgctggatggatgtatttgttatgttttgttgtcgtgagaagctacttacctgcagacaatgatgtcgttaattttgag

SEQ ID NO: 2227 - DNA, 2620 bp, Flaveria ramosissima
tggattgtgttagaagctattctgagtgtgctctaaaaaccaggcaaaatggtgaagtttaccgcggaagagcttcggaggattatggactataagcataacattcgtaatatgtctgtgattgcgcatgttgaccatgggaaatccaccttgactgattctcttgtggctgctgctggtattattgctcaagaagttgctggtgatgttcgtatgactgatacccgtgctgatgaagcagaacgcggtatcacaatcaaatccactggtatctccctttactatgagatgaccgctgatgctttaaagagcttcaagggagaaagaaacgggaatgagtacctgattaatcttatcgattcacctgggcacgttgacttttcttctgaagttactgctgcactacgtatcactgatggtgccctggtggtggttgattgtattgaaggtgtttgtgtgcaaacagagactgttcttagacaagctcttggagaaagaattcggcctgttttaaccgttaacaagatggacaggtgttttcttgagctccaggttgatggtgaagaagcatatcaaacctttcaaagggttattgaaaatgctaatgtcatcatggcaacctatgaggacccacttcttggtgatgtcatggtttatcctgagaaaggtactgttgctttctcagctgggctccatggttgggcttttactctgaccaactttgcaaagatgtacgcctccaaatttggtgttgacgagtctaaaatgatggaaaggctttggggagagaactactttgacccgaaaaccaaaaagtggaccacaaagagcaccggctctccatcttgcaaacgtgggtttgttcagttctgttatgagccaatcaagcagattattaatacgtgcatgaatgatcaaaaagatcagttgtggcctatgttggctaagcttggtgtcaccatgaaatccgaagagaaagagttgatgggtaaggcattgatgaagcgtgttatgcagaattggcttccagctgctactgctttacttgaaatgatgatctttcatctgccttcacctcacactgcccaaaaataccgtgttgagaatctgtatgagggtccgttggacgatcaatatgctaatgctattagaaactgtgacccagatggtcctctcatgctttatgtttctaagatgattcccgcttctgataaaggaagattctttgcatttggtcgtgtttttgctggtaaggtttctactggtttgaaagttaggatcatagggtccaaattatgtccctggcgaaaagaaagatttgtacgtcaagagtgttcagaggactgtcatctggatgggaaagaagcaagaaactgttgaagatgtgccatgtggtaacacagtggctatggttggtttggatcaattcatcacaaaaaacgcaacattgacaaatgaaaaggaggttgatgctcacccgattagagccatgaagttttctgtttcccctgtggtgcgtgttgcggttcagtgtaaggttgcatctgatcttcccaagcttgtcgaaggtcttaaacgtctggctaaatctgaccctatggttgtttgtaccattgaggagtctggtgagcacatcattgctggtgctggtgagctgcatcttgaaatctgtttgaaggacttgcaagatgatttcatgggtggtgctgaaatcgttgtctctgacccggttgtgtcgttccgtgaaaccgtcttggagaaatcctcccgaaccgtgatgagcaagtctccaaacaagcacaaccgtctctacatggaagctaggcccctggaagatggtcttcccgaggctattgacgaaggaaggattggcccacgtgatgaccccaagattcgtggaaagatcttgtccgaagagtttggttgggacaaggatttggctaaaaagatctggtgttttggccctgaaacaactggtcccaacatggttgttgatatgtgtaagggagttcaatatcttaacgaaatcaaggattcagtggttgctgggttccagtgggcttccaaggaaggtgctttggctgaggagaacatgaggggtatttgctttgaagtttgtgatgttgttctccatgctgatgccattcacagaggtggtggtcaagtcattccaaccgctaggagagtcatatacgctgcccagctcaccgccaagccacgtctacttgaacctgtttacttggttgaaattcaagcaccagagcaagctttgggtggaatctacagtgtgcttaatcaaaggcgtggacatgtgtttgaagaaatgcagaggcccggtactcctctctacaacattaaggcgtatctccctgttgtggaatccttcgggttttctggtgctttgagagcagctacttcaggtcaagctttccctcaatgtgtgtttgatcattgggacatgatgggatcagacccattggaagctggctcccaggccagcacacttgtgacccagatccgtaagaggaagggtttgaaggagcagatgacaccactatctgagtttgaggataagctgtgagcggtgaagatgctggctgagataccatcaattgttatc

SEQ ID NO: 2228 - DNA, 3005 bp, Beta vulgaris
cctctatctttcctccatttctctctaaacgccttctcaggttcttttggtagcttctagtggacttccatattggtcgctttgtttctcttaaacagctgcgaaaatggtgaagttcacagctgacgagctccgtgctatcatggactgcaagcataacatccgtaacatgtctgttatagcccatgtggatcacgggaaatcaacgctcacagattctttggtggctgctgctggtatcattgcccaggaggtggctggcgatgtacggatgactgatacccgtgccgatgaagctgaacgtggtattaccatcaagtccactggaatttctctctactatcagatgacagatgaagctttgcaatcttacaagggagagcgtaagggtaatgattatctcatcaaccttattgattcccctgggcacgttgacttttcatcagaggtcacagctgctcttcgtatcactgatggggcccttgtcgtggttgactgtattgagggtgtatgtgtccagacagagactgtccttcgccaggctcttggtgagaggattaggcctgttcttactgttaataagatggatcgctgcttccttgagcttcaggttgatggagaagaggcttacacaacattccagaaggttattgagaatgcaaatgtcatcatggccacctatgaagatccccttctgggtgatgtccaagtttaccccgaaaagggaacagtggctttctcagctggtctccacggatgggcatttactttgtccaactttgctaagatgtatgcatccaagtttggagttgatgagtctaagatgatggaacgtctttggggtgagaacttttttgacccagccaccaagaagtggacaaccaagaactctggcaatgccagttgtaagcgtggttttgttcaattttgctatgagcccatcaaacagatcatcgctacttgcatgaatgatcaaaaggataaactttggcccatgttgacaaagcttggaatccagatgaagactgaagaaaaggatctaatgggtaaggcattgatgaagcgtgttatgcagacctggctgccagctagcagcgctttgcttgaaatgatgatccatcacttgccatcccctgcaacagctcagagatatcgtgttgagaacttgtacgagggtcctatggacgatgtctatgccactgccatcaggaactgtgaccctgagggacctttgatgctttacgtgtctaaaatgattcctgcatctgataagggtaggttctttgcttttggccgtgtatttgctggaaaggtttcaactggtatgaaggtcaggatcatgggacctaactatgttcccggtgagaagaaggatctttatgttaagaatgtccagagaactgtcatttggatgggaaagaagcaggaaacagttgaggatgttccctgtggaaacactgttgctctcgttggtctggatcagtatatcacaaagaatgctactcttacgaacgagaaggaatcggacgcccatccaattcgtgctatgaagttctctgtgtctcctgttgttcgtgttgctgtgcagtgtaaggttgcttcggatcttcccaagcttgttgaaggtctaaagcgtttggcaaaatcagatcctatggttgtctgtagtattgaggagtctggagagcacattattgctggtgctggtgaactccatctggaaatctgtttgaaggatctgcaggacgacttcatgggtggagctgaaattatcaagtctgacccagttgtgtccttccgggagacagtccttgataggtcagtccgtaccgtaatgagcaagtcccccaacaagcacaatcgtctgtacatggaagcccgcccaatggaagaggggcttgctgaggccattgatgaagggcgaattggcccaagagatgacccaaagaaccgttccaagatcttggctgaggaatacggctgggacaaggatcttgcgaagaaaatctggtgttttggtcctgaaactactggtcccaatatggtggttgatatgtgtaagggagtccagtatctgaatgaaatcaaggactctgttgttgctggtttccagtgggcttcgaaggaaggtgctttggctgaagagaacatgagaggtatctgctttgaagtctgtgatgtggttcttcatactgatgccatccatcgtggtggtggccagattattccaactgctaggagagtcttctatgcttcccagctgactgccaagcccagattgttggagcccgtctaccttgttgagatccaggctcctgaaaatgctctcggtggtatctacagtgttctgaatcagaagcgtgggcacgtgtttgaagaaatgcagagacctggtactcccctctacaacatcaaggcatacctccctgttgttgagtcattcggattttcaagtaccttgagagcttcaacttctggtcaggctttcccccagtgtgtgtttgatcattgggaaatgatgccttctgaccctctggaggcaggatcacaagcttcaacccttgtgtcagttatccgtaagaggaagggattgaaggagcaaatgaccccactttctgaatttgaagacaagctgtgaggattcctctgcgttgaagattttggtagtttttttggtgaagattttctcttatcaatttcattgctgcttgcttactttgtactggttacattgtggacaacactgttttttgttgtgtctgggatttttcttccaatttttggatttaaaattttgttgtagtagtctctattgcctaagcatctgccgtggtagtctctattgccaagatctggtaatgcaattgtgcttattttggtactgaaatcgcttggtatttggctagtttgtgatttgtgttgtgcgcatttgtggggattgttactgtagtgagcatttgtggagattgttactgtagcgaggatttggttcacattgattgcac

SEQ ID NO: 2229 - DNA, 2778 bp, Cajanus cajan
atctgtcaatgcgtgcaggtgaagtttacagctgaagagcttcgtcgcattatggactacaagcacaacattcgtaatatgtctgttattgctcatgttgatcatggaaaatcaactcttacggattctctagtggctgctgctggtattattgcacaagaagttgctggagatgttcggatgacagatactcgtcaagatgaagctgagcgtggcatcacaatcaagtctactggtatctctctttactatgaaatgtccaatgattctctcaagaacttcaagggagaacggaatgggaatgagtacctcatcaaccttattgactctcctgggcacgtggacttctcttctgaggttacagctgccctgcgcattactgatggggcacttgtggtggtagattgtgttgagggggtctgtgtccaaactgaaacagttctccgtcaggctcttggtgaaaggattcggcctgttttgactgttaacaagatggataggtgtttccttgagcttcaggtggatggagaagaagcttatcagacatttcaaagggttattgagaatgctaatgtgattatggctacatatgaagatccccttcttggtgatgttcaggtctacccagagaaaggaactgttgctttttctgctggtttgcatggctgggctttcactctgaccaactttgctaaaatgtatgcctcaaagtttggtgttgatgaggcaaagatgatggaaaggctctggggtgagaatttctttgatccagccaccaagaaatggaccagcaagaatactggttctgctacatgcaagcgtggttttgttcagttttgttatgagcctatcaaacagataatttcaacttgtatgaatgatcagaaggacaagctgtggcctatgttgcaaaaacttggaatcaccatgaaatctgaagagaaagacctaatgggtaaagctctaatgaaacgtgtcatgcagacctggctcccagcaagcactgcacttctggagatgatgattttccatcttccgtccccttcaaaggcccaaaagtatcgtgtagagaacttgtatgagggcccccttgacgatgtttattctactgctatcaggaattgtgatcccgatggacctttaatgctttatgtttcaaagatgattcctgcatctgacaagggcagattttttgcttttggccgtgttttctctggaagggtctcaactggtttgaaagttagaattatgggtccaaattatgtccctggagagaaaaaagacttgtatgtcaagagtgtgcaaaggactgtaatttggatggggaaaaggcaagaaactgttgaggatgtgccttgtggtaacactgttgccatggttggattggaccaatttatcaccaagaatgcaacattaacaaatgaaaaggaagttgatgcacaccctatccgagctatgaagttttctgtctcacctgttgttcgtgttgctgtccagtgcaaggttgcttcggatcttcctaaacttgttgaaggtcttaaacgattggccaaatctgatcctatggtcgtgtgtacgatagaggagtctggagagcacattgttgctggtgctggagaactccaccttgagatctgtttgaaggacttgcaggatgatttcatgggtggagctgagattattaagtcagatcccgttgtctccttccgtgagactgtcttagagagatcttgccgcactgtgatgagcaagtcacccaacaagcacaaccgtctatacatggaggccagacccttggaggaagggcttcctgaggctattgatgatggtcgtattggtccaagggatgaccccaaagttcgttctaaaattttgtctgaagaatttggttgggataaggatcttgcaaagaaaatctggtgttttggacctgatactctgggacctaatatggtggttgatatgtgtaaaggtgttcaatacctgaacgaaattaaagactctgttgttgctggtttccagtgggcatcaagagaaggtgcattggctgaagaaaacatgagggccatctgctttgaagtgtgtgatgttgttctccatgctgatgctattcacagaggtggtggtcagatcattcctactgccaggagagtattttatgcttccatgttgactgcaaagcctaggcttcttgagcccgtgtacctggttgaaatacaggcacctgagcaggctcttggtggcatctacagtgttcttaaccagaaacgtgggcatgtattcgaggaaatgcagcgccctggtaccccattatacaacattaaggcatacctccctgtcattgagtccttcggcttctcaagcacattgagggctgcaacatcaggccaggctttcccccagtgcgtatttgatcactgggatatgatgtcatctgatccattggagtctggatcacaagcttcacagcttgttgctgacattcgtaagaggaaaggtttgaaggagcaaatgacaccactttcagaatatgaggacaagatttaagtaatctagcacgttgaaccttagtattcagttttttaaagtttagaattttgttttgtgtctcttctattgccaattaaagttaaagaaaagctttgctgtactcagctgttaattgcctcttatgggttttagccttttaggaattgtagataacgtaaaggcagcgttgcatcgtcttcgattgaactatttcggagaagttcaatttaaaattactgttttccttca

SEQ ID NO: 2230 - DNA, 2776 bp, Eutrema halophilum
acagaatataagagtgcaaggcaaataatcaagagcaaaatatttgcgaacacataattaagttcttctcaactaaaagtaaaacatcgaggaggggagataaaagagtatcaaatccatcataccaaaatagtaaacaaaaaaaaaaacaaagacaaaaataaggtagagagacggagagagcaaacagcaaatggagagtgctggctgcttacagcttatcttcaaactcagagagtggagtcatcgcttccttcaaacccttcctcttcctgatgtcagccaccagcactgaagcctgagttcctgcctcgagagggtcagatgacatcatttcccagtgatcgaacacacactgcgggaaggcctgtcctgaggttgctgccctaagctgactcgagaatccaaaagactccacgactggcaagtatgccttgatgttgtacagtggtgttccgggcctctgcatctcctcaaagacgtgtccacgcttctgattcagcacgctgtagattcctccaagagctccctctggtgcttggatctccaccatgtaaaccggctccaagagtctgggcttggcagtgatctgagaggcgtagataacccttctggctgtggggataacctgaccaccacctctgtggatggcatcagagtggagcaccacatcgcaaacctcaaaacaaatacctctcatgttctcttctgccaaaggaccttccttggacgcccactggaacccagcaacaactgaatccttgatttcattaaggtactgaactcccttacacatgtcaaccaccatgttaggccccgtggtttcaggtccaaacgcccagatcttctttgcaagatccttgtcccatccaaactcctctgccaagatctttgatcggatcttggggtcgtctcttgggccgatacggccgtcatcaattgcctctgctagaccttcctccatcggcctggcctccatgtaaagacggttgtgcttgttaggggatttgctcatcacagtgcggacagatctctcgaggacagtctcacggaacgacacaacagggtctgacttgatgatctcagctccacccatgaaatcatcctgaagatccttgagacaaatctcaagatggagttctccagcaccagcaacaatgtgctcacctgactcttccattgtgcacacaaccataggatcagacttggccagcctcttgagtccttccacaagcttgggaaggtcggatgcaaccttgcactgaacagcaacacggacaacgggggagacggaaaacttcattgcacgaatagggtgggcatcaacttctttctcattcgtcagggtggcattcttggtgatgaactgatccagcccaaccatggcaacggtgttaccacagggaacgtcttcaacagtctcctgcctcttacccatccaaatgacggttctctggacactcttgacatacaaatctttcttctcaccagggacaaagttgggtcccatgatcctgaccttcataccagtagacaccttaccagcaaagacacgtccaaaggcaaagaatctacccttgtctgaggcgggaatcatcttagaaacgtaaagcatgaggggaccatttggatcacagtttctgatggccgtggcatactgatcatcgaggggaccttcgtacaagttctcaacacggtacctctgagcagtgtggggagatggcaggtgaaagatcatcatctcaagtagtgcggtacttgcaggaagccatgtctgcatgacacgcttcatcaaaggtttacccatgagctccttctcatcattcttcatctggacaccaagcttctgcaacataggccacaacttgtccttctggtcgttcatgcaagtggcaatgatttgcttgatgggttcgtaacagaactggacaaacccacgcttgcaggtcggggaaccagtgtttttgccggtccacttcctggtggcagggtcaaagaaattctcaccccagagcctctccatcattttagattcgtcaacaccaaactttgaagcgtacatcttagcaaagttggtcagagtgaaagcccatccgtggagaccagcagagaaagccacggttcccttttctgggtagacctgaacatcaccgaggagaggatcctcataggttgccatgatgacattagcattctcaatgaccctctggaaagtctggtaagcctcctcaccatcaacctggagttcaaggaaacacctgtccatcttgttaacagtcaagacaggcctaatcctttcaccaagagcttgacggagcacggtctcagtctgcacacagacaccctcaatgcagtcgaccacgacaagagcaccatctgtaatacggagagcggcagtgacctcggacgaaaagtcaacgtgcccaggggagtcgataagattgatgaggtattcgtttccatctctcgctccagtgaaactcttcaaggaagcatcggacatctcgtagtagagagaaataccggtggacttgattgtaataccacgttctgcctcatcagcacgggtatcagtcatacgaacatcaccagcaacttcttgggcaataataccagcggcagcgaccagggagtcagtgagggtagatttcccttaccatggtcgacatgggcaataacagacatattacggatgttgtgcttatagtccataatcctacgaagctcatcggctgtgaacttcacctgcaagtttttttttataaaaattttataa

SEQ ID NO: 2231 - DNA, 2883 bp, Gnetum gnemon
gggctctatttacgtacataccccttcacctggacttgcagctgctgcagcttcttctcatttcggaagcagcggcacaggtagaagcgcagagcatcagagcatttcgcgtcttttgttcgccgtttctgtgcgcgcgaggtttttccatccatatcgattttttttggctgtggtctttaaaatcaagcaaaatggtgaagttcacagcagaagagcttcgcaggatcatggacaaaaaacacaatatcagaaacatgtccgtgatcgctcatgtggaccatggaaagtctactctgacggactctttagtggctgctgctggtattattgcccaggaggttgctggagatgttcgaatgactgatacaagagcggatgaagctgaacgtggtatcaccatcaagtccaccggaatttcactgtactatgagatggacgctgaagctttgaaaattacaaaggggagagggacggaaatgagtatctgattaatttgattgattcccccgggcacgtcgacttctcatctgaagttacggcggcattgcgtattactgatggtgcactggtggtggttgattgtatcgaaggtgtctgtgttcagacagaaactgtgcttcgtcaagctcttggtgagaggattaggcccgttttgactgtaaacaagatggacaggtgtttcttgagttgcaagttgatggagaagaagcatatcaaacgtttcttcgtgtgattgagaatgcaaatgttataatggctacctacgaagatcctcttcttggtgactgtcaggtgtacccagaaaacgggactgttgcattttcagctggcttgcacggttgggcgttcactctcactaactttgcaaaaatgtatgcctctaagtttggtgtggatgaagggaaaatgatggaaaggttgtggggtgagaactactttgatccagccaccaggaaatggacaagcaagaacaccggttcagccacatgtaagaggggttttgttcaatttatctatgagcccattaagcagattatcaacatctgtatgaatgatcagaaggataagctgtggccgatgttgcagaagttgaatgttgtcatgaagagtgaagagaaggaactggttggcaaggccctaatgaagcgtgttatgcaaacttggcttccggcaagcaatgctctgttagagatgatgatatttcaccttccttctccttcgaaggcccagaagtatcgtgtggagaacttatacgaaggacctctcgatgatatctatgcaactgctattaggaactgtgatccagagggacctttaatgttgtatgtttcaaaaatgattccggcttcagataagggccgtttctttgcatttggacgtgttttctctggaagagtggcaaccggtatgaaagttcgaatcatgggacctaactatgttcctggccagaagaaggacctgtatgtgaagagcgtgcagaggactgttatttggatgggtaagagacaagaatctgtcgaagatgttccttgtggaaacactgttgccatggttgggttagatcagttcattaccaaaaatgctacccttacaaatgagaaagacgtggatgcccatcctatcagagcaatgaagttctccgtttcaccagttgtgcgtgttgccgttcagtgcaaggtggcgtctgatcttccaaagcttgtggaaggtttgaaacgtcttgccaagtctgatcctatggttgtttgtacaattgaggaatctggagaacatattgtcgctggtgcaggagaacttcaccttgaaatttgtctgaaggatcttcaggaggactttatgggtggcgctgagattgttgtttctgaccctgtagtctctttcagggaaacggttctggagaagtcgaaccacactgtcatgagcaagtctcccaataagcataacaggctctactttgaagcacgtccgttggaagatggtcttcctgaagcaatagatgaaggtcgtattggtccaaaggatgatccaaaggcacgtgcaaagattttgtcagaagaatttggttgggacaaggatctagcgaagaagatttggtgttttggtccagaaaccactggcccaaacatggttgttgatatgtgtaagggagttcaatatctgaacgaaatcaaggattctgttgttgcggcattccagtgggcttccaaggaaggtgccctcgcagaggaaaacatgagggctatctgttttgaggtctgtgatgttgtattgcacactgatgctatccacagaggaggtggtcagatcattcctactgctagaagagttatgtatgcagcacagttaacagcgaagcctaggttgcttgaaccagtctatcttgtggagattcaagcgcctgagcaggcacttggtggtatatacggtgtgttgaaccagaagagaggtcatgtgtttgaggaattgcagaggccagggactccgctgtacaacatcaaggcatatttgcctgtcattgaatcatttgggttctcaagcactcttcgtgcggcaacatctggacaggcattcccccagtgtgtgtttgaccactgggacatgatgagttctgacccaatggaagcaggttctcaagcaggaaaccttgtggctgatattcgcaagaggaagggtctcaaggaacagatgacacctctgtcagaatacgaagacaagctttgagccaacagttttggttacgtttcgagtgttgattagtgttttcttggtttacttttagattccggatgggaattgaggatgatgttcgagtcaaataactatttgcttattgaatattgttatgttaattttatattattgccgtcatgtctggcggga

SEQ ID NO: 2232 - DNA, 2792 bp, Hordeum vulgare
caggaatttatatttgtagtgtgataatcaaaagcagtcaagatggtgaaattcacagtagaaggactccgcatcatcatggacaagcaaaataatattcgtaacatgtctgttattgctcatgtcgaccacggcaggaaagtctacgcttactgattctctggtggcagctgccgggattattgcacaagaagttgcaggtgacgtccgcatgactgatactcgtgcagatgaagcagagcgtggtatcacaatcaaatccacgggtatatctcttttttatgagatgactgaggaatcactcagggcttataagggcgagagagatggcaatgaatacctgatcaaccttatagattctcctgggcacgttgatttctcttcggaagtcacagctgctcttcgtattactgatggtgctttggtggtggttgactgtattgagggtgtatgtgtgcaaactgagactgtgcttcgccaagcccttggtgagaggattaggcctgtccttaccgtgaacaagatggacagatgcttccttgagcttcaggttgacggcgaggaagcttaccagactttctcccgcgtcattgagaacgccaatgtcattatggcaacatatgaagatgcaaaacttggtgatgtccaagtctacccagagaagggaactgttgctttctcggctggtttacacggatgggcatttactctcacgaactttgctaagatgtatgcctccaagtttggggttgatgaaactaaaatgatggagaggctttggggtgagaacttctttgacccaagcacaaaaaagtggaccaacaagagcactggctctccaacttgcaagagaggttttgttcagttctgctatgatccaatcaagcaaatcattaacacctgcatgaatgaccagaaggataaattgtggcccatgttacacaagcttggtgtgaccatgaagactgatgagaaggagctaatgggcaagcctttaatgaaacgtgttatgcaaacttggctgccagcaagtactgctctacttgagatgatgatattccacctcccttctccttcgaaagcacaaaagtatcgtgtagagaacttgtatgagggcccccttgatgatgtctatgcaactgctataagaaactgtgacccagaaggccctcttatgctgtatgtttccaagatgattccagcatctgacaagggcaggttctttgcgtttgggcgtgtcttctccgggagaattgcaactggcatgaaggtccggatcatgggcccaaactatgttcctggacagaagaaggatctgtacatgaagagtgtccagcgtacagtcatttggatgggaaagaagcaagagtctgttgaggatgttccttgtggtaacactgttgctatggttggcttggatcagtacatcacaaagaatgctaccctgacaaacgagaaggaggttgatgcatgcccaatcagagcaatgaaattttccgtatcccctgttgtacgcgttgctgtccagtgcaaggttgcctctgatcttcccaaacttgtggaaggcttgaagcgcctggcgaagtctgatcctatggttctctgttccatggaagagtctggcgagcatatcattgctggagctggagagctgcaccttgaaatttgcttgaaggatctgcaggaggatttcatgggtggtgctgagattattgtttcccctcctgttgtctctttccgcgagaccgttcttgagaagtcctgccgtaccgtgatgagcaagtccccgaacaagcataaccgtctctacatggaggctcgccccatggaggaaggactggctgaggccattgacgatggtcgcatcggcccacgtgatgatcccaaggtgcgctccaaggtcctgtccgaggagtttggctgggacaaggatctcgccaagaagatttggtgtttcggacccgaaaccactgggccgaatatggttgttgatatgtgcaagggagtgcagtatctgaacgaaatcaaggactccgttgtggccggcttccagtgggcgtcgaaagaaggggcattggcagaagaaaacatgcgtggcatttgctttgaggtctgtgacgtcgtcctccacacagatgctattcacaggggtggcggtcaggtcatcccgacggctagaagggtcatttatgcttctcagctcacggctaagccaaggttactcgagcctgtatacctagtggagatccaggcacctgagaatgcacttggtggcatctatggcgttctcaaccagaagagagggcatgtgtttgaggagatgcagaggcctggtaccccactttacaacatcaaggcttacctacctgttatcgagtcctttggtttctccagcacacttcgggctgcgacgtctggccaggccttcccgcagtgtgtgtttgatcactgggacatgatgtctgctgatcctttggaggcaggatcacaggcggcgcagctggtcttggatatccgcaagaggaaggggttgaaagaacagatgacccctctctccgaattcgaggacaagctctaagcttttgctcccatgtgatctatgatctcgcccagtttttgatctatacttggtctgttgtcaggagattagtactctttttcgtattccagttccttgggttgtcatgtactgagcctatttcggtgtcttatcagatttaacaaataatttaccttagatgatatgtttgattgagtggttgattagtattgttttgtgtctcctaattgca

SEQ ID NO: 2233 - DNA, 2818 bp, Silene vulgaris
ttattcgagcacttggttattggctttgtccgtgaattatctaaacagcaaaaatggtgaagtttacggcagaagagcttcgtgcgattatggacaagaaggagaacatccgtaacatgtctgtcattgcccacgttgatcatggaaaatcaactctcactgattctttggtggctgctgctggtatcattgcccaagaagtggctggtgatgttcggatgactgatactcgtgcagatgaagctgagcgtggtatcaccatcaagtcaactggaatttcattatactatgagatgacagatgcgtctttgcaagcttacaaggggaagcgtgcaggcaatgagtatctgatcaaccttattgattcgcctgggcacgttgacttttcatctgaggttacagctgctctgcgtatcactgatggggcacttgttgttgttgactgtatcgagggtgtctgtgtccagactgaaaccgttcttcgccaagctcttggtgagagaattaggcctgttctgacggttaacaagatggatcgttgtttccttgagctccaggttgatggagaagaggcttacacaaccttccagaaggttattgagaatgctaatgtcattatggctacctatgaagaccctcttctaggtgatgtccaagtttaccctgagaaagggacggttgctttctcagctggtctccatggttgggcatttactctcaccaactttgccaagatgtatgcctctaagtttggagttgacgagactaagatgatggagcgtctttggggtgagaactacttcgacccagccaccaagaagtggaccaccaagaattctggttctcccacttgtaagcgtggttttgttcagttttgttatgagcccatcaagcaaatcatcaacatttgcatgaatgatcaaaaggacaagttgtggccaatgttgaccaagcttggtgttcagctgaagtccgaagagaaggatttggtgggtaaagcattgatgaaacgtgttatgcagatttggctgccagcaagcagtgctttacttgaaatgatgatctatcatttgccatccccggcaactgctcagaagtatcgtgttgagaacttgtatgaagggcccatggatgatcagtatgctactgctattaggaattgtgatcctgatggccctctgatgctttacgtctcgaagatgattccagcctctgacaagggcaggttctttgcttttggtcgtgtgtttgctgggaaggtgtcaaccggagtgaaagttaggatcatgggtcccaactatgttcctggtgagaaaaaagatctgtatgtcaagaatgtccagagaactgttatttggatgggaaagaagcaggaaactgttgaagatgtgccttgtggaaacactgtagctttggttggtctagatcagtttatcaccaaaaatgccactttgaccaacgagaaggaggttgatgctcacccaatccgagcaatgaagttctctgtctcacctgtcgtccgtgttgctgttcagtgtaaggttgcatctgaccttcccaagcttgttgaaggtttaaaacgtcttgccaagtcggaccctatggttgtctgtagtattgaggagtctggtgagcacattattgctggtgctggtgaactccatctcgagatttgtttgaaggatcttcaagatgatttcatgggtggagctgaaatcatcaagtctgaccctgttgtctccttccgtgagaccgttgttgacagatctatccgtactgtgatgagtaagtccccgaacaagcacaatcgtctttacatggaagctaggccactggaagacggtctcgctgaggccattgatgatggaaggatcggcccaagggatgaccctaagaacaggtccaagatcctcgctgaagagtttggctgggacaaggatcttgctaagaaaatctggtgttttggtccggaaaccacaggcccaaacatggtagttgatatgtgtaagggagtccagtacttgaatgaaattaaggactctgttgttgctggtttccaatgggcttccaaagaaggtgccttggctgatgagaacatgaggggtatctgctttgaagtatgtgatgtggttcttcacgctgatgccatccatcgtggtggaggacaagtgattccaactgctagaagggtcatctttgcttctcagttgactgccaagccaaggttgatggagcctgtatacctagtcgagatccaagccccagagggtgctcttggtggcatctacagtgtgttgaatcagaagcgtgggcacgtgtttgaggagatgcagaggccaggaaccccactttataacatcaaagcttatctgcctgtggtggagtcttttggtttctcgagcaccttgagagctgcaacctctggtcaagctttcccacaatgtgtgtttgatcattgggacacgttgggttcagatcctttggaggcgggctctcaggcatcctctctggttactgacattcgtaagagaaagggattgaaggaacagatgacccctctatctgactttgaagacaagctgtgagcatgttgttatgagctggtttcgtatgttactgcattttgtagcttgttgttagccgttctacttgtttttggtacgtttggttttaatggaactagtatttcatgggatatgtagtatggttttaatacttctatggtttcaaggctactgttaatccatttgaggaattttgatgttatcatatgtgcttatgcgtagttatgcatgcttctctgcaatctgtggtttgg

SEQ ID NO: 2234 - DNA, 2649 bp, Mimulus guttatus
ggtgaaattcacagctgatcggctccgtgtgattatggacaacaagcacaacattcgtaacatgtccgtcattgcccatgtcgatcacggaaagtcaactctcaccgattcactcgtcgctgctgccggaatcattgcgcaagaagttgccggcgacgtgaggatgaccgacacgcgagcagacgaagccgagcgcggcatcaccatcaagtcgaccggtatctctctctactacgaaatgaccgacgagtccctgaagggctacgcggggcagagagacggcaacgagtacctcatcaatctgatcgactcgcccggacacgttgacttttcgtccgaagtgactgccgctcttcgtattaccgacggcgcccttgtggttgttgactgtgtcgaaggtgtctgtgttcagacagagaccgtgttgagacaagctctcggagaaagaattcggcctgtccttacggttaataaaatggacaggtgtttccttgagcttcaagtcgacggggaggaagcgtaccagacgttctcgagggttatcgagaatgcgaacgtgatcatggctacgtacgaggaccctcttctcggagatgtgcaggtttaccccgagaagggcaccgttgccttctccgccggcttgcacggctgggcgttcactctaacgaatttcgcgaaaatgtacgcctcgaaattcggcgtggttgagagcaagatgatggagagactttggggcgagaatttcttcgatccgacgactaagaagtggaccaccaagaacacgggaaccgccacctgtaagcgtggattcgtccagttctgctacgagccgatcaagatgatcatcaacacgtgcatgaacgagcagaaggacaagctgtggccgatgctccagaaactcggcgtcacgatgaagtcggacgagaaggagttgttgggcaagcccctgatgaagcgcgtcatgcagacgtggctccccgccagcagcgcgcttctcgaaatgatgatattccacctcccttctcccgccacggctcaaaagtaccgtgtcgagaatctttacgagggcccgctcgacgatgtttacgctagcgcgatccggagctgcgatccagagggccctcttatgctctacgtgtcgaagatgattccggcttccgacaagggaaggttctttgccttcggtagggttttctccgggaaggtttcgaccggtcagaaggtcagaatcatgggcccgaactacgtccccggcgaaaagaaggacctatatgtcaagagtgttcaaagaaccgttatttggatgggcaagaggcaggaaaccgtcgaagacgtaccgtgcgggaacacggtagctatggtggggctcgatcagttcattacgaaaaacgcaactttaacaaacgagaaggaagtggacgcgcatccgattagagcaatgaagttttcggtctccccggtcgtgcgtgtggccgtgcagtgcaaggtggcttcggacctgccgaagcttgtggagggtttgaagcgtttatcgaaatccgatcccatggttgtttgtactatcgaggaatccggtgagcatattatagccggtgcaggggagttgcacctcgagatctgcctgaaagacttggtggacgactacatgggtggggctgagattataaaatccgatccggtcgtctccttccgcgagacggtcatcgacaggtcgtgccgtacggttatgagtaagtcgcccaacaagcacaaccgtctctacatggaggcgaggcctctggaggatgggctagccgaagccatcgacgaggggagaatcggcccgagagacgacccgaagatccgatccaagatcctcgcggaggagttcggctgggacaaggagctggcgaagaagatttgggctttcgggcccgaaacaaccggcccgaatatggttgtcgatatgtgtaagggagttcagtacttgaacgagattaaggactcggtcgttgccggttttcagtgggcttcgaaggagggcccgttggccgaagagaacatgcgtggcatctgcttcgaggtttgcgacgttgttctacacaccgacgccatccacaggggcgggggacaggttatcccgaccgcccggagggttatctacgcgtcgcagattacggcaaagccgaggcttttggagccggtttatctcgtggaaattcaagcgcccgagcaggcgctcggcggcatctacagcgtgctgaatcagaagcgcggacacgtgttcgaggaaatgcagaggcccggtacgccgctttacaacatcaaggcgtacttgccggtggttgagtcgtttggtttctcggctaccctgagagccgcgacttccggtcaagcgttccctcagtgcgtgttcgaccattgggatacgatgagttcggatccgttggaagccggttcgcaggcggctacacttgttgcggatattaggaagaggaagggtttgaaggagcagatgactccactctctgattttgaggataagctctgagttttaaagacttggtttttgttgctttggtttttggattttgtttttgctggttgttttttttgggaataatttggatttttttaacttataatttcttctatggagttttgataatt

SEQ ID NO: 2235 - DNA, 2938 bp, Amsonia hubrichtii
tcattttttctctctcggttttgctctcaacctcgctcgacagtgatctcttctgagccgagatcagagccgcctcttctgccgtgcgttttctctctgaactctttggaggagtatcctccgcctgaatctcttccaatcaagtcgaattctgaaaaccagtcaaaatggtgaagttcacagctgaggagcttcgtagaatcatggactacaagcataacatccgtaatatgtcagttattgctcatgtggatcacggaaagtccacccttacggactctctggttgctgctgctggaatcattgctcaggaagttgctggtgatgttagaatgactgatactcgtcaggatgaagccgaacgtggcattaccatcaagtctactggtatctcattgtattatgagatgtctgatgcttccttgaagaactataaaggagagcgtaatgggaatgagtatctcatcaatcttattgattcccctggacatgtcgatttttcttctgaagttacagctgctcttcgaatcactgatggtgcccttgtggtggttgattgtatcgaaggggtgtgtgtgcaaacagaaactgttctccggcaggcccttggagaaaggattcgacctgtcttgactgttaacaagatggacaggtgttttcttgagctccaggttgatggagaagaagcatatcagacatttcaaagagtcattgaaaatgccaatgtcatcatggcgacctatgaagatgcccttctgggtgatgtccaggtctatccagaaaaaggtacagtcgctttctctgctggattgcatggctgggcttttactctcaccaacttcgcaaatatgtatgccagcaaatttggtgtcgatgagtccaaaatgatggagaggctgtggggggagaacttctttgacccggctaccaaaaagtggacctctaagcatactggagctccttcgtgcaagcgtggttttgttcaattttgttatgaacccatcaagcagatcataagcacttgcatgaatgaccagaaagataaactatggccaatgctacaaaaacttggtgttactatcaaaggtgaagagaaagaattgacgggaaaagctttgatgaagcgtgtgatgcaaacctggctccctgcaagtactgctcttcttgaaatgatgatcttccatcttccatcaccatctacagcccaaagatatcgtgttgagaacttgtatgaaggaccgcttgacgatcaatatgcaaatgctattaggaactgtgatcctgatgggcctctaatgctctatgtttccaagatgattccagcatctgacaagggtagattctttgcttttggtcgtgtcttctccggcaaggtggcaactggttcaaaggttagaattatgggtcccaactatgtacctggtgaaaaaaaggacttgtatgttaagaatgtccagagaacagttatctggatgggtaagaagcaagaaacagtggaagatgtaccatgtggaaacacagttgctatggttggtttggatcaattcatcacaaaaaatgccactttaaccaacgaaaaggaagttgatgctcatccaatcaaagcaatgaagttctctgtatcccctgttgtgcgtgttgctgtgaagtgcaagatcgcatcagatcttcccaagcttgttgagggtttgaagcgtttggcaaaatctgatcctatggttcaatgtacaattgaagaatctggagaacatattattgctggtgctggagaactccaccttgagatctgtttgaaggatttgcaagaggatttcatgggtggggctttacttgatatatctgatcctgtggtttccttccgtgagacagttatcgataagtcatgccgggttgtaatgagcaagtcacctaacaagcacaaccgtctttacatggaagctaggcctttggaggagggccttgctgaggctattgatgagggacgtattggtcctagggatgatccaaaggttcgttccaagattttgtcagaagagtttggctgggacaaggatcttgcaaagaaaatttggtgctttggtcctgagacaatgggccccaatatggtggttgatatgtgcaagggagttcagtacctgagtgaaattaaggattctgtggttgctggattccagtgggcttccaaggaaggtgctctggctgaagaaaacatgaggggtatttgttttgaagtgtgtgatgttgtacttcatgccgatgcaattcacagaggtggtggtcaagtcattccaactgctaggagagtcatttacgcttcccaacttactgccaagcctagacttctagaaccaatctacctggtggagatccaagctcctgagcaagctcttggtggcatttacagtgtcctgaatcaaaaacgtggacatgtatttgaagaaattcagaggccaggtacaccactctacaacattaaggcctatcttcctgttgcagaatcgatgaaattctcagagaccttgagagctaatacttcgggacaggctttcccacaatgtgtgtttgatcactgggacatcatgccatcagatcctttggaacctggaacacaggcatctagtctcgttgcaaatatccgcaagagaaagggtttgaaggagcagataacaccactctccgacttcgaggataggctataagcctaccgagattcttccagttcaaactgatattatgtttgagcacagcaaatatcagtttgtttttttcgctttatattcagacgttacaattttgtattagtatttcagtttttgtttcatgttttgggttatattacttggatattattgtgcttttagaagtccgtcctctgacattgaaaggtttttttctccacattctgtggaggattctttcaatttggtttacatatact

SEQ ID NO: 2236 - DNA, 2560 bp, Eschscholzia californica
tgatatagaaaaggagtaaagatggtgaagttcacagcagaagagctacgcaggattatggacctgaaacacaacatccgtaatatgtctgtcattgcccacgtcgatcatgggaaatccactcttaccgattctttggtggccgctgctggtatcatcgcacaagaagttgctggagatgtacgaatgaccgatacccgtgctgatgaggcagagcgtggtattacaatcaagtccaccggtatctctctctattacgagatgaccgacgcttctttgaaggccttcaagggagaaagaatggggaatgagtatctcatcaaccttattgattcacccggtcacgttgacttctcttccgaggtcacagccgcattgcgtattactgatggtgcccttgtggtggtcgattgcattgaaggtgtttgtgtccaaaccgagactgtccttcgccaggcccttggagaaaggattaggcccgttttaactgttaacaagatggacaggtgctttctcgaactacaggttgacggagaggaggcttatcagaccttccagagggtcattgagaatgccaatgtcattatggctacctatgaagacccacttctcggtgatgtccaagtttaccctgagaaaggaactgttgccttctctgctggtttgcacgggtgggctttcactctgaccaatttcgccaacatgtatgcatcgaagttcggagttgatgtgactaagatgatggagaggctgtggggtgagaacttctttgacccggcaaccaagaaatggaccagcaagaacactggatctccaacttgcaagcgtgggttcgtccagttctgttatgaacctattaagcagattattaacacttgcatgaacgaccagaaggacaagttgtggcctatgttgcagaagcttggagttacaatgaaatctgaggagaaagatctgctcggtaaacccttgatgaagcgtgtgatgcaaacatggctcccagcaagtactgctctacttgaaatgatgatctttcaccttccatctccttccactgctcaaagataccgtgttgagaacttatacgaggggcctcttgatgaccaatatgccaacgctatcagaaactgtgatcctgaaggacccctcatgctttacgtgtctaagatgattcccgcacctgataagggtagattctttgcttttggccgtgttttctctggtaaggttgcaactggtatgaaagttcgaatcatggggcctaactttgttcctggccagaagaaagacttgtatactaaaagtgtccagaggactgtcatctggatgggaaagaggcaagaatcagttgaggatgtaccttgtggtaacacagttgctatggtgggtctggatcaatttatcaccaagaatgcaactctaacaaatgagaaagaagttgatgcccatcctatcagagccatgaaattttcagtatctcctgttgtccgtgtcgctgtccagtgcaaggttgcttccgacctacccaaacttgttgaaggactcaagcgtcttgccaagtccgatcctatggttgtctgttcaattgaggagtctggggagcacattattgctggtgcaggagaactccacctcgagatctgcttgaaggacttgcaagatgatttcatgggtggagcagaaatagtcaagtctgacccagtcgtgtccttccgtgagactgttctagacaaatcatgcagaactgtgatgagcaagtctccaaataagcacaaccgtttgtacatggaagcacgaccccttgaagatgggcttgctgaggcaatcgacgacggcagaattggtccaagagacgaccccaaggtccgctcaaagatcttatccgaggaatttggatgggacaaggatctagccaaaaagatctggtgtttcgggcccgagaccaccggaccaaacatggttgtagacatgtgtaagggagtacagtatcttaatgaaatcaaggactctgtcgttgctgggttccagtgggcttcaaaggaaggagcattggctgaagaaaacatgaggggaatatgttttgaagtatgtgatgttgttctccacgctgatgccatccacagaggtggtggacaagtcatccccacggccagaagagctatctatgcctcacaaatcactgccaagcccaggctattggagccagtctacctagtggagatccaggcgccagagcaggctcttggtggtatttacggggttctgaatcagaaacgtggtcacgtctttgaagaaatgcagaggccgggtactccactatacaacattaaggcttatcttcctgtcgtcgagtcctttgggttttctagtcagcttcgtgctgcaacatcaggacaggctttcccacagtgtgtgtttgatcattgggacgtcatgtcttctgatccatatgaagctggaagccaggctgctgtcctagttgcagacgtcaggaagagaaagggtttcaaggacagatgacaccactttccgaatatgaagacaagctataagcaaaacg

SEQ ID NO: 2237 - DNA, 2770 bp, Helianthus annuus
catatctctcagtcgacaccgatcaagtatcactgagatcacgccgcctcattttgacaggacctgtgacagatagtttgtttgttgttgactcttaaagggagtcaaaatggtgaagtttacggcggaggagctccgcaggatcatggactacaagcataacatccgtaacatgtctgttattgctcatgttgatcacgggaagtcaacgttgaccgactctcttgtggctgctgctggtattatcgcacaagaagttgctggtgatgtacgaatgacggatacacgtgctgatgaagcagaacgcggtatcacaatcaagtcaactgggatctcactttactatgaaatgactgatgaggctctcaagagctttaaaggagaacgtaacgggaatgagtacctcatcaatctcattgactcacccgggcacgttgacttctcatccgaagttactgctgcactccgtatcactgacggtgcattggtggttgttgattgtatcgaaggtgtctgcgtccagaccgaaaccgtccttcgtcaagctctcggtgaaaggattcgacccgtgttgaccgtcaacaaaatggaccgttgtttccttgagcttcaagttgacggagaagaagcataccagacgtttcaaagggttatcgaaaacgctaatgtcattatggctacttatgaggacccgcttctcggtgatgtcatggtttaccctgagaaaggtaccgttgctttctctgctgggttacacggttgggcttttactttgaccaacttcgcgaaaatgtatgcttcaaagtttggtgttgatgaggcgaagatgatggaaaggctctggggtgagaactttttcgacccaaaaaccaaaaagtggacgacaaagaatacgggttctgcttcatgccaacgtggtttcgttcagttctgttacgagcccatcaagatgattattaacacgtgcatgaacgaccagaaagataaactctggcctatgttgaccaaactcggtgttacaatgaagtccgaagagaaggagttaatgggaaaagctttgatgaaacgtgttatgcaaaactggcttccggctgcttgctttacttgaaatgatgatatttcattcaccatctcctcatacagcccaaaaataccgtgttgagaatttgtatgaaggtccgttggatgatatgtacgccaatgctattaggaactgcgatcccgatggcccgcttatgttatatgtgtcgaagatgattcccgcttctgataaaggaaggtttttcgcttttggtcgtgtgtttgctggaaaggtttcgaccggtttgaaggttagaatcatgggcccgaattatgttcccggtgagaagaaagatctgtacgttaaaagtgttcaaaggaccgttatttggatgggaaagaaacaagaaactgttgaagatgttccttgtggaaacacagttgcgatggttggtttagatcagtttattaccaaaaacgctacgctaactaacgagaaggaagtcgacgcacacccgattcgagccatgaaattctccgtctcacctgtcgttcgtgttgcggttcagtgtaaggttgcatccgacttaccaaagctcgtcgaaggtttgaaacggttagctaaatctgaccctatggttgtttgcaccattgaggagtccggcgaacacatcatcgcaggtgccggtgagcttcatctcgaaatctgtttgaaagatctgcaagacgatttcatgggtggtgccgagatcgttgtttctgatcccgtcgtctccttccgtgagacagtgttagaaaaatcatcccgaactgttatgagcaagtccccgaacaaacacaaccgtttgtacatggaagctaggccgatggaggaagggctagcggaggctatagacgagggtcgggtcggtccacgtgacgacccgaaagttcgcggaaaaattttatccgaagagttcggttgggataaggatcttgctaagaaaatctggtgttttgggccggaaaccacgggtccgaacatggtggttgatatgtgtaagggagtgcagtacttgaacgaaattaaagattcggtcgttgcgggtttccaatgggcgtctaaggaacgtgcgttatccgaagagaacatgcggggcatctgtttcgaagtgtgcgatgtcgtcctccacgctgacgccattcaccggggtggcggtctggtgatcccaaccgctaggcgagtcatctacgcgtctcaactgaccgccaaaccccgactgctcgagccggtgtatttggtgtgagattcacgtgccggaacaagctcttggtggaatctacagcgtgctgaaccataggcgtgggcacgtgtttgaagaaatagcacacgccgggcacaccgctgtacaacatcaaggcttacttgcctgtggtcgagtcatttgggttttcaggcgcattgagggcgtctacttctggtcaagctttcccgcaatgtgtgtttgatcattgggacatgatgtcatctgacccgttggaagtcgggtcacaggcgagtacactcgtgacgcagattcgtaagaggaagggtttgaaggagcagatgactccgctttcggagtttgaggacaagctgtgagtcacaagagtattcttgtttggtttggtttcgacattttgatcttattatatttctttggtcattgtgctttaaaggctttggatgttatgtttcgagttgagtagtagactttaattggaattgtag

SEQ ID NO: 2238 - DNA, 2558 bp, Eschscholzia californica
agccgctccaggaacgtttctcatacagatagtttatccctttgatatagaaaaggagtaaaaatggtgaagtttacagcagaagagctgcgcaggattatggacctgaaacacaacatccgtaatatgtctgtcattgcccacgttgatcatgggaaatccactcttaccgattctttggtggccgctgctggtatcatcgcacaagaagttgctggagatgtacgaatgaccgatacccgtgctgatgaggcagagcgtggtattacaatcaagtccaccggtatctctctctattacgagatgaccgacgcttctttgaaggccttcaagggagaaagaatggggaatgagtatctcatcaaccttattgattcacctggtcacgttgacttctcttccgaggtcacagctgcattgcgtattactgatggtgcccttgtggtggtcgattgcattgaaggtgtttgtgtccaaaccgagactgtccttcgccaggcccttggagaaaggattaggcccgttttaactgttaacaagatggacaggtgctttctcgaactacaggttgacggagaggaggcttatcagaccttccagagggtcattgagaatgccaatgtcattatggccacctatgaagacccacttctcggtgatgtccaagtttaccctgagaaaggaactgttgccttctctgctggtttgcacgggtgggctttcactctgaccaatttcgccaacatgtatgcatcgaagttcggagttgatgtgactaagatgatggagaggctgtggggtgagaacttctttgacccggcaaccaagaaatggaccagcaagaacactggatctccaacttgcaagcgtgggttcgtccagttctgttatgaacctattaagcagattattaacacttgcatgaacgaccagaaggacaagttgtggcctatgttgcagaagcttggagttacaatgaaatctgaagagaaagatctgctcggtaaacccttgatgaagcgtgtgatgcaaacatggctcccagcaagtactgctctacttgaaatgatgatctttcaccttccatctccttccactgctcaaagataccgtgttgagaacttgtacgaggggcctcttgatgaccaatatgccaacgctatcagaaactgtgatcctgaaggacccctcatgctttacgtgtctaagatgattcccgcacctgataagggtagattctttgcttttggtcgtgttttctctggtaaggttgcaactggtatgaaagttcgaatcatggggcctaactttgttcctggccagaagaaagacttgtatactaaaagtgtccagaggactgtcatctggatgggaaagaggcaagaatcagttgaggatgtaccttgtggtaacacagttgctatggtgggtctggatcaatttatcaccaagaatgctactctaacaaatgagaaagaagttgatgcccatcctatcagagccatgaaattttcagtatctcctgttgtccgtgtcgctgtccagtgcaaggttgcttccgacctacccaaacttgttgaaggactcaagcgtcttgccaagtccgatcctatggttgtctgttcaattgaggagtctggggagcacattattgctggtgcaggagaactccacctcgagatctgcttgaaggacttgcaagatgatttcatgggtggagcagaaatagtcaagtctgacccagtcgtgtccttccgtgagactgttctagacaaatcatgcagaactgtgatgagcaagtctccaaataagcacaaccgtttgtacatggaagcacgaccccttgaagatgggcttgctgaggcaatcgacgacggcagaattggtccaagagacgaccccaaggtccgctcaaagatcttatccgaggaatttggatgggacaaggatctagccaaaaagatctggtgtttcgggcccgagaccaccggaccaaacatggttgtagacatgtgtaagggagtacagtatcttaatgaaatcaaggactctgtcgttgctgggttccagtgggcttcaaaggaggagcattggctgaagaaacatgaggggaatatgttttgaagtatgtgatgttgttctccacgctgatgccatccacagaggtggtggacaagtcatccccacggccagaagagctatctatgcctcacaaatcactgccaagcccaggctattggagccagtctacctagtggagattcaggcgccagagcaggctcttggtggtatttacggggttctgaatcagaaacgtggtcacgtctttgaagaaatgcagaggccgggtactccactatacaacattaaggcttatcttcctgtcgtcgagtcctttgggttttctagtcagcttcgtgctgcaacatcaggacaggctttcccacagtgtgtgtttgatcattgggacgtcatgtcttctgatccatatgaagctggaagccaggctgctgtcctagttgcagacgtcaggaagagaaagtggtgtcatctgttcc

SEQ ID NO: 2239 - DNA, 2729 bp, Lactuca sativa
ttttttcttacctaacaggtgaagttcacagctgaggagcttcgtaggatcatggactacaagcataacatccgtaacatgtctgttattgctcatgttgatcatggaaagtcaactttgaccgattcacttgttgctgctgctggtatcattgcacaagaagttgctggtgatgtccggatgacagatactcgtgctgacgaggcagaacgtggaatcacaattaaatccactggcatttccctttactatgaaatgactgatgcagccctcaagagtttcaagggagaacgtaatggaaacgagtacttgatcaatcttattgactcacccgggcacgttgacttttcttctgaggtcactgctgccctccgtatcactgatggtgcacttgtggttgtggattgcattgagggcgtttgtgtccaaacagaaactgtccttcgacaagcacttggagaaaggattcgccctgtgttaactgtcaacaaaatggacaggtgtttccttgaactacaggtggatggtgaagaagcatatcaaacattccaaagggttattgaaaatgcaaatgtcatcatggctacatatgaggacccgcttcttggtgatgtcatggtttatcctgaaaaaggtactgttgctttctcagctgggctccacggttgggctttcactctcaccaattttgcaaaaatgtacgcatcaaagttcggtgttgatgagtcaaagatgatggagcgtctttggggtgagaatttttttgacccgaaaacaaaaaaatggacaacaaaaagcactggttctccatcatgcaaacgtggatttgttcagttttgttatgaacccatcaagcagatcatcaacacatgtatgaatgaccagaaagatcaattgtggcctatgttgactaaacttggtgtcaccatgaagtctgatgagaaagagttgatgggaaaagcattgatgaagcgtgtcatgcagacatggctccctgcagcaactgctttactagaaatgatgatctttcatcttccttcacctcacactgcacaaagataccgtgttgagaatctctatgaaggtcctttagatgacatgtatgcaaatgcgattagaaactgtgaccccgatggcccactaatgctttatgtatccaaaatgattcctgcttctgataaagggaggttctttgcttttggccgtgtttttgccgggaaagtttcaaccggtttgaaggtcagaatcatgggtccgaattatgtcccgggtgagaagaaagatctgtatgtgaaaagtgttcaaagaactgttatctggatgggtaagaaacaagaaactgttgaagatgttccgtgtggaaacacagtcgcgcttgttggtcttgatcagtttatcacgaaaaatgcgactttaacaaacgaaaaagaagtcgatgcgcatccgattcgagccatgaagttttcggtttcgccagtggttcgagtcgcggttcagtgcaaagtggcatctgatttaccgaaactcgttgaagggcttaaacggttagccaagtcggaccccatggttgtttgcaccattgaagaatcaggtgaacatatcattgcgggtgcaggggagcttcatttggaaatttgtttgaaagatttacaagatgacttcatgggtggagctgaaattgttgtgtcagaccctgttgtgtctttccgtgaaactgttttggaaaaatcttcaaggactgtaatgagcaagtcaccaaacaagcacaatcggttatacatggaagcgaggccgatggaagacgggcttgctgaagcaatcgacgaggggcgagtcggtccacgagacgacccgaaagttcgcgggaagattttgtctgaagaattcggatgggacaaggatttggcgaaaaaaatctggtgttttggacctgaaacaacgggtcccaacatggttgttgatatgtgtaagggagttcagtatttgaatgaaatcaaggattcggttgttgcagggtttcaatgggcttcaaaagaaggggcgttagcagaagagaacatgagagggatttgttttgaagtgtgtgatgtggtactccatgcggatgccattcatcgtggtggcgggcaggtgattccgactgcccggcgtgtgatttacgcgtcgcagctgactgcaaaaccgcggttgcttgagccagtttacttggtggagattcaggcacctgagcaggcacttggtgggatttacagtgtgttgaatcagagacgtgggcatgtgtttgaggagatgcaaaggcctgggacacctttgtataatatcaaagcgtatctgcctgttgttgagagttttgggttttcgggtgctttaagggcgtctacttcagggcaagcgtttcctcagtgtgtgtttgatcattgggatatgatggggtcggatccattggaagtggggtcacaggcgaatacacttgtgcttcagattcgtaagaggaaaggtctcaaggagcagatgacacccttgtctgactttgaggacaagctttgagtcgttgagatttgagaaccaaataattttttttttcatttttcttttttagtttatttttttaccggttggttcctatatatgcatgatgagagaaacttggtgatggtttaaacttgtgatgactgggtttatttttgacaggttggtggatgatatggtatttttgttttatcgtgtct

SEQ ID NO: 2240 - DNA, 2778 bp, Eutrema parvulum
ttgaatacctttttttatcaacttgcaggtgaagttcacagccgatgagcttcgtaggattatggactacaaacacaacatccgtaatatgtctgttattgcccatgtcgaccatgggaaatccaccctcactgactccctggttgctgctgctggtatcattgcccaagaagttgctggtgatgtgcgtatgactgatactcgtgctgatgaggcagaacgtggtatcacaattaagtccactggtatttctctctactacgagatgaccgatgcttctttgaagagtttcactggggcaagagatggaaacgaataccttatcaatctcattgattcccctgggcacgttgacttttcttctgaggtcactgctgctctccgtattaccgatggtgctcttgtggtggtcgactgtattgagggtgtctgtgtgcagactgagactgtgctccgtcaggcccttggtgagaggattaggcctgtcctaactgtgaacaagatggacaggtgtttccttgagcttcaggttgatggtgaggaggcttaccagactttccagagggttattgagaatgccaatgttatcatggcaacctatgaggaccctcttcttggagatgttcaggtgtatcctgaaaagggaactgtggctttttctgctggtctccacggatgggctttcaccctaaccaactttgccaagatgtacgcctccaagtttggtgttgatgaaactaagatgatggagaggctgtggggtgagaatttctttgaccctgccaccaggaagtggagcagcaaaaacactggttccgcaacctgcaagcgtggatttgtccagttctgttatgaacccatcaagcaaatcattgccacttgcatgaacgaccagaaggacaagctttggcctatgttgcagaagcttggtgtccagatgaagtctgatgagaaggagctaatgggtaaacctttgatgaagcgtgtcatgcagacatggctcccagcaagtactgcactacttgagatgatgatctttcaccttccatctccccacactgcacagaggtaccgtgttgagaacttgtatgaaggtcccctcgatgatcagtatgccactgccatcagaaactgtgatcctaatggccctctcatgctctacgtttctaagatgattccagcctcagacaagggtaggttctttgcttttggtcgtgtcttttctggcaaggtgtccactggaatgaaggtcaggatcatgggtcccaactttgtccctggtgagaagaaggacctgtacgtgaagagtgtccagagaactgtcatctggatgggaaagaggcaagagactgttgaggatgttccctgtggtaacaccgttgctatggttggtcttgaccagttcatcaccaagaatgctaccctgaccaatgagaaagaagttgatgcccaccctatccgtgcaatgaagttttctgtctcacctgttgtccgtgttgctgttcagtgcaaggtcgcttctgaccttcccaaacttgttgagggactcaagaggctggccaagtctgaccctatggttgtgtgcacaatggaagagtcgggtgagcacattgttgctggtgctggagaactccatcttgagatttgtctgaaggatcttcaggatgatttcatgggtggtgctgagatcgtcaagtcagaccctgttgtctcattccgtgagactgtcctggagagatctgtccgtactgtgatgagcaaatcccctaacaagcataaccgtctgtacatggaggccagacccttggaggaaggtctagcagaggcaattgatgatggccgtattggtccaagagatgatcccaagatccgatccaagatcttggcagaggagtttggttgggacaaggatcttgcaaagaagatctgggcgtttggaccagaaaccacagggcccaacatggttgttgacatgtgtaagggagttcagtacctaaacgaaatcaaggattcagttgttgctgggttccagtgggcgtccaaggaaggtcctctttgtgatgagaatatgagaggaatctgctttgaggtttgtgatgtggtgcttcactctgatgctattcacagaggtggtggccaggttattcctacagcaaggagggttatctacgcctcccagctgactgccaagccgagactgttggagccggtgtacatggtggagatccaagcaccagagggagctcttggaggaatttacagcgtgctgaatcagaagcgtggacacgtgtttgaggagatgcagaggcctggaacaccgctgtacaacatcaaggcgtacttgccagtggtggagtcttttggattctcgagtcagcttagggcagcaacctcaggacaggccttcccgcagtgtgtgtttgatcattgggagatgatgtcgtcagaccctctggaggtgggatcccaggcttcgacgctggtggctgacatcaggaagaggaagggtatgaaggaacagatgactccgttgtctgatttcgaagacaagctgtaagcagcaagcacctactctttggtcacatttgctctctctctctaccgtatttttgtctttgttttctgtttactattttggtgttatgatgggattgatgatgacttaatctctcgccatcccctttttttaatgtgttttacttttagttgagaacaaacttctttatttattgtgttcccaaagtattgcactcttttattctcgttgccattaggttg

SEQ ID NO: 2241 - DNA, 2426 bp, Secale cereale
aggcctcacttccttgaaccctttccattctcacggatcgggagcgccgccgcttccccacctctcatctctccgctccggagacggaggccacgcagccccaaggaactattttctttgcgtgacattcaaaaccagtcaagatggtgaagtttacagcggaggagctccgtggaattatggacaagaaaaataatattcgtaacatgtctgttattgctcatgtcgaccacggcaagtctacgcttacggattcccttgtggcagctgctgggattatcgcccaggaagttgctggggatgttcgcatgactgatacccgtgcagatgaggcagagcgtggtattacaatcaaatccacgggtatctctcttttctatcagatgactcctgaatcacttgagatgtacaagggcgacagggatggtgatgagtacctgatcaaccttattgattcacctggccacgttgacttttcttcggaagtcacagctgctcttcgtatcactgatggtgctttggtggttgttgactgtattgagggtgtctgtgtgcagaccgaaactgtgctgcgccaagctcttggtgagaggattaggcctgttcttactgtgaacaagatggacagatgtttccttgagcttcagtttgaaggcgaggaagcatatcagactttctcccgtgtcatcgaaaatgccaatgtcatcatggcaacatatgaagatgtgctccttggtgatgtccaagtgtacccagagaaggggactgttgcattctctgctggtttgcatgggtgggctttcacccttacaaactttgcaaagatgtatgcctccaagtttggtgttgatgaggtgaagatgatggagaggctgtggggtgagaacttctttgacccagccacaaagaaatggaccaccaagaacactggcacagctacctgcaagagaggttttgttcagttctgctacgagccaatcaagcaaatcatcgccacctgcatgaatgatcagaaggataagttgtggcctatgttgaagaagcttggtgtgaccatgaagaatgatgagaaggacttgatgggcaaggctctcatgaagcgtgtgatgcaaacttggctgcctgccagtcgtgctctgcttgagatgatgatatttcacctcccctctccttcaaaggcacagaggtatcgtgtggagaacttgtatgagggtccccttgatgacgtatatgcaaatgctatcagaaactgtgaccctgacggtcctcttatgctgtatgtctccaagatgattccagcatctgacaagggtagattctttgcctttggacgtgttttcgccggtagggttgcaactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcaccaagaatgcaaccctgacaaatgagaaggaagttgatgcctgcccaatcagggcaatgaagttctctgtgtcccctgttgtgcgtgttgctgttcagtgcaaggtggcttctgatcttcctaagcttgttgagggtttgaagcgtctggccaagtctgatcctatggttctctgtaccatcgaagagtctggtgagcatatcattgctggagctggagagcttcatcttgaaatctgtttgaaggatctgcaggatgacttcatgggtggtgctgaaatcattgtttcccctcctgtcgtctccttccgtgagactgttcttgagaagtcctgccgcactgtcatgagcaagtcccccaacaagcataaccgtctttacatggaggctcgcccattggaggagggattggctgaggctatcgatgatggccgtattggcccgcgtgatgatcccaaggtgcgctccaagatcctatctgaggagtttggttgggacaaggacctcgccaagaagatttggtgctttggacctgagacgactggccccaacatggttgttgacatgtgtaagggagtgcagtatctgaatgaaatcaaggactctgttgtggctgggttccagtgggcatcaaaggaaggagcattgtgtgaggagaacatgcgtggtatctgctatgaggtttgtgatgttgttctccacactgatgctattcacaggggtggtggtcaggttatcccaacggcgaggagggtcatttacgcttctcagctcactgccaagccaaggctgctggagcccgtgtacctggttgagatccaggccccggagaacgcacttggtggtatctatggtgttctcaatcagaagagagggcacgtgttcgaggagatgcagagg

SEQ ID NO: 2242 - DNA, 2816 bp, Adiantum capillus-veneris
ctcccagaagttggagtgctgcgcggccaagctcagatccaggtattgggtgtacctctgtaaaggatttttacattgggagtagttttacaagtcagccaaaatggtgaagtttacaactgaagagctgcgtaggatcatggacaagaagaacaacattaggaatatgtctgttatcgcccatgtggatcatgggaaatctaccttaacagactctcttgtggctgctgctggtatcattgctcaagaggtcgctggagatgtgcgcctgacagacacccgtcaagatgaggctgaacgtggcattaccatcaaatctactgggatctccctgtactatgaaatgtctgaaaaatctttgaaagattacaagggtgagaaggatgggaatgactacttgattaatctaattgattctccgggccatgtcgacttttcttcggaggttactgcagctttgcgcatcacagatggtgccttggtggtggtagattgtgtggagggtgtctgtgtgcagactgaaactgtccttcgacaggctctgggtgagaggatcaggcctgttcttacagtcaacaaaatggacaggtgctttcttgagctacaggttgaaggtgaagaggcgtatcagactttccagagggtgatagagaatgcaaatgttatcatggcaacatatgaagatcctctcttgggtgatgttcaggtttatccagagaaaggtaccgttgcattctctgcgggtttgcatggatgggcttttacacttaccaactttgctaagatgtatgccgccaagtttggagtggatgaagctaaaatgatggaaagactctggggtgagaactactttgaccctgcaaccaagaaatggactactaaaaacacagggacttccacgtgccagaggggtttcgtgcagtttatttacaatccaatcaagcagcttattaacatttgtatgaatgatcagaaagataagctctggccgatgctctctaaacttggaattggtttgaaaggtgatgaaaaagagctcagggggaaggctttgatgaagcgtgtcatgcaaacatggcttccagccagtgatgccttgctggagatgatggtgtttcatcttccatctcctgcaaaggcccaaaggtatcgtgttgaaaacttgtatgaagggccattggatgatcaatatgctaatgctatcaggaattgtgatccagagggtcccctcatgctgtatgtttccaagatgattccagcttctgacaagggtcgattctttgccttcggacgtgtctttgctgggaaggtctccactggttcaaaggtaagaatcatgggacccaattatattccaggccaaaagaaagatttgtatgttaagagtgtgcagaggacggtcatttggatgggcaggagacaagagtctgtggaggatgtgccatgtggaaatactgtggctatggttggtctcgatcaatacatcaccaagaatgccactctgacaaatgagaaagaagttgatgcgcatcccatcagggccatgaagttctctgtgtcgcctgttgtgcgtgttgctgtccagtgtaaagttgcctctgatcttccaaagcttgttgaaggtttgaaacgtcttgcaaagtctgatcctatggtggtttgcacaattgaagagtcaggcgaacacatcatcgctggagcaggagaacttcaccttgagatttgtttgaaggacttgcaggatgactttatggggggtgctgaaattgtggtttcagatcctgtcgtgtcattcagggagactgtacttgaaaaatcccatcatacagttatgagtaagtctcctaacaagcacaaccgtctgtactttgaggcaaggcctctagaagagggacttgcggaggcaatagatgacgggcgcattggtcctagagatgatccaaaggctcgcagtaagattctctcagaggagtttgggtgggataaggacttggctaagaaaatttggtgctttggtccagagaccactggaccaaatctagttgtggacatgtgtaaaggagtgcagtacttgaatgaaatcaaggattctgttgttgctgccttccagtgggccacgaaggagggtgcccttgctgaggagaacatgaggggtatagcttttgaggtatgtgatgttgtcctgcatgctgatgccatccacagaggaggcggtcaggttatccctacagcacgacgtgtcatgtatgcatctcaactcacagcaaaaccaaggcttttggaacctgtgtatcttgtggaaattcaagcccctgagcaagcacttggaggtatctatggagtactcaatcagaagagaggacatgtgttcgaagagatacagcgtcctggtaccccactttataatatcaaggcttacttgcctgttatcgagtcctttggtttctcaggtacactccgtgctgccacctctggacaagccttcccgcagtgtgtgtttgaccattgggacatgatgaacagtgaccccatggaagtgggttctcaggctgctcagctggttgttgacattcgtaagaggaaggggttgaaagaacagatcactgccctctctgagtatgaggacaagctgtagagaatctttggaggagacccattgactatgaataatttgccctttttaaattatgctattgactaaactcaagccagaactagctgtttggattcctctggatccaagttttaaggctttttttgctgtgtatcatgtaatgtcagaattttattttatatggatggaaagtttttgcatt

SEQ ID NO: 2243 - DNA, 2865 bp, Pteridium aquilinum
gctgcaagagctcacctcattcctcacagagcagcaggaaaatcaaacctttagtttgaaaggggtgtagccctcatctgccaaaatggtgaagtttacaactgaggagttgcggcggatcatggacaagaagcacaacatccggaacatgtcggtcatagctcacgttgatcacgggaagtccaccctgacagattctctcgtggctgctgcgggtatcatagcccaagaagttgctggagatgtgcggcttacagatactcgtgcggatgaagctgagcgtggcatcaccatcaagtccaccgggatctcactgtattatgagatgagtgatgcttcattgaaggattacaagggtgagaaggatggtaatgattaccttattaatctcattgactcccctgggcatgtcgacttttcttcagacggtcacctgctgccttgcgcatcacagacggtgctttggttgttgtcgactgtgttgagggtgtctgtgttcaaacagaaactgtcctgcgccaggctcttggtgagaggattaggcctgttcttacagttaataaaatggacaggtgcttccttgagctgcaggtagaaggtgaagaggcgtatcagaccttccagagggtgattgagaatgctaatgtcattatggccacctatgaagatccacttctgggtgatgtccaagtctacccggaaaagggcacagttgccttttcagctggtctgcatggatgggctttcaccctcaccaattttgcaaaaatgtatgctgccaaatttggggttgatgagtcaaagatgatggagagactctggggtgagaattacttcgatcctgccactaagaagtggactagcaaaaacactggatcttctacttgctcaaggggttttgtgcaattcatctacaatcctatcaagcagctcatcaatatttgtatgaatgatcaaaaggacaagctgtggcccatgctaacaaagcttggagctagtttgaagggtgatgagaaagaactgaggggcaaggcattgatgaaacgagtgatgcagacctggcttcctgccagtgatgctcttcttgagatgatggtttttcacttgccatctcctgcaacggctcagaggtacagagttgagaacttgtatgaaggacctttggatgatcagtacgctaatgcaatcagaaattgtgatcctgaagggcccttaatgctttatgtttctaagatgattcccgcatccgacaaagggcgattttttgcttttgggcgtgtctttgccgggaaggtgtccacaggctctaaagttcggattatggggcccaactatgttcccggtcaaaagaaagatttgtatgtgaagagcgttcagaggaccgtgatctggatgggcaggaggcaggagtctgtggaggatgtgccttgtggaaacacagtcgcaatggtgggtcttgatcagtatatcacaaagaatgccacgctgacaaatgagaaagaagtggatgcccatcctattagagccatgaagttctccgtttcacctgttgtgcgagttgccgttcagtgcaaggtggcctctgatcttccaaagcttgttgaaggtttgaagcgtttggcaaaatctgatcccatggttgtctgttctattgaggaatctggtgaacacattattgcaggagcaggtgagctgcacttggaaatttgtttgaaagatctgcaggatgatttcatgggtggtgcagaaattgttgtttctgacccggtggtgtcatttagggagactgttcttgagaagtctcaccacaccgtcatgagcaagtctcctaacaagcataatcgcctttattttgaggcaaggcctcttgaggagggtctggctgaggctatagatgatggacgcattggacccagggatgatcctaaagtccgaagcaagatcttgtcggaggaatttggttgggataaggatctggccaagaagatttggtgttttggtccagagactaccgggcctaatctggtggtggacatgtgtaagggagtgcagtatcttaatgaaatcaaggattctgttgttgccgcttttcagtgggctaccaaggagggtgccctggcagaagagaatatgagaggcatagctttcgaggtttgtgatgtggtgttgcatgcagatgccattcacagaggtggtggacaggtcattcccaccgcaaggcgtgtaatgtatgcatctcagctcactgcaaagcctaggctcttggagcctgtttaccttgtggagattcaagcccctgagcaagccttgggtggcatctatggggtgctcaaccagaagagagggcatgtgttcgaagaaattcagcgcccgggtacacctctttacaatattaaggcctatcttcctgtcattgagtcttttggattttcaggcactcttcgtgcggctacttctgggcaagcttttccgcagtgtgtttttgatcactgggacatgatgaacagcgatccgcttgaggcaggctctccggcggcacaactagttatggacattcgtaagaggaagggcctgaaggatcaaattaccccgctatctgagtatgaagataagctgtaaggaggaattttgcaatgatgtgctctaggttctgaggatctaatatatagctatttgagtaccagagttgaaattttcgggaactatttgtgaggtccagagagaaccagtttgtttggaatattttgaaagttttattttttgcctctatcctgcgtagagtggttgtgtgtgggtcaattatatagcttttggttgatgtgtgtatactcgtttcttatgcaaggtaaagcctatttggtcgtt

SEQ ID NO: 2244 - DNA, 3059 bp, Ceratodon purpureus
aagagccctttcgcaactagcgaagagcggcctgctctctctcgctcacagctcctctcgcttctcccccttccgtcgctccttctctttgcccggtgggcgtggacatccctagctcgccaccatggtgaagttttcagctgatgagctccgtgctatcatggacaagaagcacaacatcaggaacatgtccgtgattgcccatgtggatcacggaaagtcgacattgacggattctcttgtggccgctgctggaattatcgcccaggagaccgccggagatgtgcgtcttactgacacccgtaccgatgaggccgagcgtggtattaccatcaagtcgaccggaatctcgttgtactacgagatgtcccaggagtccctcaaggactaccacggtgagaaggacggacacgactacttgatcaacctgatcgattcccccgggcacgtcgacttctcgtctgaggtgactgctgctctccgtatcaccgatggagcgttggtggtggtggattgtatcgagggagtgtgcgtgcagaccgagaccgtgcttcgtcaggcccttggagagaggatcaggcccgtgttgacggtgaacaagatggacaggtgctttttggagttgcaggtggatggtgaggaggcttaccagaccttccagcgtgtgattgagagcgcgaatgtgatcatggcgacgtacgaggacgcgcttctgggagatgtgcaggtgtatcccgagaagggaacggtggctttctccgccggtctccacgggtgggctttcaccctgacaaacttcgcgaagatgtacgctggcaagttcggcgtggacgagaagaagatgatggagaggctgtggggcgagaacttctttgaccccgcgacgaagaagtggacgagcaagaacaccgggtcggcgacctgccagcgtggtttcgtgcagttcgtgtacaacccgatcaagcaggtgattaacatctgcatgaacgaccagaaggacaagctgtggccgatgttggcaaagctgaactgcggtctgaaggccgacgagaaggatttggtcggaaaggctctgatgaagaggacgatgcaggcgtggttgcccgctgccagcgcgctgttggagatgatgatcttccacctgccctctccggctacggcccagaggtacagggtggagaacttgtacgagggtccgttggacgaccagtacgcgaacgcgatcaggaactgtgacccgaacggcccgctgatgctgtacgtgtcgaagatgattcccgcgtccgacaagggtcggttcttcgctttcgggcgtgtgttcgccggaaaggtggcgaccggaatgaaggtgcgcatcatgggcccgaactacgtgcccgggcagaagaaggacctgtacacgaagtcggtgcagaggaccgtgatctggatgggaaggaggcaggagtccgtggaggatgtgccttgcggtaacacggtggcgatggttgggctggaccagttcatcacgaagaacgcgactctgaccggagagaaggaggtggacgcccacccgatccgggcgatgaagttctcggtgtcccctgtggtgcgtgtggcggtgcagtgcaagcacgcgtcggatctgccgaagctggtggaggggctgaagcgtctggcgaagtcggaccccatggtgttgtgtatgatcgaggagagcggtgagcacatcatcgccggtgccggagagttgcatctggagatctgtctgaaggatctgcaggacgacttcatgggaggtgcggagatcgtggtgtcggacccggtggtgtcgttccgtgagacggtgttggacaagtcggttcggacggtgatgagcaagtccccgaacaagcacaacaggctgtacttcgaggcacgtcccctggaggagggtctgccggaggcgatcgacgagggaaggatcgggcccagggacgacccgaaggtgcggagcgtgatcctgtcgcaggagttcggatgggacaaggacttggcgaagaagatctggtgtttcggacccgagacgacgggacccaacatggtggtggacatgtgtaagggagtgcagtacctgaacgaaatcaaggactcggtggtggccgcgttccagtgggcgacgaaggagggtgcgttggcggaggagaacatgcgcggtatcgcattcgaggtgtgcgacgtggtgctgcacacagatgccattcatcgtggaggagggcagatcatcccgactgctcggcgtgtgatgtacgcggcgcagctgacggcgaagccccgtctgttggagccggtgtacctggtggagatccaggcccccgagggtgcgttgggaggaatctacggagtgctgaaccagaagcgtgggcacgtgttcgaggaggtgcagaggcccggaacgccgctgtacaacatcaaggcgtacctgcccgtcatcgagtctttcggtttctccggaacgttgcgtgctgcgacctcgggacaggcgttcccacagtgtgtgttcgatcactgggagatgttgaacagcgaccccctggaagccgcaacacagtcagcgaacatcgtgacggacatcaggaagcgcaagggactgaaggagcagatgaccccgttgtcggagtttgaggacaagttgtaagactgcggttgttaatggtgcgtgcaagttctttgtgtgtgtcaggcacttagttgaatttttatatgtctgtgttgagaagcataggcgtgaagccatggcagagtttccaggttggatttagtcagatgaggcatcacctgattattttacttagaagagtactctacgaggaaattttccgatattccggactgttgtattgaacgaccagttcattgccttgttagaaatcgaggacaaagtattagctggctacagccataaacttatctagggcaggagaccttgatctgatttcctaggcctattcgccaatgaatttattcagattgattgcttcattacttttggtcctcggttacgtcaagtgtaaatgccaaatttttacttaagtttgtaa

SEQ ID NO: 2245 - DNA, 2802 bp, Ceratodon purpureus
aagagccctttcgcaactagagaagagcggcctgctctctctcgctcacatctcctctcgcttcttccccttcccccgctccctctctttgcccggtgggcgtggacatccccagctcgccaccatggtgaagttttcagctgatgagctccgtgctatcatggacaagaagcacaacatcaggaacatgtccgttattgcccatgtggatcacggaaagtctacattgacggattctcttgtggccgctgctggaattatcgcccaggagaccgccggagatgtgcgtcttactgacacccgtaccgatgaggccgagcgtggtattaccatcaagtcgaccggaatctcgttgtactacgagatgtcccaggagtccctcaaggactaccacggtgagaaggacggacacgactacttgatcaacctgatcgattcccccgggcacgtcgacttctcgtctgaggtgactgctgctctccgtatcaccgatggagcgttggtggtggtggattgtatcgagggagtgtgcgtgcagaccgagaccgtgcttcgtcaggctcttggagagaggatcaggcccgtgttgacggtgaacaagatggacaggtgctttttggagttgcaggtggatggtgaggaggcttaccagaccttccagcgtgtgattgagagcgcaaatgtgatcatggcgacgtacgaggacgcgcttctgggagatgtgcaggtgtatcccgagaagggaacggtggctttctccgccggtctccacgggtgggctttcaccctgacgaacttcgcgaagatgtacgctggcaagttcggcgtggacgagaagaagatgatggagaggctgtggggcgagaacttctttgaccccgcgacgaagaagtggacgagcaagaacaccgggtcggcgacctgccagcgtggtttcgtgcagttcgtgtacaacccgatcaagcaggtgattaacatctgcatgaacgaccagaaggacaagctgtggccgatgttggcaaagctgaactgcggtctgaaggccgacgagaaggatttggtcggaaaggctctgatgaagaggacgatgcaggcgtggttgcccgctgccagcgcgttgttggagatgatgatcttccacctgccctctccggctacggcccagaggtacagggtggagaacttgtacgagggtccgttggacgaccagtacgcgaacgcgatcaggaactgtgacccgaacggccccctgatgctgtacgtgtcgaagatgattcccgcgtccgacaagggtcggttcttcgctttcgggcgtgtgttcgccggaaaggtggcgaccggaatgaaggtgcgcatcatgggcccgaactacgtgcctgggcagaagaaggacctgtacacgaagtcggtgcagaggaccgtgatctggatgggaaggaggcaggagtccgtggaggatgtgccttgcggtaacacggtggcgatggttgggctggaccagttcatcacgaagaacgcgaccctgaccggagagaaggaggtggacgcccacccgatccgggcgatgaagttctcggtgtcccctgtggtgcgtgtggcggtgcagtgcaagcacgcgtcggatctgccgaagctggtggaggggctgaagcgtctggcgaagtcggaccccatggtgttgtgtatgatcgaggagagcggtgagcacatcatcgccggtgccggagagttgcatctggagatctgtctgaaggatctgcaggacgacttcatgggaggtgcggagatcgtggtgtcggacccggtggtgtcgttccgtgagacggtgttggacaagtcggtgaggacggtgatgagcaagtccccgaacaagcacaacaggctgtacttcgaggcacgtcccctggaggagggtctgccggaggcgatcgacgagggaaggatcgggcccagggacgatccgaaggtgcggagcgtgatcctgtcgcaggagttcggatgggacaaggacttggcgaagaagatctggtgtttcggacccgagacgacgggacccaacatggtggtggacatgtgtaagggagtgcagtacctgaacgaaatcaaggactcggtggtggccgcgttccagtgggcgacgaaggagggtgcgttggcggaggagaacatgcgcggtatcgcattcgaggtgtgcgacgtggtgttgcacacagatgccatccatcgcggaggagggcagatcatcccgactgctcggcgtgtgatgtacgcggcgcagctgacggcgaagccccgtctgttggagccggtgtacctggtggagatccaggcccccgagggtgcgttgggaggaatctacggagtgctgaaccagaagcgtgggcacgtgttcgaggaggtgcagaggcccggaacgccgctgtacaacatcaaggcgtacctgcccgtcatcgagtctttcggtttctccggaacgttgcgtgctgcgacctccggacaggcgttcccacagtgtgtgttcgatcactgggagatgttgaacagcgaccccctggaagccgcaacacagtcagcgaacatcgtgacggacatcaggaagcgcaagggactgaaggagcagatgaccccgttgtcggagttcgaggacaagttgtagactgcggagctggagggattttcagatatctgtgcgttctaggttaagcgttagatggtgtttctgcattccagaggtcagtattgagaagcaagggcaataggtcatggcagagtattcaggctgaatgtattagatgtggaagc

SEQ ID NO: 2246 - DNA, 3059 bp, Ceratodon purpureus
aagagccctttcgcaactagagaagagcggcctgctctctctcgctcacatctcctctcgcttcttccccttcccccgctccctctctttgcccggtgggcgtggacatccccagctcgccaccatggtgaagttttcagctgatgagctccgtgctatcatggacaagaagcacaacatcaggaacatgtccgttattgcccatgtggatcacggaaagtctacattgacggattctctggtggccgctgctggaattatcgcccaggagaccgccggagatgtgcgtcttactgacacccgtaccgatgaggccgagcgtggtattaccatcaagtcgaccggaatctcgttgtactacgagatgtcccaggagtccctcaaggactaccacggtgagaaggacggacacgactacttgatcaacctgatcgattcccccgggcacgtcgacttctcgtctgaggtgactgctgctctccgtatcaccgatggagcgttggtggtggtggattgtatcgagggagtgtgcgtgcagaccgagaccgtgcttcgtcaggcccttggagagaggatcaggcccgtgttgacggtgaacaagatggacaggtgctttttggagttgcaggtggatggtgaggaggcttaccagaccttccagcgtgtgattgagagcgcgaatgtgatcatggcgacgtacgaggacgcgcttctgggagatgtgcaggtgtatcccgagaagggaacggtggctttctccgccggtctccacgggtgggctttcaccctgacgaacttcgcgaagatgtacgctggcaagttcggcgtggacgagaagaagatgatggagaggctgtggggcgagaacttctttgaccccgcgacgaagaagtggacgagcaagaacaccgggtcggcgacctgccagcgtggtttcgtgcagttcgtgtacaacccgatcaagcaggtgattaacatctgcatgaacgaccagaaggacaagctgtggccgatgttggcaaagctgaactgcggtctgaaggccgacgagaaggatttggtcggaaaggctctgatgaagaggacgatgcaggcgtggttgcccgctgccagcgcgctgttggagatgatgatcttccacctgccctctccggctacggcccagaggtacagggtggagaacttgtacgagggtccgttggacgaccagtacgcgaacgcgatcaggaactgtgacccgaacggcccgctgatgctgtacgtgtcgaagatgattcccgcgtccgacaagggtcggttcttcgctttcgggcgtgtgttcgccggaaaggtggcgaccggaatgaaggtgcgcatcatgggcccgaactacgtgcccgggcagaagaaggacctgtacacgaagtcggtgcagaggaccgtgatctggatgggaaggaggcaggagtccgtggaggatgtgccttgcggtaacacggtggcgatggttgggctggaccagttcatcacgaagaacgcgaccctgaccggagagaaggaggtggacgcccacccgatccgggcgatgaagttctcggtgtcccctgtggtgcgtgtggcggtgcagtgcaagcacgcgtcggatctgccgaagctggtggaggggctgaagcgtctggcgaagtcggaccccatggtgttgtgtatgatcgaggagagcggtgagcacatcatcgccggtgccggagagttgcatctggagatctgtctgaaggatctgcaggacgacttcatgggaggtgcggagatcgtggtgtcggacccggtggtgtcgttccgtgagacggtgttggacaagtcggtgaggacggtgatgagcaagtccccgaacaagcacaacaggctgtacttcgaggcacgtcccctggaggagggtctgccggaggcgatcgacgagggaaggatcgggcccagggacgatccgaaggtgcggagcgtgatcctgtcgcaggagttcggatgggacaaggacttggcgaagaagatctggtgtttcggacccgagacgacgggacccaacatggtggtggacatgtgtaagggagtgcagtacctgaacgaaatcaaggactcggtggtggccgcgttccagtgggcgacgaaggagggtgcgttggcggaggagaacatgcgcggtatcgcattcgaggtgtgcgacgtggtgctgcacacagatgccattcatcgtggaggagggcagatcatcccgactgctcggcgtgtgatgtacgcggcgcagctgacggcgaagccccgtctgttggagccggtgtacctggtggagatccaggcccccgagggtgcgttgggaggaatctacggagtgctgaaccagaagcgtgggcacgtgttcgaggaggtgcagaggcccggaacgccgctgtacaacatcaaggcgtacctgcccgtcatcgagtctttcggtttctccggaacgttgcgtgctgcgacctcgggacaggcgttcccacagtgtgtgttcgatcactgggagatgttgaacagcgaccccctggaagccgcaacacagtcagcgaacatcgtgacggacatcaggaagcgcaagggactgaaggagcagatgaccccgttgtcggagtttgaggacaagttgtaagactgcggttgttaatggtgcgtgcaagttctttgtgtgtgtcaggcacttagttgaatttttatatgtctgtgttgagaagcataggcgtgaagccatggcagagtttccaggttggatttagtcagatgaggcatcacctgattattttacttagaagagtactctacgaggaaattttccgatattccggactgttgtattgaacgaccagttcattgccttgttagaaatcgaggacaaagtattagctggctacagccataaacttatctagggcaggagaccttgatctgatttcctaggcctattcgccaatgaatttattcagattgattgcttcattacttttggtcctcggttacgtcaagtgtaaatgccaaatttttacttaagtttgtaa

SEQ ID NO: 2247 - DNA, 3059 bp, Ceratodon purpureus
aagagccctttcgcaactagagaagagcggcctgctctctctcgctcacatctcctctcgcttcttccccttcccccgctccctctctttgcccggtgggcgtggacatccccagctcgccaccatggtgaagttttcagctgatgagctccgtgctatcatggacaagaagcacaacatcaggaacatgtccgttattgcccatgtggatcacggaaagtctacattgacggattctctggtggccgctgctggaattatcgcccaggagaccgccggagatgtgcgtcttactgacacccgtaccgatgaggccgagcgtggtattaccatcaagtcgaccggaatctcgttgtactacgagatgtcccaggagtccctcaaggactaccacggtgagaaggacggacacgactacttgatcaacctgatcgattcccccgggcacgtcgacttctcgtctgaggtgactgctgctctccgtatcaccgatggagcgttggtggtggtggattgtatcgagggagtgtgcgtgcagaccgagaccgtgcttcgtcaggcccttggagagaggatcaggcccgtgttgacggtgaacaagatggacaggtgctttttggagttgcaggtggatggtgaggaggcttaccagaccttccagcgtgtgattgagagcgcgaatgtgatcatggcgacgtacgaggacgcgcttctgggagatgtgcaggtgtatcccgagaagggaacggtggctttctccgccggtctccacgggtgggctttcaccctgacgaacttcgcgaagatgtacgctggcaagttcggcgtggacgagaagaagatgatggagaggctgtggggcgagaacttctttgaccccgcgacgaagaagtggacgagcaagaacaccgggtcggcgacctgccagcgtggtttcgtgcagttcgtgtacaacccgatcaagcaggtgattaacatctgcatgaacgaccagaaggacaagctgtggccgatgttggcaaagctgaactgcggtctgaaggccgacgagaaggatttggtcggaaaggctctgatgaagaggacgatgcaggcgtggttgcccgctgccagcgcgctgttggagatgatgatcttccacctgccctctccggctacggcccagaggtacagggtggagaacttgtacgagggtccgttggacgaccagtacgcgaacgcgatcaggaactgtgacccgaacggcccgctgatgctgtacgtgtcgaagatgattcccgcgtccgacaagggtcggttcttcgctttcgggcgtgtgttcgccggaaaggtggcgaccggaatgaaggtgcgcatcatgggcccgaactacgtgcctgggcagaagaaggacctgtacacgaagtcggtgcagaggaccgtgatctggatgggaaggaggcaggagtccgtggaggatgtgccttgcggtaacacggtggcgatggttgggctggaccagttcatcacgaagaacgcgaccctgaccggagagaaggaggtggacgcccacccgatccgggcgatgaagttctcggtgtcccctgtggtgcgtgtggcggtgcagtgcaagcacgcgtcggatctgccgaagctggtggaggggctgaagcgtctggcgaagtcggaccccatggtgttgtgtatgatcgaggagagcggtgagcacatcatcgccggtgccggagagttgcatctggagatctgtctgaaggatctgcaggacgacttcatgggaggtgcggagatcgtggtgtcggacccggtggtgtcgttccgtgagacggtgttggacaagtcggtgaggacggtgatgagcaagtccccgaacaagcacaacaggctgtacttcgaggcacgtcccctggaggagggtctgccggaggcgatcgacgagggaaggatcgggcccagggacgatccgaaggtgcggagcgtgatcctgtcgcaggagttcggatgggacaaggacttggcgaagaagatctggtgtttcggacccgagacgacgggacccaacatggtggtggacatgtgtaagggagtgcagtacctgaacgaaatcaaggactcggtggtggccgcgttccagtgggcgacgaaggagggtgcgttggcggaggagaacatgcgcggtatcgcattcgaggtgtgcgacgtggtgctgcacacagatgccattcatcgtggaggagggcagatcatcccgactgctcggcgtgtgatgtacgcggcgcagctgacggcgaagccccgtctgttggagccggtgtacctggtggagatccaggccccggagggtgcgttgggaggaatctacggagtgctgaaccagaagcgtgggcacgtgttcgaggaggtgcagaggcccggaacgccgctgtacaacatcaaggcgtacctgcccgtcatcgagtctttcggtttctccggaacgttgcgtgctgcgacctcgggacaggcgttcccacagtgtgtgttcgatcactgggagatgttgaacagcgaccccctggaagccgcaacacagtcagcgaacatcgtgacggacatcaggaagcgcaagggactgaaggagcagatgaccccgttgtcggagtttgaggacaagttgtaagactgcggttgttaatggtgcgtgcaagttctttgtgtgtgtcaggcacttagttgaatttttatatgtctgtgttgagaagcataggcgtgaagccatggcagagtttccaggttggatttagtcagatgaggcatcacctgattattttacttagaagagtactctacgaggaaattttccgatattccggactgttgtattgaacgaccagttcattgccttgttagaaatcgaggacaaagtattagctggctacagccataaacttatctagggcaggagaccttgatctgatttcctaggcctattcgccaatgaatttattcagattgattgcttcattacttttggtcctcggttacgtcaagtgtaaatgccaaatttttacttaagtttgtaa

SEQ ID NO: 2248 - DNA, 2981 bp, Ceratodon purpureus
aagagccctttagcaactagcgaagagcggcctgctctctctcgctcacagctcctctcgcttctcccccttccgtcgctccttctctttgcccggtgggcgtggacatccccagctcgccaccatggtgaagttttcagctgatgagctccgtgctatcatggacaagaagcacaacatcaggaacatgtccgttattgcccatgtggatcacggaaagtcgacattgacggattctcttgtggccgctgctggaattatcgcccaggagaccgccggagatgtgcgtcttactgacacccgtaccgatgaggccgagcgtggtattaccatcaagtcgaccggaatctcgttgtactacgagatgtcccaggagtccctcaaggactaccacggtgagaaggacggacacgactacttgatcaacctgatcgattcccccgggcacgtcgacttctcgtctgaggtgactgctgctctccgtatcaccgatggagcgttggtggtggtggattgtatcgagggagtgtgcgtgcagaccgagaccgtgcttcgtcaggcccttggagagaggatcaggcccgtgttgacggtgaacaagatggacaggtgctttttggagttgcaggtggatggtgaggaggcttaccagaccttccagcgtgtgattgagagcgcgaatgtgatcatggcgacgtacgaggacgcgcttctgggagatgtgcaggtgtatcccgagaagggaacggtggctttctccgccggtctccacgggtgggctttcaccctgacgaacttcgcgaagatgtacgctggcaagttcggcgtggacgagaagaagatgatggagaggctgtggggcgagaacttctttgaccccgcgacgaagaagtggacgagcaagaacaccgggtcggcgacctgccagcgtggtttcgtgcagttcgtgtacaacccgatcaagcaggtgattaacatctgcatgaacgaccagaaggacaagctgtggccgatgttggcaaagctgaactgcggtctgaaagcggacgagaaggatttggtcggaaaggctctgatgaagaggacgatgcaggcgtggttgcccgctgccagcgcgctgttggagatgatgatcttccacctgccctctccggctacggcccagaggtacagggtggagaacttgtacgagggtccgttggacgaccagtacgcgaacgcgatcaggaactgtgacccgaacggcccgctgatgctttacgtgtcgaagatgattcccgcgtccgacaagggtcggttcttcgctttcgggcgtgtgttcgccggaaaggtggcgaccggaatgaaggtgcgcatcatgggcccgaactacgtgcccgggcagaagaaggacctgtacacgaagtcggtgcagaggaccgtgatctggatgggaaggaggcaggagtccgtggaggatgtgccttgcggtaacacggtggcgatggttgggctggaccagttcatcacgaagaacgcgaccctgaccggagagaaggaggtggacgcccacccgatccgggcgatgaagttctcggtgtcccctgtggtgcgtgtggcggtgcagtgcaagcacgcgtcggatctgccgaagctggtggaggggctgaagcgtctggcgaagtcggaccccatggtgttgtgtatgatcgaggagagcggtgagcacatcatcgccggtgccggagagttgcatctggagatctgtctgaaggatctgcaggacgacttcatgggaggtgcggagatcgtggtgtcggacccggtggtgtcgttccgtgagacggtgttggacaagtcggtgaggacggtgatgagcaagtccccgaacaagcacaacaggctgtacttcgaggcacgtcccctggaggagggtctgccggaggcgatcgacgagggaaggatcgggcccagggacgacccgaaggtgcggagcgtgatcctgtcgcaggagttcggatgggacaaggacttggcgaagaagatctggtgtttcggacccgagacgacgggacccaacatggtggtggacatgtgtaagggagtgcagtacctgaacgaaatcaaggactcggtggtggccgcgttccagtgggcgacgaaggagggtgcgttggcggaggagaacatgcgcggtatcgcattcgaggtgtgcgacgtggtgctgcacacagatgccattcatcgtggaggagggcagatcatcccgactgctcggcgtgtgatgtacgcggcgcagctgacggcgaagccccgtctgttggagccggtgtacctggtggagatccaggcccccgagggtgcgttgggaggaatctacggagtgctgaaccagaagcgtgggcacgtgttcgaggaggtgcagaggcccggaacgccgctgtacaacatcaaggcgtacctgcccgtcatcgagtctttcggtttctccggaacgttgcgtgctgcgacctcgggacaggcgttcccacagtgtgtgttcgatcactgggagatgttgaacagcgaccccctggaagccgcaacacagtcagcgaacatcgtgacggacatcaggaagcgcaagggactgaaggagcagatgaccccgttgtcggagttcgaggacaagttgtagactgcggagctggagggatttttcagatatctgtgcgtttctaggttaagcgttagatggtgtttttctgcattccagaggtcagtattgagaagcaagggcaataggtcatggcagagtattcaggctgaatgtatttagatgtggaagcatctgattctgtgatttcgaagagtgagctctccgagtatgtgacctggaattctggaccgttgtggctaattttcttattttatgagagaaactgtttttgcctattgtaatctatgtgtcgtcccatttgttgcttttaatcaatatgctatccgcgaaggtgttcgctaat

SEQ ID NO: 2249 - DNA, 2683 bp, Phalaenopsis aphrodite
ggatcttaagcataatattcgaaacatgtctgttatcgctcatgttgatcatggaaaatcaactctgactgattctcttgtggcggctgcgggcattattgcacaggaagttgccggcgatgttcgaatgacggatactcgtcaagatgaggctgaccgaggcatcactatcaagtctaccggcatctcgctctactatgagatggcagacgaaactctaaagaactacaagggtgagagggtaggaaatgaatatcttatcaatctgattgactcgccaggacacgtggatttctcatccgaagttacagccgcactacgaattactgatggcgctctcgttgtcgtcgactgtgttgagggcgtctgcgtccagacggaaacagtcctgcgacaagctctcggagaaagaatcagacccgtcttaaccgttaacaagatggatcgatgtttcctcgagcttcaggttgaaggtgaagaagcttaccagacttttcagcgggtcatcgagagcgcaaatgttattatggctacatatgaggatcctcttctgggtgatgtccaagtctaccccgagaagggtactgtcgcattctccgcagggctgcatggctgggcttttacgctgacaaattttgctaaaatgtatgcttcgaagtttggggtggatgagagcaaaatgatggagcggctttggggtgagaatttctttgatccggctacgaagaagtggactaccaagaacactggctcgcccacttgcaagcgtggtttcgtccagttctgctacgaaccgatcaagcagattattaagacctgcatgaatgatcagaaggacaagttgtggccgatgctgtcgaagcttggggtctcaatgaaagctgaagagaaggaactggttgggaaggcactgatgaagcgggtgatgcagacttggttgccagctagcaacgctcttcttgagatgatgatatttcacctcccatctccggcgaaggcccagaagtatcgtgttgagaatctatacgaaggtcctcttgatgatcaatatgctaatgctatcagaaactgtgatcctgaaggtcctctaatgctttatgtttcaaaaatgattcctgcatcggataagggcaggttctttgcttttggccgggtttttcaggcaaggtatcgactggtttgaaggtgagaatcatgggaccaaactatgttccaggccagaagaaggatttatatgtcaagagcgtccaacgaactgttatctggatgggagaagcaagagtctgtggaggatgtgccctgcggtaacaccgtcgccatggttggactcgatcaattcatcacgaagaatgctactcttactaatgagaaggaggttgatgcccatcctatcagagccatgaaattctccgtctctcccgtcgttcgtgtcgctgtgagctgcaaggttgcctctgatctcccaaagctcgtggaaggtttaaagcggctctcaaaatctgatcccatggtcgtctgtgccatcgaggaatccggcgagcatattgtcgcaggggccggcgagctccacctcgagatctgcctgaaagatttgcaggaggatttcatgggtggcgcggagattgtggtgtccgaccctgttgtctctttccgtgaaaccgttattgacaaatccagcagaacagtgatgagcaagtctcctaacaagcataaccggctttacatggaagcacgacccttggaagagggcttagcagaggccattgatgatggccgcattggtccgcgcgatgaccccaaggtccgtgccaaggtgctgtctgaagaatttgggtgggacaaagatctagcaaagaagatatggtgttttggcccggagaccactggaccaaacttggtggtcgacatgtgcaagggagtccagtacttgaacgaaatcaaggactccgtagtcgctggttttcagtgggcgtcgaaggagggtgccctcgcagaggagaacatgcgagggatatgctttgaagtatgtgacgtcgtactccatgccgacgcgattcacagaggcggtgggcaagtgattccgaccgcaaggagagttatatacgcctctcaactgacggcgaaacccaggcttctggagcctgtatatctggtggagatccaagctccggagcaggctcttggaggcatatatggcgttctgaaccagaaaagaggccatgtgtttgaagaaatgcagaggccgggcactcctctctacaacatcaaagcttacttacccgtcgttgagtcgttcggtttctcgacggctctgagggcgtcgacctctggccaggccttcccgcagtgtgtgttcgatcactgggacatcatgtcatcggatccgttggaggcgaattcgcaggcggggcaactcgtaacagacattcggaagaggaagggtctgaaggagcagatgacccctctttcggaattcgaagataagctgtaagagaaattttgcaactccaatttgtaggttggtggttatgagtcctctttgaaggtttgtctgtccctttcttttaccctgtttctctgtttttgttctgcgggttattttatgaactatttttattgttgcactaattttatttgtggttggacttgtatgtcacatacttgctgtattctaagttaattt

SEQ ID NO: 2250 - DNA, 2431 bp, Malus domestica
tcttacagactcgcttgttgctgctgcgggtatcattgcacaagaagttgctggtgatgttcggatgactgatactcgcgcagatgaggcagagcgtggtatcacaattaaatctaccggtatctctctgtactatgagatgactgatgagtctttgcagaggtacaagggagagaggaacggaaatgagtacctcatcaatctcattgattcccccgggcacgttgacttttcatctgaagtcacagctgctctgcgtattactgatggagcacttgtggtggtggattgtattgagggtgtgtgtgtccagactgagactgtgctccgtcaagcattgggagagaggatcaggcctgttttgaccgttaacaagatggacagatgcttccttgagctccaggttgatggagaggaagcttaccagacattccaaagggttattgagaatgctaatgtcattatggctacatatgaagatccacttcttggtgatgtccaagtgtacccagagaaaggaacagtcgccttctcagctggtttgcacggttgggctttcactctgaccaacttcgctaagatgtatgcttccaagtttggagttgatgagtcaaagatgatggaaaggctctggggtgagaacttttttgacccagctacgaagaaatggaccagcaagagcaccggcactgctacctgcaagcgtggttttgttcagttctgttacgaacccatcaagcagatcatcaacacctgcatgaatgatcagaaggataagttgtggcccatgttgacaaagcttggtgtcaccatgaagagtgatgagaaggacctgatggggaaggctctgatgaagcgtgttatgcagacctggttaccagctagcactgctttattggaaatgatgatttttcaccttccatctccgtcaacagctcaaaagtaccgtgttgagaatttgtacgagggtcctcttgatgatcaatatgccaatgccatcaggaactgtgaccccgatggacctcttatgctctatgtgtccaagatgattcccgcttctgataagggtagattctttgcctttggccgtgtctttgctggtagagttcagacaggattgaaggttagaatcatgggtccaaattttgttcccggagagaagaaggatttgtacgttaagaacgtacagaggactgttatttggatgggaaagagacaagaaactgttgaggatgttccttgcggtaacactgtggcattggtcggtctggatcagtttattaccaagaatgcaactttaactaatgagaaggaagtggatgctcaccctattcgtgctatgaagttctccgtttcacctgtcgtgcgtgttgctgtccagtgcaaggttgcatctgaccttcccaaacttgttgaaggtctcaaacgtttggccaagtctgatcctatggttgtctgctccattgaggagtcgggagagcacattattgctggtgctggtgaactgcatcttgagatctgtttgaaggatctgcaagatgattttatgggtggtgctgagattataaagtctgaccctgttgtgtccttccgtgagactgtccttgataagtcctgccgtacagtgatgagtaagtctccaaacaagcataaccgtctgtacatggaagcaaggccccttgaggaaggtcttcctgaggctattgatgaaggtcgcattggcccaagagatgatcccaagattcgttccaagatcttggctgaggagtttggttgggacaaggatcttgctaagaaaatctggtgttttggtcccgagaccaccggtcctaacatggtggtcgacatgtgtaagggagttcagtaccttaatgaaatcaaggattcggttgttgctgggttccagtgggcctcaaaggaaggtgcattggcagaagaaaacatgagaggtatttgctttgaagtctgtgatgtggttcttcacgctgatgctatccacagagggggaggtcaggtcattccaactgctcggagggtcatctatgcctctcagctcacagccaagccaaggcttctcgaaccagtgtatctcgttgaaattcaagctccagagggggcacttggcggtatctacagtgttctgaatcagaaacgtgggcatgtgtttgaggagatgcagaggccaggaactccactttacaacatcaaggcatacctccccgtcgttgagtcctttggattctctggtcaactgagggctgcaacttccgggcaggccttcccacaatgcgtgtttgatcattgggagatgatgtcgtctgatccattggaagctggatcccaggctgcaacacttgtcaccgacatccgtaagaggaagggtttgaaggagcagatgaccccgctctctgagttcgaggacaagctataa

SEQ ID NO: 2251 - DNA, 2424 bp, Secale cereale
gtacactgggaggtcgttctccacccgtcttccactttcttcctccggagcgccgccgctcccccatctcccacctctcgggctcgggagccggaagcgaaaccccaaggaactacccagcgtgacattcaaaagcagtcaagatggtgaagttcacagcagaggagctccgtggaattatggataagaagaacaatatcaggaacatgtctgttattgcgcatgttgaccatggcaagtctacgcttacggattcccttgtggcagctgctggaattatcgcccaggaagttgctggtgatgtccgcatgactgatacacgtgcagatgaagcagaacgtggtattactatcaaatccacgggtatctctctgttctatcagatgactcctgaatcacttgagatgtacaagggtgacagagatggggatgagtacctgatcaaccttattgattcacctggtcacgtcgacttttcttcggaagtcacagctgctcttcgtatcaccgatggtgctttggtggtggttgactgtattgagggtgtctgtgtgcagactgaaactgtgctgcgccaagctcttggtgagaggattaggcctgtcctcaccgtgaacaagatggacagatgcttccttgagcttcaagtggaaggtgaggaagcataccagactttctcccgtgtcatcgaaaatgccaatgtcatcatggcaacatatgaagatgtgctccttggtgatgtccaagtgtacccagagaaggggactgttgcattctctgctggtttgcatgggtgggctttcacccttacaaactttgctaagatgtatgcctccaagtttggagttgatgaggcgaagatgatggagaggctgtggggtgagaacttttttgacccagccacaaagaaatggacctccaagaacactgggacagctacctgcaaaagaggttttgttcagttctgctacgagccaatcaagcaaatcatagcaacctgcatgaatgatcagaaggataagttgtggcctatgttgaagaagcttggtgtgaccatgaagaatgatgagaaggacttgatgggcaaggctctcatgaagcgtgtgatgcaaacttggttgcctgccagtcgtgctctgcttgagatgatgatatttcacctcccctctccttcaaaggcacagaggtatcgtgtggagaacttgtatgaggggcctcttgacgatatatatgcaaatgctatcagaaactgtgaccctgacggtcctcttatgctgtatgtctccaagatgattccagcatctgacaagggtagattctttgcctttggacgtgtttttgccgggagggttgcaactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcaccaagaacgcaaccctgacaaatgagaaggaagttgatgcctgcccaatcagggcaatgaagttctctgtgtcccctgttgtgcgtgttgctgttcagtgcaaggtggcatctgatcttcctaagcttgttgagggtttgaagcggcttgcgaagtctgaccctatggttctctgtagcattgaggagtctggtgagcatatcattgctggagctggagagcttcaccttgaaatctgtttgaaggatctgcaggaggacttcatgggtggtgctgaaattattgtttcccctcctgttgtctccttccgtgagactgttctggagaagtcctgccgcactgtcatgagtaagtcccccaacaagcataaccgtctttacatggaagctcgcccattggaggagggattggctgaggctattgatgatggccgcattggcccacgtgatgatcccaaggtgcgctccaagatcctgtctgaggagttcgggtgggacaaggacctcgccaagaagatttggtgctttggacctgagacgactggccccaacatggttgttgacatgtgtaagggagtgcagtatctgaatgaaatcaaggactctgttgtggctgggttccagtgggcatcaaaggaaggtgcattggctgaggagaacatgcgtggcatctgctttgaggtctgtgatgttgttctgcacactgatgctattcacaggggtggtggtcaggtcatcccaacagccaggagggtcatttatgcttctcagctcactgctaagccaaggctgctggagcctgtgtacctggttgagatccaggccccagagaacgcactcggcggtatctatggtgtgctgaatcagaagagagggcacgtgtttgaggagatgcaga

SEQ ID NO: 2252 - DNA, 2743 bp, Setaria italica
atttagatttgtagcgtgatatccaaaggcagtcaagatggtgaagttcacagcggaagagctccgtggcatcatggataagaagaataacattcgtaacatgtctgtcattgctcatgtggaccatggcaagtctacccttacagattcccttgtggcagctgctgggattattgcccaggaagttgctggagatgttcgcatgactgatacccacgcagatgaagcagaacgtggtatcacaatcaagtccactggtatctcactttactatgagatgactgaagagtcactaaagtcgtacaagggtgagagagatgggaatgaatatttgatcaatcttattgattcacctgggcacgttgatttttcctcggaagtcacggctgctctccgtatcactgatggtgctttggtggtggttgactgcattgagggtgtctctgtgcaaactgaaactgttctccgacaagcccttggtaagaggatcaggcctgtcctcactgtgaacaagatggacagatgtttccttgagcttcaagttgaaggtgaggaagcctaccagcctttctcctgtgtcattgagaacgccaatgtcatcatggcgacatatgaagacaagctttttggtgatatccaagtttacccagagaaggggactgttgctttctctgctggtttgcatggctgggcctttaccctcactagctttgcaaagatgtatgcctccaagtttggtgttgacgagactaagatgatggagaggctctggggtgagaacttctttgacccagccacgaagaaatggaccaccaagaacactggttctcctacatgcaagagaggttttgttcagttaatcagttatgctatgagccaatcaagcaaatcatcaacacctgcatgaatgatcagaaggataagttgtggcctatgctgcagaagctcaatgtgacaatgaaggctgatgagaaggagctgattggaaaggctctcatgaagcgtgtgatgcaaacttggctgccagctagtactgccctgcttgagatgatgatattccaccttccgtccccggcgaaggcacagaaatatggtgtggagaacttgtacgagggaccacttgatgatgtctatgcaactgctatcagaaactgcgatccagaaggccccctcatgctttatgtttctaagatgataccagcatgtgacaggggaggttctttgcctttggccgtgtcttctcaggcaagaagaaaggatttgtttgtgaagagtgtccagcgtactgttatctggatgggaaagaaacaggaatccgtggaggatgttccttgtggtaacactgttgctatggttggtctggatcagttcatcactaagaatgctacactgaccaacaagaaggaggttgatgctttcccaatcagggcaatgaagttctctgtgttacctgttgtgcgtgttgctgttcagtgcatggttgcctccgatcttccgaagcttgttgaaggtttgaagcgtctggcgaagtcagatcccatggttctctgtaccattgaggagtctggtgagcacatcattgctggagccggagagcttcaccttgaaatttgtctgaaggatctgcaggaagacttcatgggtggtgctgaaaccattgtttctcctcctgttgtctccttccgtgagactgtccttgaaaagtcctgccgtactgttatgagcacgtccccaaacaagcacaaccatctctacatggaagctcgccccttggaagagggtcttccagaggccattgatgagggccgcattggcccgcgtgatgatcctaaggtgcgctccaagatcctgtctgaggagtttggctgggacaaggatctggccaagaagatttggtgctttggtcctgagaccacaggccccaacatggttgttgatatgtgtaagggagtgcagtaccttaatgaaatcaaggattcagttgtggctggtttccagtgggcatcaaaggaaggagctttggctgaggagaacatgcgtggcatttgctttgaggtctgtgatgttgtcctccatgctgatgctattcacaggggtggtggtcaggttatcccaactgccaggagggtcatctatgcgtctcagctcactgcgaagccaaggctgcttgagcctgtctacctggtggggattcaggcccctgagaatgctcttggtggcatctatggtgttctgaaccagaagagaggtcatgtgtttgaggagatgcagaggcctggtaccccgctgtacaacatcaaggcttacctccctgttatcgagtcctttgggttctcaagccagctcagggctgcgtcctcaggtcaggccttccctcagtgtgtctttgaccattgggacacgatgtcttcggatcctttggaagccggctcccaggcggcacagctggtgttggatttccgcaagaggaaggggctgaaggagcagatgaccccgctatctgagttcgaggacaagctataaatctattttttgtgttctacttttggcctgttatggtggaaagaactttgtttttttccctatggtgtcagtcatgtttcacatgaactgtgatatgttagtgttctcctggaagtatgaaactttattttggtctgtcaatgtgaactggtacgaaggttacctgaagcatgtggttgagttattcgtgtatgttatctcctgcagttttgctgcgctt

SEQ ID NO: 2253 - DNA, 2945 bp, Nicotiana benthamiana
atcatagcggcagaattgtaaggtctcacaatcacaattgtcgccgcctacttctctctacactcagaaaataaataattctgtagctgttacagttaacaagtattcaagatggtgaagttcacagctgaagagcttagaaacattatggactacaagcataacattcgtaatatgtctgttattgctcatgtggaccatggaaaatctacccttaccgactctctggtggcggctgctggtattattgctcaggaagtcgcaggtgatgtcagaatgacagatacacgtgcagatgaagctgagcgtggtatcaccatcaagtccactggtatttcactatattatcagatgacagatgaatccttgaagaacttcaagggagagagaaatgggaacgagtacctcatcaacctcattgattcacctgggcacgttgacttctcttctgaagtgactgctgcccttcgtattactgatggtgcacttgttgtggttgactgtgtagaaggtgtctgtgtccagacagagactgtgctccgtcaggccctcggtgaaaggattcgtcctgtcttgacagttaataagatggacaggtgtttccttgagcttcaggttgatggagaggaggcttatcagacattttccagggttattgagaatgctaatgttatcatggctacatatgaggatccccttcttggtgatgtccaggtctatcccgagaaaggtactgttgctttctctgctggattgcacgggtgggctttcactctcaccaactttgccaagatgtatgcttccaagtttggagttgacgagtctaagatgatggaaaggctgtggggtgagaacttctttgaccctgccaccaaaaagtggaccaccaaaaacagcgggtctgctacatgcaagcgtgggtttgttcaattctgttatgagccaatcaagcagattattaacacttgcatgaatgatcaaaaagataagctctggccgatgttgcagaagcttggtgtaaccatgaagtctgaggagaaagagttgatgggcaaggcactgatgaagcgtgtgatgcagacctggcttcctgcaagtactgctcttctggaaatgatgatctttcatctgccatctccttccacagctcaaagataccgtgtggagaacctgtacgagggacctcttgatgatcaatatgccaatgccatcaggaactgtgacccagatgggccacttatgctttatgtatccaaaatgattccagcatcggacaagggtagattctttgcttttggtcgtgtgtttgctggtaaggtttgtactggtatgaaggtcagaatcatgggtcccaactatgtacctggtgaaaagaaggatttgtatgttaagaatgtgcaaagaactgttatttggatgggtaagaagcaagaaactgttgaggatgtcccttgtggtaacactgttgctatggtcggtctggatcaatttattaccaagaatgcaacattgaccaatgagaaggaagttgaggcccatccaatcagggcaatgaagttttctgtctcaccagttgtgcgtgttgctgttcagtgcaagcttgcatctgaccttcccaagcttgttgaagggttgaagcgcctggctaagtctgatcctatggttctttgttctattgaagagtccggagagcatatcattgctggtgctggagaactccaccttgagatctgcttgaaggacttgcaggatgatttcatgggaggtgctgagattatagtgtctgatcctgttgtgtccttccgtgagactgtacttgagaagtcttgtcggactgtgatgagcaagtctcctaacaagcataaccgtttgtacatggaagctagacctttggagaaaggacagagaggctgcttccaatcgatcctcggctcattgaaggaaaggaaaaacaaaaacaaaagagcattagtaggtccagcagaaatagcgtgctttggtccagagacaactggtccaaacatggtggtagatatgtgtaagggagttcagtacctgaatgaaattaaggattctgttgttgctggtttccagtgggcttccaaggaaggtgcattggctgaagagaacatgagaggtatttgctttgaagtctgtgatgttgttcttcatgctgatgctattcacaggggtggtggccaagttattcccactgctaggagggttatctatgcttctcagcttaccgccaagcctcgcctgttggagccggtttaccttgtggagattcaagctccagagcaagcccttggtggcatttatggtgttctgaaccagaagcgtggacatgtgttcgaggagatgcagaggccagggacccctctttacaacatcaaggcataccttcctgtcatcgagtcttttggattctcaggtaccttgagggcagctacttctggtcaagctttcccacaatgtgtgttcgatcattgggacatgatgtcatccgatccattggacgctggtacacaagctcatcaactcgtccttgatatccgcaagaggaagggtttgaagcaggcagtgactcctctgtccgagtttgaggacaagctgtaagcatgcagatggttcagcttggcgggaggttttgatggatacatgcttagttcggatctctgcataagttttgttttacatttatctgtgttttggcgtaccttttaccattttcggtgatgtaggagttttaatcataagtcagctattgcagaacttatttgtcatctaaatgtaagagaatgttgctgtggctttgtttttgaagtgtcttagtttttgctcattgcttttgttgcttcggtggatctctccccccctcccccctgccaatctttctaactctccatgtgtcatttcatcgaatgttgatgtggaattgtttc

SEQ ID NO: 2254 - DNA, 2787 bp, Mesembryanthemum crystallinum
  misc_feature (1301)..(1301): n is a, c, g, or t
ggatcccccgggcgcagaatcgccggttggagatggtgaagttacagctgatgagctcaggaggattatggacctcaaacataacattcgtaatatgtctgttattgcccatgttgatcacgggaaatcaacacttaccgattctttggtcgctgctgctggtatcattgcccaggaagttgctggtgatgtgcggatgactgatacccgtgcagatgaagctgagcgtggtatcaccatcaagtctactggaatttctctctactatgagatgactgatgaagccttggctgcttacaagggagagaaaatgggaaatgattacctcatcaaccttattgattcccctgggcacgttgacttctcatctgaagtcacagctgctctccgtatcactgatggtgctcttgttgtggttgactgtattgagggtgtttgtgtccagacagagactgtcctccgacaggctcttggtgagagaatcaggcctgttctgactgtcaacaagatggaccgttgcttccttgagcttcaggttgatggagaagaggcttacaccactttccagaaggttattgagaatgccaatgtcattatggctacatatgaagacccccttctgggcgatgtcatggtgtaccccgacaaggggacagtggctttctcagctggtctccatggttgggcatttactctctccaactttgctaagatgtatgcatccaagtttggagttgatgagtctaagatgatggagcgtctctggggtgagaacttctttgacccagcaaccaaaaagtggactaccaagaacactggcaacgccacttgcaagcgtggatttgttcagttctgttatgagcccatcaagcagatcatttcaacttgtatgaatgatcaaaaggataagctgtggcctatgttgacaaagcttgggatccagcttaagggtgaggagaaggacttgatgggtaagccattgatgaagcgtgtcatgcagacctggctgccagctagcactgctttacttgaaatgatgatctttcacttgccatccccggcaacagctcaaagatatcgtgttgagaacttgtatgaaggacctatggatgatatttatgccactgccatcaggaactgtgatcctgagggaccattgatgctttatgtttcaaaaatgattcccgcatctgacaagggtaggttctttgcctttggtcgtgtgtttgctggaaaggtgtctactggtatgaaggttagaatcatgggtcctaactttgttcctggagagaagaaggatntttatgttaagaatgtccagagaactgtgatctggatgggtaagaggcaagaaactgttgaggatgtgccttgtggtaacactgtggctttggttggtttggatcaattcatcaccaagaatgcaaccctgaccaacgagaaggaagtagatgctcacccaatccgtgctatgaagttctctgtttcaccagttgtccgtgttgccgttcagtgcaaggttgcatcagaccttcccaagcttgttgaaggtttgaaacgtttggccaaatctgatcctatggttgtctgtagtattgaggagtctggtgagcacatcattgctggtgctggagaactccatctggaaatttgcttgaaggatcttcaggacgacttcatgggtggtgctgaaattgtcaagtctgaccctgttgtgtccttccgtgaaactgttcttgagaggtcaatccgtaccgtgatgagcaagtctccaaacaagcacaaccgtttgtacatggaggctcgaccaatggaggaaggtcttgcagaggccattgacgatggacgtattggcccaagagacgaccccaagatccgttcgaagatcttggccgaggaatttggctgggacaaggatcttgcaaagaagatctggtgtttcggtccagaaaccatgggtcctaacatggttgttgatatgtgtaagggagttcagtaccttaatgaaatcaaggattctgttgttgctggtttccaatgggcatcaaaggaaggtgctctagccgaagaaaacatgaggggtatctgctttgaagtctgtgatgtggttctccacactgatgccatccatcgtggaggtggtcagatcatcccaactgctaggagggtcttctacgcttcccagctgacagccaagcccaggttgttggagccagtttatatggtcgagatccaagcacctgaaggagctcttggtggtatctacagtgttctgaaccagaagcgtggacacgttttcgaggaaatgcagaggcctggtaccccactctacaacatcaaggcatacctcccagtcatcgagtccttcgggttctcaagtaccctgagagctgcaacctctggtcaggccttcccacaatgtgtgtttgatcactgggacatgatgtcttcagacccattggagcctggtagtcaagctgcaaaccacgtgaccgagatccgtaagaggaagggattgaaggagacaatgaccccgctctcagaattcgaagacaagctataagaaatctgtgctcgtaaggatcaattttcttagatttatgtgttacctgcctacctactagtgacattggaacttttgctgtgttgctattttctatcaatttggctatgtatctgcgatactggttttgaatgcctggatcttttccgggtttttggagtttgctatttgtactgtagctgtgatattttgacaactttttatgtagcttcttgtttgcagta

SEQ ID NO: 2255 - DNA, 2847 bp, Physcomitrella patens
ggttttcgaggttaggctagagttgcctctcctctctctctctctcactctcagttgctcttcctttcctcttcctcagttctctattgcccggtgggcgagggtctctcaatctcgccaacatggtgaagttttcagctgatgagctccgtgctatcatggacaagaagcacaatattaggaacatgtcagttattgcccatgtggatcacggaaagtcgactttgacggattccctggtggctgctgctggaatcattgcccaggagaccgccggagatgtgaggctgacggacactcggcaggatgaggcggaccgtggcatcaccatcaagtcgaccggtatctcgctgtactacgagatgacggaggagtcgctgaaggactacaagggcgagaaggacgggcatgattacctgatcaacctgatcgactcgcccgggcatgtggacttttcgtcggaggtgacggcggcgctgcggatcacggacggagctttggtggtggtggactgcgtggagggagtgtgcgtgcagacggagacggtgctgcggcaggcactgggagagaggatcaggccggtgttgactgtgaacaagatggacaggtgctttttggagctgcaggtggagggcgaggaggcgtaccagacgttccagcgggtgatcgagagcgcgaacgtgatcatggcgacgtacgaggacgcgctgctgggggacgtgcaggtgtatccggagaaggggacggtggcgttttcggcgggtctgcacgggtgggcgttcacgctgacgaacttcgcgaagatgtacgcggggaagttcggggtggacgagaagaagatgatggagaggctgtggggggagaactttttcgacccggcgacgaagaagtggacgtcgaagaacacggggtcggcgacgtgccagcgcgggttcgtgcagttcgtgtacaacccgatcaagcaggtgatcaacatctgcatgaacgaccagaaggagaagctgtggccgatgctggcgaagctgaactgcgggctgaaggcggacgagaaggacctggtggggaaggcgctgatgaagaggacgatgcaggcgtggctgccggcggcgagcgcgctgctggagatgatgattcaccatttgccgtcgccggcgacggcgcagaggtacagggtggagaatttgtacgaggggccgctggacgaccagtacgcgaacgcgatcaggaactgcgacccgaacggcccgctgatgctgtacgtgtcgaagatgattccggcgtcggacaaggggcggtttttcgcgttcgggcgcgtgttcgcggggaaggtgtcgacgggaatgaaggtgcggatcatggggccgaactacgtgcccggggggaagaaggacctgtacacgaagtcggtgcagaggacggtgatctggatggggaggaggcaggagtcggtggaggacgtgccgtgcgggaacacggtggcgatggtgggactggaccagttcatcacgaagaatgcgacgctgacgggggagaaggagacggacgcgcacccgatcagggcgatgaagttttcggtgtcgccggtggtgcgggtggcggtgcagtgcaagcacgcgtcggacttgccgaagctggtggaggggctgaagcggctggcgaagtcggacccgatggtgttgtgcatgatcgaggagagcggggagcacatcatcgcgggggcgggagagctgcatttggagatctgtttgaaggatctacaggacgacttcatggggggcgcggagatcgtggtgtcggacccagtggtgtcgttccgggagacggtgttggacaagtcggtgcggacggtgatgagcaagtcgccgaacaagcacaacaggctgtacttcgaggcgcggccgttggaggaggggctgtcggaggcgatcgacgacgggcggatcgggccgcgggacgacccgaaggtgcggtcgcagatactggcgcaggagttcgggtgggacaaggatttggcgaagaagatctggtgtttcgggccggagacgacggggccgaacatggtggtggatatgtgtaagggagtgcagtacctgaacgagatcaaggactcggtggtggcggcgttccagtgggcgacgaaggagggtgcgatggcggaggagaacatgcgcgggatcgcgttcgaggtgtgcgacgtggtgctgcacacggacgcgatccatcgcggaggagggcagatcatcccgacggcgcggcgggtgatgtacgcggcgcagctgacggcgaagccgcggctgctggagccggtgtacctggtggagatccaggcgccggagggtgcattgggaggaatctacggagtgctgaaccagaagcgcggtcacgtgttcgaggaggtgcagaggccggggacgccgctgtacaacatcaaggcgtacttgccggtgatcgagtcgttcgggttttcggggaccttgcgagcggcgacgtcggggcaggcgttcccgcagtgcgtgttcgaccactgggagatgatgaacagcgacccactggaggcgggtactcaggcggcgaccctggtgtcggacatcagaaagcggaaggggttgaaggagcagatgaccccattgtcggatttcgaggacaagttgtagggattgtgctgtgttatgttgtcattatcatttagataggtatttctgagttcaggagacatggacgagaggttattgaagtacatgcggatagtatgtagtcagtttgaggagttggttgtgcttcatggaattttattcaatgtgctggattatctcagaggcattttcattgacaagccgcttggctttt

SEQ ID NO: 2256 - DNA, 2928 bp, Physcomitrella patens
ctcctcctctccaagtgacgagcgccctgccctcctgcatcgctgctcttccttcctccttaattccaccaccgtcgtgggcgcggtaatcccaagctcgccaagatggtgaagttttcggcggacgagctccgcgccatcatggacaagaagcacaacatcaggaacatgtccgtcatcgcccatgtcgatcacggaaagtcgactttaacggattccctggtggctgctgctggaatcattgcccaggagaccgccggagatgtgaggctgacggacactcggcaggatgaggcggaccgtggcatcaccatcaagtcgaccggtatctcgctgtactacgagatgacggaggagtcgctgaaggactacaagggcgagaaggacgggcatgattacctgatcaacctgatcgactcgcccgggcatgtggacttttcgtcggaggtgacggcggcgctgcggatcacggacggagctttggtggtggtggactgcgtggagggagtgtgcgtgcagacggagacggtgctgcggcaggcactgggagagaggatcaggccggtgttgactgtgaacaagatggacaggtgctttttggagctgcaggtggagggcgaggaggcgtaccagacgttccagcgggtgatcgagagcgcgaacgtgatcatggcgacgtacgaggacgcgctgctgggggacgtgcaggtgtatccggagaaggggacggtggcgttttcggcgggtctgcacgggtgggcgttcacgctgacgaacttcgcgaagatgtacgcggggaagttcggggtggacgagaagaagatgatggagaggctgtggggggagaactttttcgacccggcgacgaagaagtggacgtcgaagaacacggggtcggcgacgtgccagcgcgggttcgtgcagttcgtgtacaacccgatcaagcaggtgatcaacatctgcatgaacgaccagaaggagaagctgtggccgatgctggcgaagctgaactgcgggctgaaggcggacgagaaggacctggtggggaaggcgctgatgaagaggacgatgcaggcgtggctgccggcggcgagcgcgctgctggagatgatgattcaccatttgccgtcgccggcgacggcgcagaggtacagggtggagaatttgtacgaggggccgctggacgaccagtacgcgaacgcgatcaggaactgcgacccgaacggcccgctgatgctgtacgtgtcgaagatgattccggcgtcggacaaggggcggtttttcgcgttcgggcgcgtgttcgcggggaaggtgtcgacgggaatgaaggtgcggatcatggggccgaactacgtgcccggggggaagaaggacctgtacacgaagtcggtgcagaggacggtgatctggatggggaggaggcaggagtcggtggaggacgtgccgtgcgggaacacggtggcgatggtgggactggaccagttcatcacgaagaatgcgacgctgacgggggagaaggagacggacgcgcacccgatcagggcgatgaagttttcggtgtcgccggtggtgcgggtggcggtgcagtgcaagcacgcgtcggacttgccgaagctggtggaggggctgaagcggctggcgaagtcggacccgatggtgttgtgcatgatcgaggagagcggggagcacatcatcgcgggggcgggagagctgcatttggagatctgtttgaaggatctacaggacgacttcatggggggcgcggagatcgtggtgtcggacccagtggtgtcgttccgggagacggtgttggacaagtcggtgcggacggtgatgagcaagtcgccgaacaagcacaacaggctgtacttcgaggcgcggccgttggaggaggggctgtcggaggcgatcgacgacgggcggatcgggccgcgggacgacccgaaggtgcggtcgcagatactggcgcaggagttcgggtgggacaaggatttggcgaagaagatctggtgtttcgggccggagacgacggggccgaacatggtggtggatatgtgtaagggagtgcagtacctgaacgagatcaaggactcggtggtggcggcgttccagtgggcgacgaaggagggtgcgatggcggaggagaacatgcgcgggatcgcgttcgaggtgtgcgacgtggtgctgcacacggacgcgatccatcgcggaggagggcagatcatcccgacggcgcggcgggtgatgtacgcggcgcagctgacggcgaagccgcggctgctggagccggtgtacctggtggagatccaggcgccggagggtgcattgggaggaatctacggagtgctgaaccagaagcgcggtcacgtgttcgaggaggtgcagaggccggggacgccgctgtacaacatcaaggcgtacttgccggtgatcgagtcgttcgggttttcggggaccttgcgagcggcgacgtcggggcaggcgttcccgcagtgcgtgttcgaccactgggagatgatgaacagcgacccactggaggcgggtactcaggcggcgaccctggtgtcggacatcagaaagcggaaggggttgaaggagcagatgaccccattgtcggatttcgaggacaagttgtagggatgatggtgcggtgggcgtgtgatagggtatattctggttggattttgttagtaaggtgtagtgtttaggtaagtgttggtgtatgctagggggcagtggagaggcacgggcgtgagggtatagcagcggtttgagctgggacattgagttgtggagtcggctgattctgcggcgtggaagtgtggattcttggagggagtgacccgggaatgtggaccttcgtggtagctgagatatctggaccagacagaatgttttcatctaatggaatggacctggatgttttcg

SEQ ID NO: 2257 - DNA, 2626 bp, Cirsium arvense
cattatatctctcggtgtagaccaaaagctaagggtcactgagagttcgtcttccttctccgccgcttcctcttgttttcttggaggatttttgtagacacgtattaattacatttttgttggagatacctaaaactaggcaaaatggtgaagtttaccgctgaagagcttcgcaggattatggacttcaagcataacattcgtaatatgtctgttattgctcatgttgaccacgggaaatctaccttgactgattctcttgtcgctgctgctggtattattgcccaagaagttgctggtgatgttcgtatgactgatacccgtgctgatgaagcagaacgtggtatcaccatcaagtccactggtatctcactttactatgagatgactgatgcagctctcaagagtttcactggagagcgaaatgggaatgaataccttatcaatcttatcgattcacctggacacgttgacttttcttctgaagtcactgctgctctacgtatcactgatggtgctttggttgtggttgattgtatcgaaggtgtttgcgtccaaactgaaaccgttcttcgacaagcccttggagaaaggatccgacctgttttgaccgtcaacaagatggacaggtgtttccttgagcttcaagtcgatggagaagaagcataccaaactttccaaagggttatcgaaaacgctaatgtcatcatggccacatatgaggacccacttcttggtgacgttatggtttaccccgagaaaggtaccgttgctttctctgctgggctccacggttgggcttttaccttaaccaactttgcaaagatgtatgcttctaagtttggagttgatgagtcgaaaatgatggaaaggctttggggagagaactttttcgaccccaaaactaagaagtggaccaccaagaactcgggctcaccatcttgcaaacgtgggtttgttcagttttgttacgaacccattaagcagatcatcaacacttgtatgaatgaccagaaagatcagttgtggcctatgttgaccaagcttggtgtcaccatgaagtctgacgagaaagagttgatgggtaaggcgttgatgaaacgtgttatgcagacatggcttcctgctgctactgctttacttgaaatgatgatctttcatctgccttcacctcacacggcacaaagataccgtgtcgagaatttgtacgaaggtccgttggatgatgtttatgctaacgctattagaaactgtgaccccaatggtcctcttatgctttacgtttctaagatgattcccgcttctgacaagggtcggtttttcgcttttggtcgtgtttttgccggaaaggtttcgaccggattgaaggttaggatcatgggtcctaactacatacctggagaaaagaaggatctgtatgtgaagagtgttcagaggaccgttatttggatgggtaagaagcaagaaactgtagaagatgttccctgtggtaacacagttgcgttggtcggtttggatcagttcatcaccaagaatgcaactttgacaaacgagaaagagtccgacgctcatccgatccgtgccatgaagttttccgtctcacccgttgtgcgtgttgcggttcagtgcaaggtcgcctctgatctccctaagcttgttgaaggtctgaaacgtctagcgaaatccgatcctatggttgtctgtaccattgaagaatccggtgaacacattatcgctggtgccggtgagcttcatctcgaaatctgtttgaaggatttgcaagacgatttcatgggaggtgctgaaatcgttgtttccgacccagttgtttcattccgtgaaactgttctcgagaaatcttctcgcactgttatgagcaagtctcccaacaaacataaccgtttgtacatggaagctagaccgatggaggacggactagccgaagctatcgatgatggcagaatcggtccacgtgatgaccctaagatccgtggtaagatcttagccgaagaattcggatgggataaggatctcgctaagaaaatctggtgtttcggacccgaaacaaccggacccaatatggttgtcgatatgtgtaagggagttcagtatttgaacgaaatcaaggattcagttgtggctggtttccaatgggcttcaaaagaaggtgcgttagccgaagaaaacatgagaggtatttgctttgaagtttgtgatgttgttctccatgctgatgctattcacagaggtggcggtcaagttatcccaactgccaggagggttatctacgcctcccagctaaccgccaagccacggctccttgagccggtctatttggtcgagattcaggcacctgagcaagctcttggtggaatctatagtgttctgaatcaaaggcgtgggcacgtgtttgaggaaatgcagaggcctgggactccattgtataacattaaggcgtatcttccggttgtggaatcttttggattttctggtgctttgagagcttcgacttctggtcaagctttcccgcaatgtgtgtttgatcattgggatatgatgggttcggatcctttggaggctgggtctcaggctagcacgcttgtgactcaaatccgtaagcgaaagg

SEQ ID NO: 2258 - DNA, 2581 bp, Euonymus alatus
cagcctcgcctttgaagactggagagccgtgacgcccagagcctctctgctctctctttctatatctgaacgacgtctctgtaaggtttgttttacaaagttagttgggaaatttaaagagcagcgaagatggtgaagtttactgctgatgggcttcggaggattatggacctgaagcataatattcgtaatatgtctgttattgctcatgttgatcatgggaagtcaacgcttactgattctcttgtggctgctgctggtatcattgctcaagaagttgctggtgatgtacgtatgactgacacccgagcggacgaggctgagcgtggcattacgattaagtcaactggtatatctctttactatgagatgagtgatgagtctttgatgagctacaagggtgaaagaatggggaacgagtacctcatcaatctcattgactctcctgggcacgttgacttttcatctgaagtcacggccgcgcttcgtatcactgatggtgcccttgttgtggttgattgtattgagggggtttgtgtccagacagaaactgttctcaggcaggcccttggtgaaaggatcagacctgttttgacagtaaacaagatggacaggtgttttctcgagctgcaggttgatggagaggaggcttaccaaacattccagagggtaattgagaatgctaatgtcatcatggctacgtatgaagatccactccttggtgatgttcaggtctatcctgagaaaggaactgttgctttctctgctggattgcatggttgggcttttactctaaccaattttgccaagatgtatgcatccaaattcggagttgatgaggcgaagatgatggaaaggctctggggtgagaactactttgacccagcaacgagaaaatggaccaccaagaacactggcgcttcttcttgcaagcgtggttttgttcagttctgctatgaacccattaagcagattattaacacttgcatgaatgaccagaaagataagctttggcctatgttgcagaagcttggtgttaccatgaagtctgatgagaaagaattgatggggaagccactgatgaagcgtgtcatgcagacctggctcccggcaagtagagcccttctggagatgatgatctttcaccttccctctccttccatggctcaaaggtatcgtgttgaaaacttgtatgagggtcccatggatgatcagtatgctactgctataaggaactgtgatcccgagggtcctctcatgctttatgtgtcaaagatgattcctgcttctgacaaaggtagattctttgcttttggtcgtgtattctctggaaaggttgcaacaggtgcaaaagtccggatcatggggccaaattatgtccctggtgagaagaaagatttgtatgttaagaatgtgcagagaactgtcatctggatgggcaagaaacaagaagctgttgaagatgttccttgtggtaacacagtggcattggttggcttggatcagtttattactaagaatgctaccttgacaaatgaaaaggaagttgacgctcacccaatccgtgccatgaagttctctgtttcacctgttgttcgtgtggctgttcagtgcaaggttgcttctgacctgcccaagcttgttgaaggtttaaaacgtttgtccaagtcagatcctatggtcgtttgtagcattgaagagtctggggagcacattattgctggtgcaggagaactccatcttgaaatctgtttgaaggatctgcaggatgatttcatgggtggtgctgagatcataaagtcagatcccgttgtgtcattccgtgaaacagtgctcgagaagtccagccgcactgtgatgagcaagtcccccaacaagcacaatcgtctctacatggaagcacgtcccttggaggagggccttcctgaggccattgacgatggccgtattggtcctcgtgatgatcccaaggttcgatcgaagatattgtctgaggagtttgggtgggacaaggatcttgccaagaaaatttggtgttttgggcccgagacaactggccctaatatggtggttgacatgtgtaaaggggttcagtaccttaatgaaattaaggactctgtggttgctggtttccagtgggcatctaaggaaggtgcattggctgaagagaatatgaggggtatctgttttgaagtctgtgatgttgttcttcacgctgatgccattcacagaggtggtggtcaggtcattccaactgccaggagggttatttatgcttcgcagcttactgccaagcccaggctgcttgagcctgtgtatatggttgagatccaggccccggagcaggctcttggtggtatttatagtgttcttaaccagaaacgtggtcatgtctttgaagaaatgcagaggcccggaaccccactctataacatcaaggcttacctcccagtcgtagagtcatttggtttctctggcaatttgagggctgcaacctctggtcaggctttccctcagtgtgtgtttgatcattgggatatgatgatgtcagacccattggatcccacatcgcaggctggag

SEQ ID NO: 2259 - DNA, 2488 bp, Papaver somniferum
ctgtcattgctcatgtggatcatggaaaatcaacacttactgattctcttgtggctgcggctggaattattgcccaagagactgctggtgatgttcgtatgacagatacccgtgcagatgaggcagaacgtggtattacaattaaatctactggtatctctctctattacgagatgagtgatgcgtctttgaaggcctacaagggtgacaggatgggtaacgagtacctcatcaaccttattgattcacctggtcacgttgacttctcttctgaagtcacagctgcattacgtattaccgatggtgcacttgttgtggtggattgtattgagggtgtttgtgtccaaaccgagactgtccttcgtcaagctcttggagaaaggatcaggcctgttttgactgtcaacaagatggacagatgtttcctagagctacaggttgatggagaagaggcttatcagactttctccagagtcatcgagaatgctaatgttattatggccacatatgaagacccactcctcggtgacgtccaagtttaccctgagaaaggaacagttgccttctctgctggtttgcacggttgggcttttactctcaccaattttgcaaacatgtatgcttccaagtttggtgtcgagcacagtaagatgatggagaggctctggggtgagaacttctttgacccagcaactaagaagtggactaataagagaacctcctctcccacatgtaagcgtggatttgttcagttctgttatgaacccatcaagcagatcattgccacttgcatgaatgatcagaaggacaagttgtggcctatgcttcagaagcttggtgttacaatgaagaatgacgagaaggaattgattgggaagcccttgatgaagcgtgtgatgcagacttggctccctgcagctactgctctacttgaaatgatgatttatcatctcccctctccccacacagctcagaagtatcgtgttgagaacttgtacgagggtcctcttgacgaccagtatgccaatgccatcagaaactgtgatcccgaaggtcctcttatgctctacgtgtctaagatgattcccgcctctgacaagggtagattctttgccttcggtcgtgtctttgctggtaaggttgcaactggtgctaaggtcagaatcatggggcctaactacgttcctggtgggaagaaagacttgtacaccaagagtgtccagagaactgttatctggatgggaaagaaacaggagtcggttgaggatgtaccttgtggtaacactgttgccctggttggactggatcaatttatcaccaagaatgcaaccctcacaaacgagaaggaagttgatgcccatcctatcagagctatgaagttttccgtctctcccgttgttcgtgttgctgtccagtgtaaggttgcctctgacctgcccaagctggttgaagggcttaagcgtctatccaaatcagatcctatggtggtgtgtaccattgaggagtcaggcgagcacattattgcaggtgctggagaactccaccttgagatactgtttgtaaggacttgcaggatgatttcatgggtggtgctgaaattattaagtctgaccctgtggtgtcatttcgtgagactgtcctagagagtcttcaagaacagtgatgagcaacgtccccaaacaagcacaaccgtttgtacatggaggcacgtcctcttgaggatggacttgctgaagccatcgatgatggtcgtattggtccaagagatgatacccaaaattcgtcaaagatcttatctgaagagtttggatgggataaggatcttgcaaagaagatctggtgttttggtccagatactactggtccaaacatggttgtggatatgtgtaagggagttcagtaccttaatgaaatcaaggattcagttgtggcagggtttcagtgggcttcaaaggaaggtgtgctagcagaagagaacatgagaggtatatgctttgaagtatgtgacgtggttctccattctgatgccattcacagaggcggtggacaggttattcctaccgctaggagggttatgtatgcctcacagctcacagctaaacctagactgctagaacctgtgtatctagtcgagatccaggctcctgaaggtgctcttggtggtatttacggtgttctcaatcagaagcgtggtcacgtctttgaggaaatgcagaggccaggaactcctctctacaacattaaagcatatctacctgtcgttgagtcatttggtttctctgctcagcttagggctgccacatctggacaggctttcccccagtccgtgtttgatcattgggatatgatgatggctgatcctttggagcctggcactcaagctgcagatcttgtgacagacatcagaaagaggaagggtttgaaggctcagatgacccccctctctgattttgaggacaagctttaagtctggtattttcatttggtc

SEQ ID NO: 2260 - DNA, 2995 bp, Physcomitrella patens
agactattcacgagctcgctgcgcagtccggcctcttttgcatcaggagaagagctccccgctctgtctctttctctgtctcactcttcttctacctcggaattccttggttgcccggtgggcgagaattcctccagctcgccaagatggtgaagttttcagctgaggagctccgtgctattatggacaagaagcacaatattcgtaacatgtctgtcattgcccacgttgaccacgggaagtcgacactgacggattcgctggtggctgctgcggggattatcgcgcaggagacggccggagatgtgcgtctgacggacacccggcaggatgaggcggatcgtggtattacgatcaagtcgaccggtatctcgttgtactacgagatgacttcggagtcgctgaaggactaccacggcgagaaggacggatgcgactacctgatcaacctgatcgattcgcctgggcacgtggatttttcgtcggaggtgactgcggcgctgcgtatcactgacggagcgctggtggtggtggactgcgtggagggagtgtgcgtgcagacggagacggtgctgcgacaggctctgggagagaggatcaggccggtgttgacggtgaacaagatggaccgatgctttttggagctgcaggtggacggcgaggaggcgtaccagacgttccagcgggtgatcgagagcgcgaacgtgatcatggcgacgtacgaggatgcgctgctgggagacgtgcaggtgtatccggagaaggggacggtggcgttttcggcgggtctgcacgggtgggctttcacgctgacgaacttcgcgaagatgtacgcggggaagttcggagtggacgagaagaagatgatggagaggctgtggggcgagaactttttcgacccggcgacgaagaagtggacgtcgaagaacacggggtcggcgacgtgccagcgtgggttcgtgcagttcgtgtacaacccgatcaagcaggtgatcaacatctgcatgaacgaccagaaggacaagctgtggccgatgttggcgaagctgaactgcgggctgaagtcggaggagaaggagctggtggggaaggcgctgatgaagaggacgatgcaggcgtggctgccggcggcgagcgcgctgctggagatgatgatcttccacctgccgtccccggcgacggcgcagaagtacagggtggagaacctgtacgagggtccgctggacgaccagtacgcgaacgcgatcaggaactgcgacccgaacgggccgctgatgttgtacgtgtcgaagatgattccggcgtcggacaagggtcggttcttcgcgttcgggcgtgtgttcgcggggaaggtggcgacgggaatgaaggttcggatcatggggccgaactacgtgcccggcgggaagaaggacctgtacacgaagtcggtgcagaggacggttatctggatgggaaggaggcaggagtcagtggaggacgtgccgtgcgggaacacagtggcgatggttgggctggaccagttcatcacgaagaacgcaacgctgacgggcgagaaggagacggacgcgcacccgatccgggcgatgaagttttcggtgtcgcctgtggtgcgtgtggcggtgcagtgcaagcacgcgtcggacctgccgaagctggtggaggggctgaagcggctggcgaagtcggaccccatggtgttgtgtatgatcgaggagagcggggagcacatcatcgcgggagcgggagagctgcatttggagatctgtctgaaggatctgcaggaggacttcatgggaggcgcggagatcgtggtgtcggacccggtggtgtcgttcagggagacggtgctggacaagtcggtgcggacggtgatgagcaagtcgccgaacaagcacaacaggctgtacttcgaggctcggccactggaggaggggctgccggaggcgatcgacgacgggcggatcgggccgcgcgacgacccgaaggtgcggtcgcagatattggcgcaggagttcgggtgggacaaggacttggcgaagaagatctggtgtttcggaccggagacgacgggaccgaacatggtggtggacatgtgtaagggagtgcagtacctgaacgagatcaaggactcggtggtggcggcgttccagtgggcgacgaaggagggtgcgttggcggaggagaacatgcgcggaatcgcgttcgaggtgtgcgacgtggtgctgcacacagacgcgatccatcgaggaggagggcaggtgatcccgacggcgcgtcgtgtgatgtacgcggcgcagctgacggcgaagccgaggctgttggagccggtgtacttggtggagatccaggcaccggagggcgctctgggaggaatctacggagtgctgaaccagaagcgtggtcacgtgttcgaggaggtgcagaggccgggtacgccgctgtacaacatcaaggcatacttgccggtcatcgagtcgttcgggttttcggggacgttgagggcggcgacgtccgggcaagcgttcccgcagtgcgtgttcgaccactgggagatgatgacgagcgacccgttggaagccgggacgcagtcggcccagatcgtggcggacgtgaggaagcggaagggattgaaggagcagatcacgccgttgtcggagtacgaggacaagttgtaaggaaggaggcgcaggtggagcattgtgttttgggatattatgctggctggcgttcgttttgttggacaagcgtttagataggtgttgggttcctattccaggggtcaatattgagaggcatggacgcgaggccgtggcaggtaattcgggtcgggaggattcagttgtggagtcctctggttttgtgatttagaagagtgggctctccgagttagcggcctggaaattcggaccttagtggtaattgggaacatttgaacgagacgggatgttttttgcctattggagtgaatctgaacgttttcaacccttcgtta

SEQ ID NO: 2261 - DNA, 2969 bp, Physcomitrella patens
ctctttcacaaccagaggagagtagcctgctctctctcaccgtcacttatctgctcctctcgcctcaatcctttgctgcccagtgggcacggactcctcaagcgcgtcaagatggtgaagttttcagctgaagagcttcgtgccattatggacaagaagcacaacatcaggaacatgtccgttatcgcccatgtggatcatgggaagtcgacactgacggattcgctggtggctgctgcggggattatcgcgcaggagacggccggagatgtgcgtctgacggacacccggcaggatgaggcggatcgtggtattacgatcaagtcgaccggtatctcgttgtactacgagatgacttcggagtcgctgaaggactaccacggcgagaaggacggatgcgactacctgatcaacctgatcgattcgcctgggcacgtggatttttcgtcggaggtgactgcggcgctgcgtatcactgacggagcgctggtggtggtggactgcgtggagggagtgtgcgtgcagacggagacggtgctgcgacaggctctgggagagaggatcaggccggtgttgacggtgaacaagatggaccgatgctttttggagctgcaggtggacggcgaggaggcgtaccagacgttccagcgggtgatcgagagcgcgaacgtgatcatggcgacgtacgaggatgcgctgctgggagacgtgcaggtgtatccggagaaggggacggtggcgttttcggcgggtctgcacgggtgggctttcacgctgacgaacttcgcgaagatgtacgcggggaagttcggagtggacgagaagaagatgatggagaggctgtggggcgagaactttttcgacccggcgacgaagaagtggacgtcgaagaacacggggtcggcgacgtgccagcgtgggttcgtgcagttcgtgtacaacccgatcaagcaggtgatcaacatctgcatgaacgaccagaaggacaagctgtggccgatgttggcgaagctgaactgcgggctgaagtcggaggagaaggagctggtggggaaggcgctgatgaagaggacgatgcaggcgtggctgccggcggcgagcgcgctgctggagatgatgatcttccacctgccgtccccggcgacggcgcagaagtacagggtggagaacctgtacgagggtccgctggacgaccagtacgcgaacgcgatcaggaactgcgacccgaacgggccgctgatgttgtacgtgtcgaagatgattccggcgtcggacaagggtcggttcttcgcgttcgggcgtgtgttcgcggggaaggtggcgacgggaatgaaggttcggatcatggggccgaactacgtgcccggcgggaagaaggacctgtacacgaagtcggtgcagaggacggttatctggatgggaaggaggcaggagtcagtggaggacgtgccgtgcgggaacacagtggcgatggttgggctggaccagttcatcacgaagaacgcaacgctgacgggcgagaaggagacggacgcgcacccgatccgggcgatgaagttttcggtgtcgcctgtggtgcgtgtggcggtgcagtgcaagcacgcgtcggacctgccgaagctggtggaggggctgaagcggctggcgaagtcggaccccatggtgttgtgtatgatcgaggagagcggggagcacatcatcgcgggagcgggagagctgcatttggagatctgtctgaaggatctgcaggaggacttcatgggaggcgcggagatcgtggtgtcggacccggtggtgtcgttcagggagacggtgctggacaagtcggtgcggacggtgatgagcaagtcgccgaacaagcacaacaggctgtacttcgaggctcggccactggaggaggggctgccggaggcgatcgacgacgggcggatcgggccgcgcgacgacccgaaggtgcggtcgcagatattggcgcaggagttcgggtgggacaaggacttggcgaagaagatctggtgtttcggaccggagacgacgggaccgaacatggtggtggacatgtgtaagggagtgcagtacctgaacgagatcaaggactcggtggtggcggcgttccagtgggcgacgaaggagggtgcgttggcggaggagaacatgcgcggaatcgcgttcgaggtgtgcgacgtggtgctgcacacagacgcgatccatcgaggaggagggcaggtgatcccgacggcgcgtcgtgtgatgtacgcggcgcagctgacggcgaagccgaggctgttggagccggtgtacttggtggagatccaggcaccggagggcgctctgggaggaatctacggagtgctgaaccagaagcgtggtcacgtgttcgaggaggtgcagaggccgggtacgccgctgtacaacatcaaggcatacttgccggtcatcgagtcgttcgggttttcggggacgttgagggcggcgacgtccgggcaagcgttcccgcagtgcgtgttcgaccactgggagatgatgacgagcgacccgttggaagccgggacgcagtcggcccagatcgtggcggacgtgaggaagcggaagggattgaaggagcagatcacgccgttgtcggagtacgaggacaagttgtaaggaaggaggcgcaggtggagcattgtgttttgggatattatgctggctggcgttcgttttgttggacaagcgtttagataggtgttgggttcctattccaggggtcaatattgagaggcaaggacgcgaggccgtggcaggtgaatcttcttggatagtttgtaagtagccaatgtgcctcgcaatttatccggcattcgatagttatggttgatttaccggtcccattcatttgttattctcgtgaatggaatggaagctggatgtgttcttatctcatttatggtggatttatatgcctgagcactgctagctatgtttctgat

SEQ ID NO: 2262 - DNA, 3086 bp, Marchantia polymorpha
agccaagcagaagggctccgcgagctctcctctctctcccaattccacagcctcctgcgcaggaaggctgaatttcatctagccttctcacaactcgccgtctcggcaggatctcgtcagctcgtcaagatggtgaagtttacagcagatgagttgcgaaggatcatggacaagaaacataatattagaaatatgtccgtgattgctcatgtggatcacggaaagtcgactctcaccgactccttggtggcagctgccggtatcattgcccaggccgacgcaggagatgtgcgtcttactgacaccagggccgatgaggcagagcgtggtattactattaagtccaccggaatttcgttgtactacgagatgtctgacctgtctctgaaggacttcacaggtgagaaagatggctctgactatctcatcaacttgatcgattctcccgggcacgtcgacttttcttctgaggtcactgccgctctgcgtattaccgatggagctcttgtcgtcgtcgattgtgttgagggcgtgtgcgtgcaaacggagactgtgctccgacaggctcttggagagaggattaggcccgttttgactgtcaacaagatggaccgatgtttcctggagcttcaggtcgagggagaggaggcctaccagaccttctcccgtgtgattgagaacgctaacgttattatggccacctatgaagacaagcttctgggagatgttcaagtttacccagagaagggaacagttgccttctcagctggtctccatggatgggctttcaccctaaccaactttgctaagatgtacgcgtctaagttcggagttgatgagaagaaaatgatggagagactttggggagagaacttctttgatcgcgccaccaagaaatggacgaccaagaacaccggatcgcccacctgttctcgtggattcgtgcagttcgtgtacaaccccatcaagcagatcatcaacatctgtatgaacgaccagaaggataagttgtggccgatgttggcccagttgggttgcggtcttaagggagaggagaaggaattgatgggcaagcacctcatgaagagagttatgcagacttggttgcccgccagtgctgctcttttggagatgatgatcttccacttgccctctcccgccactgcccagagatatcgtgttgagaacttgtacgagggtcccctcgatgacatgtacgccaacgctatcaggaactgtgacccagagggtcctctcatgttgtacgtttccaagatgattcccgcatccgacaagggtcgtttcttcgccttcggtcgtgtgttcgccggtaaggtgtctactggactcaaggtcagaatcatgggtccgaactacgtccctggccagaagaaggatttgtacaccaagagtgttcagaggactgtcatctggatgggaaggaggcaggagtctgttgaggacgttccttgcggtaacaccgtcgccctggtgggtcttgatcagttcatcaccaagaacgctactttgactaatgagaaggaagtggacgcccaccccattcgtgccatgaagttctccgtgtcacctgtcgtgcgtgttgctgttcagtgtaaggtggcatctgatctcccgaagctggttgagggattgaagcgtctcgccaagtctgaccctatggttatctgtaccatcgaggagtcaggcgagcacatcatcgcaggagctggtgaacttcatcttgagatctgtctcaaggatttgcaggatgacttcatgggcggagctgaaattgttgtgtctgaccctgttgtctcatttagggaaactgttcttgagaagtcaaaccacacagtcatgagcaagtcccccaacaagcacaaccgactgtacttcgaggccaggcccctcgaggatggtctcgccgaggctattgatgacggccgcattggacccagagacgaccccaaggtcaggagcaagatcctcgctgaggagttcggctgggacaaggacttagctaagaagatctggtgtttcggtcccgataccaccggacccaacatggttgtggatatgtgtaagggagtgcagtacttgaatgaaatcaaggactctgttgttgctgccttccagtgggccaccaaggagggagttctcggagatgagaacatgcgtggtattgcctttgaggtgtgcgatgttgtgttgcatgctgatgctatccacaggggtggtggtcagatcatccccaccgccagacgtgccatgtacgctgcaatgctcactgccaagcccagacttttggaacccgtctatttggtcgagatccaggctcccgagcaggctcttggaggtatctacggagtcttgaatcagaagagaggtcacgtgttcgaggagatccagaggcctggaaccccactgtacaacatcaaggcatacttgcctgtcattgaatctttcggattctccagcacccttcgtgcagccacctccgggcaggctttcccccaggccgtgttcgaccattgggaaatgatgagctctgaccctactgacaacagtacccaatctggtcaaattgtcagtgacatcaggaaacggaagggtctcaaggagcagatcaccgccctttctgagtacgaggaccgattataggttttggtagttcccttttttttattttattgtcatgcaaagacggtagacagtgttcacgcggattctacccagtgaatgggaggcggaacggatgatcaataatcaagtacatctgtcattctggtttatctgaatgtcgcaatgtctctcaggccaggaaccttttacggcctgtactaaagattatcctctcaatgcggtgtagattgcaatatattgcattgcaatctgtttgtcggtgagatgtagatgaaaacctagaagggtttagatgtagatgccagttttgtcattgttcaccaaccttcagattgaggtgaagaacaagttctctatttcaggttaacacgagtggatgaattcaatctaagttcgaaattgtcctgtgagatcaatgcgttgtttagacatgaatgtgagac

SEQ ID NO: 2263 - DNA, 2830 bp, Triphysaria pusilla
tcgtttttcactagcgcctcccgactcgtactcacacaccactgttttctgttaattttggaggtagcattataaagtcttgcgaaaatggtgaagttcacatcagaagagcttcgaaggattatggacctcaagcataacattctaatatgtctgttattgctcatgttgatcatgggaaatcaactcttactgattcccttgttgcggctgcggggattattgctcaagaaactgctggtgatgtcagaatgacggatactcgtgctgatgaagctgaacgtggcatcactatcaaatccactggaatctccctttactatgagatgactgatgagtccttgaagagctacaagggtttacgcaccgggaacgagtaccttatcaatcttattgactcacctgggcacgttgacttctcttctgaagtgacagctgctcttcgtatcactgatggtgctcttgtggtggtcgattgtgttgaaggtgtctgtgtccaaactgagaccgtgcttagacaagctcttggagaaaggatccgacctgttctgactgttaacaagatggataggtgtttccttgagctccaagttgatggtgaagaagcttatcagaccttccaaagggtgattgagaatgcgaatgtcatcatggcaacatacgaggatccccttctaggtgatgtcatggtttacccagagaaaggtaccgttgctttctctgctggtctgcatggctgggcttttactcttacaaattttgccaagatgtatgcttccaagtttggtgttgatgagagcaagatgatggaaaggctctggggtgagaatttctttgatccagctactaagaagtggactaccaagaacaccggctctccatcttgtaaacgtggtttcgttcagttttgttatgagcccatcaagcagatcatcaacacttgcatgaatgaccagaaggataagctgtggcccatgttgaccaagcttggtgttcagatgaagtctgacgagaaggacctgatgggaaaggccttgatgaagcgtgtcatgcagacctggctgcctgctagcagtgccctacttgaaatgatgatatttcatctcccgtcgccctcaattgctcagaggtaccgtgtggagaacttgtacgagggcccacttgacgaccagtatgccaatgctattaggaactgtgaccccgacggccctctcatgctttatgtgtctaagatgattccagcttccgataaagggagattctttgcttttgggcgtgtttttgctggtaaggtgtcgactgggatgaaggtcaggatcatgggtcctaactatgtccctggtgagaaaaaggacttgtacaccaagagtgtacaaaggactgttatctggatgggcaagaaacaagaaacggttgaggatgttccatgtggtaacactgtcgctatggttggtctcgatcagtacatcaccaagaatgctactctgaccagtgagaaggaagtcgatgcccatcccatcaaggccatgaagttctctgtctcacccgttgttcgtattgctgtacagtgcaaggttgcgtctgatctgcctaagcttgttgagggtctcaagcgtcttgccaagtctgaccctatggttgtttgtacaatggaagaatctggtgagcacatcgttgcgggtgctggagagttgcatcttgagatttgcttgaaggacttggttgatgattttatgggcggggctgagattattaaatctgacccagttgtctccttccgtgagacggtcctcgacagatcttcccgaattgtgatgagcaagtcgcccaacaagcacaaccgtctctacatggaagcccggcccttggaagagggacttgctgaagccattgatgatggccgtattggcccgagagatgaccccaagatccgttcaaagatcctatccgaggaattcggctgggacaaggagctcgctaagaagatctgggcttttggtcccgaaaccatgggaccaaacatggtggttgatatgtgtaagggagtccagtacttgaatgaaatcaaggactcggtcgttgctggtttccagtgggcttccaaggagggcccgttagctgaggagaacatgaggggtgtctgctttgaggtttgtgatgttgttcttcacacagatgctattcacagaggtggtgggcaggttattccaactgcgaggagagttatttacgcttcgcacctcactgctaagccccgtctattggagcctgtttaccttgttgagatccaagcgcccgagcaagctcttggtgggatttacagtgtgctgaatcagaagagaggacatgtgttcgaggagatgcaaaggcctggtacaccactgtacaacatcaaggcttatctccctgttgttgagtcttttggtttctcggcccaacttagggcagcgacatctggacaggctttcccgcagtgcgtgtttgatcattgggacatgatgatgtctgacccaatggagactgggtcccaggcttccgcgcttgttgctgatattaggaagaggaagggtttgaaggagcaaatgacaccattgtcggatttcgaggataagctgtgagagcttgtgaggcgttttaccagttctgccaagtatcgtctttaatattgcattattttattgtctatgtattgtgacatttgtgttttggaaccacattttgttattgtgggttgggttgttgttcaaactttttaacaattgctatgatatgatgctatttttgtttagatccctgtggttcttcaaattagtttttttcatttggtgct

SEQ ID NO: 2264 - DNA, 3096 bp, Aristolochia fimbriata
ttcagagtatgaggaagatattttgtcggaaaggtaccttgcgctgctatagcgttatctccttttttagggttttccgccacacttgcaaattcatccgagggaggggagtttaaggctttcatttctcttcgttcgatcagacatcgagcggataggttacgctgggaggttctttcggtacctctcgtctcgttgttgttgcagaatattgctcaaagttggtgggtagcagtgtgttgagggtgtttctaaccagtcaagatggtgaagtttactgcagaagaacttcgtagaattatggatttgaagcacaatattaggaatatgtcagttattgcccatgttgaccatggcaaatccactcttactgattcacttgtggctgcggctggtatcattgcccaagaggtggctggtgatgttcggatgacagacacacgccaagatgaagcagagcgaggcatcactattaaatctactggcatctctttatattatgagatggatgatgatgctctcaaagcctataaaggagagcgtagtggcaatgagtatctgatcaacttgattgattcacctggacatgttgatttttcgtcagaggtcactgctgcacttcgtattacagatggagcattggtagtggttgattgtattgaaggtgtctgtgttcagactgagactgttcttcgtcaggctcttggagagaggattaagcctgttttgactgttaacaagatggaccgctgctttcttgagctgaaagtcgaaggtgaagaagcttttcaaactttttctagggtgattgagaatgcaaatgtcataatggccacctacgaggaccctcttcttggtgactgccaggtctacccagagaaagggacagtggctttctctgctgggcttcatggttgggcatttacgttaactaactttgccaagatgtatgcttctaagtttggagtagatgaagccaagatgatggaaagactttggggtgaaaattattttgatcctgcaaccaaaaagtggactagcaaaagtactggttctgctacgtgtaaacgtggttttgtccagttctgttatgagccaattaaacagattatcaatacttgcatgaatgatcagaaggacagattatggcccatgttaaccaagcttggtgtgaacatgaaatctgacgaaaaagaactgatgggaaagcctttgatgaagagggtcatgcagacatggcttccagcaagcagtgcacttcttgaaatgatgatatttcaccttccttctccttctagggcccaaagatacagggttgagaacctctatgagggtccacttgatgatcaatatgccaatgctattaggaactgtgaccctgatggtcctcttatgctttatgtttctaagatgattcctgcctctgataagggtagattctttgctttcggtcgtgtattttctggcaaggtctgcactggtatgaaggtcagaattatgggaccaaactatatacccggacaaaagaaggatttatatgttaagaatgttcagagaactgttatttggatgggaaagaagcaagaatctgttgaagatgttccttgtggtaatacagtggctatggttgggttggatcagttcattaccaaaaatgctactttgactgctgagaaggaagttgatgcccaccctattcgtgccatgaaattctctgtgtcccctgtcgttcgtgttgcggtacaatgtaaggttgcttctgatcttccgaagcttgttgaaggtttgaaacggctggcaaaatcagatcctatggttgtctgtactattgaggagagtggtgagcatattgttgcaggtgctggtgaacttcatcttgagatttgccttaaagatttgcaggaggactttatgggaggagctgaaatcattgtttctgacccagttgtttcatttcgtgagactgttcttgagaagtcttgccgtacagttatgagcaagtctccaaacaagcacaatcgactttatatggaagctagaccgatggaagaagggttagctgaggccattgatgagggtcgaattggtccaagagatgatcctaagaaccgtgccaagatactttctgaagaatttggctgggacaaggacctggcaaggaagatttggtgttttgggccagaaactatgggaccaaatatggtggttgatgtatgcaaaggagttcagtacctgaatgaaataaaggattctgttgttgcagggtttcagtgggcatcaaaggaaggtgcccttgctgaggagaacatgcgggcgatatgctttgaagtttgtgatgttgttctccatgccgatgcaattcaccgaggtggtggtcaagttattcctactgcaaggagggtcatatatgcttcccagttgactgcaaagccgaggctgctggagcctgtctatcttgtggagatccaggcaccggaacaagctcttggcggtatctatggtgttttgaatcagaagagagggcatgtgtttgaagaactacagaggcctggcactcccctttacaacatcaaggcatatctgcctgttattgaatcctttggattctcgacgagtttgagagctgccacatctggccaggctttccctcagtgtgtttttgaccattgggatatgatgtcttctgatcctatggataccaacatctcagtctgggctattagttagtgagattaggaagaggaagggtctaaaggagcaaatgacccctctgtctgagtttgaagacaagctgtgagtcttcttttagaagttttactcgacgtaactgtctttggtttacttgtttacattgtactaaaatagagggtactgcttcaaaggcagatagttttacggtttaatagtttaccgaatatgacagatggatgatgagactatccttcggttatcagtggataagttccctttgctacgaggccttcgatgatctaactgaaaagcaaagtagattgttcacttttgcggaatgaaactttagtatagacttgttatttgttcgctactcatttgagtcttctggtgaatgatactatg

SEQ ID NO: 2265 - DNA, 2754 bp, Eutrema parvulum
ggtgaagttcacagccgatgagcttcgtaggattatggactacaaacacaacatccgtaatatgtctgttattgcccatgtcgaccatggtacaagggaaatccaccctcactgactccctggttgctgctgctggtatcattgcccaagaagttgctggtgatgtgcgtatgactgatactcgtgctgatgaggcagaacgtggtatcacaattaagtccactggtatttctctctactacgagatgaccgatgcttctttgaagagtttcactggggcaagagatggaaacgaataccttatcaatctcattgattcccctgggcacgttgacttttcttctgaggtcactgctgctctccgtattaccgatggtgctcttgtggtggtcgactgtattgagggtgtctgtgtgcagactgagactgtgctccgtcaggcccttggtgagaggattaggcctgtcctaactgtgaacaagatggacaggtgtttccttgagcttcaggttgatggtgaggaggcttaccagactttccagagggttattgagaatgccaatgttatcatggcaacctatgaggaccctcttcttggagatgttcaggtgtatcctgaaaagggaactgtggctttttctgctggtctccacggatgggctttcaccctaaccaactttgccaagatgtacgcctccaagtttggtgttgatgaaactaagatgatggagaggctgtggggtgagaatttctttgaccctgccaccaggaagtggagcagcaaaaacactggttccgcaacctgcaagcgtggatttgtccagttctgttatgaacccatcaagcaaatcattgccacttgcatgaacgaccagaaggacaagctttggcctatgttgcagaagcttggtgtccagatgaagtctgatgagaaggagctaatgggtaaacctttgatgaagcgtgtcatgcagacatggctcccagcaagtactgcactacttgagatgatgatctttcaccttccatctccccacactgcacagaggtaccgtgttgagaacttgtatgaaggtcccctcgatgatcagtatgccactgccatcagaaactgtgatcctaatggccctctcatgctctacgtttctaagatgattccagcctcagacaagggtaggttctttgcttttggtcgtgtcttttctggcaaggtgtccactggaatgaaggtcaggatcatgggtcccaactttgtccctggtgagaagaaggacctgtacgtgaagagtgtccagagaactgtcatctggatgggaaagaggcaagagactgttgaggatgttccctgtggtaacaccgttgctatggttggtcttgaccagttcatcaccaagaatgctaccctgaccaatgagaaagaagttgatgcccaccctatccgtgcaatgaagttttctgtctcacctgttgtccgtgttgctgttcagtgcaaggtcgcttctgaccttcccaaacttgttgagggactcaagaggctggccaagtctgaccctatggttgtgtgcacaatggaagagtcgggtgagcacattgttgctggtgctggagaactccatcttgagatttgtctgaaggatcttcaggatgatttcatgggtggtgctgagatcgtcaagtcagaccctgttgtctcattccgtgagactgtcctggagagatctgtccgtactgtgatgagcaaatcccctaacaagcataaccgtctgtacatggaggccagacccttggaggaaggtctagcagaggcaattgatgatggccgtattggtccaagagatgatcccaagatccgatccaagatcttggcagaggagtttggttgggacaaggatcttgcaaagaagatctgggcgtttggaccagaaaccacagggcccaacatggttgttgacatgtgtaagggagttcagtacctaaacgaaatcaaggattcagttgttgctgggttccagtgggcgtccaaggaaggtcctctttgtgatgagaatatgagaggaatctgctttgaggtttgtgatgtggtgcttcactctgatgctattcacagaggtggtggccaggttattcctacagcaaggagggttatctacgcctcccagctgactgccaagccgagactgttggagccggtgtacatggtggagatccaagcaccagagggagctcttggaggaatttacagcgtgctgaatcagaagcgtggacacgtgtttgaggagatgcagaggcctggaacaccgctgtacaacatcaaggcgtacttgccagtggtggagtcttttggattctcgagtcagcttagggcagcaacctcaggacaggccttcccgcagtgtgtgtttgatcattgggagatgatgtcgtcagaccctctggaggtgggatcccaggcttcgacgctggtggctgacatcaggaagaggaagggtatgaaggaacagatgactccgttgtctgatttcgaagacaagctgtaagcagcaagcacctactctttggtcacatttgctctctctctctaccgtatttttgtctttgttttctgtttactattttggtgttatgatgggattgatgatgacttaatctctcgccatcccctttttttaatgtgttttacttttagttgagaacaaacttctttatttattgtgttcccaaagtattgcactcttttattctcgttgccattag

SEQ ID NO: 2266 - DNA, 2544 bp, Secale cereale
ggcgatcgcgatggggacgaatacctgatcaaccttattgattcacctggccacgttgacttttcttcggaagtcacagctgctcttcgtatcactgatggagctttggtcgttgttgactgtattgagggtgtctgtgtgcagaccgaaactgtgctgcgccaagctcttggtgagaggattaggccagtccttactgtgaacaagatggacagatgcttccttgagcttcaggtggaaggtgaggaagcatatcagaccttctcccgtgttatcgaaaatgccaatgtcatcatggcaacatatgaagatgtgctccttggtgatgtccaagtgtacccagaaaaggggactgttgcattctctgctggtctgcatgggtgggctttcacccttacaaactttgctaagatgtatgcctccaagtttggagttgacgagtcaaagatgatggagaggctgtggggtgagaacttctttgacccagctacaaagaaatggacctccaagaacactgggacagctacctgcaagagaggtttcgttcagttctgctatgagccaatcaagcaaatcatagccacctgcatgaatgatcagaaggataagttgtggcctatgttgaagaagcttggtgtgaccatgaagaatgatgagaaggacttgatgggcaaggctctcatgaagcgtgtgatgcaaacttggctgcctgccagtcgtgctctgcttgagatgatgatatttcacctcccctccccttcaaaggcacagaggtaccgtgtggagaacttatatgagggcccccttgatgatatatatgcaaatgctattagaaactgtgacccagatggtcctcttatgctgtatgtctccaagatgattcccgcatctgacaagggtagattctttgcctttggacgtgtttttgctgggagggttgcaactggcatgaaggtccgcatcatgggtcccaactttgttcctggccagaagaaggatctgtatgtgaagagtgtccagcggactgttatctggatgggaaagaagcaagagtctgttgaggatgttccctgtggtaacactgttgctttggttggtttggatcagttcatcacgaagaatgcaaccctaacaaatgagaaggaagttgatgcctgcccaatcagggcaatgaagttctctgtgtcccctgttgtgcgtgttgctgttcagtgcaaggtggcctctgatcttcccaagcttgttgagggtttgaagcgtctggcaaagtctgatcctatggttctctgtaccattgaagagtctggtgagcatatcattgctggagctggagagcttcaccttgaaatctgtttgaaggatctgcaggatgacttcatgggtggtgctgaaatcattgtttccccccctgtcgtctccttccgtgagactgttctggagaagtcctgccgtacagtcatgagcaagtccccgaacaagcacaaccgtctttacatggaagctcgccccttggaggagggcctggccgaggccattgatgatgggcgcattggcccacgtgacgatcccaaggtgcggtccaagatcctgtctgaggagtttgggtgggacaaggatcttgccaagaagatttggtgctttggacctgagacgactggccccaacatggttgttgacatgtgtaagggagtgcagtatctgaatgaaatcaaggactctgttgtggctgggttccagtgggcgtcgaaggaaggtgcactggctgaggagaacatgcgcggcatttgtctcgaggtctgtgatgttgttctccacactgatgctattcacaggggtggtggtcaggtcatcccaacagccaggagggtcagtttatgcttctcagctcactgctaagccaaggctgctggagcctgtgtacctggttgagatccaggccccggagaacgcacttcggcggtatctatggtgtgctgaatcagaagagagggcatgtgtttgaggagatgcagaggcctggtaccccgctgtacaacatcaaggcttacctcccggtcatcgagtcgttcgggttctcaagtaccctcagggctgctacatctggccaggctttcccccagtgtgtgttcgaccactgggacatcatgtcttcggatcctttggaggccggctcccagtctgcgacccttgtcacggagatccgcaagcgcaagggtctgaaggaacagatgacccctctgtctgatttcgaggacaagctctaaacttttggttctgttacatggtctagtttgcttttgctgctaagagagctgcactatattttctgtctattgagtcgtggctgtattgctattggaatgtcgtatctgtcgtggtactggtactttgttttgatgtctatcgatgttaaaacttagataaatatatctgttatctactggtagttcttggttatgtctgctttggttttggatcctgagatctgcctggttctttattgctatgtttttgctctagtatattttcatgttgtccagaact

SEQ ID NO: 2267 - DNA, 2856 bp, Oryza sativa
agttgtccaggaggcgacggatggcgtccgtgcgtggccggccagccccaagcgagcgagattcaggctggcacccggtctacaatctacatccatgcctcccgaggccgcgggaggaaataagtttggtgtaaattgaaaatcactcacaatggttaagtttacggttgaagagatgcgcaggattatggacaagaagcataacatccgtaacatgtctgttgtcgctcatgtggaccatggaaaatctacccttactgattcccttgtggcagctgctggaattatagcccaggatgttgctggtgatgttcgaatgactgatagtcgttcagatgaagcagaacgtggtattacaataaaatctactggtatctctctttactatgagatgagtgatgagtcactcaaaagttacaagggtgacagagatggaaatgaatacctaatcaacctcattgactcacctggacatgtcgatttttcttcggaagtcacagccgcacttcgtataactgatggcgctttggttgtggttgactgtattgagggtgtctgcgttcaaactgaaactgtgcttcgccaagcccttggtgagaggattaggcctgtcctcactgtgaacaagatggatagatgttttcttgaacttcaagttggtggtgaggaagcttatcaaactttctcccgtgtcatagagaatgcaaatgttattatggcaacatacgaagatgcactccttggtgatgttcaagtctatccagaaaaagggactgttgctttctctgctggcttgcatggatgggctttcaccttgtctaactttgcaaagatgtatgcatccaagtttggagttgatgaatctaaaatgatggagaggctttggggtgagaactactttgaccctaccacaaagaagtggaccatcaaacacaccggttctgatacttgcaagagaggttttattcagttctgctatgagcccatcaggcaaattatcaacacctgcatgaatgatcagaaagataagttgttgcctatgctgcaaaagcttggtgttaccatgaaggacctaactggcaaggctctcatgaagcgtgttatgcaaacttggcttcctgcaagtaatgcacttcttgagatgatgatctatcaccttccctctccagcaaaggctcagaggtaccgtgtggaaaacttgtatgagggcccccttgatgatatatatgcatctgccattagaaactgtgatccagaaggtcctcttatgctgtatgtttcaaagatgattccagcatctgacaaggggaggttctacgcttttggtcgtgttttctcagggagagttgcaactggcatgaaggtccgtatcatgggccccaattatgcccctggccagaagaaagatctgtacgtaaagaatgtccagcgaactgtcatctggatgggcaagaagcaggagtcagtggaaggtgttccttgtggcaacactgttgctatggtgggtttggaccagttcatcacaaagaatgctaccctgacaaacgagaaagaagttgatgcctgtccaatcaaagccatgaaattttcagtgtcccctgttgtgcgtgttgctgttcagtgcaaggttgcctctgaccttcccaagcttgttgaaggtttgaagcgtctggccaagtcagatcctatggttctctgtactgttgaggaatctggcgagcatattattgctggagctggcgagcttcaccttgaaatttgtttgaaggatctgcaggaagacttcatgggtggtgctgaaattactgtctcccctcctgttgtctcattccgtgagactgttcttgagaaatcttgccggactgtcatgagcaaatccccgaacaagcacaaccgtctgtacatggaagcccgcccaatggaagagggtctgcctgaagccattgacgagggtcgtattggcccgcgtgacgatcctaaagtacgctccaaaattctatccgaggagtttggttgggacaaggacctcgcaaagaagatatggtgttttgggccagagaccacaggccctaacattgttgtggatatgtgcaagggagtgcagtatcttaacgaaataaaggattccgttgtggctggctttcagtgggcatcaaaagaaggtgcactggctgaagagaacatgcgtggccgtggcatttgctttgaggtttgtgatgttatcctccattctgatgctattcatagaggtggtggccagatcattccaacagccaggagggtcatttatgctgctcagctcactgccaagccaagactgcttgagcctgtttacttggtggagattcaggcccctgagaatgctcttggtggaatttacagtgttctgaaccagaagagaggacatgtgttcgaggagatgcagaggcctggtaccccactctacaacatcaaagcttacctccctgttatcgagtcatttgggttcacaagcacccttagggcagcaacctctggtcaggccttccccctctttgtatttgatcactgggaaatgctgtcagttgatcctttggagcctggcaccagacagctaaccttgtcctggatatccgcaagaggaagggtctgaaggagcaaatcacccctctgtctgaatacgaggacaaactctagatatttaatcatgttattatgcttatagtgttatatcgctttataattggtagtggccatctatgtgagcagtgagctgctatttcatgtataatattatgtcgaacggttgtacggtagcatgggatgatgatcaggcgatattgttataatttgttatggtatttaccatcatatcat

SEQ ID NO: 2268 - DNA, 2520 bp, Brassica rapa
aaaacagagtaaacaaaatacggtagagatagagagataagggtgaacatagtgagtagtcttgttggctggctgcttaaagcttgtcttcaaaatcagacaaaggagtcatctgttccttcatacccttcctcttcctgatgtcagccaccagcgttgaagcttgcgatcctgtctccaaagggtcagatgacatcatctcccagtgatcaaacacacactgagggaaagcctgtcctgaggttgctgctctaagctgacttgagaatccaaatgactcaacaactggcaggtacgccttgatattatacagcggtgtccctggcctctgcatctcctcaaagacgtgtccacgcttctgattcagcacgctgtagattcctccaagagctccttctggtgcttggatctccaccatgtaaaccggttccaacagtctgggcttggcagtgagctgtgacgcgtaaataaccctcctcgctgttgggataacctgaccaccacctctgtggatagcatcagagtggagcacaacatcgcaaacctcaaagcagattcctctcatgttctcatcacaaagaggaccttccttggaagcccactggaacccagcaacaacagaatccttgatctcattcaggtattgaactcccttacacatgtcaacaaccatgttgggccctgtggtttctggtccaaacgcccatatcttctttgcaagatccttgtcccaaccaaactcctcagccaatatcttggaacgtatcttgggatcatctcttggaccaatacggccttcatctattgcctccgcaagaccatcctccaagggcctagcctccatgtacagacggttgtgcttgtttggggacttgctcatcacagtacgcacagatcgctccaaaacagtctcacggaatgagacaacagggtcagacttgacaatctccgcaccacccatgaaatcatcctgaagatccttcaagcaaatctcaagatggagttctccagcaccagcaacaatgtgctcacctgactcctccattgtgcacacaaccatagggtcagacttggccagcctcttaagtccctcaacaagcttgggaagatcagaagcgaccttgcactgaacagcaacacgtacaacaggggacacagagaacttcatcgcacggataggatgagcatcaacttctttctcgttcgtcagcgtagcattcttagtgatgaactgatcaagaccaaccatagcaacggtgttaccacagggaacatcctcaacagtctcttgcctcttgcccatccagatgacagtcctctgaacactcttgacataaagatctttcttctcaccaggaacaaagttgggacccatgatcctgactttcataccagtggacaccttaccagagaatacacgaccaaaagcaaagaatcttcccttgtctgaagcaggaatcatcttagagacatagagcatgagagggccattaggatcacagtttctgatggcagtggcatactgatcatcgagaggaccttcatacaggttctcaacacggtacctctgggcagtgtggggagatggaaggtgaaagatcatcatctcaagcaaagcagtactcgcagggagccaagtctgcatgacacgcttcatcaaaggtttacccataagctccttctcgtcagacttcatctggactccaagcttctgcaacataggccacaacttatccttctggtcattcatgcaagtggcaatgatctgcttgatgggctcataacagaactgcacaaacccacgcttgcaggtagcggacccagttgttcttgccgctccacttccttgtagcagggtcaaagaaattctcaccccacagcctctccatcatcttagtctcgtccacaccaaacttagaagcatacatcttcgcaaagttggtcagcgtgaaggcccatccatggagaccggcagagaaggcgacagttcccttctcagggtaaacctgaacatcaccaaggagaggatcctcatacgtcgccatgatcacattagcgttctcaataaccctctggaacgtctggtaagcctcctcaccgtcaacctgaagctcaaggaaacacctgtccatcttgttcacagtcagcacgggcctaatcctctcaccaagagcctgacgcagcacagtctccgtctgaacacagacaccctcgatacagtcgacgacaacaagggcaccatcagtgatacggagcgcagcagtgacctcagaggagaagtcaacgtggccaggagagtcgatgaggttgataaggtactcgtttccatctctggcaccagtgaagctcttcaaggaagcatcagtcatctcgtagtagagagagatacccgtggacttgatggtgataccacgttcagcctcatcggcacgtgtatcagtcatacggacatcaccagcaacttcttgagcaatgataccagcagcagcaaccaaggagtcagtgagggtggatttacct

SEQ ID NO: 2269 - DNA, 2741 bp, Papaver somniferum
atcaacacttactgattctcttgtggctgctgctggtattattgcccaagaaactgctggtgatgttcgtatgacagatacccgtgcagatgaggcggaacgtggtattacaattaaatctactggtatctctctctattatgagatgtctgatgagtctttgaaggcctacaagggtgacagaatgggtaatgagtacctcatcaaccttatcgattcacctggtcacgtcgactttcttctgaagtcacagctgcattacgtattactgatggtgcacttgttgtggtggactgtattgagggtgtctgtgtccaaaccgagactgtccttcgacaagctcttggagaaaggatttaggcctgtgttgactgtcaacaagatggacagatgtttcctagagctacaggttgatggagaagaggcttatcagaccttctccagagttattgagaatgccaatgttatcatggccacttatgaagacccactccttggtgacgtccaggtttatcctgaaaaaggaactgtcgccttctctgctggtttgcacggttgggctttcactctaaccaatttcgcaaacatgtatgcttctaagttcggtgttgaacacagtaagatgatggagaggctttggggtgagaacttctttgacccagcaactaagaagtggactaataagagaaccgcgtctcctacatgtaagcgtgggtttgtccagttctgttatgaacccatcaagcagatcattgccacttgcatgaatgatcaaaagacaagttgtggcctatgttgcaaaagcttggtgttacaatgaagaatgatgagaaggaattgattggaaagcccttgatgaagcgtgtgatgcagacttggctccctgcagctactgccctacttgaaatgatgatttatcatctccctctcccacacagctcagaagtatcgtgttgagaacttgtacgagggtcctcttgatgaccagtatgctaatgccatcagaaactgtgatcccgatggtcctcttatgctctacgtgtctaagatgattcctgcctccgacaaaggtagattctttgcctttggtcgtgtctttgctggtaaggttgcaacaggtgctaaagtccgaatcatggggcctaactatgttcctggtgggaagaaggacttgtacaccaagagtgtccagaggactgttatctggatgggaaagaaacaggagtctgttgaggatgttccttgtggtaacacagttgccctggtcggattggatcaatttatcaccaagaatgcaaccctcacaaacgagaaggaagttgatgctcatcctatcagagccatgaagttttctgtctctcccgttgttcgtgttgctgtccagtgtaaggttgcctctgacttgcccaagctggttgaagggcttaagcgtctgtccaaatctgatcctatggttgtgtgtaccattgaggagtcgggcgagcacattattgcaggtgctggagaactccatcttgagatctgtttgaaggatttgcaggatgatttcatgggtggtgctgaaattgtgaagtccgaccccgtggtgtctttccgtgagactgtgcttgaaaagtcttcaagaactgtgatgagcaaatctccaaacaagcacaaccgtttgtacatggaggcacgtcctcttgaggatggacttgctgaagccattgatgatggtcgtattggtccaagagatgatcctaaagttcgttcaaagatcttatctgaagagtttggatgggataaggatcttgcaaagaagatctggtgttttggtcccgatactactggtccaaacatggttgtggatatgtgtaagggagttcagtaccttaatgaaatcaaggattcagttgtcgcaggttttcagtgggcgtcaaaggaaggtgttttggcggaagagaacatgagaggtatatgcttcgaagtatgtgatgtggttctccattctgatgccattcacagaggtggtggacaggttattcctactgctaggagggttatgtatgcctcccagctcacagctaaacccagacttttagaacctgtgtacctagtcgaaatccaggctcccgaaggtgcccttggtggtatctacggtgttctcaatcagaagcgtggtcacgtctttgaggaaatgcagagaccaggaactcctctctacaacatcaaagcatatctaccagtcgttgagtcatttggtttctctgcccagcttagggctgccacatcaggacaggctttcccccagtctgtttttgatcattgggatatgatgatggctgatcctttggaacaaggcactcaagcttcagatcttgtgactgagatcaggaggaggaagggtttgaaggctcagatgacccctctatctgattttgaggacaagctttaagtatgaggttactcgtaaaagttcctggaattcaagagctagatgacattgttgatccgaactagagttttggttgggagagtgttaatccgaaaagttcctcttttgttttccattttggtttttcttctgctgggtgtgcaacactattaatatttacgaaactttcacaatgttgattttgatccatgaaacaacattttccccagtagcaagtctttgtagtttataatagggatccatgaacatcaatgagatggtttttgtttgcagcttattattttggatgctgatagtaatgtttata

SEQ ID NO: 2270 - DNA, 2850 bp, Arabidopsis thaliana
atggtaagctttttttcttttctttcagagtactattcatttattttttgtgtagtgatctgccttgtgttttgtttaacacgtttttgttaaaaaatcttgcaggtgaagtttacagttgaagagcaacggaaaattacggatcgtaaacacaacatccgtaacatgtctgtcatcgcccatgtcgatcatgggaaatctacacttacggattcacttgttgctgctgctggtatcattgctcaagaaactgcgggtgatgtgcgtatgactgatactcgtgctgatgaggcagaacgtggtatcaccatcaagtccactggtatctctctctactatgagatgactgatgcgtctctgaagagtttcaccggagctagagatggcaatgagtacctgatcaacctcattgactctcctggacacgttgacttttcttcagaggtcacagctgctctccgtatcactgatggtgctcttgtggttgttgactgcattgaaggtgtttgtgtgcagactgagactgtgctcaggcaatctcttggtgaaaggattaggcctgttttgactgtcaacaagatggacaggtgtttccttgagcttaaggttgatggtgaggaggcgtatcagaatttccagagggtcattgagaatgctaatgtcatcatggccacgcatgaggatcctctcctcggtgatgttcaggtttaccctgaaaaggggacagtagctttctctgctggtctccacggatgggctttcactctcaccaattttgctaagatgtatgcttccaagtttggtgtctctgaatctaaaatgatggagaggctgtggggtgagaacttctttgattctgcaaccagaaaatggacgaccaaaaactggctccccgacctgcaagcgtgggtttgttcagttctgttatgaacccattaagataatgatcaacacttgtatgaatgatcagaaggataagctgtggccgatgttagagaagcttggtattcagatgaagcccgatgagaaagagttgatgggtaaacctttgatgaagcgtgtcatgcaggcatggcttcctgcgagtaccgctcttcttgaaatgatgatctttcacttaccatcaccctacactgcgcagaggtaccgtgttgagaacttgtatgaaggtccccttgatgataagtatgctgcagctatcagaaactgtgatccagacggtcctttgatgctctacgtctctaagatgattcccgcatctgacaagggcaggttctttgccttcggtcgtgtcttttctggtacggtttctactggtatgaaagtcaggatcatgggtcctaactatgtccctggtgaaaagaaagatctgtatgtcaaaagtgtgcagaggactgtcatttggatgggtaagaaacaagagacagtggaggatgttccttgtggtaatactgttgctatggttgggctggatcagttcatcaccaagaatggtaccttgacgaattagaaggaagtggacgcacacccgcttcgtgccatgaagttttctgtctctcccgttgttcgtgttgctgtgaaatgcaagctagcgtctgaccttcccaagcttgtagaaggtcttaagaggctggccaagtctgaccctatggttctatgcacaatggaagagtctggtgagcacattgttgcaggtgctggagaactccacattgaaatttgtgtcaaggatcttcaagattttatgggtggtgcggatatcatagtgtcagatcctgttgtttcgttacgagagacagtctttgagaggtcttgccggactgtgatgagtaagtccccaaacaaacacaaccgtctttacatggaagccagaccaatggaggatggtctagcagaggccattgatgaaggccgcatcggtccatctgatgaccccaagatccgatccaagattcttgcagaagagtttgggtgggacaaggatcttgccaagaaaatctgggcgtttggacctgacaccacagggcccaacatggtggttgacatgtgtaagggagtgcagtacttgaatgaaatcaaggactcagtggttgctgggttccaatgggcttcaaaggaaggtcctttagcagaggaaaacatgagaggggtctgttatgaggtgtgtgatgttgtgctccatgctgatgcaatccacagaggatgtggtcagatgatctcaacagcaagaagagccatctatgcatcacaactcacggccaagcctagacttcttgagccggtttacatggtcgagatacaagcacctgagggagctttaggaggaatctacagtgtgttgaatcagaagcgtggacatgtgtttgaagaaatgcaaaggccaggaacgcctctctacaacatcaaagcctaccttcctgtggtcgagtcatttggtttctcaggtcagctaagggctgcaacctcaggacaagcctttcctcagtgtgtgtttgaccattgggacatgatgtcttctgatccgcttgagactggctcacaggctgcgacattggtagctgatatcaggaagagaaaaggtttgaagctacaaatgactccactctctgattatgaagacaaattgtaagcggaacatagctcctctaactctttctcaaagactcttatctccctcttaggcttgtttattgttcacatttttgattcagacttacaccctgttttttgttcactctttttacttcatagacctatcaattcagtagtattgtttatactagttgagttattttctgtttcataacttgttttttttgttctcttcgatgacgaacgtcctaagcgtcg

SEQ ID NO: 2271 - DNA, 2716 bp, Brassica napus
agttatcgtaggtgacaaataagagtcagtacaaaatggtgaagtttacatccgacgagcttcgtaggattacggattacaaacacaacatccgtaaacatgtccgttattgcccatgtcgacccatgggtaaaatccaccctcactgactccttggttgctgctgctggtatcattgcccaagaagtagctggtgatgtccgtatgactgatacccgtgctgatgaggctgaacgtggtatcactatcaagtccacgggtatctctctctactacgagatgactgatgcttccttgaagagcttcactggtgcccagagatggtaacgagtaccttatcaatctcatcgactctcctggccacgttgacttctcctctgaggtcactgctgcactccgtatcaccgatggtgcccttgtggtggtcgactgtatcggagggtgtgtgtgttcagactgagactgtgctacgtcaggctcgtttggtgagagggatttacgggccccgttgcctgactgtcaactagatggaccggtctttcctgagcttcaggttgatggtgaggaggcttcagacttccagcggtcattgagaatgccaatgtcatcatggctacgtatgaggatcctctccttggtgatgttcaggtttaccctgagaagggaactgttgccttctctgctggtctccacggatgggctttcacctgaccaactttgccaagatgtatgcttccaagttcggtgttgacgagactaagatgatggagaggctggtggggtgagaacttcttcgaccctgccacaggaaatggagcagcaaagacactgggtccgctacctgcaagcgtgggttgtgcagttctgttatgaacccatcaagcagatcatcgccacttgcatgaacgaccagaaggataagttgtggcctatgttgcagaagcttggtgtccagatgaagtctgatgagaaggagcttatgggtaaacctttgatgaagcgtgtcatgcagacttggctccctgcgagtactgcattgcttgagatgatgatctttcaccttccatctccccacactgcacagaggtaccgtgttgagaatttattatgaaggtcctctcgatgatcagtatgccactgccatcagaaactgtgatcctaatggtccgctcatgctctatgtttctaagatgattcccgcttcagacaaaggaagattctttgctttgggacgtgtcttctctggaaaggtgtctaccggtatgaaggtcaggatcatgggtcccaactttgttcctggtgagaagaaagatctttatgtcaagagtgttcagaggactgtcatctggatggggtaagaggcaagagactgttgaggatgttccctgtggtaacaccgttgctatggttggtcttgatcagttcatcaccaagatgctacgctgacgaatgagaaagagttgatgctcatcctatccgtgcgatgaagttctctgtgtcccctgttgtacgtgttgctgttcagtgcaaggtcgcttctgatcttcccaagcttgttgagggacttaagaggctggccaagtctgaccctatggttgtgtgcacgatggaggagtcaggtgagcacattgttgctggtgctggagaactccatcttgagatttgcttgaagaatcttcaggatgatttcatggggggtgctgagattgtcaagtcagaccctgtcgtctcattccgtgagactgttttggagagatctgtgcgtactgtgatgagcaagtccccgaacaagcacaaccgtctgtacatggaggctaggcccttggaggatggtcttgcggaggcgattgatgaaggccgtattggtccaagagatgatccaagatacgttccaagatcttggctgaggagtttggctgggacaaggatctcgcaaagaagatatgggcgtttggacctgaaaccacagggcccaacatggttgttgacatgtgtaagggagttcaatacctgaatgagatcaaggattctgttgtggctgggttccagtgggcttccaaggaaggtcctctttgtgatgagaacatgagaggaatctgttttgaggtttgcgatgtggtgctccactctgatgctatccacagaggtggtggtcaggttatcccgacagcgaggagggttatctacgcctctcagatcactgccaagcccaggcttttggaaccggtttacatggttgagatccaagcaccagagggagctcttggaggaatctacagcgtgctgaatcagaagcgtggacacgtctttgaggagatgcagaggccaggaacaccgctttacaacatcaaggcgtacctgccagttgttgagtcatttggattctcaagtcagcttagagcagcaacctcaggacaggccttccctcagtgtgtgtttgatcattgggagatgatgtcgtctgacccattggaggcaggatcgcaggcttcaacgcttgtgactgacatcaggaagaggaagggtatgaaggaacagatgactcccttgtctgattttgaagacaagctgtaagcagccagccaagaagactactcgctatggtcacccttttctctctatctctaccgtattttgttttctgttttaatgttatgactttttctgtgttgccacatccttttgaaatactcttttgaagttgagaaaactagtt

SEQ ID NO: 2272 - DNA, 2499 bp, Arabidopsis lyrata
caggtgaagttcacagttgaagagcaacggaaaattatggatcgtaaacacaacatccgtaacatgtctgttattgcccatgtcgatcatgggaaatctactcttacggattcacttgttgctgctgctggtattattgcacaagaatctgctggtgatgttcgtatgactgatacgcgagctgatgaagcagaacgtggtatcaccatcaagtccactggtatctctctctactatgagatgactgatgagtctttgaagagtttcactggagctagagatggcaatgagtacctgatcaacctcattgactctcctggacacgttgacttttcatcagaagtcactgctgctctccgtattactgatggtgctcttgtggttgttgactgcattgaaggcgtttgtgtgcagaccgagactgtgctcaggcaatctcttggtgaaaggataaggcctgttttgactgtcaacaaaatggacaggtgtttccttgagcttaaggttgatggtgaagaggcttatcagaatttccagagggtcattgagaatgctaatgtcatcatggcgacgtatgaggatcctctccttggtgatgttcaggtttaccctgaaaaggggacagtggctttctctgctggtctccacggatgggctttcactcttaccaattttgctaagatgcatgcttccaagtttggtgtttctgaatctaaaatgatggagaggctgtggggtgagaacttctttgatcctgcaaccagaaaatggacgaccaaaaacactggctccgcgacctgcaagcgtgggatgatgatcaacacttgtatgaatgaccagaaggataagctgtggccgatgttggagaagcttggtattcagatgaagcccgatgagaaagagttgatgggtaaacctttgatgaagcgtgtcatgcaggcatggctccctgcgagtactgctctgcttgaaatgatgatatttcacttaccatcaccctacactgcgcagaggtaccgtgttgagaacttgtatgaaggtccccttgatgataagtatgctgcagctatcagaaactgtgatccagaaggtcctttgatgctctacgtctctaagatgattcctgcatctgacaagggtaggttctttgccttgggtcgtgtcttttctggtacagtttctactggtatgaaagtcaggatcatgggtcccaactatgtccctggtgaaaagaaagatctgtatgtcaagagtgtgcagaggactgtcatttggatgggtaagaagcaagagacagtggaggatgttccttgtggtaacactgttgctatggttgggctagatcagttcatcaccaagaacgctaccttgacgaatgagaaggaagtggacgcacacccgcttcgtgccatgaagttttctgtctctcccgttgttcgtgttgctgtaaaatgcaagctagcgtctgaccttcccaagcttgtagaaggtcttaagaggctggccaagtctgaccctatggttttatgcacaatggaagagtctggtgagcacattggtgcaggtgctggagaactccacattgaaatttgtgtcaaggatcttcaagattttatgggtggtgcggagatcatagtgtcagatcctgttgtttcgttgcgagagacagtctttgagaggtcttgccgcactgtgatgagtaagtccccaaacaagcacaaccgtctttacatggaagccagaccaatggaggatggtctagcagaggctattaatgaaggtcgcatcggtccatctgatgatcccaagatccgatccaagatccttgcagaagagtttggatgggacaaggatcttgccaagaaaatatgggcatttggacctgacaccacagggcccaacatggtggttgatatgtgtaagggagtgcagtacttgaatgaaatcaaggactcagtggttgctggtttccaatgggcttcaaaggaaggccctttagcagaagaaaacatgagaggggtctgttatgaggtgtgtgatgttgtgctccatgttgatgcaatccacagaggaggtggtcagatgatctcaacagcaagaagagccatctatgcatcacagctcacggccaagccaagacttcttgagccggtttacatggtcgagatacaagcacctgagggagctttgggaggaatctacagtgtgctgaatcagaagcgtggacatgtgtttgaagaaatgcaaaggccaggaacacctctctacaacatcaaagcctaccttcctgtggtcgagtcgtttaatttctcaggtcagctaagggctgcaacctcaggacaagcctttcctcagtgtgtgtttgaccattgggacatgatgtcttctgatccgctggaggctggctcacaggctgctacattggtagctgatatcaggaagagaaaaggtttgaagctacagatgactccactctctgatttcgaagacaaattgtaa

SEQ ID NO: 2273 - DNA, 2507 bp, Flaveria ramosissima
actgattctcttgtggctgctgcgggtattattgcccaagaagttgctggtgatgttcgtatgactgatacccgtgctgatgaagcagaacgtggtatcacaatcaaatccactggtatctccctttactatgagatgactgctgatgctttaaagagcttcaagggagaaagaaatgggaatgagtacctgattaatcttatcgattcacctgggcacgttgacttttcatctgaagttactgctgctctacgtatcactgatggtgccctggtggtggttgattgtattgaaggtgtttgtgtgcaaacagagactgttcttagacaagctcttggagaaagaatccggcctgttttaactgtcaacaagatggacaggtgttttcttgagcttcaggttgatggtgaagaagcatatcaaacctttcaaagggttattgaaaatgctaatgtcatcatggcaacttatgaggacccacttcttggtgatgtcatggtttaccctgagaaaggtaccgttgctttctcagctgggctccacggttgggcttttactctaaccaactttgcaaagatgtatgcttccaaattcggtgttgacgagtctaaaatgatggaaaggctttggggagagaactactttgacccgaaaaccaaaaagtggaccacaaagagcaccggctctccatcttgcaaacgtgggtttgttcagttctgttatgagccaatcaagcagattattaacacgtgcatgaatgatcaaaaagatcagttgtggcctatgttggctaagcttggtgtcaccatgaaatctgaagagaaagagttgatgggtaaggcattgatgaagcgtgttatgcagaactggcttccagctgctactgctttacttgaaatgatgatctttcatctgccttcacctcacactgcccagaaataccgtgttgagaatctgtatgagggtccgttggacgaccagtatgctaatgctattagaaactgtgacccggatggtcctcttatgctttatgtttctaagatgattcctgcttctgataaaggacgattctttgcctttggtcgtgtttttgctggtaaggtttctactggtttgaaagttaggatcatgggtccaaactatgtccctggtgaaaagaaagatttgtacgtcaagagtgttcagaggactgtcatctggatgggaaagaagcaagaaactgttgaagatgtgccatgtggtaacacagttgccatggttggtttggatcaattcatcaccaaaaacgcaacattgacaaacgagaaagaggttgatgctcacccgattagagccatgaagttctctgtttcccctgtggtgcgtgttgcggttcagtgcaaggttgcatcagatcttcccaagcttgttgaaggtctcaaacgtcttgctaaatctgaccctatggttgtttgcacaattgaggagtctggtgagcacatcattgctggtgctggtgagctgcatcttgaaatctgtttgaaggacttgcaagacgatttcatgggtggtgctgaaatcgttgtttcagacccggttgtctctttccgtgaaactgtcttggagaaatcatcccgcaccgtgatgagcaagtctccaaacaaacacaaccgtctctacatggaagctagacccctggaggatggtcttcctgaggctattgatgaaggcaggattggtccacgtgatgaccccaagattcgtggaaagatcttatctgaagaattcggttgggacaaggatttggctaaaaagatctggtgttttggtcctgaaacaactggtccgaacatggttgttgatatgtgtaagggagttcaatatcttaatgaaatcaaggattcagtggttgctgggttccagtgggcttctaaggaaggtgctttggctgaggagaacatgagaggtatttgctttgaagtgtgtgatgttgttcttcatgctgatgccattcacagaggtggtggtcaagtcattccaaccgctaggagagtcatctacgccgcccaactcaccgccaagccacgtttacttgagcccgtttaccttgttgaaattcaggcaccggagcaagcattgggtggaatctacagcgtgctgaatcaaaggcgtgggcacgtgtttgaggaaatgcagaggccgggtacccctctgtacaacattaaggcatatctccctgtggtggaatcattcgggttttcaggtgcgttgagagctgccacttcgggtcaagccttcccacaatgtgtgtttgatcactgggacatgatgggatcagacccattggaagctgggtcccaggcgagcacacttgtgactcagatccgtaagaggaagggtttgaaggagcagatgacaccgctatctgagttcgaggataagctgtaagcggctgaaatgctggccgagatactatcattataatcctctgggtttctggtttactatattttctataatattttttt

SEQ ID NO: 2274 - DNA, 2484 bp, Secale cereale
atcacttaggagagtgtacgaagggtggacacggagagtgggagtgagtactgatcgaacctgatgatcacctggtcacgtgacttctcttcggaagcacagctgctcttcgtatcaccgctggtgctttggtggtggttgactgtattgagggtgtctgtgtgcagactgaaactgtgctgcgccaagctcttggtgagaggattaggcctgttcttactgtgaacaagatggacagatgcttccttgagcttcaagtggaaggtgaggaagcataccagactttctcccgtgtcatcgaaaatgccaatgtcatcatggcaacatatgaagatgtgctccttggtgatgtccaagtgtacccagagaaggggactgttgcattctctgctggtttgcatgggtgggctttcacccttacaaactttgctaagatgtatgcctccaagtttggagttgatgaggcgaagatgatggagaggctgtggggtgagaacttttttgacccagccacaaagaaatggacctccaagaacactgggacagctacctgcaagagaggttttgttcagttctgctacgagccaatcaagcaaatcatagcaacctgcatgaatgatcagaaggataagttgtggcctatgttgaagaagcttggtgtgaccatgaagaatgatgagaaggacttgatgggcaaggctctcatgaagcgtgtgatgcaaacttggctgcctgccagtcgtgctctgcttgagatgatgatatttcacctcccctctccttcaaaggcacagaggtatcgtgtggagaacttgtatgaggggcctcttgacgatatatatgcaaatgctatcagaaactgtgaccctgacggtcctcttatgctgtatgtctccaagatgattccagcatctgacaagggtagattctttgcctttggtcgtgtttttgccgggagggtcgcaactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcacgaagaatgcaaccctgacaaatgagaaggaagttgatgcctgcccaatcagggcaatgaagttctctgtgtcccctgttgtgcgtgttgctgttcagtgcaaggtggcatctgatcttcctaagcttgttgagggtttgaagcggctggcgaagtctgaccctatggttctctgtagcattgaggagtctggtgagcatatcattgctggagctggagagcttcaccttgaaatctgtttgaaggatctgcaggaggacttcatgggtggtgctgaaattattgtttcccctcctgttgtctccttccgtgagactgttctggagaagtcctgccgcactgtcatgagcaagtcccccaacaagcataaccgtctttacatggaggctcgcccattggaggagggattggctgaggctattgatgatggccgcattggcccacgtgatgatcctaaggtgcgctccaagatcctgtctgaggagttcgggtgggacaaggatcttgccaagaagatttggtgctttggacctgagacgactggccccaacatggttgttgacatgtgtaagggagtgcagtatctgaatgaaatcaaggattctgttgtggctggtttccagtgggcatcaaaggaaggtgcattggctgaggagaacatgcgtggcatctgctttgaggtctgtgatgttgttctgcacactgatgctattcacaggggtggtggtcaggtcatcccaacagccaggagggtcatttatgcttctcagctcactgctaagccaaggctgctggagcctgtgtacctggttgagatccaggccccagagaacgcactcggcggtatctatggtgtgctgaatcagaagagagggcacgtgtttgaggagatgcagaggcctggtaccccgctgtacaacatcaaggcttacctccccgtcatcgagtcgttcgggttctcaagtaccctcagggctgctacatctggccaggctttcccccagtgtgtgttcgaccactgggacatcatgtcttcggatcctttggaggccggctcccagtctgcgacccttgtcacggagatccgcaagcgcaagggtctgaaggaacagatgacccctctgtctgatttcgaggacaagctctaaacttttggttctgttacatggtctagtttgcttttgctgctaagagagctgcactatattttctgtctattgagtcgtggctgtattgctattggaatgtcgtatctgtcgtggtactggtactttgttttgatgtctatcgatgttaaaacttagataaatatatctgttatctactggtagttcttggttatgtctg

SEQ ID NO: 2275 - DNA, 2530 bp, Pennisetum glaucum
atcaagtccactggtatttctctgtactatgagatgactgacgagtcgctgaagaattacaagggtcagagagatggcaacgagtacttaatcaaccttatcgactcacctgggcacgttgacttttcttcggaagtcacagccgcccttcgtatcactgatggtgctctggtggtggttgactgtattgaaggtgtctgtgtgcaaactgaaactgtgctccgccaggctcttggtgagaggatcaggccagtgcttactgtgaacaagatggacaggtgcttccttgagcttcaggtcgagggtgaggaagcctaccagactttctcccgtgtcattgagaatgccaatgtcattatggcaacatatgaagacaagctccttggtgatgtccaagtgtacccagagaagggaactgttgctttctctgctggtctgcacggctgggccttcaccctcaccaactttgccaagatgtacgcatcgaagtttggagttgatgaaactaagatgatggagaggctctggggcgagaacttctttgacccagccacaaagaagtggaccaccaagagcacaggctctgctacctgcaagagaggatttgttcagttctgctatgagccgatcaagcaaatcatcaaaacctgcatgaatgaccagaaggataagttgtggcctatgcttcagaagcttaatgttaccatgaagtctgatgagaaggaattgattggcaaggctttgatgaagcgtgttatgcaaacttggcttccagccagtactgcactgcttgagatgatgatattccaccttccttccccggcaacagcacaaaagtatcgtgtggagaacttgtacgagggtccccttgatgatatctatgctactgccatcaggaactgtgacccggagggtcctcttatgctgtatgtttctaagatgattccagcatctgacaaaggcaggttctttgccttcggtcgtgtcttctctgggaaggttgctactggtatgaaggtcaggatcatgggtcccaactatgtccctggccagaagaaggatctgtatgtcaagagtgtccagcgtactgttatctggatgggaaagaaacaagagtcagttgaggatgttccttgtggtaacaccgttgctatggttggtctggatcagttcatcacgaagaatgctacactcaccaatgagaaggaggttgatgcatgcccaatcagagcaatgaagttctctgtctcccctgttgtgcgtgttgctgttcagtgcaaggttgcctctgacctgcccaagctagttgaaggtttgaagcgtctggcaaagtctgatcctatggtcctctgtacaatggaagaatctggtgagcacattattgctggagctggtgagcttcaccttgagatctgcctgaaggatctgcaggaagacttcatgggtggtgctgaaattattgtttcaccacctgtggtctccttccgtgagactgttcttgagaaatcctgccggacagtcatgagcaagtcccccaacaagcacaaccgtctttacatggaagctcgtcccttggaagagggtctccctgaggctattgacgagggccgcattggtccacgtgatgaccccaaggttcgctccaagatcctatctgaggagttcggttgggacaaggatcttgccaagaagatttggtgctttggacctgagaccactggcccgaacatggttgtcgatatgtgtaagggagtgcagtatctcaatgaaatcaaggattctgttgtggctggcttccagtgggcctcgaaggagggtgcgctggctgaggagaacatgcgtggcatttgctttgaggtctgtgatgtcgttctccatgctgatgcaattcacaggggtggtggccaggtcattccaactgccaggagggtcatttatgcttctcagctcactgccaagccaaggctgctcgagccagtttaccttgtggagatccaggccccagaaaatgcacttggtggtatctatggtgttctgaaccagaagagaggtcatgtgtttgaggagatgcagaggcctggtaccccactctacaacatcaaggcttacctccctgtcattgagtcctttgggttctccagccagctgagggctgcaacctctggccaggcgttccctcagtgtgtgtttgaccactgggacatgatgggctctgatcctctggaggctggctctcaggctgctacactggtgttggatatccgcaagaggaagggtctcaaggagcagatgacccctctttctgagttcgaggacaagctctaaattttgtcgcttgtgctgccgttacccctgctggtttgataccctattcgtctactgtaacatgaactacttaaatgtttcatttcctttcaatatgcatctgtttctgaacatcattggtcatatggtagtgtgctgggaagacagtattttgttatccagttgtgatgtaacagatgaaacagagttagtatctgtggcttaa

SEQ ID NO: 2276 - DNA, 2313 bp, Secale cereale
tcagattctccccgggagcgccgccgcttcctcatctcccactctcacctctcggctcgggaggcggagaagcgaaaccccaaggaaccatttttccagtgtgacactcaaacagtcaagatggtgaagtttacagcggaggagctccgtggaatcatggacaagaagaacaatatcaggaacatgtcggttattgctcatgtagaccatggcaagtctacgcttacggattcccttgtggcagctgctgggattattgcccaggaagttgctggtgatgttcgcatgactgatacccgtgcagatgaggcagagcgtggtattacaatcaaatccacgggtatctctcttttctatcagatgactcctgaatcacttgagatgtacaagggtgatcgcgatggggacgaatacctgatcaaccttattgattcacctggccacgttgacttttcttcggaagtcacagctgctcttcgtatcactgatggagctttggttgttgttgactgtattgagggtgtctgtgtgcagaccgaaactgtgctgcgccaagctcttggtgagaggattaggccagtccttactgtgaacaagatggacagatgcttccttgagcttcaggtggaaggtgaggaagcatatcagactttctcccgtgttatcgaaaatgccaatgtcatcatggcaacatatgaagatgtgctccttggtgatgtccaagtgtaccctgaaaaggggactgttgcattctctgctggtctgcatgggtgggctttcacccttacaaactttgctaagatgtatgcctccaaatttggagttgatgagtcaaagatgatggagaggctgtggggtgagaacttctttgacccagctacaaagaaatggacctccaagaacactgggacagctacctgcaagagaggtttcgttcagttctgctatgagccaatcaagcaaatcatagccacctgcatgaatgatcagaaggataagttgtggcctatgttgaagaagcttggtgtgaccatgaagaatgacgagaaggacttgatgggcaaggctctcatgaagcgtgtgatgcaaacttggctgcccgccagtcgtgctctgcttgagatgatgatatttcacctcccctccccttcaaaggcacagaggtaccgtgtggagaacttatatgagggcccccttgatgatatatatgcaaatgctattagaaactgtgacccagatggtcctcttatgctgtatgtctccaagatgattccggcatctgacaagggtagattctttgcctttggacgtgtttttgctgggagggttgcaactggcatgaaggtccgcatcatgggtcccaactttgttcctggccagaagaaggatctgtatgtgaagagtgtccagcggactgtcatctggatgggaaagaagcaagagtctgttgaggatgttccctgtggtaacactgttgctttggttggtttggatcagttcatcacgaagaatgcaaccctaacaaatgagaaggaagttgatgcctgcccaatcagggcaatgaagttctctgtgtcccctgttgtgcgtgttgctgttcagtgcaaggtggcctctgatcttcccaagcttgttgagggtttgaagcgcctggcaaagtctgatcctatggttctctgtaccattgaagagtctggtgagcatatcattgctggagctggagagcttcaccttgaaatctgtttgaaggatctgcaggatgacttcatgggtggtgctgaaatcattgtttccccccctgtcgtctccttccgtgagactgttctggagaagtcctgccgtacagtcatgagcaagtccccgaacaagcacaaccgtctttacatggaagctcgccccttggaggagggcctggccgaggccattgatgatgggcgcattggcccacgtgatgatcccaaggtgcggtccaagatcctgtctgaggagtttgggtgggacaaggatcttgccaagaagatttggtgctttggacctgagacgactggccccaacatggttgttgacatgtgtaagggagtgcagtatctgaatgaaatcaaggactctgttgtggctgggttccagtgggcgtcgaaggaaggtgcactggctgaggagaacatgcgcggcatttgcttcgaggtctgtgatgttgttctccacactgatgctattcacaggggtggtggtcaggttattcccacggccaggagggtcatttatgcttctcagctgaccgccaagccaaggctgctggagcctgtctacctg

SEQ ID NO: 2277 - DNA, 2383 bp, Papaver somniferum
atttttacagaagcaaagatggtgaagtttacagctgaagagctgcgccggatcatggacctgaagcataatatcaggaacatgtccgtcattgctcatgtcgaccatggaaaatcaacacttactgattctcttgtggctgctgctggtattattgcccaagaaactgctggtgatgttcgtatgacagatacccgtgcagatgaggcagaacgtggtattacaattaaatctactggtatctctctctattatgagatgtctgatgagtctttaaaggcctacaagggtgacagaatgggtaacgagtacctcatcaaccttatcgattcacctggtcacgtcgacttttcttctgaagtcacagctgcattacgtattactgatggtgcacttgttgtggtggactgtattgagggtgtctgtgttcaaaccgagactgtccttcgacaagctcttggagaaaggatcaggcctgtgttgactgtcaacaagatggacagatgtttcctagagctacaggttgatggagaagaggcttatcagaccttctccagagttattgagaatgccaatgttattatggccacttatgaagacccactccttggtgatgtccaggtttaccctgaaaagggacagtcgccttctctgctggtttgcacggttgggctttcactctaaccaatttcgcaaacatgtatgcttctaagttcggtgttgagcacagtaagatgatggagaggctttggggtgagaacttctttgacccagcaactaagaagtggactaataagagaaccacatctcctacatgtaagcgtgggtttgtccagttctgttatgaacccatcaagcagatcattgccacttgcatgaatgatcaaaaggacaagttgtggcctatgttgcaaaagcttggtgttgtaatgaagaatgacgagaaggaattgattggaaagcccttgatgaagcgtgtgatgcagacttggctccctgctgctactgccctacttgaaatgatgatttatcatctcccctctccccacacagctcagaagtatcgtgttgagaacttgtacgagggtcctcttgatgaccagtatgctaatgccatcagaaactgtgatcccgatggtcctcttatgctctacgtgtctaagatgattcctgcctccgacaaaggtagattctttgcctttggtcgtgtctttgctggtaaggttgcaacaggtgctaaagtcagaatcatggggcctaactatgttcctggtgggaagaaggacttgtacaccaagagtgtccagaggactgttatctggatgggaaagaaacaggagtctgttgaggatgttccttgtggtaacacagttgccctggtcggattggatcaatttatcaccaagaatgcaaccctcacaaacgagaaggaagttgatgctcatccaatcagagccatgaagttttctgtctctcccgttgttcgtgttgctgtccagtgtaaggttgcctctgactgccaagctggttgaagggcttaagcgtctgtccaaatctgatcctatggttgtgtgtaccattgaggatcgggcgagcacattattgcaggtgctggagaactccatcttgagatctgtttgaaggatttgcaggatgatttcatgggtggtgctgaaattgtgaagtccgaccccgtggtgtctttccgtgagactgtgcttgaaaagtcttcaagaactgtgatgagcaaatctccaaacaagcacaaccgtttgtacatggaggcacgtcctcttgaggatggacttgctgaagccattgatgatggtcgtattggtccaagagatgatcctaaagttcgttcaaagatcttatctgaagagtttggatgggataaggatcttgcaaagaagatctggtgttttggtcccgatactactggtccaaacatggttgtggatatgtgtaagggagttcagtaccttaatgaaatcaaggattcagttgttgcaggttttcagtgggcgtcaaaggaaggtgtgctggcagaagagaacatgagaggtatatgctttgaagtatgtgatgtggttctccattctgatgccattcacagaggtggtggacaggttattcctactgctaggagagttatgtatgcctcacagctcacagctaaacccagacttttagaacctgtgtacctggtcgaaatccaggctcccgaaggtgctcttgggggtatctacggtgttctcaatcagaagcgtggtcacgtctttgaggaaatgcagagaccaggaactcctctgtacaacatcaaagcatatctacctgtagttgagtcatttggtttctctgcccagcttagggctgccacatc

SEQ ID NO: 2278 - DNA, 2323 bp, Secale cereale
tccatttcgttcctccggagcgccgccgctcctcatctcccacctctcggtctcgggagccggaagcgaaaccccaaggaactacccagcgtgacattcaaaagcagtcaagatggtgaagttcacagcagaggagctccgtggaattatggataaaaagaacaatatcaggaacatgtctgttattgcgcatgttgaccatggcaagtctacccttacggattcccttgtggcagctgctggaattatcgcccaggaagttgctggtgatgtccgcatgactgatacacgtgcagatgaagcagaacgtggtattactatcaaatccacgggtatctctctgttctatcagatgactcctgaatcacttgagatgtacaagggtgacagagatggggatgagtacctgatcaaccttattgattcacctggtcacgttgacttttcttcggaagtcacagctgctcttcgtatcaccgatggtgctttggtggtggttgactgtattgagggtgtctgtgtgcagactgaaactgtgctgcgccaagctcttggtgagaggattaggcctgttcttactgtgaacaagatggacagatgcttccttgagcttcaagtggaaggtgaggaagcataccagactttctcccgtgtcatcgaaaatgccaatgtcatcatggcaacatatgaagatgtgctccttggtgatgtccaagtgtacccagagaaggggactgttgcattctctgctggtttgcatgggtgggctttcacccttacaaactttgctaagatgtatgcctccaagtttggagttgatgaggcgaagatgatggagaggctgtggggtgagaacttttttgacccagccacaaagaaatggacctccaagaacactgggacagctacctgcaagagaggatttgttcagttctgctacgagccaatcaagcaaatcatagcaacctgcatgaatgatcagaaggataagttgtggcctatgttgaagaagcttggtgtgaccatgaagaatgatgagaaggacttgatgggcaaggctctcatgaagcgtgtgatgcaaacttggttgcctgccagtcgtgctctgcttgagatgatgatatttcacctcccctctccttcaaaggcacagaggtatcgtgtggagaacttgtatgaggggcctcttgacgatatatatgcaaatgctatcagaaactgtgaccctgacggtcctcttatgctgtatgtctccaagatgattccagcatctgacaagggtagattctttgcctttggtcgtgtttttgccgggagggtcgcaactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcaccaagaacgcaaccctgacaaatgagaaggaagttgatgcctgcccaatcagggcaatgaagttctccgtgtcccctgttgtgcgtgttgctgttcagtgcaaggtggcatctgatcttcctaagcttgttgagggtttgaagcggcttgcgaagtctgaccctatggttctctgtagcattgaggagtctggtgagcatatcattgctggagctggagagcttcaccttgaaatctgtttgaaggatctgcaggaggacttcatgggtggtgctgaaattattgtttcccctcctgttgtctccttccgtgagactgttctggagaagtcctgccgcactgtcatgagcaagtcccccaacaagcataaccgtctttacatggaagctcgcccattggaggagggattggctgaggctattgatgatggccgcattggcccacgtgatgatcctaaggtgcgctcaagatcctgtctgaggagttggttggacaaggatctcgccaagaagatttggtactttggacctgagacgactggccccaacatggttgttgacatgtgtaagggagtgcagtatctgaatgaaatcaaggactctgttgtggcgggttccatggcactcaaccgaggtgcacttggctgaggagaacatgcgtggcatttgctttgaggtctgtgatgttgttctgcacactgatgctattcacaggggtggtggtcaggtcatcccaacagccaggagggtcatttatgcttctcagctcactgctaagccaaggttgctggagcctgtctacctggttgagatccaggccccggagaa

SEQ ID NO: 2279 - DNA, 3030 bp, Pinus taeda
aattcggcaagaggggcagatgaagctgaacgtggcatcaccattaagtcaactggaatttcattgtactatgagatggaggatgcagctgtgaaaaatttcaagggggatagagaaggacatgaatatttgataaatctgattgattctccagggcacgttgacttttcttcagaagttacagcagccctgcgaatcacagatggtgcactggttgtggtagattgtattgaaggggtttgtgttcagactgagactgttcttcgtcaagctcttggagaaaggattaggcctgttctcaccgtgaacaagatggacaggtgctttcttgagttgcaggttgatggagaggaagcttaccaaaccttctcacgtgtcattgaaaatgcaaatgtgattatggctacttatgaagatcctcttcttggtgactgccaagtttatcctgaaaaaggcacagttgcattctcagcaggtctgcatgggtgggcatttaccctcacaaattttgcaaaaatgtatgcttcaaagtttggagtggatgaagcaaagatgatggagaggctctggggtgaaaacttttttgatccagctaccaagaaatggactaccaagaatacaggttctgcaacttgcaaaagaggatttgttcaattcatatatgaacctattaagcaaattatcaatatttgtatgaatgatcaaaaggataagttgtggcccatgttgcagaaattgggagttgtaatgaaaagtgatgagaaggagctggttgcaaaagcactcatgaagcgtgtcatgcaaacctggctacctgcaagtagtgctttacttgaaatgatgattttccatcttccttctccagcgaaggcacagagatatcgtgtggaaaacttgtatgaaggacctcttgatgatatatatgcaactgcaataagaaactgtgaccctgagggtccactgatgttgtatgtttcaaaaatgattccagcttcggacaaaggacgtttctttgcctttggtcgtgtttttgctgggagagttgcaacaggtatgaaggtaaggatcatgggtcccaactatgtgccaggtcagaagaaagatttatatacaaagagtgttcaaaggactgtgatatggatgggaaagaaacaagaatctgttgaggatgtgccttgtggaaatacagtggctttggttgggttagaccagttcataacaaaaaatgctacactgacaagcgagaaggaggttgatgctcatccgatcagagcaatgaagttctctgtgtcccctgttgtacgtgttgctgtgcagtgcaaggtggcatctgaccttccaaaacttgttgaagggctgaagcgtcttgctaagtcagatcctatggtggtttgtacaattgaggaatctggagaacatattattgcaggtgcaggagagcttcatcttgagatttgcttaaaagatctccaagaagattttatgggtggagctgagattgttgtttctgatcctgttgtctcatttagagaaactgttttggagaaatcatgccgtactgttatgagcaagtctccaaataaacataataggctttactttgaagcgagacctttagaagaaggtcttgcagaagcaattgatgatggtcgcattggcccgaaggatgatccaaaggctcgcgcaaaaatcctttctgaagaatttggatgggacaaagatttggctaagaagatctggtgttttggacctgaaaccactggtcccaatatggtggtggatatgtgtaagggagttcaatacttgaatgaaattaaagattctgtggttgctgcattccaatgggcatccaaggaaggtgctcttgcagaagaaaacatgcgtggtatttgctttgaggtttgtgacgtggttttgcacactgatgctatccatagaggaggtggccaggttatcccaacggccagaagggttatgtatgcatctcagcttactgccaaaccgcggcttcttgaaccagtgtatcttgttgagattcaggctcctgagaatgcccttggtggtatttatggtgtgttgaaccagaagagaggtcatgtttttgaagaaatgcagaggccaggtactccactatacaacatcaaggcatatctgccggttgttgaatcattcggattctcaagcactctccgcgctgcaacttccggccaggcttttcctcaatgtgtgtttgaccactgggatatgatgggctctgatccattggaatctgggtcacaagctggtcagcttgtgatcgatatacgtaagaggaagggtcttaaggagagtatgactcccttgtcagagtacgaagacaagctgtagagctttgttatgtttgcctgtcggatgctgtcaatattgaggatagtattttatttatagtaggatcagaaatcatcaaagctgccatttctttttgctacgtattgagtctcaaagggagagaccagacttcccagacttcactaagtatgaaaaggcaattgtttcaaccatcttgtaggcaggacttcaaaattcaaactgagtatgaaaaggaaattgtttgagccatcttgctgtcaggacattaaaattcagcgaataaattgaagttgctcacagattgtttaatagatccaactccaaaatgtttagttcaaatttttaattgatacttgcgaggctgttgagtgcttgatctggtctgccttttttatcattgtactttctatttcattttttgcaccgtacgattaagctccatggatcaattgattgctgtattgagaatcgaagggtaatgccatttcaagaatcccatagaatcttctctctgtcatcgtttgtctctttgaatgtaaatcctatttgtcctgaccacatctgaatattttttatattatgacatgtgattcctaacccttcatgttatgtttgaaccataattaaatcatcctctaaacctctggtaggagagcagcttccttgaatttgaaatgcgat

SEQ ID NO: 2280 - DNA, 2505 bp, Pennisetum glaucum
caatcaagtccactggtatttctctgtactatgagatgactgacgagtcgctgaagaattacaagggtcagagagatggcaacgagtacttaatcaaccttatcgactcacctgggcacgttgacttttcttcggaagtcacagccgcccttcgtatcactgatggtgctctggtggtggttgactgtattgaaggtgtctgtgtgcaaactgaaactgtgctccgccaggctcttggtgagaggatcaggccagtgcttactgtgaacaagatggacaggtgcttccttgagcttcaggtcgagggtgaggaagcctaccagactttctcccgtgtcattgagaatgccaatgtcattatggcaacatatgaagacaagctccttggtgatgtccaagtgtacccagagaagggaactgttgctttctctgctggtctgcacggctgggccttcaccctcaccaactttgccaagatgtacgcatcgaagtttggagttgatgaaactaagatgatggagaggctctggggtgagaacttctttgacccagccacaaagaagtggaccaccaagagcacaggctctgctacctgcaagagaggatttgttcagttctgctatgagccgatcaagcaaatcatcaaaacctgcatgaatgaccagaaggataagttgtggcctatgcttcagaagcttaatgttaccatgaagtctgatgagaaggaattgattggcaaggctttgatgaagcgtgttatgcaaacttggcttccagccagtactgcactgcttgagatgatgatattccaccttccttccccggcagtatcgtgtggagaacttgtacgagggtccccttgatgatatctatgctactgccatcaggaactgtgacccggagggtcctcttatgctgtatgtttctaagatgattccagcatctgacaaaggcaggttctttgccttcggtcgtgtcttctctgggaaggttgctactggtatgaaggtcaggatcatgggtcccaactatgtccctggccagaagaaggatctgtatgtcaagagtgtccagcgtactgttatctggatgggaaagaaacaagagtcagttgaggatgttccttgtggtaacaccgttgctatggttggtctggatcagttcatcacgaagaatgctacactcaccaatgagaaggaggttgatgcatgcccaatcagagcaatgaagttctctgtctcccctgttgtgcgtgttgctgttcagtgcaaggttgcctctgacctgcccaagctagttgaaggtttgaagcgtctggcaaagtctgatcctatggtcctctgtacaatggaagaatctggtgagcacattattgctggagctggtgagcttcaccttgagatctgcctgaaggatctgcaggaagacttcatgggtggtgctgaaattattgtttcaccacctgtggtctccttccgtgagactgttcttgagaaatcctgccggacagtcatgagcaagtcccccaacaagcacaaccgtctttacatggaagctcgtcccttggaagagggtctccctgaggctattgacgagggccgcattggtccacgtgatgatcccaaggttcgctccaagatcctctctgaggagttcggttgggacaaggatcttgccaaaaagatttggtgctttggacctgagaccactggcccgaacatggttgtcgatatgtgtaagggagtgcagtatctcaatgaaatcaaggattctgttgtggctggcttccagtgggcctcgaaagagggtgcgctggctgaggagaacatgcgtggcatttgctttgaggtctgtgatgtcgtcctccatgctgatgcaattcacaggggtggtggccaggtcattccaactgccaggagggtcatttatgcttctcagctcactgccaagccaaggctgctcgagccagtttacccaggccccagaaaatgcactgggtggtatctatggtgttctgaaccagaagagaggtcacgtgtttgaggagatgcagaggcctggtaccccgctctacaacatcaaggcttacctccctgtcatcgagtcctttgggttctccagccagctaagggctgcaacctctggccaggcgttccctcagtgtgtgtttgaccactgggacatgatgggctctgatcctttggaagcaggctcccaggctgctacgctggtgttggatatccgcaagaggaagggtctcaaggagcagatgacccctctttctgagtttgaggacaagctctaaattttgctcgcttgtgctgtctgctggtttaatcgccattttgtctgctgtagtggaattactctaatgtttcatttccttttagctgtcatgcatctgtctcgaacatcattggccatatggtattgtgctgctaagactgaattttgttatctggttgtgatgtctgagatgaaacagagtttgtatctgtggtctaa

SEQ ID NO: 2281 - DNA, 2890 bp, Papaver somniferum
gcggcacttcctctcagggatttgcctgttcagtgatatttggtagtaacaaagttattttttacagaagcaaagatggtgaagtttacagctgaagagctgcgccggatcatggacctgaagcataatatcaggaacatgtccgtcattgctcatgtcgaccatggaaaatcaacacttactgattctcttgtggctgctgctggtattattgcccaagaactgctggtgatgttcgtatgacagatacccgtgcagatgaggcagaacgtggtattacaattaaatctactggtatctctctctattatgagatgtctgatgagtctttaaaggcctacaagggtgacagaatgggtaacgagtacctcatcaaccttatcgattcacctggtcacgtcgacttttcttctgaagtcacagctgcattacgtattactgatggtgcacttgttgtggtggactgtattgagggtgtctgtgttcaaaccgagactgtccttcgacaagctcttggagaaaggatcaggcctgtgttgactgtcaacaagatggacagatgtttcctagagctacaggttgatggagaagaggcttatcagactttctccagagttattgagaatgccaatgttatcatggccacttacgaagacccactcctcggtgacgtccaggtttaccctgaaaagggaacagtcgccttctctgctggtttgcacggttgggctttcactctaaccaatttcgcaaacatgtatgcttctaagttcggtgttgaacacagtaagatgatggagaggctttggggtgagaacttctttgacccagcaactaagaagtggactaataagagaaccgcgtctcctacatgtaagcgtgggtttgtccagttctgttatgaacccatcaagcggatcattgccacttgcatgaatgatcaaaaagacgagttgtggcctatgttgcaaaagcttggtgttacaatgaagaatgatgagaaggaattgattggaaagcccttgatgaagcgtgtgatgcagacttggctccctgcagctactgccctacttgaaatgatgatttatcatctcccctctccccacacagctcagaagtatcgtgttgagaacttgtacgagggtcctcttgatgaccagtatgctaatgccatcagaaactgtgatcctgaaggtcctcttatgctctacgtgtctaagatgattcccgcctccgacaagggtagattctttgccttcggtcgtgtctttgctggtaaggttgcaacaggtgctaaagtcagaatcatggggcctaactatgttcctggtgggaagaaggacttgtacaccaagagtgtccagagaactgttatctggatgggaaagaaacaggagtctgttgaggatgttccttgtggtaacacagttgccctggtcggattagatcaatttatcaccaagaatgcaaccctcacaaacgagaaggaagttgatgctcatcctatcagagccatgaagttttctgtctctcccgttgttcgcgttgctgtccagtgtaaggttgcctctgacttgcccaagctggttgaagggcttaagcgtctgtccaaatctgaccctatggttgtgtgtaccattgaggagtcaggagagcacattattgcaggtgctggagaactccatcttgagatctgtttgaaggatttgcaggatgatttcatgggtggtgctgaaattgtgaagtccgaccccgtggtgtctttccgtgagaccgtgcttgaaaagtcttcaagaactgtgatgagcaaatctccaaacaagcacaaccgtttgtacatggaggcacgtcctcttgaggatggacttgctgaagccattgatgatggtcgtattggtccaagagatgatcctaaagttcgttcaaagatcttatctgaagagtttggatgggataaggatcttgcaaagaagatctggtgttttggtcccgatactactggtccaaacatggttgtggatatgtgtaagggagttcagtaccttaatgaaatcaaggattcagttgttgcaggttttcagtgggcgtcaaaggaaggtgtgctggcagaagagaacatgagaggtatatgctttgaagtatgtgatgtggttctccattctgatgccattcacagaggtggtggacaggttattcctactgctaggagagttatgtatgcctcacagctcacagctaaacccagacttttagaacctgtgtacctggtcgaaatccaggctcccgaaggtgctcttggtggtatctacggtgttctcaatcagaagcgtggtcacgtctttgaggaaatgcagagaccaggaactcctctgtacaacatcaaagcatatctacctgtcgttgagtcatttggtttctctgcccagcttagggctgccacatcaggacaggctttcccccagtctgtgtttgatcattgggatatgatgatggctgatcctttggaacaaggcactcaagcttcagatcttgtgactgagatcaggaggaggaagggtttgaaggctcagatgacccctctatctgattttgaggacaagctttaagtacgaggttactcgtaaaagttcctggaagtgaagagctagatgccattgttgatccgaactagagttttggttgggagagtgttaatcctaaaagacccctctttgttttccattttggtttttcttctgctgggtgtgtaacactattaatatttacgaaactttcacaatgtgttctcgtgattttgatccatgaaacaacatttttcccagtagcaagtctttgtagtttataatagggatccatgaacatcaatgagatggtttttgtttgcagctta

SEQ ID NO: 2282 - DNA, 2390 bp, Brassica napus
cttctctctctccaagagatatcgtaggtgaagaatataagagttagtcaaaatggtgaagtttacatccgatgagcttcgtcggatcatggattacaaacacaacatccgtaacatgtccgttattgctcatgtcgaccatggtaaatccaccctcactgactccttggttgctgctgctggtatcattgctcaagaagttgctggtgatgtccgtatgactgatacacgtgccgatgaggctgaacgtggtatcactatcaagtccacgggtatctctctctactacgagatgactgatgcttccttgaagagcttcactggtgccagagatgggaacgagtaccttatcaacctcatcgactctcctggccacgttgacttctcctctgaggtcactgctgcgctccgtatcactgatggtgcccttgttgtcgtcgactgtatcgagggtgtctgtgttcagacggagactgtgctgcgtcaggctcttggtgagaggattaggcccgtgctgactgtgaacaagatggacaggtgtttccttgagcttcaggttgatggtgaggaggcttaccagacgttccagagggttattgagaatgctaatgtcatcatggcgacgtatgaggatcctctccttggtgatgttcaggtttaccctgagaagggaactgttgccttctctgctggtctccacggatgggctttcactctgaccaactttgccaagatgtatgcttctaagttcggtgttgatgagactaagatgatggagaggctgtggggtgagaatttctttgaccctgccactaggaaatggagtagcaaaaacactgggtccgctacctgcaagcgtgggtttgtgcagttctgttatgagcccatcaagcagatcattgccacttgcatgaatgaccagaaggataagttgtggcctatgttgcagaagcttggagtccagatgaagtctgacgagaaggagcttatgggtaaacctttgatgaagcgtgttatgcagacttggctccctgcgagtactgctttgcttgagatgatgatctttcaccttccatctccccacactgcacagaggtaccgtgttgagaatctgtatgaaggtcctctcgatgaccagtatgccaccgccatcagaaactgtgatcctaatggccctctcatgctctatgtctctaagatgattcctgcctcagacaagggaagattctttgcttttggtcgtgtgttctctggtaaggtgtccactggtatgaaagtcagaatcatgggtcccaactttgttcctggtgagaagaaagatctttacgtcaagagtgttcagaggactgtcatctggatgggcaagaggcaagagactgttgaggatgttccctgtggtaacaccgttgctatggttggtcttgatcagttcatcaccaagaatgctacgctgacgaatgagaaagaagttgatgctcatcctatccgtgctatgaagttttctgtgtcccctgttgtacgtgttgctgttcagtgcaaggtcgcttctgatcttcccaagcttgttgagggacttaagaggctggccaagtctgaccctatggttgtgtgcacaatggaggagtcaggtgagcacattgttgctggtgcgggagaactccatcttgagatttgcttgaaggatcttcaggatgatttcatgggtggtgcggagattgtcaagtctgaccctgttgtctcattccgtgagactgttttggagcgatctgtgcgtactgtgatgagcaagtccccaaacaagcacaaccgtctgtacatggaggctaggcccttggaggatggtcttgcggaggcaatagatgacggccgtattggtccaagagatgatcccaagatacgttccaagatattggctgaggagtttggttgggacaaggatcttgcaaagaagatatgggcgtttggacctgaaaccacagggcccaacatggttgttgacatgtgtaagggagttcaatacctgaatgaaatcaaggactctgttgttgctgggttccagtgggcttccaaggaaggtcctctttgtgatgagaacatgagaggaatctgctttgaggtttgcgatgttgtgctccactctgatgctatccacagaggtggtggtcaggttatcccaacagcgaggagggttatttacgcgtcacagctcactgccaagcccagactgttggaaccggtttacatggtggagatccaagcaccagaaggagctcttggaggaatctacagcgtgctgaatcagaagcgtggacacgtctttgaggagatgcagaggccagggacacctctgtataatatcaaggcgtacctgccagttgtcgagtcatttg

SEQ ID NO: 2283 - DNA, 2406 bp, Cirsium arvense
gcctcatcgtcttctcaattctcatcggtattttggctgaaactttcactgtatttttgttggtgatatttgaagccaggcacaatggtgaagtttacagctgaggagctccgtcggatcatggactacaagcacaacattcgtaacatgtctgttattgctcatgttgatcatgggaaatctaccttgacggattctcttgtggctgctgctggtattattgcacaagaagtcgccggtgatgtgcgaatgactgatactcgtgctgatgaagcagaacgtggcatcactatcaagtctactggtatctctctttactatgagatgacggatgcagctcttaagagttttaagggagaacgtaatgggaatgagtacctgatcaatcttattgactcacctgggcacgttgacttttcttctgaggttactgctgccctacgtatcacggatggtgcattagttgttgttgattgtatcgaaggtgtctgtgtccagacagaaactgttcttcgacaagcccttggagaaaggattcggccagtcttgactgtcaacaagatggacaggtgtttccttgagcttcaggttgatggagaggaggcatatcagacgttccagagggttattgagaatgctaatgtcattatggcaacatatgaggacccacttcttggtgatgttatggtttaccctgagaaaggtactgttgctttctctgctgggttgcatggttgggcatttaccctaaccaactttgctaagatgtatgcctccaagtttggtgtggatgagtcgaaaatgatggaaaggctctggggagagaacttctttgaccctaaaacaaagaagtggaccaccaaaaatagtggctctccaacatgcaagcgaggctttgttcaattctgttatgagcccatcaagcagattatcaacacctgtatgaatgaccagaaagatctgttgtggcccatgttgacaaagcttggtgtcaccatgaagtctgatgagaaggagttgatgggcaaggcattgatgaagcgtgtcatgcagacatggcttcctgctgctactgccctacttgaaatgatgatctttcatctgccttctcctcacactgctcagaggtaccgtgttgagaacttgtacgagggtcctttggatgatgcttatgccaatgccattagaaactgtgaccctgatggccctctcatgctgtatgtctcgaagatgattccagcatctgacaaaggaagattctttgcttttggtcgtgtgtttgccgggaaggtttcaactggtttgaaggtaagaataatgggccccaattatgtcccaggtgaaaagaaagatctgtatgtgaagagtgttcaaaggactgtcatctggatgggaaagaaacaagagaccgtagaggatgtcccttgtggtaatacagttgcattggttggtttggatcagttcattaccaagaatgcaacattgacaaatgagaaagaagttgatgcacatccaattcgtgccatgaagttctccgtgtcaccggttgtgcgtgttgctgttcagtgtaaggttgcatcagaccttcctaagcttgttgaaggattgaagcggttagccaagtctgaccctatggttgtttgtaccattgaggagtctggtgaacatatcatcgcgggtgcaggagagctccatcttgaaatttgtttgaaagatttgcaagatgatttcatgggtggtgcagagattgttgtttcggatccagttgtgtccttccgtgaaactgttcttgagaagtcatcccgaacagtgatgagcaagtctcccaacaagcacaatcgtttgtacatggaagctaggccaatggaggaaggacttgcagagctattgatgaagggagagttgggcctcgggatgaccctaaggtacgtggtaagatcttggctgaggagtttggatgggacaaggatcttgcaaagaaaatctggtgttttggtcctgagactactgggcccaacatggtggttgatatgtgtaagggagtgcagtacttgaatgaaataaaggattcggttgttgctgggttccagtgggcttccaaggaaggtgcattggcagaagagaacatgagagggatatgctttgaggtgtgtgatgtggtactccatgcggatgccatccacaggggtggtggtcaagtgattccgaccgccaggagagttatctatgcttcacagctgaccgccaagcccaggctccttgagccggtgtacctggtggagattcaggcacctgaacaggctcttggtggaatctacagtgtgctgaatcaaaggcgtggacatgtgtttgaggagatgcagaggcctggtactccactgtacaacataaaggcttatctgccgg

SEQ ID NO: 2284 - DNA, 2618 bp, Platanus occidentalis
gcgaggtattactatcaaatcgactggtatttctctgtattatgagatggcagacgatgctgtaaagaacttcaagggagatcgtcaagggaacgagtatctcattaacctcattgactcccctggacacgttgacttctcatctgaggtcacagctgctctccgtattactgatggtgcgctagtggtggtagattgtgttgagggagtgtgtgttcaaactgaaaccgtcctgcgacaggctcttggtgaaaggattaggcctgtcttgactgtaaacaagatggacaggtgcttccttgagcttcaggttgatggagaagaggcttatcagactttccaaagagtcattgagaatgccaatgtgattatggccacatatgaggatcctcttcttggtgatgtacaagtttaccctgagaaaggaacagttgccttttctgctggtttgcatggttgggctttcaccttaaccaactttgccaagatgtatgcatccaagtttggtgtagatgagtcaaagatgatggagaggctctggggtgagaactactttgaccctgctaccaagaaatggacaagcaagaacaccggttcacctacctgcaagcggggatttgttcagttctgttatgaacctatcaagcagattataaacacttgcatgaacgatcaaaaggacaagctgtggccaatgttgcagaagctcggtgtggttatgaagtctgatgagaaagatttggtcgggaaggctttgatgaagcgtgtcatgcagacttggctcccggcaagcagtgcccttctggaaatgatgatttttcacctcccatcacctgccaaggctcagaggtatcgtgttgagaacttgtatgagggtcctatggatgatatttatgccactgctattaggaactgcgatccagagggacctcttatgctttatgtatctaaaatgattccagcatctgacaagggtaggttctttgcttttggccgtgtctttgctggaaaggtctcaacgggtttgaaggttagaatcatgggaccaaactacgtccctggtcagaaaaaggacttgtatgttaaaagtgtgcagaggactgttatttggatgggaaagaagcaggaatcagttgaagatgtgccctgtgggaacacagttgctttggttggtcttgaccaatttataaccaagaatgcaaccttgacaaatgagaaggaagttgatgcgcatccaattcgagctatgaagttttctgtctcacctgttgttcgtgtggccgtacagtgtaaggttgcatctgaccttcccaagcttgttgagggtctgaaacgtttagccaagtcagatcctatggtggtgtgtaccatagaggagtctggtgagcacatcattgctggtgctggtgaactccaccttgagatttgtttgaaggacttgcaggaggatttcatggggggtgcagagattgtacaatctgatcctgttgtttcgttccgtgagactgtcatggagaagtcaatccggactgtgatgagcaagtctccaaacaagcacaaccgtttgtacatggaagcacggccaatggaggaaggtcttgcagaggccattgacgaggggcgtattggtccaagggatgaccccaagattcgtgcaaagatcttggctgaggagtttgggtgggacaaggatcttgcaaaaaagatttggtgttttggccctgagaccaccggacctaacatggttgtcgacatgtgtaagggagtacaatatctgaatgaaattaaggactcagttgttgctgggttccagtgggcttcaaaggagggggcattggctgaagagaacatgagaggtatctgctttgaagtttgtgatgtggtcctgcatgctgatgctattcacagaggtggtgggcaggttatcccgacagcaaggagggtcatctatgcttctcagctcactgccaagccgaggctcctggagccagtctacctggttgagatccaggcccctgagcaagctcttggtggcatctatggtgttctcaaccagaagcgtggccatgtcttcgaggaaatgcagcgaccaggtaccccactctacaatatcaaggcttacttgcctgttgttgagtcgtttgggttctcgagcacacttagggctgcgacctcgggtcaggccttcccccagtgtgtgtttgatcattgggacatgatgtcatccgacccactggaatctggatcacaggcagcaactctggtggctgatatccggaagagaaaaggcttgaaggagcagatgactccactttctgagtttgaggacaagctataagttgccctcattgttgttgaggcgacaggatgaactggaggagtgaggtaaggttgagcaacacaattttattttcccttgatactaatatatttttccttctgtcactgtttattgcgttttctgagcaaaatgttgctgtgctcagttttgtcgtctaggacttgcatgtgcttgcaaggacatgaatgctttgttattgttttaagtattttgtttttggaacaattctttctggcacttttgccgagagatagttaaggtggttgtgtgtttccat

SEQ ID NO: 2285 - DNA, 2333 bp, Secale cereale
ctagagtaccgcagcagtacacggtaattacggttatctactgtaaccccgtacgtgtccttatctgtcctatcatcatctactcagtcatgtacgagtagaagtgaacagagctgggatcgatacctctagtcctaaccttcttcgatctacctcggtcacgttgtactttcttcgaagtcacagctgctccttgtatcacatggtgctttggtggtggttgactgtattgagggtgtctgtgtgcagactgaaactgtgctgcgccaagctcttggtgagaggattaggcctgtcctcaccgttaacaagatggacagatgcttccttgagcttcaagtggaaggtgaggaagcataccagactttctcccgtgtcatcgaaaatgccaatgtcatcatggcaacatatgaagatgtgctccttggtgatgtccaagtgtacccagagaaggggactgttgcattctctgctggtttgcatgggtgggctttcacccttacaaactttgctaagatgtatgcctccaagtttggagttgatgaggcgaagatgatggagaggctgtggggtgagaacttttttgacccagccacaaagaaatggacctccaagaacactgggacagctacctgcaagagaggttttgttcagttctgctacgagccaatcaagcaaatcatagcaacctgcatgaatgatcagaaggataagttgtggcctatgttgaagaagcttggtgtgaccatgaagaatgatgagaaggacttgatgggcaaggctctcatgaagcgtgtgatgcaaacttggctgcctgccagtcgtgctctgcttgagatgatgatatttcacctcccctctccttcaaaggcacagaggtatcgtgtggagaacttgtatgaggggcctcttgacgatatatatgcaaatgctatcagaaactgtgaccctgacggtcctcttatgctgtatgtctccaagatgattccagcatctgacaagggtagattctttgcctttggtcgtgtttttgccgggagggtcgcaactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcaccaagaatgcaaccctgacaaatgagaaggaagttgatgcctgcccaatcagggcaatgaagttctctgtgtcccctgttgtgcgtgttgctgttcagtgcaaggtggcatctgatcttcctaagcttgttgagggtttgaagcggctggcgaagtctgaccctatggttctctgtagcattgaggagtctggtgagcatatcattgctggagctggagagcttcaccttgaaatctgtttgaaggatctgcaggaggacttcatgggtggtgctgaaattattgtttcccctcctgttgtctccttccgtgagactgttctggagaagtcctgccgcactgtcatgagcaagtcccccaacaagcataaccgtctttacatggaagctcgcccattggaggagggattggctgaggctattgatgatggccgcattggcccacgtgatgatcctaaggtgcgctccaagatcctgtctgaggagttcgggtgggacaaggatcttgccaagaagatttggtgctttggacctgagacgactggccccaacatggttgttgacatgtgtaagggagtgcagtatctgaatgaaatcaaggactctgttgtggctgggttccagtgggcatcaaaggaaggtgcattggctgaggagaacatgcgtggcatctgctttgaggtctgtgatgttgttctgcacactgatgctattcacaggggtggtggtcaggtcatcccaacagccaggagggtcatttatgcttctcagctcactgctaagccaaggctgctggagcctgtgtacctggttgagatccaggccccagagaacgcactcggcggtatctatggtgtgctgaatcagaagagagggcacgtgtttgaggagatgcagaggcctggtaccccgctgtacaacatcaaggcttacctcccggtcatcgagtcgttcgggttctcaagtaccctcagggctgcgacatctggccaggctttcccccagtgtgtgttcgaccactgggacatcatgtcttcggatcctttggaggccggctcccagtctgcgacccttgtcacggagatccgcaagcgcaagggtctgaaggaacagat

SEQ ID NO: 2286 - DNA, 2555 bp, Eutrema parvulum
tttaactcttaaccacaggtgaagctcacagctaatgagctcagggcaattatggaccgtaagaacaacatccgcaatatgtctgtcattgcacatgttgaccacgggaaatcaactcttactgattctcttgtggctgctgcgggaatcattgaacaagaagttgctggtgatgttcgtatgactgatccacgtgaagacgaagcagagcgtggtatgacaatcaaatccaccggcatttcactttactaccaaatggaagacgaaagcctcgaaaactacaaaggcgaaagagatgggaatgagtatttgatcaatctgattgacacccctggccatgttgacttctcatcagaagtcacagctgcgttgcgtatcactgatggtgcccttgtggtggttgactgcattgaaggtgtctgtgtgcagactgagactgtacttcgtcaagcacttggtgagaggatcagacctgttttgacggtcaacaagatggaccgttgtttcctcgagcttcaggttgagggtgaagaagcttatcagactttgcaaagggtggttgaaaatgccaacgttatcatggctacttacgaagaccctcttcttggggatgttcaggtttatcctgagaaaggaacggttgctttctctgctggtttgcacggttgggcctttacactcactaactttgccaacatgtatgcttcaaagtttggagttgatgaatcgaaaatgatggaaaggctgtggggtgagaactttttcgaccctgccacggggaagtggacaagcaaaagcactggatcctcaacctgcaagcgtggctttgtccagttctgttatgagcccattaagaagatcatcaacacctgcatgaatgatgacaagagtaagctatggccgatgttgcagaagctcggtgtcacaatgaaatctgatgagaatgaactgatggggaaacacctgatgaagcgtgtgatgcagaattggctgccagccagtggtgctctccttgaaatgatgatctttcaccttccgtccccttccatagctcaaagataccgtgttgagaacttgtatgaaggctctctcgatgacaagtacgcaactgcaatacggaactgtgatcctgagggtcctctcatgctctacgtgtccaagatgatcccatcatcagataaagggagattctttgcctttggccgtgtcttttcagggaaagtggaaaccggtatgaaggtaaggattatgggtccaaacttcgtttcgggtgagaaaaaggagttgcacgtggagagtgtgcaacgtactgttatctggatggggaagagacaagagactgtggaagatgttccatgtggtaacactgtggctctggttggattagaccagtttataaccaagaacgcgactctcacaaacgaaaaggaagttgatgctcacactattcgggcaatgaagttctctgtttcccctgttgtccgtgttgctgttcagtgtaaagttgcctccgaccttccaaaacttgtggacgggcttgaaagactggccaaatcagaccctatggttgtttgcacaatggaagaatccggggaacacatcatcgccggtgctggagaactccaccttgagatgtgtttgaaggacttgcaagatgacttcatgggaggtgcagagatcataaaatcagatccagttgtctctttccgcgagacggttctcgaaaggtcttgcaggagggtgatgatcaaatccccaaacaagcataaccgtctgtacatggaagcacgccccttggaagaaggtctagctgaatccattgacgacggcatcatcggtccaagagacgaccccaaggcacgagccaagatattttccgaacagtttggatgggacaaggacctcgccaagaagatatgggcgtttggtccagagactacaggaccaaacattgttgtggacatgtgtaaaggagtccagtacctgaatacaatcaaggagtcagtagtgagtggtttccaatgggcatcaaaggaaggtattttatgtgaagaaaacatgagaggcatttgttttgaggtctgtgacgttgttctccactcacaccccattcgcagaccaggtggtcaggtcattgcaatggctagaaggggttgctacgcttctcagataaccgcaaagccgagacttgttgagccggtctacttggtggagatccaagcaccagaacaagcacttggaggaatatacagccttcttaaccagaaacgtggacacgtgtttgaagagttgcagagacaaggaacacctttgtacaacatcaaagcttatctcccggtttcagagtcctttgggttctcccgacagctcagggctgcaacatcggaacaggcgttctctcaggcgatcttcgaccactgggacgtgctgactttggatcctatggagaatggttcgcaggcttctgctattgttgcagatatcaggaagcgaaaggggctgaagctacaaatcactcccgtctccgagcttgaggacaagctataagggagcca

SEQ ID NO: 2287 - DNA, 2375 bp, Saccharum officinarum
gaccaacccgtccgccggcggcgcctgcacatctcgtctctcagatcgggaggcgaaaccaaggaatacatatacaaatttttagtgggatcatcataaaaagtcaagatggtgaagttcacggctgaagagcttcgtgccatcatggacaaaaagaacaacattcgcaatatgtctgttattgctcatgtggaccatggaaagtccacgcttacagattcccttgtggcagctgctgggattattgcccaggaagttgccggtgatgtccgcatgactgatactcgtgcagatgaagcagaacgtggtattacaatcaaatccactggtatctctctttactatgagatgactgatgagtcactgaagaactacaagggtgagagggatggtaaccaatatttgatcaaccttattgactcacctgggcacgttgatttttcttcggaagttacagctgctcttcgcatcaccgatggtgctctggtggtggttgactgtattgaaggtgtctgtgtgcaaactgaaactgtgctccgccaagcccttggtgagaggattaggccagtccttactgtgaacaagatggacaggtgcttccttgagcttcaggttgagggtgaggaagcttatcagactttctcccgtgtcattgagaatgccaacgtcattatggcaacatatgaagataagctcctaggtgatgtccaagtctacccagagaaggggactgttgctttttctgctggcctgcatggatgggcctttaccctcactaactttgccaagatgtatgcatctaagtttggagttgatgaagctaagatgatggagaggctttggggtgagaacttctttgaccctgccacaaagaagtggactaccaagagcacaggttctcctacgtgcaagagaggattcgttcagttctgctatgagccaatcaagcaaatcatcaagacctgcatgaacgaccagaaggagaaattgtggcccatgctgcaaaagctcaatgttaccatgaaggctgatgagaaggaattgattggcaaagctttgatgaagcgtgttatgcaaacgtggcttccagctagcactgcactgcttgagatgatgatattccaccttccttcccctgcaaaggctcaaaagtatcgtgtggagaatttgtatgagggaccccttgatgatgtctatgcaactgctatcagaaactgtgatccggagggacctcttatgctgtatgtttcaaagatgattccagcatctgacaagggcaggttctttgcctttggccgtgtcttctcagggaaggttgctactggtatgaaggttcggatcatgggtcccaactatgtccccggccagaagaaggatctgtatgtcaagagtgtccagcgtactgttatctggatgggaaagaaacaagagtctgttgaggatgttccttgtggtaacactgttgcaatggttggtctggatcagttcatcacgaagaatgctacactcactaatgagaaggaggttgatgcttgcccaatcagagcaatgaagttctctgtctcccctgttgtgcgtgttgctgtgcagtgcaaggttgcctctgaccttcccaagctagttgaaggtttgaagcgtctggcaaagtctgatcctatggttctctgtacaatggaagaatctggtgagcatatcattgctggagctggtgagcttcatcttgagatttgcctgaaggatctgcaggaggacttcatgggtggtgctgaaattatcgtatcccctcctgttgtgtccttccgtgaaaccgttcttgagaagtcctgccgtactgtcatgagcaagtcacccaacaagcacaaccgtctgtacatggaagcgcgccccttggaggagggtctcgctgaggccatcgatgagggccgcattggcccacgtgatgatcctaaggtgcgctcccaaatcctctctcaggagtttgggtgggacaaggacctcgccaagaagatttggtgttttggacctgagaccactggtccaaacatggttgttgatatgtgtaagggagttcagtatctcaatgaaatcaaggattctgttgtggctggtttccagtgggcctcaaaggagggtgcactggcagaggagaacatgcgtgggatttgttttgaggtctgtgatgtcgttcttcatgctgatgctatccacaggggtggtggccaggtcattccaactgccaggagggtcatctatgcttctcagctcacggccaagccaaggctgctggagccagtgtacctggtggagattcaggccccagaaaatgcacttggtggtatctacggtgttttgaaccagaagagagggcatgtctt

SEQ ID NO: 2288 - DNA, 2850 bp, Medicago truncatula
atcacaagtgtctgctgcaaagggtttaatgtgatcttttcattgttttctatatcctccaccagataaattctgctgtgtgtcaagctcttgtttgtaaggaataaaacctgtcaagatggtgaagttcacagttgatgaacttcgacggatcatggatctcaaacacaacattcggaatatgtctgttattgctcatgtcgaccacggaaaatcaactctaactgattctcttgtggctgctgctggcattatagcacaagaggttgcaggagatgttaggatgacagatacccgtcaagacgaagctgagcgtggcataacgatcaagtcaactggtatttctctctactatgagatgagtgatggtgatttgaagaatttcaagggagaacgtgaagggaacaagtaccttataaacctcattgactcgcctggacacgtagatttctcgtctgaggtcacagccgcacttcgcatcaccgatggagcacttgtcgtggtggattgtgttgaaggggtttgtgtacaaactgaaactgtgctgagacaagcacttggagaaaggattaaacctgttttaactgttaacaaaatggatagatgttttcttgagcttcatcttgatgcagaagaggcatactcgacgattcaaagagtcattgagagtgtgaatgttgtcatggcaacatatgaagatgctttacttggtgatgttcaggtttaccctgaaaagggaacagtttctttttctgctggtttacatggatggtcttttactctcaccaactttgctaagatgtatgcttcaaagtttggagttgatgaggagaagatgatgaataggctttggggtgaaaatttctttgactcttcaaccaaaaagtggactaacaagcacacatcgacgcctacttgcaagcgcggttttgtacagttttgttatgaaccaatcaagcagattattgaactttgtatgaatgatcagaaggataagttgtggccgatgttgcagaagcttggggttaatttgaagtcggaggagaaagaattgtcaggaaaggctttgatgaagcgtgttatgcagagttggctcccagctagtagtgcccttttggagatgatgatttttcaccttccttctcctaccaaggctcaaaagtatcgtgtcgagaatttgtatgagggcccccttgatgatccttatgcttctgcaatccgaaattgtgatcctgaaggacctttaatgctttatgtctcaaagatgattcctgcatctgataagggtaggttttatgctttcggtcgtgttttttcaggtaaggtttcaactggtatgaaggtcagaattatgggaccaaattatatccctggggagaagaaagatttgtatgtgaaaagtgttcagagaacagttatttggatgggaaagaagcaagaaaccgtggaggatgtcccttgtggaaatacagttgccatggtgggtttggatcaattcattaccaagaatgctactttaacaaatgagaaagaagtcgacgcacaccctattcgagctatgaagttttcagtgtcacctgtggtaagtgtagcagttacatgcaaggttgcatcggatcttcccaagttagtcgaaggccttaaacggttagcaaagtcagatcccatggtggtatgcacaatttcagagactggagaacatatcatagctgctgctggtgagctgcatcttgaaatctgcttgaaggatttgcaggatgatttcatgaatggagctgagattacaaaatcagatcctatcgtttctttccgcgagactgtgcttgagaagtctagccatactgtgatgagcaagtcaccaaacaaacacaaccgtttatacatggaagcaaggccaatggaggaagggcttgctgaggccattgatgatggaaggattggaccaagggatgagccaaaaaatcatttaaaaatattgtctgacgagtttggttgggacaaagatcttgccaaaaaagtatggtgtttcggacctgagactacaggtcccaacatgttggtagacacatgtaaaggcgtacaatatctgaacgaaatcaaggactccgtcgttgcaggttttcagatagcgtcaaaagaaggtccaatggctgatgagaacctgcgaggagtctgttttgaggtttgtgatgttgttcttcatactgatgccattcacagaggtggcggccagatcattccaactgctagaagagtgttctatgctgctatgcttacagcaaagccaagacttctagagccggtgtatctggttgaaatacaagcacctgaacatgctcttggaggtatatacagtgttcttaatcagaaaagaggtcacgtgtttgacgaaatccagaggcctaacaccccactttacaatgttaaggcatacttgcctgttattgaatcatttcaattcaatgaatcattaagggctcaaactggaggacaagctttccctcagttggtatttgaccactgggatatggtgccatctgatccgttagaacccgggacaccagccgctgcacgtgttgtcgagataagaaaaaagaaaggtttaaaggaacaactgattcctctctccgagttcgaggacaggctttaatgtgtcaataaattattctagaaacgatgtttgtatagtttcattgtttcctgtttttccattttgtgtgtgtaagggtcatgttgctgtgattttaaatattttaattataatttcttaatagtactgtcctagatatttcaattgtagtttctcatttactcatttgttttctaatagtatacaatttcattttttaa

SEQ ID NO: 2289 - DNA, 2630 bp, Secale cereale
ggagcgccgccgcttccccacctctcatctctccgctccggagacggaggccaagcagccccaaggaactatattcttagtgtgacactcaaaaccagtcaagatggtgaagtttacagcggaggagctccgcggaattatggacaagaaaaataatattcgtaacatgtctgttattgctcatgtcgaccacggcaagtctacgcttacggattcccttgtggcagctgctgggattatcgcccaggaagttgctggggatgttcgcatgactgatacccgtgcagatgaggcagagcgtggtattacaatcaaatccacgggtatctctcttttctatcagatgactcctgaatcacttgagatgtacaagggcgacagggatggtgatgagtacctgatcaaccttattgattcacctggccacgttgacttttcttcggaagtcacagctgctcttcgtatcactgatggtgctttggtggttgttgactgtattgagggtgtctgtgtgcagaccgaaactgtgctgcgccaagctcttggtgagaggattaggcctgttcttactgtgaacaagatggacagatgtttccttgagcttcagtttgaaggtgaggaagcatatcagactttctcccgtgtcatcgaaaatgccaatgtcatcatggcaacatatgaagatgtgctccttggtgatgtccaagtgtacccagagaaggggactgttgcattctctgctggtttgcatgggtgggctttcacccttacaaactttgctaagatgtatgcctccaagtttggtgttgatgaggtgaagatgatggagaggctgtggggtgagaacttctttgacccagccacaaagaaatggaccaccaagaacactgggacagctacctgcaagagaggttttgttcagttctgctatgagccaatcaagcaaatcatcgccacttgcatgaatgatcagaaggataagttgtggcctatgttgaagaagcttggtgtgaccatgaagaatgatgagaaggacttgatgggcaaggctctcatgaagcgtgtgatgcaaacttggctgcctgccagtcgtgctctgcttgagatgatgatatttcacctcccctctccttcaaaggcacagaggtatcgtgtggagaacttgtatgagggcccccttgatgacgtatatgcaaatgctatcagaaactgtgaccctgacggtcctcttatgctgtatgtctccaagatgattccagcatctgacaagggtagattctttgcctttggacgtgttttcgccggtagggttgcaactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcaccaagaatgcaaccctgacaaatgagaaggaagttgatgcctgcccaatcagggcaatgaagttctctgtgtcccctgttgtgcgtgttgctgttcagtgcaaggtggcttctgatcttcctaagcttgttgagggtttgaagcgtctggccaagtctgatcctatggttctctgtaccatcgaagagtctggtgagcatatcattgctggagctggagagcttcatcttgaaatctgtttgaaggatctgcaggatgacttcatgggtggtgctgaaatcattgtttcccctcctgtcgtctccttccgtgagactgttcttgagaagtcctgccgcactgtcatgagcaagtcccccaacaagcataaccgtctttacatggaggctcgcccattggaggagggattggctgaggctattgatgatggccgcattggcccgcgtgatgatcccaaggtgcgctccaagatcctatctgaggagtttggttgggacaaggacctcgccaagaagatttggtgctttggacctgagacgactggccccaacatggttgttgacatgtgtaagggagtgcagtatctgaatgaaatcaaggactctgttgtggctgggttccagtgggcatcaaaagaaggagcattgtgcgaggagaacatgcgtggtatctgctatgaggtttgtgatgttgttctccacactgatgctattcacaggggtgtggtcaggttatcccaacggcgaggagggtcatttacgcttctcagctcactgccaagccaaggctgctggagccagtctacctggttgagatccaggccccggagaacgcacttggtggtatctatggtgttctcaatcagaagagagggcacgtgttcgaggagatgcagaggcaaggtaccccactctacaacatcaaggcctacctgcctgtcatcgagtccttcggttctcgagcaccctgagggcggcgacgtccggccaggccttcccccagtgcgtgttcgaccactgggacatcatggcttccgaccctctggaccccggcacccagtcggcgacgctggtgacggagatccgcaagaggaagggtctcaaggagcagatgacccccctatccgatttcgaggacaagctc

SEQ ID NO: 2290 - DNA, 2690 bp, Aristolochia fimbriata
agatgaagcagagcgaggcatcaccattaaatctactggcatctctctctactatgaaatggatgatgcttcattgaaaagctacaaaggggagcgaagtggcaatgagtacttgattaacttgattgattcacctgggcacgttgatttttcttcggaggttactgctgcactccgtattaccgatggtgcattggttgtggttgattgtattgaaggtgtttgtgtccaaactgaaaccgttcttcgtcaagctcttggtgaaaggattaagcctgttttgactgtgaacaaaatggaccgttgctttctggagctcaaagtcaaaggtgaaaaagcttatcaaactttctcaagggtgattgaaaatgccaatgttattatggcaacttatgaggacccacttcttggggattgtcaggtctaccctgaaaaaggaactgttgctttctctgctgggctccatggttgggcattcactttaaccaattttgctaaaatgtacgcgtcgaagtttggggttgatgagtctaagatgatggaaagactttggggtgaaaattattttgatccttccacaaagaagtggacaaccagaaatactggtactccaacttgcaagcgtgggtttgttcaattctgttatgagccaattaagcaaatcataaatacttgcatgaatgaccagaaagataagctttggcctatgttaactaagcttggtgtaaccatgaaatctgatgagaaagagctgattggaaaacctttgatgaaaagagtcatgcagacatggctgcctgccagcagtgcacttcttgaaatgatgatctttcatctcccttctccttcaaaggctcagaaatatagggttgaaaacttgtatgagggcccacttgatgaccaatacgccaatgccatcagaaactgtgatcctgaaggtccacttatgctgtatgtttctaagatgattcctgcctctgataaaggtcgtttctttgcctttggccgtgtcttttctggcaaggtctccactggcatgaaggtcaggatcatgggcccaaattatgtaccgggacagaagaaagatttgtatgtgaagaatgtccagcgtactgttatttggatgggaaagaagcaggagtctgttgaagatgttccttgtggaaacactgttgctatggttggattggatcagttcattaccaaaaatgctactttgactggtgagaaggaagttgatgctcacccaattcgagccatgaagttctctgtttcccctgttgtgcgtgttgctgtacaatgcaaggttgcgtcagatctccccaaactggttgaaggtttaaaacggttggctaagtcagatcctatggttgtttgttcgattgaggagagtggtgaacatattgttgcaggagctggcgaactccatcttgagatctgtcttaaggatttgcaggatgacttcatgggtggagctgaaattattgtttctccccctgttgtttcattccgtgagactgtccttgagaagtcgtgccgtactgtgatgagcaagtcccccaacaaacacaatcggctttacatggaagctaggccaatggaagaagggttagctgaggccattgatgagggccgaattggaccaagagatgatccaaagagccgttctaagattctttctgaggagtttggctgggacaaggaccttgcaaggaagatttggtgttttgggcctgaaaccaccggaccgaacatggtggttgatgtatgtaagggagtgcagtacctcaatgaaatcaaggattctgttgttgctgggtttcagtgggcatccaaggaaggtgcccttgccgaggagaacatgcgtgcgatatgctttgaggtctgtgatgtggttctccatgctgatgcaattcacagaggtggtggtcaggttattccaactgcaagaagggtcatttatgcctctcagttgacagctaagcccaggttgctggagcctgtctatctcgtggagattcaggcacctgaacaggcccttggtggcatctacggtgttctgaatcagaagcgtggccatgtgtttgaagaactacagaggcctggaactcctctttacaacatcaaggcttatcttcctgtcattgaatcttttggattctcaactgacttgagagctgccacttctgggcaggccttcccacagtgcgtgtttgatcattgggatatgatgtcgtccgaccccatggaggcaacttctcaagctggtctgttggttgcagaaattaggaagaggaagggtttgaaggagcaaatgactcctttgtccgagtttgaagataaactgtgagtaagtacttgatggcggcgcagtgtctttatttgaaaccatatttggtctgttgtgaattttttgtttccgtcttcctttttttgaagttaggaaccagtataatatataaggtcttgtgttttagattagttttctgtggattttgttgagtaatttctgttttgtgacatttatcaagtaattgagttattgatctattttgcttaaggtttaaaaaaaaaaaaaaaaaaaaaaaaacaaaaaaaaaaaaaaaaaaaacaaaaaaaaaaaaaaaaacaaaaaaaaaaactaagaagaacaacgaacaacggaaggagagagagacacacgaggagag

SEQ ID NO: 2291 - DNA, 2360 bp, Pinus taeda
gggaagagcaaccagctgcaaagattctacaaacgaattgcagctagacacaggtgctcattggtattcaagagtaaggcaaaatggtgaagttcacagctgaagggcttcgtacgatcatggacagaaagcataacatacgaaacatgtctgttattgcccatgttgaccacggaaaatccactctcactgattctttggtagcagcagctggtatcattgctcaagaagttgccggagatgtcagaatgactgatactcgggcagatgaagctgaacgtggcatcaccatcaagtcaactggaatttcattgtactatgagatggaggatgcagctgtgaaaaatttcaagggggatagagatggacatgaatatttgataaatctgattgattctccagggcacgttgactttcttcagaagttacagcagccctgcgaatcacagatggtgcactggttgtggtagattgtattgaaggggtttgtgtccagactgagactgttcttcgtcaagctcttggagaaaggattaggcctgttctcactgtgaacaagatggacaggtgctttcttgagttgcaggttgatggagaggaagcttaccaaaccttctcacgtgtcattgaaaatgcaaatgtgattatggctacttatgaagatcctcttcttggtgactgccaagtttatcctgaaaaaggcacagttgcattctcggcaggtctgcacgggtgggcatttaccctcacaaattttgcaaaaatgtatgcttcaaagtttggagtggatgaagcaaagatgatggagaggctctggggtgaaaacttttttgatccagctaccaagaaatggacaaccaagaatacaggttctgcaacttgcaaaagaggatttgttcaattcatatatgaacctattaagcaaattatcaatatttgtatgaatgatcaaaaggataagttgtggcccatgttgcagaaattgggagttgtaatgaaaagtgacgagaaagagctggttgcaaaagcactcatgaagcgtgtcatgcaaacctggctacctgcaagtagtgctttacttgaaatgatgattttccatcttccttctccagcgaaggcacagagatatcgtgtggaaaacttgtatgaaggacctcttgatgatatatatgcaactgcaataagaaattgtgaccctgatggtccactgatgttgtatgtttcaaaaatgattccagcttcggacaaaggacgtttctttgcctttggtcgtgtttttgctgggagagttgcaacaggtatgaaggtaaggatcatgggtcccaactatgtgccaggtcagaagaaagatttatatacaaagagtgttcaaaggactgtgatatggatgggaaagaaacaagaatctgttgaggatgtgccttgtggaaatacagtggctttggttgggttagaccagttcataacaaaaaatgctacactgacaagcgagaaggaggttgatgctcatccgatcagagcaatgaagttctctgtgtcccctgttgtacgtgttgctgtgcagtgcaaggtggcatctgaccttccaaaacttgttgaagggctgaagcgtcttgctaagtcagatcctatggtggtttgtacaattgaggaatctggagaacatattattgcaggtgcaggagagcttcatcttgagatttgcttaaaagatctccaagaagattttatgggtggagctgagattgttgtttctgatcctgttgtctcatttagagaaactgttttggagaaatcatgccgtactgttatgagcaagtctccaaataaacataataggctttactttgaagcgagacctttagaagaaggtcttgcagaagcaattgatgatggtcgcattggcccgaaggatgatccaaaggctcgcgcaaaaatcctttctgaggaatttggatgggacaaagatttggctaagaagatctggtgttttggacctgaaaccactggtcccaatatggtggtggatatgtgtaagggagttcaatacttgaatgaaattaaagattctgtggttgctgcattccaatgggcatctaaggaaggtgctcttgcagaagaaaacatgcgtggtatttgctttgaggtttgtgacgtggttttgcacactgatgctatccatagaggaggtggccaggttatcccaacggccagaagggttatgtatgcatctcagcttactgccaaaccacggcttcttgagccagtatatcttgttgagattcaggctcctgagaatgcccttggtggtatttatggtgtgctgaaccagaagagaggtcatgtttttgaagaaatgc

SEQ ID NO: 2292 - DNA, 2273 bp, Triticum aestivum
ttggttgttgttgactgtattgagggtgtctgtgtgcagactgaaactgtgctgcgccaagctcttggtgagaggattaggcctgtcctcaccgtgaacaagatggacagatgcttccttgagcttcaggtggaaggtgaggaagcatatcagactttctcccgtgttatcgaaaatgccaatgtcatcatggcaacatatgaagatgtgctccttggggatgtccaagtgtaccctgaaaaggggactgttgcattctctgctggtctgcatgggtgggctttcacccttacaaactttgctaagatgtatgcctccaagtttggagttgacgaggcaaagatgatggagaggctgtggggtgagaacttcttcgacccagccacaaagaaatggacctccaagaacaccgggacagctacctgcaagagaggtttcgttcagttctgctatgagccaatcaagcaaatcatagccacctgcatgaatgatcagaaggataagttgtggcctatgttgaagaagcttggagtgaccatgaagaatgatgagaaggacttgatgggcaaggctctcatgaagcgtgtgatgcaaacttggctgcctgccagtcgtgctctgcttgagatgatgatatttcacctcccctctccctcgaaggcacagaggtatcgtgtggagaacttgtacgagggtccccttgatgatatatatgctaatgctatcagaaactgcgaccctgatggtcctcttatgctgtatgtctccaagatgattccagcatctgacaagggtagattctttgcctttggacgtgtttttgctgggagggttgccactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgcgttggttggtttggatcagttcatcacaaagaatgcaaccctgacaaatgagaaggaagttgatgcctgcccaatcagggcaatgaagttctctgtgtcccctgttgtgcgtgttgctgttcagtgcaaggtggcctctgatctcccagcttgttgaggtttgaagcgtctggcaaagtctgatcctatggttctctgtaccattgaagagtctggtgagcatatcattgctggagctggagagcttcaccttgaaatctgtttgaaggatctgcaggatgacttcatgggtggtgctgaaattattgtttcccctcctgtcgtctccttccgtgagactgttctggagaagtcctgccgcactgtcatgagcaagtccccgaacaagcacaaccgtctttacatggaagctcgccccttggaggagggactggctgaggccattgatgacgggcgcattggcccgcgtgacgatcctaaggtgcgttccaagatcctgtctgaggagtttggctgggacaaggatcttgccaagaagatttggtgctttggacctgagacgactggacccaacatggtcgttgacatgtgtaagggagtgcagtatctcaatgaaatcaaggactctgttgtggctgggttccagtgggcgtcaaaggaggcgcgttggctgaggagaacatgcgtggcatttgctttgaggtctgtgatgttgttctccacactgatgctattcacaggggtggtggtcaggtcattcccacggccaggagggtcatttatgcttctcagctcactgccaagccaaggctgctggagcctgtgtacctggttgaaatccaggccccggagaatgcgcttggtggcatctatggtgttctgaatcagaagagagggcacgtgttcgaggagatgcagaggcaaggtaccccgctctacaacatcaaggcctacctccccgtcatcgagtcctttgggttctcaagcaccctgagggctgcgacgtccggccaggccttcccccacgtgtgtgtttgaccactgggacatcatggcttccgatcctttggaccccggcacccagtctgcgacgctcgtcacggagatccgcaagaggaaggggctcaaggagcagatgacccctctatccgatttcgaagacaagctctaaatttttggtgctgttatcccttacctggtcttgtgttgttaaagagagccgcactattttgtatcgatgagtcttgctgttaatgacctatttgtcgtgatactgggaactatgttttg

SEQ ID NO: 2293 - DNA, 2590 bp, Gossypium hirsutum
aaatgtctgatgactctttgaagagctacaaaggagagagacaagggaatgagtacctcatcaatcttatcgattcccctgggcacgttgacttttcatccgaggtcacagctgctctacgtattactgatggtgcccttgtggttgttgattgtattgaaggtgtctgtgtgcaaacagagactgttctccgtcaggctcttggagaaagaatcaggcctgtcttgactgttaacaagatggataggtgcttccttgagctccaggttgatggagaggaggcttaccagacattccagagagtgattgaaaatgctaatgtcatcatggccacctatgaagatcctcttcttggtgatgttcaagtctacccagagaagggaacagttgctttctctgctggtttgcatggttgggcttttaccttgaccaactttgctaaaatgtacgcctctaaatttggagttgatgaggcaaagatgatggaaagactttggggtgagaacttttttgatccagctaccaagaagtggaccaccaagaacactggctctggtacctgcaagcgtggatttgttcagttctgttatgaacccatcaagcagataatcaacacttgtatgaatgaccagaaggataagctctggcccatgctgcaaaagcttggtgtcaccatgaagtctgatgagaaggacttgatggggaagtccctaatgaaacgtgtaatgcagacgtggcttcctgctagcagtgctctcctggaaatgatgatcttccaccttccctctcctagcaaggctcagaaatatcgtgttgagaacttgtatgagggtcctcttgatgatgtctatgccaatgctatcaggaactgtgatcctgagggtcctcttatgctctatgtttcaaagatgattcctgcttctgataagggtaggttctatgcttttggtcgtgtcttctctggcaaagtttcaactggcctgaaggtcaggatcatgggtccaaactatgtccctggtgagaagaaagatttgtatgtcaagagcgtacagagaactgttatttggatgggaaagaagcaggaaactgttgaggatgttccttgtggtaacacagtggccatggttggtctggatcagtttatcaccaagaatgctactttgactaatgagaaggaagttgatgcgcacccaattcgtgcaatgaagttctctgtctctcctgttgttcgtgttgctgttcagtgcaaggttgcatctgatcttcccaaacttgttgaagggctgaagcgtttggccaagtctgatcctatggttgtttgtacaattgaagagtcgggagagcacattgttgctggtgctggagagctccaccttgagatctgtcttaaggatttgcaagaagattttatgggtggtgctgagatcatcaagtcagacccggttgtctcattccgtgaaactgtcctagagaggtcttgcaggactgtaatgagtaagtctcccaacaagcacaaccgattatacatggaagctcgacccttggaggaaggtctggctgaagccattgatgaaggtcgtattggtccaagagatgatcccaaggttcgttcaaaaattttggctgaggagtatggatgggacaaagatcttgctaagaagatatggtgttttggccctgagaccacaggtcctaacatggtggttgatatgtgtaagggagttcagtacctgaacgaaattaaggattctgtagtcgctgggttccaatgggcatcaaaggaaggtgcaatggccgaagagaacatgaggggtatatgctttgaagtttgtgatgtggttcttcatactgatgctatccatagaggtgggggtcagatcattccaactgctaggagggttttctatgcttctcagctgactgccaagccgaggctgcttgagccagtgtacttggtggagatccaagccccagagcaagcacttggtggtatttacagtgttcttaaccagaagcgaggacatgtgtttgaggagatgcagaggcctggtactccactatacaacatcaaagcataccttcctgttatcgagtcatttggattctcaagcaccctgagggctgcaacttcaggacaggctttcccacaatgcgtgtttgaccactgggatatgatgtcatcagatccattggaacctggttcccaggcagccaaccatgttgctgagatccgtaagaggaagggattgaaggagcagatgaccccgctctccgattacgaggacaagctgtaagctaagcaacaaaataataattaattgaagaggttacgttacccattttatgcaatgctgctagttagttccttctatattttgtttactggtggacttagatggtttttacaatggacacgattgttatgtttttttgtattcaaatagacaattggctttgttaatgtttttgacctccataatcttcattttctgacttatttacattgcttatattatatgtttatttatattttgctgattttccttaaattacttgtaatattttacaattctatttgttatgtctagtc

SEQ ID NO: 2294 - DNA, 2533 bp, Trigonella foenum-graecum
atcttgatatttgatttattttttttggacggaatattttaggaattagggttgggattgcgtttttggttttgcttggtccatatatacatatatcttcacacacttcacactctctctctcttatagcatcacacgcgagaaaggcagcaccattccatagccgcctctctctcgatctctcgttctttctttcagtactaaaagactccttttttgcggactagaaagaccagtcaagatggtgaagttcacagctgatgagttacgtcgcattatggactacaagcacaacattcgtaatatgtctgtcattgctcatgttgaccatggaaaatctactctaacagactctctagtcgctgctgccggaattattgcccaagaagttgctggtgatgtccgtatgacggacacccgtgctgatgaagctgagcgtggtattacaatcaagtctaccggtatctcactctactatgaaatgactgatgagtctctctcgaggtacaagggagagcgcaatggaaatgagtatctcattaatctcattgattcccctgggcacgtcgacttctcatctgaggttactgctgcactccgtattacagacggagcacttgtggtggttgactgtgtggaaggtgtttgtgtccaaactgaaactgtgctgcgacaagctcttggagaaaggatcaggcctgttcttacagttaataagatggacagatgcttccttgagctccaggttgatggagaggaggcataccagacctttcaaagggtcattgagaatgctaatgtgattatggctacctatgaagatccacttcttggtgatgttcaggtgtatccagagaaaggaacagttgctttctctgctggtttgcatggttgggcttttactttgaccaactttgcaaaaatgtatgcctcaaaatttggtgttgatgagaccaagatgatggagaggctttggggtgaaaatttctttgatccagccacaaaaaaatggaccaccaagaatactggtgcagcttcttgcaagcgtgggtttgttcagttttgttatgagcctatcaagcagatcatcaacacttgtatgaatgatcagaaggataagttgtggcctatgcttacaaagctgggggtcaccatgaagtctgatgagaaagacctgatgggtaagccattgatgaaacgtgtcatgcagacctggctgccagcaagtactgcactcctagaaatgatgatctttcatcttccctcaccatcaactgcccagaggtaccgtgttgagaatttgtacgagggtccccttgacgatcaatatgcaaatgctatccgaaactgtgatcctgaaggacctctgatgctttatgtctcaaagatgattccagcatctgataaaggaaggttttttgcttttggccgtgtgtttgccggtaaggtttccacaggtatgaaggtcagaattatgggaccaaattatgtccctggggagaagaaggatttgtatgtgaaaagtgtccagagaactgttatttggatgggaaagagacaggagactgttgaggatgtgccttgtggtaacactgttgctatggttgggttggatcaatttatcacgaaaaatgctacattgacaaatgagaaggaagttgatgcccaccctatccgagctatgaagttttccgtctcacctgttgtgcgtgttgctgttcagtgcaaggttgcttcagatcttcccaagcttgttgaaggtctcaaacgtcttgctaagtcagatcctatggttgtttgtactattgaggagtctggagaacacattgttgctggtgcaggagagcttcatcttgagatctgtttgaaggatttggtggatgatttcatgggtggagctgagattatcgtatccgaccctgttgtgtccttcagagagactgttctagagagatcatgccgcactgtgatgagtaaatcacccaacaagcacaacagattgtacatggaagctagaccgttggaggatgggcttgcagaggccattgatgatggcaagattggaccaagggacgaccctaagaatcgttccaaaatcttatcagaagactacggttgggataaggatcttgccaagaaaatctggtgttttggacccgagaccactggacccaacatggtggttgatatgtgtaagggagtccaatacttgaatgaaatcaaggattctgttgttgctggattccagtgggcatcaaaagaaggtgctttgtctgaagaaaacatgagagccatttgctttgaagtatgcgatgttgtcctccacactgatgctatccacagaggaggtggtcagatcattcctactgctaggagagtcttctatgcctcccagctcacagccaaacccagacttctggagcctgtttacatggtggaaatccaagctcctgagcaagctcttggtggtatctacagtgttcttaatcagaaacgtggacatgtctttgtaagaaatagcagaggcctggta

SEQ ID NO: 2295 - DNA, 2556 bp, Secale cereale
cgacagctgcgtcttcgttatcacttgatggtaggctttggtttggtttgtttggtactagtattgagggtggtctgtgtgcgagaccggaaactacgtggctgcggcaagctcttgtgagaggattaggccagtccttactgtgaacaagatggacagatgcttccttgagcttcaggtggaaggtgaggaagcatatcagactttctcccgtgttatcgaaaatgccaatgtcatcatggcaacatatgaagatgtgctccttggtgatgtccaagtgtaccctgaaaaggggactgttgcattctctgctggtctgcatgggtgggctttcacccttacaaactttgctaagatgtatgcctccaaatttggagttgatgagtcaaagatgatggagaggctgtggggtgagaacttctttgacccagctacaaagaaatggacctccaagaacactgggacagctacctgcaagagaggtttcgttcagttctgctatgagccaatcaagcaaatcatagccacctgcatgaatgatcagaaggataagttgtggcctatgttgaagagcttggtgtgaccatgaagaatgacgagaaggacttgatgggcaaggctctcatgaagcgtgtgatgcaaacttggctgcctgccagtcgtgctctgcttgagatgatgatatttcacctcccctctccttcaaaggcacagaggtatcgtgtggagaacttatatgagggtccccttgatgacgtatatgcaaatgctatcagaaactgtgaccctgatggtcctcttatgctgtatgtctccaagatgattccagcatctgacaagggtagattctttgcctttggacgtgtttttgccgggagggtcgcaactggcatgaaggtccgtatcatgggtcccaactttgttcctggccagaagaaggatctgtatgtgaagagtgtccagcgtactgtcatctggatgggaaagaagcaagagtctgttgaggatgttccctgtggtaacactgttgctttggttggtttggatcagttcatcaccaagaatgcaaccctgacaaatgagaaggaagttgatgcctgcccaatcagggcaatgaagttctctgtgtcccctgttgtgcgtgttgctgttcagtgcaaggtggcttctgatcttcctaagcttgttgagggtttgaagcgtctggccaagtctgatcctatggttctctgtaccattgaagagtctggtgagcatatcattgctggagctggagagcttcaccttgaaatttgcttgaaggatctgcaggatgacttcatgggtggtgctgaaatcattgtttcccctcctgtcgtctccttccgtgagactgttcttgagaagtcctgccgcactgtcatgagcaagtcccccaacaagcataaccgtctttacatggaggctcgcccattggaggagggattggctgaggctatcgatgatggccgtattggcccgcgtgatgatcccaaggtgcgctccaagatcctatctgaggagtttggttgggacaaggacctcgccaagaagatttggtgctttggacctgagacgactggccccaacatggttgttgacatgtgtaagggagtgcagtatctgaatgaaatcaaggactctgttgtggctgggttccagtgggcatcaaaagaaggagcattgtgcgaggagaacatgcgtggtatctgctatgaggtttgtgatgttgttctccacactgatgctattcacaggggtggtggtcaggttatcccaacggcgaggagggtcatttacgcttctcagctcactgccaagccaaggctgctggagccagtctacctggttgagatccaggccccggagaacgcacttggtggtatctatggtgttctcaatcagaagagagggcacgtgttcgaggagatgcagaggcaaggtaccccactctacaacatcaaggcctacctgcctgtcatcgagtccttcgggttctcgagcaccctgagggcggcgacgtccggccaggcttcccccagtgcgtgttcgaccactgggacatcatggcttccgaccctctggaccccggcacccagtcggcgacgctggtgacggagatccgcaagaggaagggtctcaaggagcagatgactcccctatccgatttcgaggacaagctctaaattttgggggtcatgttttgctgctggctcttgctgtgaagggaggcgcggtatttttctccctatgtgtcttccttactatcttgttgtttgtatgttggtgctactgagactatggttttgatgacggtcgtggtgatgtaacagatgttgaacttagatgatatatccgtcgtcagctggtggttatttttattgtgctgtgtttgcttttgtgcttggtttcatttacgtatatttgattgttgtgctagcaaattgcgtcgtgcgtgttgttatgtttgcgagttttagccattgttgtgttcagtcaggtttgttcatagtctcttcagctgttgtttttcaagtc

SEQ ID NO: 2296 - DNA, 2296 bp, Cucumis sativus
tctttaattttttgtgtgttcaggtgaagtttacagccgaggagcttcgtaggattatggactataagcataacattcgtaatatgtctgttattgctcacgtcgatcatggaaagtcgacacttacagattctcttgtggctgccgcgggtatcattgcacaagaagttgccggtgatgtacgaatgacagatactcgccaagatgaggcagagcgtggtatcaccattaaatctactggaatctccctctactatgagatgtctgatgaatccttgaaaagttacaagggagagagacatggaaatgagtatcttatcaatcttattgattcacctgggcacgttgacttctcgtcggaggttacagctgctttacgtattactgatggtgcccttgttgtggtggattgcatcgaaggtgtttgtgtccaaacagagactgtgctccgtcaggctttgggagagaggattagacctgtcttgactgttaacaagatggataggtgcttccttgaacttcaagtggatggagaagaggcttatcaaacattccagagggtcattgagaatgccaatgtgattatggccacgtatgaggatccacttctgggcgatgttcaagtgtacccggagaaaggaacagttgctttctctgctggtttgcacggctgggcatttaccctgactaactttgccaagatgtatgcctccaagtttggagtagatgaggcgaagatgatggagagactttggggtgagaatttctttgatcctgcaaccaagaagtggacaagcaagaacactggcacggcaacatgcaagcgtgggtttgttcagttctgctacgaacccatcaagcagatcattgcaacttgcatgaacgatcggaaggacaagctatggcccatgttgcagaagcttggtgttgtcatgaagtctgatgagaaggatctgatgggcaaaccactgatgaagcgggtcatgcaaacatggctaccagcaagtactgctcttttggaaatgatgatctttcatcttccatcccctgccaaggctcaaaagtatcgtgtggagaatttgtatgagggtccacaagatgatgtttacgctagtgccattagaaattgtgatcctgagggacctcttatgctttatgtatcaaagatgattccagcatctgacaagggcaggttctttgcctttggacgtgtgttctctgggaaagtttcaactggtttgaaagttagaatcatgggccccaactatgttcctggtgagaaaaaagatttgtatgttaagagcgtccagagaactgtcatttggatgggaaagaagcaagaaacagtggaggatgtgccttgtggtaacactgttgccatggttgggctggatcaatttatcactaagaatgccactctgacaaatgaaaaggaagtcgatgctcatccaattcgagccatgaagttttctgtatctcccgtcgtgcgtgttgccgttcagtgcaaggtggcctctgatcttcccaagcttgtggaaggacttaaacgtctggccaagtcagaccctatggttgtgtgtaccatggaggaatctggtgagcacattgttgctggcgctggagaactacatcttgagatctgtttgaaggatttgcaagatgatttcatgggtggagctgagatcataaaatctgaccctgttgtctctttccgtgaaaccgtacttgagaggtcatgccgcacagtgatgagcaagtcccctaacaaacacaatcgactgtacatggaagcacgacccatggaggatggactggcagaggctattgatgatggccgcattggaccacgagatgatcctaaagttaggtctaaaattttgtcagaggagtttgcttgggacaaagatcttgctaagaagatttggtgctttggtcctgagactaccggccctaacatggtggttgatatgtgtaagggagttcaatacctgaatgaaatcaaggattccgttgttgctggtttccaatgggcgtcgaaagaaggtgcattggcggaagagaacatgagaggcatctgttttgaagtgtgtgatgtggtgcttcacgctgatgccatccacagaggaggtggtcaagtgattccgactgctaggagggtaatctacgcttctcagctgactgccaaaccaagacttcttgagccagtgtacctagtggagattcaggctccggagcaagctcttggtggtatctacagtgttcttaatcaaaagcgtgggcatgtctttgaggaaat

SEQ ID NO: 2297 - DNA, 2111 bp, Secale cereale
gaacatgtcggttattgctcatgtagaccacggcaagtctacgcttacggattcccttgtggcagctgctgggagttattgcccacggaagttgctggtgacgttcgcatgactgatacccgtgcagatgaggcagagcgtggtattacaatcaaatccaccggtatctctcttttctatcagatgactcctgaatcacttgagatgtacaagggcgatcgcgatggggacgaatacctgatcaaccttattgattcacctggccacgtcgacttttcttcggaagtcacagctgctcttcgtatcaccgatggagctttggttgttgttgactgtattgagggtgtctgtgtgcagaccgaaactgtgctgcgccaagctcttggtgagaggattaggccagtccttactgtgaacaagatggacagatgcttccttgagcttcaggtggaaggtgaggaagcatatcagactttctcccgtgttatcgaaaatgccaatgtcatcatggcaacatatgaagatgtgctccttggtgatgtccaagtgtacccagaaaaggggactgttgcgttctctgctggtctgcatgggtgggctttcacccttacaaactttgctaagatgtatgcctccaagtttggagttgatgagtcgaagatgatggagaggctgtggggtgagaacttctttgacccagctacaaagaaatggacctccaagaacactgggacagctacctgcaagagaggtttcgttcagttctgctatgagccaatcaagcaaatcatagccacctgcatgaatgatcagaaggataagttgtggcctatgttgaagaagcttggtgtgaccatgaagaatgacgagaaggacttgatgggcaaggctctcatgaagcgtgtgatgcaaacttggctgcctgccagtcgtgctctgcttgagatgatgatatttcacctcccctccccttcaaaggcacagaggtaccgtgtggagaacttatatgagggcccccttgatgatatatatgcaaatgctattagaaactgtgacccagatggtcctcttatgctgtatgtctccaagatgattccagcatctgacaagggtagattctttgcctttggacgtgtttttgctgggagggttgcaactggcatgaaggtccgcatcatgggtcccaactttgttcctggccagaagaaggatctgtatgtgaagagtgtccagcggactgtcatctggatgggaaagaagcaagagtctgttgaggatgttccctgtggtaacactgttgctttggttggtttggatcagttcatcacgaagaacgcaaccctaacaaatgagaaggaagttgatgcctgcccaatcagggcaatgaagttctctgtgtcccctgttgtgcgtgttgctgttcagtgcaaggtggcatctgatcttcctaagcttgttgagggtttgaagcggcttgcgaagtctgaccctatggttctctgtagcattgaggagtctggtgagcatatcattgctggagctggagagcttcaccttgaaatctgtttgaaggatctgcaggaggacttcatgggtggtgctgaaattattgtttcccctcctgttgtctccttccgtgagactgttctggagaagtcctgccgcactgtcatgagcaagtcccccaacaagcataaccgtctttacatggaagctcgcccattggaggagggattggctgaggctattgatgatggccgcattggcccacgtgatgatcctaaggtgcgctccaagatcctgtctgaggagttcgggtgggacaaggatcttgccaagaagatttggtgctttggacctgagacgactggccccaacatggttgttgacatgtgtaagggagtgcagtatctgaatgaaatcaaggactctgttgtggctgggttccagtgggcatcaaaggaaggtgcattggctgaggagaacatgcgtggcatctgctttgaggtctgtgatgttgttctgcacactgatgctattcacaggggtggtggtcaggtcatcccaacagccaggagggtcatttatgcttctcagctcactgctaagcc

SEQ ID NO: 2298 - DNA, 2511 bp, Brassica napus
cgttccttgaagagacttcactggtgccagagatggaaacgagtaccttatcaatctcatcgactctcctggccacgttgacttctcctctgaggtcactgctgcactccgtatcactgatggtgcccttgtggtggtcgactgtatcgagggtgtgtgtgttcagaccgagactgtgctacgtcaggctcttggtgagaggattaggcccgtgctgactgtcaacaagatggacaggtgtttccttgagcttcaggttgatggtgaggaggcttaccagactttccagagggtcattgagaatgccaatgtcatcatggcaacgtacgaggatcctctccttggtgatgttcaggtttaccctgagaagggaactgtcgccttctctgctggtctccacggatgggctttcaccctgaccaactttgccaagatgtatgcttccaagttcggtgttgacgagactaagatgatggagaggctgtggggtgagaacttctttgaccccgccaccaggaaatggagcggcaagaacactgggtccgctacctgcaagcgtgggtttgtgcagttctgttatgaacccatcaagcagatcatcgccacttgcatgaacgaccagaaggataagttgtggcctatgttgcagaagcttggtgtccagatgaagtctgatgagaaggagcttatgggtaaacctttgatgaagcgtgtcatgcagacttggctacctgcgagtactgcattgcttgagatgatgatctttcaccttccatccccccacactgcacagaggtaccgtgttgagaatttatatgaaggtcctctcgatgatcagtatgccactgccatcagaaactgtgatcctaatggtccgctcatgctctatgtttctaagatgattcccgcttcagacaagggaagattctttgcttttgggcgtgtcttctctggaaaggtgtctaccggtatgaaggtcaggatcatgggtcccaactttgttcctggtgagaagaaagatctttatgtcaagagtgttcagaggactgtcatctggatgggcaagaggcaagagactgttgaggatgttccctgtggtaacaccgttgctatggttggtcttgatcagttcatcactaagaatgctacgctgacgaatgagaaagaagttgatgctcatcctatccgtgcgatgaagttctctgtgtcccctgttgtacgtgttgctgttcagtgcaaggtcgcttctgatcttcccaagcttgttgagggacttaagaggctggccaagtctgaccctatggttgtgtgcacaatggaggagtcaggtgagcacattgttgctggtgctggagaactgcatcttgagatttgtttgaaggatcttcaggatgatttcatgggtggtgctgagattgtcaagtcagaccctgttgtctcattccgtgagactgttttggagcgatctgtgcgtactgtgatgagcaagtccccaaacaagcacaaccgtctgtacatggaggctaggccgttggaggatggtcttgcggaggcgattgatgaaggccgtattggtccaagagatgatcccaagatacgttccaagatcttggctgaggagtttggttgggacaaggatcttgcgaagaagatatgggcgtttggacctgaaaccacagggcccaacatggttgttgacatgtgtaagggagttcaatacctgaatgagatcaaggattctgttgttgctgggttccagtgggcttccaaggaaggtcctctttgtgatgagaacatgagaggaatctgttttgaggtttgcgatgtggtgctccactctgatgctatccacagaggtggtggtcaggttatcccgacagcgaggagggttatctacgcctctcagctcactgccaagcccaggcttttggaacctgtttacatggttgagatccaagcaccagagggagctcttggaggaatctacagcgtgctgaatcagaagcgtggacacgtctttgaggagatgcagaggccaggaacaccgctttacaacatcaaggcgtacctgccagttgttgagtcatttggattctcaagtcagcttagagcagcaacctcaggacaggccttccctcagtgtgtgtttgatcattgggagatgatgtcgtctgacccattggaggcaggatcgcaggcttcaacgcttgtgactgacatcaggaagaggaagggtatgaaggaacagatgactcccttgtctgactttgaagacaagctgtaagcagcagccaacaagactcactatggtcacctttttctctccatctctaccgtattttgtttactgttagctctgttttggtgttatgatatcactttatctgtggccacaaacgtcttgaatgttttacttttttagctgaaaactggtttatctctgtgtttattcttttttgcactcttgttatcctgttttcattggaacgttgttatatctaccgtattttt

SEQ ID NO: 2299 - DNA, 2516 bp, Papaver somniferum
atgggtaacgagtacctcatcaaccttattgattcacctggtcatgttgacttctcttctgaagtcacagctgcattacgtattaccgatggtgcacttgttgtggtggattgtatcgagggtgtttgtgtccaaaccgagactgtccttcgacaagctcttggagaaaggatcaggcctgttttgactgtcaacaagatggacagatgtttcctagagctacaggttgacggagaagaggcttatcagactttctccagagtcattgagaatgctaatgttattatggccacatatgaagacccactcctcggtgacgtccaagtttaccctgagaaaggaacagttgccttctctgctggtttgcacggttgggcttttactctcaccaatttcgcaaacatgtatgcttccaagttcggtgttgaacacagtaagatgatggagaggctctggggtgagaacttctttgacccagcaactaagaagtggactaataagagaaccaactctcctacatgtaagcgtggatttgttcagttctgttatgaacccatcaagcagatcattgctacttgcatgaatgatcagaaggacaagttgtggcctatgcttcagaagcttggtgttacaatgaagaatgacgagaaggaattgattggaaagcccttgatgaagcgtgtgatgcagacttggctccctgcagctactgccctacttgaaatgatgatttatcatctcccctctccccacacagctcagaagtatcgtgttgagaacttgtacgagggtcctcttgacgaccagtatgccaatgccattagaaactgtgatcccgaaggtcctcttatgctctacgtgtctaagatgattcccgcctctgacaagggtagattctttgcctttggtcgtgtctttgccggtaaggttgcaacaggtgctaaggtcagaatcatggggcctaactacgttcctggtgggaagaaagacttgtacaccaagagtgtccagagaactgttatctggatgggaaagaaacaggagtcggttgaggatgtaccttgtggtaacactgttgccctggttggactggatcaatttatcaccaagaatgcaaccctcacaaacgagaaggaagttgatgcccatcctatcagagctatgaagttttccgtctctcccgttgttcgtgttgctgtccagtgtaaggttgcctctgacctgcccaagctggttgaagggcttaagcgtctatccaaatcagatcctatggtggtgtgtaccattgaggagtcaggcgagcacattattgcaggtgctggagaactccatcttgagatctgtttgaaggacttgcaggatgatttcatgggtggtgctgaaattgtgaagtctgaccctgtggtgtcatttcgtgagactgttctagaaaagtcttcaagaacagtgatgagcaagtccccaaacaagcacaaccgtttgtacatggaggcacgtcctcttgaggatggacttgctgaagccatcgatgatggtcgtattggtccaagagatgatcccaaagttcgttcaaagatcttatctgaagagtttggatgggataaggatcttgcaaagaagatttggtgttttggtccagatactactggtccaaacatggttgtggatatgtgtaagggagttcagtaccttaatgaaatcaaggattcagttgtcgcagggtttcagtgggcttcaaaggaaggtgtgctagcagaagagaacatgagaggtatatgctttgaagtatgtgacgtggttctccattctgatgccattcacagaggtggtggacaggttattcctaccgctaggagggtcatgtatgcctcacagctcacagctaaacctagactgctagaacctgtgtacctagtcgagatccaggctcctgaaggtgctcttggtggtatttacggagttctcaatcagaagcgtggtcacgtctttgaggaaatgcagaggccaggaactcctctctacaacattaaagcatatctacctgtcgttgagtcatttggtttctctgcccagcttagggctgccacatctggacaggcttttccccagtccgtgtttgatcattgggatatgatgatggctgatcctttggaggctggtactcaagctgcagagcttgtgacagacatcagaaagaggaagggtttgaaggctcagatgacccctctctctgattttgaggacaaactttaagtctatggtatttcatttggtctttaagttttagacattaggataatttgtgctatggatcttttctattttttttttttgtgtcatctttttcttttgttttctttggtgctgaatttatgtggttaatgtttctaggatctgcacaatccataatttgtaattgggttgggtgatttataaagtaaacgaacatgaaaatgagtaaaattagcaccaactctgtcatggtttatttttctaaaaaggcttgctttggagtt

SEQ ID NO: 2300 - DNA, 2507 bp, Papaver somniferum
aaggccgtacaagggtgaaggatggtaacgagtacctcatcaaccttattgatttcacctggtcacgttgacttctcttctgaagtcacagctgcattacgtattaccggatggtgcacttgttgtggttgattgtatcgagggtgttgtgttcaaaccgagaccgtccttcgacaagctcttgggagaaaggatcaggcctgttttgactgtcaacaagatggacagatgtttcctagagctacaggttgatggagaagaggcttatcagactttctcccgagtcattgagaatgctaatgttattatggccacatatgaagacccactcctcggtgacgtccaagtttaccctgagaaaggaacagttgccttctctgctggtttgcacggttgggcttttactctcaccaatttcgcaaacatgtatgcttccaagttcggtgttgaacacagtaagatgatggagaggctctggggtgagaacttcttgacccagcaactaagaagtggactaataagagaacccaactctcctacatgtaagcgtggattgtcagttctgttatgaacccatcaagcagatcattgctacttgcatgaatgatcagaaggacaagttgtggcctatgcttcagaagcttggtgttacaatgaagaatgacgagaaggaattgattgggaagcctttgatgaagcgtgtgatgcagacttggctccctgctgctactgccctacttgaaatgatgatttatcatctcccctctccccacacagctcagaagtatcgtgttgagaacttgtacgagggtcctcttgatgaccagtatgctaatgccatcagaaactgtgatcccgatggtcctcttatgctctacgtgtctaagatgattcctgcctccgacaaaggtagattctttgcctttggtcgtgtctttgctggtaaggttgcaacaggtgctaaagtcagaatcatggggcctaactatgttcctggtgggaagaaggacttgtacaccaagagtgtccagaggactgttatctggatgggaaagaaacaggagtctgttgaggatgttccttgtggtaacacagttgccctggtcggattggatcaatttatcaccaagaatgcaaccctcacaaacgagaaggaagttgatgctcatccaatcagagccatgaagttttctgtctctcccgttgttcgtgttgctgtccagtgtaaggttgcctctgacttgcccaagctggttgaagggcttaagcgtctgtccaaatctgatcctatggttgtgtgtaccattgaggagtcgggcgagcacattattgcaggtgctggagaactccatcttgagatctgtttgaaggatttgcaggatgatttcatgggtggtgctgaaattgtgaagtctgaccctgtggtgtctttccgtgagaccgtgcttgagaagtcttcaagaactgtgatgagcaaatctccaaacaagcataaccgtttgtacatggaggcacgccctcttgaggatggacttgctgaagccattgatgatggtcgtattggtccaagagatgatcctaaagttcgttcaaagatcttatctgaagagtttggatgggataaggatcttgcaaagaagatctggtgttttggtcccgatactactggtcctaacatggttgtggatatgtgtaagggagttcagtaccttaatgaaatcaaggattcagtcgttgcagggttccagtgggcgtcaaaggaaggtgtgctagcagaagagaacatgagaggtatatgcttcgaagtatgtgacgtggttctccattctgatgccattcacagaggtggtggacaggttattcctactgctaggagagttatgtatgcctcacagctcacagctaaacctagacttctagaacccgtgtacatggtcgagatccaggctcccgaaggtgctcttggtggtatctatggtgttctcaatcaaaagcgtggtcacgtctttgaggaaatgcagagaccaggaactcctctctacaacatcaaagcatatctaccagtcgttgagtcatttggtttctctgcccagcttagggctgccacatcaggacaggctttcccccagtccgtgttcgatcattgggatatgatgatggctgatcctttggaaccaggcactcaagctgctgaacttgtggctgacatcaggaagaggaagggtttgaagattcagatgacccctctatcagatttcgaggacaagctttaagtctgaggttgcttgtaaaagattctggaagttaagagctaggtgacattgttgatccgaaggagagttttgatgggagtgtgttaatccgaaacattcctcttttgtttttcattttggtttttcttctgctgggtgtgtaacactatgaatatttacgaacttgaacatgtattcttgtgattttgatccttgaagcaacattttgcccagtaactagtctttgtagtttat

SEQ ID NO: 2301 - DNA, 2740 bp, Cajanus cajan
aagtggtctatcatgaacaggtgaacttcacagttgatgaacttcggcggattatggatcgcaaacacaatataaggaatatgtctgttattgctcatgttgatcatggaaaatccacactcactgattctctggtggctgctgctggtatcatagcacaagaggttgcaggagatgttaggatgacagatacccgtcaagatgaagctgagcgtggtatcactatcaagtccactggcatctctctctactatgagatgacagagggtgatttgaagaatttcaagggagagcgtgaagggaatgagttccttataaatctcattgactcacctgggcatgtggatttctcatctgaggtcactgccgcgcttcgcatcactgatggggcacttgtggtggtggattgtgttgagggtgtgtgtgtccagacagaaactgtgctgagacaagcccttggagaaagggttaagcctgttttagctgttaacaagatggataggtgcttccttgagctcaaccttgatgcagaggaggcctaccttacatttcagagggttgttgagagtgcaaatgtcatcatggcaacctatgaagatgctctacttggtgatgttcaggtataccctgagaagggaacagttgccttttctgctggtttgcatggatggggttttaccattaccaacttcgccaaggtgtatgcttctaagtttggagttgatgaggcaaagatgatgagtaggctttggggtgagaatttctttgactctgccaccaaaaagtggaccaagaagcacaccgggacttctacttgcaagcgtggctttgttatgttctgttatgaaccaatcaaacagattattcaactttgcatgaatgatcagaaggataagctgtggccaaagttgcaacagcttgggttgaaattgaagtcagaggaaaaggagttaacaggaaaggctttgatgaagcgtgttatgcagagctggctcccagcaaatagggcccttctggagatgatgatatttcaccttccttctcctgccagtgctcaaaaatatcgtgttgataacttgtatgagggtcccctggatgatccttatgctcatgctatcagaaattgtgaccctgatggacctttaatgctctatgtctcaaagatgattcctgcatctgataggggtaggttttatgcttttggccgagtcttctctggtaaggtttcaaccggtttgaaggtcagaatcatgggaccaaactatgttccagggaagcaaaaagacttgtatgttaaaagtgttcagcgaactgtaatttggatgggaaagaaacaggaaacagttgaggatgtgccttgtggcaacacagtagctatggtgggtttggaccacttcatcaccaagaatgctacattaacaaacgagaaggaagttgatgcacacccaattcgtgctatgaagttttctgtgtcaccggtggtaagtgttgctgttacaagcaaggttacatcagatcttcctaagcttattgaaggcctaaagcgtttagcaaagtcagaccctatggtggtctgcacaatgtcagagacaggagagcatataatatctgctgctggtgagctccatcttgaaatctgcttgaaggacttgaaggatgattttatgaatggtgcagagatttcaatatctgatccaattgtctccttccgcgagactgtgtttgagaggtcttgccgtacagtgatgagcaagtcacctaacaaacacaaccgtctgtacgtggaagcaaggccaatggaggatggacttgcagaggcaattgatgatgaaaagattggaccaggggttgaccccagaaatcggtctaaaatattgtctgaagagtttggttgggacaaggatctggcaaggaaaatatggtgttttggccctgagggtaaaggacccaacatggtgatagatacttgcaagggtgtacagtacctcaatgaaatcaaagactcggttgttgctgggtttgagacagcatcaaaatcaggtccaatggctgaggagaacatgcgaggggtctgctttgaaatttgtgatgttgttcttcatgctgatgccattcaccgaggaggtggccagatcattccaactgctagaagggtcttctgtgcagccatgctgacagcaaaaccaaggcttcttgaacctgtgtatcttgtggaaattcaagcaccggaacaggctcttggcgatatatacagtgttgttaaccagaaaagagggcatgtgtttgaggaaatccagaggcctggcaccccactttacaatataaaagcatatttgcctgttattgagtcatttagattcaatgaatcactaagggctcaaactggaggtcaagctttcccacagttagtatttgaccactgggatatggtgccatcggatccactagaacctggcactcctgctgctgcacgtgtggctgagataagaaggaaaaaaggcttgaaagaacaaatgatgcccctgtctgagttcgaggacagactttgatgtgtcaataagttatctttgaaacaaatatagtataactttttttttttcctagattttgttcatgttactcaatcttaatgttagatgatattaatcgtagtttctcaattgtaatgttacatggcaattttctttcttctcttttttgtttatttattaatattgtacaacttaaatttcagtttttg

SEQ ID NO: 2302 - DNA, 2507 bp, Secale cereale
cccatccgacggtagtctctcttttctatcagatgactcctgaatcacttgagatgtacaaggcgacagggatggtgatgagtacctgatcaaccttattgattcacctggccacgttgacttttcttcggaagtcacagctgctcttcgtatcactgatggtgctttggtggttgttgactgtattgagggtgtctgtgtgcagaccgaaactgtgctgcgccaagctcttggtgagaggattaggcctgttcttactgtgaacaagatggacagatgcttccttgagcttcagtttgaaggtgaggaagcatatcagactttctcccgtgtcatcgaaaatgccaatgtcatcatggcaacatatgaagatgtgctccttggtgatgtccaagtgtacccagagaaggggactgttgcattctctgctggtttgcatgggtgggctttcacccttacaaactttgctaagatgtatgcctccaagtttggtgttgatgaggtgaagatgatggagaggctgtggggtgagaacttctttgacccagccacaaagaaatggaccaccaagaacactgggacagctacctgcaagagaggttttgtgcagttctgctacgagccaatcaagcaaatcatcgccacctgcatgaatgatcagaaggataagttgtggcctatgttgaagaagcttggtgtgaccatgaagaatgatgagaaggacttgatgggcaaggctctcatgaagcgtgtgatgcaaacttggctgcctgccagtcgtgctctgcttgagatgatgatatttcacctcccctctccttcaaaggcacagaggtatcgtgtggagaacttgtatgagggcccccttgatgacgtatatgcaaatgctatcagaaactgtgaccctgatggtcctcttatgctgtatgtctccaagatgattccagcatctgacaagggtagattctttgcctttggacgtgtttttgccgggagggtcgcaactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcaccaagaatgcaaccctgacaaatgagaaggaagttgatgcctgcccaatcagggcaatgaagttctctgtgtcccctgttgtgcgtgttgctgttcagtgcaaggtggcttctgatcttcctaagcttgttgagggtttgaagcgtctggccaagtctgatcctatggttctctgtaccattgaagagtctggtgagcatatcattgctggagctggagagcttcaccttgaaatctgcttgaaggatctgcaggatgacttcatgggtggtgctgaaatcattgtttcccctcctgtcgtctccttccgtgagactgttctggagaagtcctgccgcactgtcatgagcaagtcccccaacaagcataaccgtctttacatggaggctcgcccattggaggagggattggctgaggctattgatgatggccgcattggcccgcgtgatgatcccaaggtgcgctccaagatcctatctgaggagtttggttgggacaaggacctcgccaagaagatttggtgctttggacctgagacgactggccccaacatggttgttgacatgtgtaagggagtgcagtatctgaatgaaatcaaggactctgttgtggctgggttccagtgggcatcaaaagaaggagcattgtgcgaggagaacatgcgtggtatctgctatgaggtttgtgatgttgttctccacactgatgctattcacaggggtggtggtcaggttatcccaacggcgaggagggtcatttacgcttctcagctcactgccaagccaaggctgctggagccagtctacctggttgagatccaggccccggagaacgcacttggtggtatctatggtgttctcaatcagaagagagggcacgtgttcgaggagatgcagaggcaaggtaccccactctacaacatcaaggcctacctgcctgtcatcgagtccttcgggttctcgagcaccctgagggcggcgacgtccggccaggccttcccccagtgcgtgttcgaccactgggacatcatggcttccgaccctctggaccccggcacccagtcggcgacgctggtgacggagatccgcaagaggaagggtctcaaggagcagatgacccccctatccgatttcgaggacaagctctaaattttgggggtcatgttttgctgctggctcttgctgtgaagggaggcgcggtatttttctccctatgtgtcttccttactatcttgttgtttgtatgttggtgctactgagactatggttttgatgacggtcctggtgatgtaacagatgttaaacttagatgatatatccgtcgtcagctggt

SEQ ID NO: 2303 - DNA, 2687 bp, Phaseolus vulgaris
ggtgaagttcacagttgatcaaattcggcgaataatggaccgcaaacacaatataaggaacatgtctgttattgctcatgtagatcatggaaaatccacactgactgattctcttgtggctgctgctggtatcatagcacaagaggttgcaggagatgtgaggatgacagatacccgtcaagatgaagttgagagaggtatcactatcaagtccaccggcatctctctctactatgaaatggcagagggtgatttgaagaatttcaagggagagcgtgaagggaatgagttccttataaatctcattgactcacctgggcatgtggacttctcatctgaggtcacggctgcacttcgcatcactgatggagcacttgtggtggtggattgtgttgagggtgtatgcgtacagacagaaactgtgctaagacaagctcttggagaaagggttaagcctattttggcagttaacaagatggatagatgcttcctcgagctcaaccttgatccagaggaggcataccttacatttcagagggttgttgagagtgcaaatgtgatcatggcaacatatgaagatgctctacttggtgacattcaggtataccctgagaaggggacagttgttttctctgctggtttgcatggatggggttttaccctcaccaactttgccaagatgtatgcttccaagtttggagttgacgaggcaaagatgatgagtaggctttggggtgcgaatttctttgattctgccaccaaaaagtggaccaacaaacacaccgggacttctacttgtaagcgtggctttgttatgttatgttatgaaccgatcaaacatattattgagctttgcatgagcgaccagagggcagagctgtggcctaagttgcaaaagctcggagtaaacatgaagtcagaggaaaaggatttgacaggaaaggctttgatgaagcgtgtcatgcagagttggctcccagccagtagtgcccttctggagatgatgatatatcaccttccctctcctgccagtgctcagcagtatcgcgttcagaatttgtacaatggtcccctggatgatccttatgcttctgctatcagaagctgtgaccctgaaggacctttaatgctctatgtctcaaagatgattcctgcatctgatagtggtaggttttatgcttttggcagagtcttctctggtagggtttcaactggtttgaaagtcagaatcatgggaccaaactatgtcccaggagataaaaaggacttgtatgttaaaagtgttcagcgaactgtaatttggatgggaaagaaacaggaaactgttgaggatgtgccttgtggcaacacggtagctatggtgggtttggatcaattcataaccaaaaatgctacattgaccaatgagaaggaagttgatgcacaccccattagagctatgaagttttctgtgtcacccgtggtaagtgttgctgttacaagcagggttccgtcagatcttcctaagctacaagaaggtctaaaacgtttagcaaagtcagaccctatggttgtctgcacaatgtcagagacaggagagcatataatatctgctgctggtgagcttcatctagaaatctgcttgaaggacttacaggtcgattttatgaatggagcagaggtttcaatatctgatcctattgtctcttttcgcgagaccgtggttgagagatcttgccgtacagtgatgagcaagtcaccaaacaaacacaatcgcctgtacatggaagcagggcctatggaagatggactagcaaaggctattgatgatgaaaagattggaccagggattgacccaaaaaacaggtctaaaatattgtcagaagagtttggttgggacaaggatctggccaagaaaatatggtgttttggccctgagggtaaaggacccaacatgttggtagatacttgcaagggcgtacattacctcagtgaaatcaaagactcagttgttgctgggtttgagttagcatcaaaaggaggtccaatggctgatgagaacatgcgaggggtctgtttcgagatttgtgatgtggttcttcatgctgatgcaattcacagaggaggcggccagatcattccaacagctagaagggtcttctatgcagccacactgacagcaaaaccgagacttctggagcccgtgtatctggtggaaatacaggcacctgaacaggttcttggaggtatatatagtgttcttaaccaaaaaagagggcatgtgtttgaggaaatccagaggtctggcaccccactttacaatgtcaaggcatatttgcctgttattgagtcatttaaattcaatgaatcactgagggctcaaaccgggggtcaggctttcccacagttagtatttgaccattgggatctggtgtcatctgatccactagaacctggcactcctgctgctgctcgtgttgcagagataagaaggaagaaaggcttgaaggaacaaattacacctctatctgagttcgaggacaggctttgatgtgttaataaggtctcttagatagaaatatatagcaatttctttttcattttcctagtttttgttcatatttatcttaatgctatatgaaatcaattgtagattttaaattttgatgttgcatgttacactgcaaatggtcattctttctttctct

SEQ ID NO: 2304 - DNA, 2313 bp, Papaver somniferum
tttttttttttttctttcttcttctccttccactgcggcacttcctctcagggatttgcctgttcagtgatatttggtattgacaaagttatcttttacagaagcaaagatggtgaagtttacagctgaagagctgcgtcggatcatggacctgaagcataatatcaggaacatgtccgtcattgctcatgtcgaccatggaaaatcaacacttactgattctcttgtggctgctgctggtattattgcccaagaaactgctggtgatgttcgtatgacagatacccgtgcagatgaggcggaacgtggtattacaattaaatctactggtatctctctctattatgagatgtctgatgagtctttgaaggcctacaagggtgacagaatgggtaacgagtacctcatcaaccttatcgattcacctggtcacgtcgacttttcttctgaagtcacagctgcattacgtattactgatggtgcacttgttgtggtggactgtattgagggtgtctgtgtccaaaccgagactgtccttcgacaagctcttggagaaaggattaggcctgtgttgactgtcaacaagatggacagatgtttcctagagctacaggttgatggagaagaggcttatcagaccttctccagagttattgagaatgccaatgttatcatggccacttatgaagacccactcctcggtgacgtccaggtttaccctgaaaagggaacagtcgccttctctgctggtttgcacggttgggctttcactctaaccaatttcgcaaacatgtatgcttctaagttcggtgttgaacacagtaagatgatggagaggctttggggtgagaacttctttgacccagcaactaagaagtggactaataagagaaccgcgtctcctacatgtaagcgtgggtttgtccagttctgttatgaacccatcaagcagatcattgccacttgcatgaatgatcaaaaggacaagttgtggcctatgttgcaaaagcttggtgttgtaatgaagaatgacgagaaggaattgattggaaagcccttgatgaagcgtgtgatgcagacttggctccctgctgctactgccctacttgaaatgatgatttatcatctcccctctccccacacagctcagaagtatcgtgttgagaacttgtacgagggtcctcttgatgaccagtatgctaatgccatcagaaactgtgatcccgatggtcctcttatgctctacgtgtctaagatgattcctgcctccgacaaaggtagattctttgcctttggtcgtgtctttgctggtaaggttgcaacaggtgctaaagtccgaatcatggggcctaactatgttcctggtgggaagaaggacttgtacaccaagagtgtccagaggactgttatctggatgggaaagaaacaggagtctgttgaggatgttccttgtggtaacacagttgccctggtcggattggatcaatttatcaccaagaatgcaaccctcacaaacgagaaggaagttgatgctcatcctatcagagccatgaagttttctgtctctcccgttgttcgtgttgctgtccagtgtaaggttgcctctgacttgcccaagctggttgaagggcttaagcgtctgtccaaatctgatcctatggttgtgtgtaccattgaggagtcgggcgagcacattattgcaggtgctggagaactccatcttgagatctgtttgaaggatttgcaggatgatttcatgggtggtgctgaaattgtgaagtccgaccccgtggtgtctttccgtgagactgtgcttgaaaagtcttcaagaactgtgatgagcaaatctccaaacaagcacaaccgtttgtacatggaggcacgtcctcttgaggatggacttgctgaagccattgatgatggtcgtattggtccaagagatgatcctaaagttcgttcaaagatcttatctgaagagtttggatgggataaggatcttgcaaagaagatctggtgttttggtcccgatactactggtccaaacatggttgtggatatgtgtaagggagttcagtaccttaatgaaatcaaggattcagttgttgcaggttttcagtgggcgtcaaaggaaggtgtgttggcggaagagaacatgagaggtatatgcttcgaagtatgtgatgtggttctccattctgatgccattcacagaggtggtggacaggttattcctactgctaggagggttatgtatgcctcccagctcacagctaaacccagacttttacgaacctgtgtacctagtcgaaatcc

SEQ ID NO: 2305 - DNA, 2741 bp, Phaseolus vulgaris
aactggattatcatgtgcaggtgaagttcacagttgatcaaattcggcgaataatggaccgcaaacacaatataaggaacatgtctgttattgctcatgtagatcatggaaaatccacactgactgattctcttgtggctgctgctggtatcatagcacaagaggttgcaggagatgtgaggatgacagatacccgtcaagatgaagttgagagaggtatcactatcaagtccaccggcatctctctctactatgaaatggcagagggtgatttgaagaatttcaagggagagcgtgaagggaatgagttccttataaatctcattgactcacctgggcatgtggacttctcatctgaggtcacggctgcacttcgcatcactgatggagcacttgtggtggtggattgtgttgagggtgtatgcgtacagacagaaactgtgctaagacaagctcttggagaaagggttaagcctattttggcagttaacaagatggatagatgcttcctcgagctcaaccttgatccagaggaggcataccttacatttcagagggttgttgagagtgcaaatgtgatcatggcaacatatgaagatgctctacttggtgacattcaggtataccctgagaaggggacagttgttttctctgctggtttgcatggatggggttttaccctcaccaactttgccaagatgtatgcttccaagtttggagttgacgaggcaaagatgatgagtaggctttggggtgcgaatttctttgattctgccaccaaaaagtggaccaacaaacacaccgggacttctacttgtaagcgtggctttgttatgttatgttatgaaccgatcaaacatattattgagctttgcatgagcgaccagagggcagagctgtggcctaagttgcaaaagctcggagtaaacatgaagtcagaggaaaaggatttgacaggaaaggctttgatgaagcgtgtcatgcagagttggctcccagccagtagtgcccttctggagatgatgatatatcaccttccctctcctgccagtgctcagcagtatcgcgttcagaatttgtacaatggtcccctggatgatccttatgcttctgctatcagaagctgtgaccctgaaggacctttaatgctctatgtctcaaagatgattcctgcatctgatagtggtaggttttatgcttttggcagagtcttctctggtagggtttcaactggtttgaaagtcagaatcatgggaccaaactatgtcccaggagataaaaaggacttgtatgttaaaagtgttcagcgaactgtaatttggatgggaaagaaacaggaaactgttgaggatgtgccttgtggcaacacggtagctatggtgggtttggatcaattcataaccaaaaatgctacattgaccaatgagaaggaagttgatgcacaccccattagagctatgaagttttctgtgtcacccgtggtaagtgttgctgttacaagcagggttccgtcagatcttcctaagctacaagaaggtctaaaacgtttagcaaagtcagaccctatggttgtctgcacaatgtcagagacaggagagcatataatatctgctgctggtgagcttcatctagaaatctgcttgaaggacttacaggtcgattttatgaatggagcagaggtttcaatatctgatcctattgtctcttttcgcgagaccgtggttgagagatcttgccgtacagtgatgagcaagtcaccaaacaaacacaatcgcctgtacatggaagcagggcctatggaagatggactagcaaaggctattgatgatgaaaagattggaccagggattgacccaaaaaacaggtctaaaatattgtcagaagagtttggttgggacaaggatctggccaagaaaatatggtgttttggccctgagggtaaaggacccaacatgttggtagatacttgcaagggcgtacattacctcagtgaaatcaaagactcagttgttgctgggtttgagttagcatcaaaaggaggtccaatggctgatgagaacatgcgaggggtctgtttcgagatttgtgatgtggttcttcatgctgatgcaattcacagaggaggcggccagatcattccaacagctagaagggtcttctatgcagccacactgacagcaaaaccgagacttctggagcccgtgtatctggtggaaatacaggcacctgaacaggttcttggaggtatatatagtgttcttaaccaaaaaagagggcatgtgtttgaggaaatccagaggtctggcaccccactttacaatgtcaaggcatatttgcctgttattgagtcatttaaattcaatgaatcactgagggctcaaaccgggggtcaggctttcccacagttagtatttgaccattgggatctggtgtcatctgatccactagaacctggcactcctgctgctgctcgtgttgcagagataagaaggaagaaaggcttgaaggaacaaattacacctctatctgagttcgaggacaggctttgatgtgttaataaggtctcttagatagaaatatatagcaatttctttttcattttcctagtttttgttcatatttatcttaatgctatatgaaatcaattgtagattttaaattttgatgttgcatgttacactgcaaatggtcattctttctttctctctttctttattattgtaacttcaaattttaagttt

SEQ ID NO: 2306 - DNA, 2428 bp, Pteridium aquilinum
atgattatctcatcaatctcattgattctcctggtcatgtggacttttcttcggaggtcactgctgctttgcgtatcacagatggtgccttggtggttgttgattgtgttgaaggtgtttgtgtgcagacagaaactgttcttcgtcaggctttgggtgaaaggatcaggcccgtccttacagtcaacaagatggacaggtgctttcttgagttgcaggtagaaggtgaagaggcttatcagacttttcaaagggtcatagagaatgccaatgttatcatggccacatatgaagaccctcttcttggtgatgttcaagtctatccggagaaaggtacagttgccttttctgctggtttacatggatgggccttcacacttaccaattttgctaagatgtatgctgcgaaatttggggttgttgagtccaagatgatggagaggttgtggggtgagaatttctttgaccctgccaccaagaagtggaccactaagaacactggaacagcaacttgccagaggggttttgtgcaatttatttacaacccaatcaagcaggtcatcaacatctgcatgaatgatcagaaagacaagctgtggccaatgctgacgaagctcgggattgggttgaaaggagacgagaaggaacttagggaaaagccttgatgaagcgtgtcatgcaaacttggcttcctgccagtgatgcattacttgagatgatggtgttccatcttccatctcctgccaaggcccagaggtaccgtgttgagaatctgtatgaaggcccattagatgatcagtatgctaatgctatcagaaactgtgacccagaaggtcctctaatgctctatgtctcgaaaatgattccagcttctgataagggcaggttctttgcctttggccgtgttttcgctggaaaggtttctactggttccaaagtcaggattatgggccccaactatgttcctggccagaaaaaggatttatatgtgaaaagtgttcaaaggactgtcatttggatgggcaggaggcaggagtctgttgaggatgtgccttgtgggaatacggtggccatggttggtcttgaccagtacatcaccaagaatgccacccttaccaatgagaaggaagtagatgctcatcccatcagagccatgaagttttctgtctctcctgttgtgcgtgtcgctgtccaatgtaaagttgcttctgatcttcccaagcttgtcgaggggcttaagcgcttggccaaatctgaccctatggttatttgctctattgaagagtcaggtgaacacattattgcaggagcaggtgaacttcacttagagatttgcctgaaagacttgcaggatgattttatgggaggcgctgaaattgtggtttcagaccctgttgtgtcatttagggaaaccgttcttgaaaagtctcatcacacagttatgagcaaatctcctaacaagcacaaccgtctttacttcgaggctaggcctctggaggaggggcttgctgaggccatagatgaagggcgtattggtcctagagatgacccgaaggtccgcagcaagattctctctgaggagtttggttgggataaggatttggccaagaaaatctggtgctttggtcctgaaacaaccgggcctaatctggtagtagacatgtgtaaaggagtgcagtacctaaatgaaattaaggattctgttgttgcggccttccagtgggccaccaaggagggtgcccttgctgaggagaacatgagaggcatagcatttgaggtctgtgatgtggtcctgcatgccgatgccatccacagaggaggcggccaggtcatccctactgcccggcgtgtcatgtatgcatcccaactcactgctaaaccaaggcttttggaacctgtgtatcttgtcgagattcaagcccctgagcaagcactagggggtatttatggagtgctcaaccagaagagaggacatgtgtttgaagaaattcagcgcccgggtacacccctgtacaacatcaaagcctatctccctgttattgaatcttttggtttttcaggcgctcttcgagctgctacttctggacaggccttccctcagtgtgtattcgatcactgggacatgatgaacagcgatcccctggaggtaggttctccggctgcgcagcacgtcattgacattcgcaagaggaaggggctgaaggaacaacttactcccctctcagagtatgaagacaagctgtagagtgcaagatttgtggagtggcaataaggctgggtttttttttattaaagggttaagcaagctagctaggaggcggatgaatatttttggactctaatgtgggggagaactggctattttttgttctgtttgagaattatgttttaccttctattgagttaactgagaactatatatgctttt

SEQ ID NO: 2307 - DNA, 1822 bp, Triticum aestivum
ctcctgcgactgcgagccagccactgggagagcccgcggaagcacagagcgggaggagggatcgcgagatggagtgcaaggatgtcgggatcctcgccatggacatgtatttccctcccacctgcgtccagcaggaagcgctggaggttcatgacggagccagcaaggggaagtacacaattggtcttgggcaagattgcatggccttctgcagcgaggtagaagatgtcatctcgatgagcttgacagttgtcaaatccctgctggagaagtaccacatagatccgaagctaattggccgcctggaggttggtagcgagacagtgatagacaaaagtaaatccatcaaaacatggctgatgcaaatttttgaggaaagtggtaatactgacattgagggagttgactcaagtaacgcatgttatggtgggacagctgccctgttgaattgtgtgaattgggtcgaaagtcgatgctgggatggacgctacggccttgtggtctgcacagatagcgcggtttatgcagagggaccagctcggcctacgggtggagctgctgcaattgctatgcttattggtccaaacgcacctatttcttttgaaagtaaatatagagcttctcacatggctcatgtttacgatttctacaagcctgatcttgcaagtgaatatccggttgttgatgggaaactatctcaaacgtgctacctgatggctctggattcgtgctatagacagtattgcgccaagtatgagaagctagtgggtgaacagttctcaatttctgacgccgattattgtgtgtttcattctccatataataagcttgtacagaagagttttgctcgactttacttcaatgatttcatgcgtaattgcagttcggttgataatgatgccaaagaaaagcttcagccttttgcaaacctgactagtgaagaaagctaccaaagtcgtgacttggaaaagggctctcaacaacttgcaaagcatttgtatgacatcaaagttcaaccgtcaacgttgcttccaaaacaaattggtaacatgtatactgcatctctgtatgctgcattggcatctgtaatctacaacaagcatgctagtctgagcggccaacgaattgtcatgttctcttacggcagtggcttgacatccactatgttttcattcaaactaaatgagggtcagcatccctttagtttaacaaacattgcttctgtgcttgatgtgacggcaaagcttgagtcaagacatgtgacttcacctgagaagttcatcgacacactgaagctgatggagcaccgatatggagcaaaagattttgaaacaagcaaagacataagcttgttgccaccaggaacattctaccttacaaaagttgattcaatgtacaggaggttctatgaaaagaaaaccgatggcatcgttgatggcaaaatcaagtgcagcaatggcattgcgaatggtcactagtggcatatcatcagatactgttagttcaccttgcattttattagccatcacccgtacaatttgttgtatttatctctagaattcccagtttagctcagtttcaaataagcctattctctaaagttgtttcccccacactcttcagcttattttttgtgttgagctgaactgaaaccttcgtgtagtacaagcattcttgttttcctctagcttgctacctttgatttgattgttttgttgctattgaccacgtactgttctgtgatattatcaatgaattgtggcagtaggcattgagcactattgtatcatgtgtttactgagcacttgtattctacttcctc

SEQ ID NO: 2308 - DNA, 1808 bp, Secale cereale
acaacgaactacgctcacgtccacacaccgcctccctcctccctcgcgagccagccactgggagagcccgcggaagcacagagcggcaggagggatcgcgagatggagtgcaaggatgtcgggatcctcgccatggacatgtacttccctcccacctgcgttcagcaggaagccctggaggttcatgacggagccagcaaggggaagtacacaattggtcttgggcaagattgcatggccttctgcagcgaggtagaagatgtcatctcgatgagcttgacagttgtcaaatccctgctggaaaagtaccacatagatcccaagctaattggccgcctggaggttggtagtgagacggtgatagacaaaagtaaatccatcaaaacgtggctgatgcaaatttttgaggaaagtggtaatactgacattgagggagttgactcgagtaacgcatgttatggtgggacagctgcgctgttgaattgtgtgaactgggtcgaaagtcgatgttgggatggacgctacggccttgtggtctgcacagatagcgcggtttatgcagagggaccagctcggcctacgggtggagctgctgcaattgctatgcttattggtccaaatgcacctatttcttttgaaagtaaatatagagcttctcacatggctcatgtttacgatttctacaagcctgatcttgcaagtgaatatccggttgttgatgggaaactatctcaaacgtgctacctgatggctctggattcgtgctatagacagtattgtgccaagtatgagaagctagtgggagaacagttctcgatttctgacgcagattattgtgtatttcattctccatataacaagcttgtacagaagagttttgctcgactttacttcaatgatttcatgcgcaattgcagttcggttgataatgatgctaaagaaaagcttcagccttttgcaaacctgactagtgaagaaagctaccaaagtcgtgacttggaaaagggctctcaacaacttgcaaaacatttgtatgacatcaaagttcaaccgtcaacgttgcttccaaaacaaattggtaacatgtatactgcatctctgtatgctgcattggcatctgtaatctacaacaagcatgctagtctgaacggccaacggattgtcatgttctcttacggcagtggcttgacatccactatgttttcattcaaactaaatgagggtcagcatccctttagtttaacaaacattgcttctgtgcttgatgtgacggcaaagcttgagtcaagatatgtgacttcacctgagaagttcatcgacacactgaagctgatggagcaccgatatggagcaaaagattttgaaacaagcaaagacacaagcttgttgccaccaggaacattctaccttacaaaagttgattcaatgtacaggaggttctatgaaaagaaaaccgatggtgttgttgacggcaaaatcaagtgcagcaatggcattgcaaatggtcactagtggcacatcatcagatactgttagtccaccttgcattttagccatcatccgtacaatttgttgtatttatctctagaatttccagtctagctaagtttcaaataagccattgttctctaaagttgtttaccccacactcttcagcttatttttgtgttgagctgaactgaaaccttcttgtagtacaaacattcttgttttcctctagcttgctacctttgatttaattgttttgttgctagtggccacttactgttctgtgatgttattaatgaattgtggcagtaggcattgag

SEQ ID NO: 2309 - DNA, 1837 bp, Triticum aestivum
gaactctctcacgtcacacacgcctcctcctcctcgcagccactgggagagcccgcggaagcacagagcgggaggagggatcgcgagatggagtgcaaggatgtcgggatcctcgccatggacatgtatttccctcccacctgcgtccagcaggaagcgctggaggttcatgacggagccagcaaggggaagtacacaattggtcttgggcaagattgcatggccttctgcagcgaggtagaagatgtcatctcgatgagcttgacagttgtcaaatccctgctggaaaagtaccatatagatccgaagctaattggccgcctggaggttggcagtgagacagtgatagacaaaagtaaatccatcaaaacgtggctgatgcagatttttgaggaaagtggtaatactgacattgaaggagttgactcaagcaacgcatgttatggtgggacagctgccctgttgaattgtgtgaactgggttgaaagtcgatgctgggatggacgctacggccttgtggtctgcacagatagcgcagtttatgcagagggaccagctcggcctacgggtggagctgctgcaattgctatgcttattggtccaaatgcacctatttctttcgaaagtaaatatagagcttctcacatggctcatgtttacgatttctacaagcctgatcttgcaagtgaatatccggttgttgatgggaaactatctcaaacatgctacctgatggctctggattcgtgctatagacagtattgtgccaagtatgagaagctagtgggagaaaagttctcgatttcggacgcagattattgtgtgtttcattctccatataacaagcttgtacagaagagttttgctcgactttacttcaacgatttcatgcgcaattgcagttcggttgataatgatgctaaagaaaagcttcagccttttgcaaacctgactagtgaagaaagctaccaaagtcgtgacttggaaaagggctctcaacaacttgcaaagcatttgtatgacatcaaagttcaaccgtcaacgttgcttccaaaacaaattggtaacatgtatactgcatctctgtatgctgcattggcatctgtaatctacaacaagcatgctagtctgagcggccaacgaattgtcatgttctcttacggcagtggcttgacatccactatgttttcattcaaactaaatgagggtcagcatccctttagtttaacaaatattgcttctgtgcttgatgtgacggcaaagcttgagtcaagacatgtgacttcacctgagaagttcatcgacacactgaagctgatggagcaccgatatggagcaaaagattttgaaacaagcaaggacataagcttgttgccaccaggaacattctaccttacaaaagttgattcaatgtacaggaggttctacgaaaagaaaaccgatagcattgttgacggcaaaatcaagtgcagcaatggcattgcaaatggtcactagtggcatatcatcagatactgttagttcaccttgcattttattagccatcatcagtacaatttgttgtatttatctctagaattcccagtttagctcggtttcaaataagccattattctctaaagttgtttcccccacactcttcagcttattttttgtgttgagctgaactgaaaccttcgtgtagtacaagcattcttgttttcctctagcttgctacctttgatttgattgttttgttgctattgaccacgtactgttctgtgatattatcaatgaattgtggcagtaggcattgagcactattgtatcatgtgttttactgagcacttgtattcta

SEQ ID NO: 2310 - DNA, 1737 bp, Triticum aestivum
gctgccaaagtcacacgaactctctcacgtcacacacgcctcctcctgcgagccagccactgggagagcccgcggaagcacagagcgggaggagggatcgcgagatggagtgcaaggatgtcgggatcctcgccatggacatgtatttccctcccacctgcgtccagcaggaagcgctggaggttcatgacggagccagcaaggggaagtacacaattggtcttgggcaagattgtatggccttctgcagcgaggtagaagatgtcatctcgatgagcttgacagttgtcaaatccctgctggaaaagtaccacatagatccgaagctaattggccgcctggaggttggtagcgaaacagtgatagacaaaagtaaatccatcaaaacgtggctgatgcaaaattttgaggaaagtggtaatactgacattgagggagttgactcaagtaacgcatgttatggtgggacagctgccctgttgaattgtgtgaattgggtcgaaagtcgatgctgggatggacgctacggccttgtggtctgcacagatagcgcggtttacgcagagggaccagctcggcctacgggaggagctgctgcaattgctatgcttattggtccaaatgcacctatttcttttgaaagtaaatatagagcttctcacatggctcatgtttacgatttctacaagcctgatcttgcaagtgaatatccggttgttgatgggaaactatctcaaacgtgctacctgatggctctggattcgtgctatagacagtattgcgccaagtatgagaagctagtgggagaacagttctcgatttctgacgccgattattgtgtgttccattctccatataataagcttgtgcagaagagttttgctcgactttacttcaacgatttcatgcgtaattgcagttcggttgataatgatgccaaagaaaagcttcagccttttgcaaacctgactagtgaagaaagctaccaaagtcgtgacttggaaaagggctctcaacaacttgcaaagcatttgtatgacatcaaagttcaaccgtcaacgttgcttccaaaacaaattggtaacatgtatactgcatctctgtatgctgcattggcatctgtaatctacaacaagcatgctagtctgaccggccaacgaattgtcatgttctcttatggcagtggcttgacatccactatgttttcattcaaactaaatgagggtcaacatccctttaatttagcaaacattgcttctgtgcttgatgtgacggcaaagcttgaatcaagacatgtgacttcacctgagaagttcattgacacactgaagctgatggagcaccgatatggagcaaaagattttgaaacaagcaaagacataagcttgttgccaccaggaacgttctaccttacaaaagttgactcaatgtacaggaggttctatgaaaagaaaaccgatggcattgttgacggcaaaatcaagtgcagcaatggcattgcaaatggtcactagtggcatatcatcagatactgttagttcaccgtgcattttattagccatcatccgtacaatttgttgtatttatctctagaatttccagtctagctaagtttcaaataagccattattctctaaagttgtttcccccacactcttcagcttattttttgtgttgagctgaactgaaaccttcgtgtagtacaagcattcttgttttcctctagcttgctacctt

SEQ ID NO: 2311 - DNA, 1767 bp, Triticum aestivum
cacagagcgggaggagggatcgcgagatggagtgcaaggatgtcgggatcctcgccatggacatgtatttccctcccacctgcgtccagcaggaagcgctggaggttcatgacggagccagcaaggggaagtacacaattggtcttgggcaagattgcatggccttctgcagcgaggtagaagatgtcatctcgatgagcttgacagttgtcaaatccctgctggaaaagtaccatatagatccgaagctaattggccgcctggaggttggcagtgagacagtgatagacaaaagtaaatccatcaaaacgtggctgatgcagatttttgaggaaagtggtaatactgacattgaaggagttgactcaagcaacgcatgttatggtgggacagctgccctgttgaattgtgtgaattgggtcgaaagtcgatgctgggatggacgctacggccttgtggtctgcacagatagcgcggtttatgcagagggaccagctcggcctacgggtggagctgctgcaattgctatgcttattggtccaaatgcacctatttcttttgaaagtaaatatagagcttctcacatggctcatgtttacgatttctacaagcctgatcttgcaagtgaatatccggttgttgatgggaaactatctcaaacgtgctacctgatggctctggattcgtgctatagacagtattgcgccaagtatgagaagctagtgggagaaaagttctcgatttcggacgcagattattgtgtgtttcattctccatataacaagcttgtacagaagagttttgctcgactttacttcaacgatttcatgcgtaattgcagttcggttgataatgatgccaaagaaaagcttcagccttttgcaaacctgactagtgaagaaagctaccaaagtcgtgacttggaaaagggctctcaacaacttgcaaagcatttgtatgacatcaaagttcaaccgtcaacgttgcttccaaaacaaattggtaacatgtatactgcatctctgtatgctgcattggcatctgtaatctacaacaagcatgctagtctgaccggccaacgaattgtcatgttctcttatggcagtggcttgacatccactatgttttcattcaaactaaatgagggtcaacatccctttaatttagcaaacattgcttctgtgcttgatgtgacggcaaagcttgaatcaagacatgtgacttcacctgagaagttcattgacacactgaagctgatggagcaccgatatggagcaaaagattttgaaacaagcaaagacataagcttgttgccaccaggaacgttctaccttacaaaagttgactcaatgtacaggaggttctatgaaaagaaaaccgatggcattgttgacggcaaaatcaagtgcagcaatggcattgcaaatggtcactagtggcatatcatcagatactgttagttcaccgtgcattttattagccatcatccgtacaatttgttgtatttatctctagaatttccagtctagctaagtttcaaataagccattattctctaaagttgtttcccccacactcttcagcttattttttgtgttgagctgaactgaaaccttcgtgtagtacaagcattcttgttttcctctagcttgctacctttgcctttgatttaattgttttgttgctagtgaccacttactgttctgtgatattatcaatgaattgtggcagtaggcattgagcactattgtatcctgtgttttactg

SEQ ID NO: 2312 - DNA, 4536 bp, Brachypodium distachyon
aaagtcacacgaactcccctctctctgtctttcacgccacccacacacacacaccccccacagagcgaggccgtcagcccgcggaagcgcctccagtccagctccaggccggagatcgcgagatggagtgcaaggatgtcgggatcctcgccatggacatctacttccctcccacctgcgtccagcaggaggcgctggaggctcatgacggagccagcaaggggaagtacacgattggtctagggcaagactgcatggccttttgcagcgaagtggaagatgtcatatccatgagcttgacagttgtcaaatccctgctggaaaagtaccacatcgatccgaagctaattggccgcctggaggttggtagcgagacagtgatagacaaaagcaaatccatcaaaacgtggctgatgcaaattttcgaggaaagtggtaatactgacatagaaggagttgactcgagtaacgcttgctatggtggaacagctgccctgttgaattgtgtgaattgggtggaaagtaaatgctgggatggacgctatggccttgttgtctgcacagatagcgcggtttatgccgaaggaccagctcgtcctacagggggagctgctgctattgcgatgcttattggcccaaatgcacctatttcttttgaaagtaaatatagagcttctcacatggctcatgtttatgatttctacaagcctgatcttgcaagtgaatatccggttgttgatggaaaactgtctcaaacatgctatctgatggctctggattcatgctatagacagtattgtgccaagtatgaaaagctagtgggagaacaattctcactttccgatgcagattactgtgtgtttcattctccatacaataagctcgtacagaagagttttgctcgactttacttcaatgatttcatgcgcaattgcagttcggttgataacgatgctaaagagaagcttcagccttttgcaaacttgacaagtgaagaaagctaccaaaaccgtgacttggaaaagggctctcaacaacttgcaaagcatttgtatgacatcaaagttcaaccgtcaactttgcttccaaaacaaattggtaacatgtatactgcatctctttatgctgccttggcatctgtactctacaacaagcatgctagcctgagcggccaacgaattgtcatgttctcgtatggcagtggcttgacatccactatgttctcattcagacttaatgagggtcagcatccctttagcttaacaaacattgcctctgtgcttgatgtgacggcgaagcttgagtcaagacatgtgacctcgcctgagaagttcatcgcgacgctgaagctgatggagcaccgatatggagcaaaagactttgaaacaaacaaagacacagccttgttgccacccggaacgttctaccttacgaaagtcgattcaatgtacaggaggttctatgaaaagaaagcagccgccgatgacaaaaccaagtgcagcaacggcatcgcaaacggacactagtgtcagatacagttagttcgttcaccttgcgatttatttagcaaccatcatccttgaaatttgctgtatttatttatgtctagaatccgcagtcttagttatctttcaaataagagccatcattctctgaagctgttttcccccatgtactctcagcttatttattttgggctgagctgaactgaaaaaaccctttgtgtagaacaagcagccttcttctcctctagcattggtacctttggttaattgctttgttgttagtgaacaacatgctgctctgtgatattttatcattgaatcaaccaattgtgccgcagaaagcattgagcactcgtgtgcattctatgcctggctgctctgagctcccctttccatcgaccaaagcctgctgattctgcattattaccaaattgcagtacagaagaactttcatctatgggacaccaatgttgaacattgggcacaggtcaggattcattcccaagacgtgcgcatttcttgttgccaaggaagcagcagacagtgtctacaacattttacagttcactcacagaagcaggcaggcaggagctacaacaattacaatctctctcgagacaaagaatggaaaggggagtgaagctggagacgaatgagaccagaaacagaaacagaagcaatggcggccaggtgtagcgtggcctgctagcgtgctagacctcgacggtcttctggttgagcgccgtgtacctccagcgctccttctcgacgaagtcggcgtcgaggaacttggccacgaacgcccacagcctgtaggcgtcctcgaagctgctcaggaaccccagcgacgcgttcaccacgtggatcccccacacctcctcctccccttcgttgctccgccgccgctcgaggacggcggtccggtcggcgtcgtacttatcggcgaaggagacgttgcggaggaagccgcaggtgagggagacggcgtggcggtcggcgagcttctgcaccatccccggcgccaccttctcccctttccagtcgtacacgttgaacgccaccgccgggcccctcgagaagctcacccgcggcccgtatatcctcaccagctgctgccccccgcccccgccaatggcggcggtgtcctccgggtgcgggtgcttcagcttctgcatcgcgatcaccagccagttgctgatgcaccgcagcctgttcccgatcgcgatcagccccagggcgtccgcgtggtccagcccccgaagctccaccgccacctccttctcctctgcttccggcagcggcggcggcggtggtggggcaggggcttcttcctcctcgcagatctctggcgtggcagcggcggcggcggtgctgagggggccggagaaggagcacgtgatgtcgatctcggccgattgcggcggcggcggatcggggttggtgaagctgcgggagaggtcgaggtcggtggagtaatcgtcccggagcgaccagcggcggggcgggacgagggagacgacgccgatgctgcgtgccacggcggcgggggaatcctctacgagagcggcgaggctggccttcttgacgaagatcccggcgaagcccgaggggttctcgccgaagaccttgaagaagttgcagacgacgaagtcggggcggaggagggagaggcccagcgtgtcgaggtccttggcgcccatggcggacgcgtccagcgccacgtgccagcctcgctccgcggccgcgctcatccacaggtacgggtgccgcgcgcccgtcatccgcgacaccagcgggaacaccatgagcccctggtggcggcggaggagcttcttgcggaggtcggcggcgtggaggcggagaccgggccaggtgaaggtcgcgtgcagcacctccgcgccgcgccggcgggcggccgcggacatcgcgcccaccgcctcgctctcgtagtcgtacacggccaggagcttttttttcttccggccgccggagttgggggaggagaaggcgtaggactcggccaggaggcggaaggcgctcgtccggttggccgcgcacaccatgacgtactcctcctccggcatcttcatcgacgccatgatgcgcctcgccaccgcgcggccgattccgccgccgatgccgccggaatcgcattgctccacctgcgaccgcagggtcgcggacctgtaggccacgtcgaagaagggaggctgccacggcgccggcgccggggacgacgacgacgtggacggcagggaagaagaggaagagtccatctgggcgtgggagaagaggttgacgccggtgtagtcgaggcacgcgtggcgggcgaggtgcgggtactcgcgggccctgatggcgtccgccgccgcggcggcctcttctccgtccccggcgccggcggagtactgcgggaacgcggcggcgaactcggcgcgtgcctccggcagcggcgggagcgactcgtggttggtgaagtatcgcccccgcgccgccgcgccgtcccggaacagccccgacgccgccgacctcacgaagccgtgcctcgacgtcctcgccgacgacgccgtcacggtcaccaccttcgccgacgcccccgtccgcttgtatcgcatagccaccggcacgcagcccgccatgcacccctgctctcgctctcgctccaccgccgccgccgccggcatctccctgttgttgtcgccgggtgccgccgccgtgtgcttgctgctgccgcggcgtcttgatgaggatgacgataagtacttggcgatgaggaagagcatggttgcctcatggaaaggtctcaagtggatcgatgatgataactctgtttctgagctcgtcgcatcttctttcctttgcgtgtgggcgcggtcgtcggcggccggacagcgacagggcgggcggccggcgctgggcggccagtggccttgccttgtttgcttcgcggccgaggtagctggagctcaacaacaacgagaagatgtgattgtgctgtgcgcgcgcgccagtggctctcctgctgccgggg

SEQ ID NO: 2313 - DNA, 1792 bp, Avena sativa
gagcagagctcgtatattatccgacgtgctccgcgtccacggcgctgccaaagtcacccggactctctcacgttacacacgcctctctctccctccctccccctgcgagccaggccacttccgtagccgcggaagagaatcgagctctcggagcaggaggagggatctcgagatggagtgcaaggatgtcgggatcctcgccatggacatgtacttccctcccacctgcgttcagcaggaagcgctggaggctcatgacggagttagcaaggggaagtacacaattggtcttgggcaagattgcatggccttttgcagcgaggtggaagatgtcatctccatgagcttgacagttgtcaaatccctgctggaaaagtacaatattgatccgaagctaattggacgcctggaggttggtagcgagacagtgatagacaaaagcaaatccatcaaaacgtggctgatgcaaatttttgaggaaagtggtaatactgacattgaaggagttgactcgagtaacgcttgctatggtggaacagctgccctgttgaattgtgtgaattgggtggaaagtaaatgctgggatgggcgttatggtcttgtagtctgcacagatagcgcggtttatgcagacggaccagctcggcctactgggggagctgctgctattgcaatgcttgttggtccaaatgcacctatttcctttgaaagtaaatatagagcttctcacatggctcatgtttatgatttctacaagcctgatcttgcaagtgaatacccggttgttgatggaaaactgtcgcaaacatgctatctgatggctctggattcatgctataatcagtattgtgccaagtatgaaaagcttgtgggagaacaattctcaatttctgatgcagattattgtgtctttcattctccatataataagcttgtacagaagagttttgctagactttacttcaatgatttcatgcgcaattgcagttcggttgataatgatgctaaagagaagcttcagccttttgtaaacttgactagtgaagaaagctaccaaagtcgtgacttggaaaagggctctcaacaacttgccaagcatttgtatgacatcaaagttcaaccatcaactttgcttccaaaacaaatcggtaacatgtataccgcctctctttatgctgcattggcatctgtaatctacaacaagcacgctagtctgagcggtcaacgaattctcatgttctcttatggcagtggcttgacatccactatgttttcatttagactaaatgagggtcagcatccctttagcttagcaaaaattgcttcagtgcttgatgtgacggcaaagctcgagtcaagacatgagacctcacctcagaagttcattgagacactgaagctgatggagcaccgatacggagcaaaggatttcgaaacaaacaaagacacaagcttgctgccaccaggaacattctaccttacaaaagttgattcaatgtacaggaggttctatgaagaaaaaacagccgatggcactgctgacggtaacaagtgcagcaacggcattgcaaatggtcactagtggcgttccccagatactgttagtttaccctttcatttattagccgtgatcagtgcaatttgttgtatttacctctagaactccgatctagctaagtttctaataagtcattattctatgaagtttttccccgcacaatcagtttagtttttgttttgagttgaatgaatgaaacctttgtgtagtacaagcacaacttttcccctctaa

SEQ ID NO: 2314 - DNA, 5154 bp, Oryza sativa
aagttgtacaataataaatttttattcctgtttccgtcgtggcccatctgtgatgatgccagctgggcaatcgtcgtgggcagccgcaagcaaagcagccgtagctgaacgggagtcacacgcagctcacaaaagaccggttccacacttccacgagaggaggacgcgagatccgtattcgagtctcatctccatccttcacgcgacgtgctgctccgctccgctccgtcgtcaagcccccgcccccctcacacttcaggcggcgcccgcgcgagccagccacttcgagaagcgaagcgcggaagcggaggggagatcgagagagatcgcgagatggagcagcccaacgacgtcgggatcctcgccatggacatctacttccctcccgcctgcgtccaccaggaagcgctggaagcgcacgatggagccagcaagggtaagtacacaattggtcttgggcaggactgcatggcctattgcagcgaggtggaagatgttatctctatgagcttgacggttgttgcatcactgctgaaaaagtacaacattgatcctaagcaaattggccgcctggaggttggtagtgagacagtgatagacaaaagcaaatccatcaaaacatggctgatgcatattttcgaggagagtggcaatactgacattgagggggttgactcaagtaacgcatgctatggtggaacagctgccctgttgaattgtgttaattgggtggaaagtaaatcctgggatggacgctacggtcttgttgtttgcacagatagcgcggtttatgcagaagggccagctcgtccaacaggtggtgctgctgctattgctatgcttattggtccgaatgctcccatttcttttgaaagtaaatatagggcttcacacatggcccatgtttacgatttctacaagcctgatcttgcaagtgaatacccggttgttgatggaaaactttctcagacatgctatctgatggctcttgattcgtgctataggcaatattgtaccaagtatgaaaagatagtgggagaacaattctcgatttctgatgcagaatactgtgtcttccattctccatataataagcttgtacaaaagagtttcgcccgactttatttcaatgacttcatgcgtaattgcagcacggttgataatgatgctaaagagaagcttcagccttttgcaaatttgactagtgaagaaagctaccaaagtcgtgacttggaaaaggcctctcaacaagtagcaaagcatctgtatgatatcaaagttcaaccatcaactctgcttccaaaacagatcggtaatatgtacactgcatctctttatgctgcattggcatctgtgatctacaacaagcatgacagtctggatggccagcgaattctcatgttttcttatgggagtggattgacatccactatgttttcgttgagactacatgatggtcaacatccctttagcttaatgaacattgcttctgtgcttgatgtgacgacaaagcttgagtcaagacatgtgacctcacctgagaagtttattgagacattgaagctgatggagcaccgctatggagcaaaagattttgaaacaagcaaagataccagcttgttgccaccaggaacattctatcttacaaaagttgattcgatgtacaggaggttctatgacaagaaagccgccgagggaaaaatcaagggctgcaacggcattgcaaacggtcactgattgggtgccaagaatgctgtgagctcacgcgcattattagccatcttgttgctcagtttgatgtatttattcttagagtgctcagtctagatatcttccaataattcattgttcccctcgtgcccctcagcttgtttttactttaagctgaacaataaacctttgtgtagtactgtagtagtactaggtcctagtatccttgtttcctctagctctattgcttcattgttactagctaattccctccccatgctttattgttctcagtaatatcctgcaaaactgttggctgtgtgcatcttatgatgcagacgttgaagatgtaatttttatcttatctaaaaaattcagttaagtcttgagcagataaaagaaaatagctgtaactttttctgctttgaaacaatgatgcagaattcatatcctggagatggcaaccaaatgatttcagtatagcgaacaagtaataggcacatatttttttctaaggaagcaaagactacattttacagtataatcatgaacacactggagcgagcctctctcacacaaagaatggacggagcagctctgcacagccgatcgagctgatcccaaaagaatggcgaacagtgacagtgacagtgaagtgtaccaatggtggaagctgaaggtggatggacatgtcggctacacctccaccgtcttctggttgagcgcggtgtacctccaccgctccttctccacgaaatcggcgtccaagaacttggccacgaacgcccacaacctgtaggcgtcgtcgaagttggtcaagaaccccagcgacgcgttcaccacgtagatccccatctcgccggcggcgtccttcctcttgccgccgccgtcgatgtgctcgaggacggcggccctgtcggcgtcgtacttgtcggagaagcagatgtggcggaggaagccgcaggtgagggagatgttgtggcggtcggcgagcttctgcaccagcggcggcgccaccttctcccccttccagtcgaacacgttgaacgccagcgatggcccccgctcgaacttcacccgcggcccgtacacccgcaccagcgccttcccctgctccgactgcgggtgccgcagcttctgcatcgccaccaccagccagttgctgatgcacctcagccggttgcctatggcgatcagccccagcgcgtccgcgtggtccagccccctgcactccacctccattattggcggtggtggtggcggcggatcggcctcgcggatctccggcgagtggccgttctcctcgcctgcggcgtccatctccggtacgttcttgagtgtgagcgcgatgagggtgccactgagtgggccggagaaggagctggtggtgtcgaggtcgtccgccgccgcggcgaccgggtcgagctcggtggagtagccgtcgtggagcgaccagcggcgtgcggggacgatgctgacgatgccgatgctgcgggcgatgacggagcgctccagcgcggcgaggctggacttcttgacgaagaggcccgcgaagccggaggggttctcgccgaacaccttgaagaagttgcagacgatgaagtccgggcggaggagggagaggcccagcgtgtcgaggtccttggtgcccagcgcgcacgcgtcgagcgcgacgtgccacccttgttcgtgcgccgcgctcatccacaggtatgggtacctggcccccgtcatccgcgacaccagcgggaacacgaagagccccctccggtgcccgccgccgccgccgcgccgcctcccgcggagcagcttcttgcggaggtcggcggcgtggacgcgcatgcccggccacgcgaacgtcgccgacatcacctccgcaccgcggcggcgcgcgctctccgccatcgcgcccgccgcctcgctctcgtagtcgtacacggtgagcagccgcttgccgtgctgctggaaggagtaggactccgccagcagccggaacgcggtggtccggttcgccgtgcacaccatggcgtactcgtcgtcggggatgttgagcgacgccatgacgcgcctcgtcacggcgccgccgatcccgcccgccgcggacgccgccgcgacgtcgtccccgcattgcacctgcgaccgcaggctcgtggacttgtacgcgatgtcaaagaacggcggctgccacgccgcgcccgacgacgacgccggcggcgtggccgacgtcgacggcaccgacgagttcatctgcgcgtgggagaagaggttgatgccggtgtagtcgaggcacacgtggcggtcgaggtgctggtactcgccgtccctgatggcgtcggcctgggcgagcccggcgtactgcgggaacgcggcgacgaactcggcgtacgcctcctccatcgccgggagcgactcgtggttggtgaactgcgcgccggggaacagccctgacgccgccgacttgacgaaattgtgccgcgacgtcctcgccgtggtcgtcgtcgtcgtcgtcgtcgtggttcccctcttgacgcgcaccggcacgcagccggggatgcacatgaactcacgctccgctccgttcgccggcggtggcggcggcggcggtggcatctccttgtcgtcgccggctgccgggttcttgctcctggacaggtacttgttgatgagcaagagcatggttgcctcatggatagggttgtcttggatgagctcggcgagttgcaattgctgctgctgctgtcacggcgagagcgaccggatggccgccgagtggccgcatgcgactgcttctccctcgtcgccggccgccgccgccgccgcctcctggttttcttctccggctagcttttttgctcggctcttggtggtgaagtggtgatcgatggatcgatgtgcgcgccagtggctgtcctgctgctgggaaaaaggcttgtttttttttccttttttttttcattcagttggccacaggctcacagggagtgacagcaacataccaagcagaggattgatgaaggtgatgcaaatgctgatatgcatcatccatcttgttatactacaatccagtcaatggcatcctgctgactgacaagatgatcatataggaacaggatagggttttacttatttatatagggaaaggggatttttttgtttaaaaaggtgaagaaaagaacatgttttttttaatattaggtgtgaaagcccccaacctccagatattctcttaatttggtcagaaaccaaatcaagttgctcgtcttccccagcattcacgccttgtcttgtactccatatggctcccctatttgcgctgccggcgctgaccggcccaatttctactcctattgagtgtttatgtatgtgaattccatactgaatttcggctcagtctcccgatttatttttaccaactcaccgttctcgctttctgaactactaaac

SEQ ID NO: 2315 - DNA, 1827 bp, Sorghum bicolor
ctgagacccaaccgctctataatccacgcccacgacgtaagcgcacgcagaagcagacccacacaccaaaggcgacgtcgcgtgtgagagctctcagagccgggaggcgtcgagaggtcgagccgacctcgcacgcagtcgaaggcgccggcgccgccgcggcagcggaggaggaggaggggtctcgatcgccgagatggaggagggcaaggacgtcgggatcctcgccatggacatctacttccctcccacctgtgtccagcaggaagcactggaggctcatgacggtgccagcaaggggaagtacacaattgggcttgggcaggattgcatggcattctgcagcgaggtggaagacgttgtatctatgagcttgacagttgttgcatccctgctgcaaaagtacaacattgatcctaagctaattggacgcttggaggttggtagtgaaacggtgatagataaaagcaagtccatcaaaacatggctgatgcaaattttcgaggaaagtggtaatactgacattgaaggagtcgactcgagcaatgcatgctatggtggaacagctgccctgttgaactgtgtgaattgggttgagagtaaatcatgggatggacgctatggccttgtcgtttgcacagacagcgcggtttatgcagaaggacctgctcgtcctacagggggtgctgctgctattgcaatgcttattggtccaaatgctcctatatcttttgaaagaaaatataaagcttcccacatggcccatgcttacgatttctacaagccggatcttgcaagtgaatacccggttgttgatggaaagttatctcaaacatgctacttgatggctctcgattcatgttataaacagttttgtaccaagtatgaaaagctagtcggagaacagttctcaatatctgatgcagattattgcgtgttccattctccatataataagcttgtgcagaaaagtttcgctcgactcttctttaatgatttcatgcgcaattgcagctcagttgataacgatgctaaagagaagcttctaccttttgcaaatctgaatagtgaagaaagttaccaaagccgtgacttggaaaaggcttctcagcaagttgcaaagcatttgtatgacatcaaagttcaaccgtcaactttgcttccaaaacaaatcggtaacatgtatactgcatctctgtatgcagcactggcctctgtagtctacaacaagcacaacagtctagctggccaacgaatcattatgttctcttatggcagtggcttgacatcgacattgttctcattaagattgcatgagggacaacatcccttcagcctagcaaacattgcttccatgcttgatgtaacagcaaagctcaactcaagacatgtgacaccacctgagaagtttgttgagacattgaagctgatggagcaccgttacggagcaaaggatttcgagacaagccaagacacaagcctgttgccacctggcacattctaccttacaaaagttgattccatgtataggaggttctatgacaagaaagcatctgacgacattgtttggggtaaaaccaaggttagcaatgccctagcaaatagccaatagcagtgaggaaatatcataaagcaatgttattagataactgcactattaacgccatcctgcaaatgtgttcaccgtaaacactgaacttatatttatgctgaaaacagaaactctgtacccttgttttctctttgattgtgctatgattgtattggtgattgtgattgaccaaaactcatgatttcatataccaaatgaggccttgtttagatcgc

SEQ ID NO: 2316 - DNA, 2274 bp, Sorghum bicolor
cgtttgtcgtgtctgtgtctctgagcctgtcacgtgccgtgccggaatctcgcagccatcgatcgatccagcagatgtgacagccgccgcgccgagctgacgcagctgaaattcctacgaacatatagatcccgcatcgtcgacccatccgattccgtcgtcctcctcccgacggtacgccaagtccaacgcaggcgtagctcccggccacagcagagcccacgccttgacgcgctccgtgtgagactgtgagtggagcgtccggacgccggccggcggccagagaggaagcggatcgaggaggctcggctgactggaggagatggaccgcaaggatgtcgggatcctcgccatggacatctacttcccgccctcctgcgtgcagcaggaagcacttgaggcccatgatggggcgagcaaagggaagtacaccattgggctcgggcaagattgcatggccttttgcagcgaggtggaagatgtcatctcaatgagtttgacggttgtcaattccctgctgaaaaagtacaagattgatcccaagttaatcggtcgcttggaggtcggaagtgaaacagttatagacaaaagtaaatccatcaaaacttggctgatgcagatttttgaggaaagtggtaatactgacattgaaggcgttgactccagcaatgcatgttatggtgggacagcagccctactgaattgtgtgaattgggtcgaaagtaactcctgggatggccgttatggtcttgtcgtttgcacggatagcgcggtttatgcggaagggccagctcgtccaacaggaggtgctgctgctatagcaatgctcattggtcctaatgctccaatttccttcgagagcaaatatagagcttctcacatggctcatgtttacgatttctacaagcctgatcttgcaagtgaatatccggttgttgatggtaaattatcccaaacatgctacctgatggctctagactcatgctacagacagttctgcaacaagtatgagaagatcgcgggtaaacaattctcaatttctgatgcagaatattttgtgttccattctccatacaacaagctcgtgcagaagagtttcgctcgactttactacaatgacttcatgcgcaactgcagctctgttgatgatgacgctaaagagaagctccagtctttttcaaatttgactggtgaagagagctaccagagtcgcgacttggaaaaggcctcacaacaagttgcaaagcacctctatgacatcaaagttcagccatcgactctgcttccgaaacaaattggtaacatgtatactgcatccctttatgctgcattggcatctgtgctatataacaagcatgatagtctgaatggacacagaattgtgatgttctcttacggcagtggcttgacatccactatgttttcattgaggctgaacaatggtcagcatccattcagtctatcaaacattgcttcagttcttgatgtcaccgagaagcttcagtcaagacatgagaccttgcctgaaaaattcgttgagacactgaagctgatggaacacagatacggcgcaaaggacttcgagacgagcagagacaccagcctgctgcagccaggcacattctacctcaccaaggtcgactccatgtacaggaggttctattcccagaagctggccgaggaaacaggcggcggcaaaaccaagtgctgcaacggcttcgcaaatggccactagtggtgttcatgccgtgaattgctaggtcgccctgcactgttgttcatcattctccgtattttgataatgctcgtggttagcgtttagtctacgtgtttctgaaataatataattgttctttgaagctgttccccctagatcagctagtttttgtatcttatttatctgaccaatgagatttatcagtctcgacattgtttctctttgattcttcttccactagcaagagttcttagaaattagtaccccctccattccaaatttcaaactataatacattttggcttttctatatacatagcgtttgctttgtatttagatactagcaaacttatccgttgcaaacttgtttgtgcattgcaacagaagataaaaaaagctatgaaatgttacttgttcacttagtcaaaaaaaatgttacttcaacttgctacacagctctaacgaccgcaaccacttaaatgtgtataggtgctatttttgattttttgagtggttgctgcaccgatatctattcaatttttatcctttctataaaa

SEQ ID NO: 2317 - DNA, 1973 bp, Saccharum officinarum
catccgtcctcctcctccagacggtacgccagcctgccagagtcccccgacgcaggcgtagctcccggccacagcagagcccacgccttgacgcgctccgtgtgagactgtgagtggagcgtacgggcgccggccggcggccagagaggaagcggatcgaggaggctcggctcggctgagtggaggagatggaccgcaaggatgtcgggatcctcgccatggacatctacttcccgccctcctgcgtgcagcaggaagcacttgaggtccatgatggggcgagcaaagggaagtacaccattggactcgggcaagattgcatggccttttgcagcgaggtggaggatgtcatctcaatgagtttgacggttgtcaattccctgttgaaaaactacaagattgaccccaagttaatcggtcgcttggaggtcggaagtgaaacggttatagacaaaagtaaatccatcaaaacttggctgatgcagatttttgaggaaagtggtaatactgacattgaaggcgttgactccagcaatgcatgttatggtgggacagcagccctactgaattgtgtgaattgggtcgaaagtaactcctgggatggccgttatggtcttgtcgtttgcacggatagcgcggtttatgcggaagggccagctcgtccaacaggaggtgctgctgctatagcaatgctcattggtcctaatgctccaatttccttcgagagcaaatatagagcttctcacatggctcatgtttacgatttctacaagcctgatcttgcaagtgaatatccggttgttgatggtaaactatcccaaacatgctacctgatggctctagactcgtgctacagacagttctgcaacaagtatgagaagattgcgggcaaacaattctcaatttctgatgcagaatattttgtgttccattctccatacaacaagctcgtgcagaagagtttcgctcgactttactacaatgacttcatgcgcaactgcagctttgttgatgatgatgctaaagagaagctccagtctttttcaaatttgaccggtgaagagagctaccggagtcgcgacttggaaaaggcctcacagcaagtcgcaaagcacctctatgacatcaaagttcagccatcaactctgcttccgaaacaaattggtaacatgtatactgcatccctttatgctgcgttggcatctgtgctatataacaagcatgatagtctgaatggacaaagaattgtgatgttctcttatggcagtggcttgacatccactatgttttcattgaggctaaacaatggtcagcatcccttcagtctatcaaacattgcttcagttcttgatgtcaccgagaagcttcagtcaagacatgaaaccttgcctgagaaattcattgagacactgaagctgatggaacaccgatacggcgcaaaggacttcgagacgagcagagacacgagcctgctgcagccaggcacattctacctcaccaaggtcgactccatgtaccggaggttctattcccagaagctggctgaggaaacaggcggctgcaaaaccaagtgctgcaacggcttcgcaaatggccactagtggtgcgcgtgccgtgaattgctaggtcgccctgcaccgttgctcgtcattctccgtattttgataatgctcgtggttagcgtttagtctagcgtgtttctgaaataatattattggttctttgaagctgttccacctagatcagctagtttttgtattttattcatctgaccaataagattcatcagtctcgacattgtttcttctttctgaaaagagaatcttgtaacggaagcaatgtaaacaaaaaattgtatgatgatatttaaaatgcacactacttgattcaatagggctgacgcatataaatgataaaagggggggcccttttagaggacccaggttatcttccgctggatggcaacggaatgg

SEQ ID NO: 2318 - DNA, 1907 bp, Setaria italica
ccccacccgtcctcctcccgtccccccaccccgacgcgcagccagccactcggccagaaccgtgcggagttcacgaagacagagccctcctccgcgaccaccagccacaggaaagccccacgcgtcgacgcgctccgtctgtgtggagcgcacgagcgccggccggcggctagggagcgaggggatcgaggcggctcggccgagtggaggagatggaccgcaaggatgtcggaatcctcgccatggacatctacttcccgcccagctgcgtgcagcaggaagcgctcgaggcccatgacggcgcgagcaaagggaagtacaccattggccttgggcaagattgcatggccttttgcagtgaggtggaggacgtaatctcgatgagcttgacggttgtcaattccctcctgaaaaagtacaaggttgacccgaagcttatcggtcgcttggaggttggaagcgagacggttatagacaaaagtaaatccatcaaaacttggctgatgcaaattttcgaggaaagtggtaatactgacattgaaggagttgactccagcaatgcttgttatggtggaacagcggccctattgaattgcgtgaattgggtcgaaagtaactcctgggatggacgatatggtcttgtcgtttgcacagacagcgcggtttacgcggaaggaccagctcgcccaactgggggtgctgctgctattgctatgctcattggtcctaatgctcctatttcatttgagagcaaatatagagcttctcacatggctcatgtttatgatttctacaagcctgatcttgcaagtgaatacccggtggttgatggtaaactatcccaaacatgctacttgatggccctagactcatgctacagacagttctgcaacaagtatgagaagattgtggggaaacaattctcaatttctgatgcagaatattttgtgttccattctccttacaacaagcttgtgcagaagagttttgctcggctttgctataatgacttcatgcgcaactgcagctctattgatgatgatgctaaagagaagctccagccgttttcaaatctgactggtgaagagagctaccagagtcgcgacttggaaaaggcctcacaacaagtcgcaaagcacttgtatgacatcaaagttcagccatcgactctgcttccaaaacaaattggcaacatgtatactgcatccctctatgcagcgttggcatctgtgctatataacaagcatgatagtctggatggacaaagaattgtgatgttctcttacggcagtggcttgacatccactatgttttcgttgaggctaaacaatggccagcatccgttcagtttatcaaacattgcttccgtgcttggtgttacagagaagcttcagtcaagacatgagacattgcccgaaaagttcattgagacgctgaagctgatggagcataggtacggcgcaaaggatttcgagactaacaaggacacgagcctgctgccgcccggcacgttttacctcacccatgtcgactccatgtaccggaggttctatgaccagaagcctgtagaggaaacagccggtggcaaagccaagtgctgcaacggcttcgcaaatggccactagtgacgtgccgtggactccctatgtcgcctgccttgttgctcatcgactcatcgtgctttgtactctaatatgcttatgcttagaattccaagcctagcgtgtttctgaaataatttattatctgcagctgttctcctagatcagctagtttttgtattttatttatctgactagtgaaatcagtcttgacattcttgtttcttttagttcgttattttttcgttcgccggtcaggcttcttgtaagttaggctgggaaaattacagcctgatgcttcaggtg

SEQ ID NO: 2319 - DNA, 2025 bp, Panicum virgatum
cccactcgtccccccccccccccccacccgcgcagccaagccagagccgtccggagtccacgaggacagcgtcgtcctccactcctcctccgccgccgccgccgccggccgcagcagaacagaggagcccacgcgccggcgcgcgctccgtccgggcggagcgcacgagcgcgggtccagggagcgaggggggatcggggcggcggctctcggcttcactgctgcgcgggatggcgggccgcaacgatgtcgggatcctcgccatggacatctacttcccgcccacctgcgtgcagcaggaggcgcttgaggcccatgacggcgtgagcaaagggaagtacaccatcggccttgggcaagattgcatggccttttgcagcgaggtggaggatgtcatctcaatgagtttgaccgttgtcaattccctcctaaaaaagtacaacattgatccaaagcttattggtcgcttggaggttggaagtgagacggttatagacaaaagtaaatccatcaaaacttggctgatgcaaatttttgagaaaagtggcaatactgacattgaaggagttgactccagcaatgcttgttatggtggaactgctgccctgctgaattgcgtgaattgggttgaaagtaactcctgggatggacgctatggtcttgtcgtttgcacagacagcgcggtttatgctgaagggccagctcgtccaactgggggtgctgctgcaattgcaatgctcattggccctaatgctcctatttcatttgagagcaaatatagagcttctcacatggctcatgtctatgatttctacaagcctgatctcgcaagtgaatatccggttgttgatggtaaactatcccaaacatgctacttgatggccctagactcatgctacagacaattttgcaacaaatacgagaagattgtggggaaacaattctcgatttctgatgcagaatattttgtgttccattctccatacaacaagctcgtgcagaagagttttgctcgactttactacaatgacttcatgcgcaactgcagctctattgatgatgatgctaaagagaagcttcagccattttctaatctgactggtgaagagagctaccagagtcgcgacttggaaaaggcctcgcaacaagtcgcgaagcacttgtatgacatcaaagttcagccatcgactctgcttcccaaacaaattggcaacatgtatactgcatccctttatgctgcattggcatctgtactatataacaagcatgatagtctggatggacaaagaatcgtgatgttctcttacggcagtggcttgacatccactatgttttcgttgaggctaaacaatggccagcatcccttcagtttatcaaacattgcttcagtgcttggtgtcacagagaagcttcagtcaaggcatgagaccttgcccgagaagttcattgacacattgaagctgatggagcaccggtacggtgcaaaggatttcgagaccagcagggacacgagcctgctgccgcctggcacattttacctgacccatgtggactccatgtaccggaggttctatgaccagaagcctgtagagggtggcaaagccaagtgctgcaacggctttgcaaatggccactagtggcgtgccgtggactctaaggtcgcctcgcctgccttgttgctcatagactcatcgtgctctgtactctgatatgcttatggttagaatttccagcctagtgtgtttctgaaataatttgttgtctgcagctgttctcctagatcagctagtttttgtaatatttttatctgaccggtgaaatcagtcttgatattcttgtttctgtagtttgttggttcactgcttcactggtcaagtggtcagcgttcttgtcttcttgtaagttaggctgcgaaattattctgtatcgagcgcctgacactttggtgctccggcacaaggccaagtgatgcggacgtggttgtgccgcggctaacaaggtagctcaactcttagcaggtttcac

SEQ ID NO: 2320 - DNA, 2091 bp, Zea mays
aagaataggcgtttgtcgtgtctcgtgcccgtgcctgtgaacctctcacgtgccgtgccggaatctcgcagccatcgatcgatccagcagatgtgccagccgccgcggccgcgccaagcccaagccgagctgacgatcctgatgcggttgaaaatttccacgaacatatagatccgcatcgtcgaccccatccgtggtgctcccggtgcgccaggctaccagagtccgacgcaggcgtagctcccggccacagcagagcccacgccttgactgcgctccgttcgagtggagcgtacgggcgccggccggcggccagagaggaaacggatcgaggaggctcagctgagtggaggagatggaccgcaaggatgtcgggatcctcgccatggacatctacttcccgccctcctgcgtgcagcaggaggcacttgaggcccatgatggggcgagcaaagggaagtacaccattgggcttgggcaagattgcatggccttttgcagcgaggtggaggatgtcatctcaatgagtttgacggttgtcaattctctgctgaaaaaatacaagattgatcccaagttaatcggtcgcttggaggtgggaagtgaaacagttatagacaaaagcaaatccatcaaaacttggctgatgcagatttttgaggaaagtgataatactgacattgaaggtgttgactccagcaatgcatgttatggtgggacagcagccctactgaattgtgtgaattgggtcgaaagtaactcctgggatggccgttatggtcttgtcgtttgcacggacagcgcggtttatgcggaaggaccagctcgtccaacaggaggtgctgctgctatagcaatgctcattggtcctaatgctccgatttccttcgagagcaaatatagagcttctcatatggctcatgtttatgatttctacaaacctgatcttgcaagtgaatatccggttgttgatggtaaattatcccaaacatgctacctgatggctcttgactcatgctacagacagttctgcaacaagtatgagaagattgcgggtaaacaattctcaatttcagatgcagaatattttgtgttccattctccatacaacaagctcgtgcagaagagttttgctcgactttactacaatgacttcatgcgcaactgcagctatgttgatgatgatgctaaagagaagctccagtccttttcaaatttgactggtgaagagagctaccagagtcgcgacttggaaaaggcctcacaacaggtcgcaaagcacctgtatggcatcaaagttcagccaacgactctgcttccgaaacagatcggcaacatgtatacggcatccctttatgctgcattggcatctgtgctatataacaagcatgatagtctgaatggacaaagaattgtgatgttctcttacggcagtggtttgacatccactatgttttcgttgaggctaaacaatggccagcatcccttcagcctatcaaacattgcttcagttcttgatgtcaccgagaagcttcagtcaagacatgagactttgcctgagaaattcgttgagacgctgaagctgatggaacaccgatacggcgcaaaggacttcgagacgagcagagacacgagcctactgcagccgggcacattctacctcaccaaggtcgactccatgtaccggaggttctattcccagaagctgtccgaggaaacaggcggcgggaaaaccaagtgctgcaacggcctcgcaaatggccactagtggtcgcccagcactgttgctcatcattctcagtattttgataatgctcatggttagcgtttagtctagcgtgtttctgaaataatataattgttctttgaagctgtcccaccccccctagatcagctagttttttattttaaaattttattcttctgaacattgaaattcatcagtctctacattgtttctctttgtttcttcttttagtactctcttcgttccaaattctaaattacgtacataatgtttgctatgtctaatagtaaaaaaaaagtcaacaccttataatttagagttagagtggaaatgtggaatgtggc

SEQ ID NO: 2321 - DNA, 2023 bp, Saccharum officinarum
cagagccggaagcgccgagaggtcgagccggcctcgcacgcagccgcagtcgaaggcgccgcggcggcagcggaggaggtggggtctcgatcgccgagatggaggagcgaaaggacgtcggcatcctcgccatggacatctacttccctcccacgtgtgtccagcaggaagcactggaggctcacgatggtgccagcaaggggaagtacacaattgggcttgggcaggattgcatggcattctgcagcgaggtggaagacgttgtatctatgagcttgacagttgttgcatccctgctgcgaaagtacaacgttgatcctaagctaattggacgcttggaggttggtagtgagacggtgatagacaaaagcaagtccatcaaaacatggctgatgcaaattttcgaggaaagtggtaatactgacattgaaggagttgactcgagcaatgcatgctatggcggaacagctgccctgttgaactgcgtgaattgggttgagagtaaatcatgggatggacgctatggccttatcgtttgcacagatagcgcggtttatgcagaaggacctgctcgtcctacagggggtgctgctgctatggcaatgcttattggtccagatgctcctatatcttttgaaagaaaatataaagctctccacatggcccatgtttatgatttctacaagccagatcttgcaagtgaatacccggttgttgatggaaagttatctcaaacatgctacttgatggctctagattcatgttatagacagttttgtaccaagtatgaaaagctagtcggagaacagttctcaatatctgatgcagattactgcgtgttccattctccatataataagcttgtgcagaagagttttgctcgactcttctttaatgatttcatgcgcaattgcagctcagttgataacgatgctaaagagaagcttctaccttttgcaaatctgactagtgaagaaagttaccaaagccgtgacttggaaaaggcttctcaacaagttgcaaagcatttgtatgacatcaaagttcaaccgtcaactttgcttccaaaacaaatcggtaacatgtatactgcatctctgtatgcagcactggcatctgtaatctacaacaagcacaacagtctagctggccaacgaatcattatgttctcatacggcagtggcttgacatccacattgttctcattaagattgcatgagggacaacatcccttcagcctaggaaacattgcttccatgcttgatgtaacagcaaagctcaactcaagacatgtgatgtcacctgagaagtttgttgagacgttgaagctgatggagcaccgttacggagcaaaagatttcaagacaagccaagacacaagcctgttgccacctggcacattctaccttacaaaagttgattccatgtataggaggttctatgacaagaaagcatctgatgacattgattggcgtaaaaccaaggttagcaatgccgtagcaaatggccaatagcggcgaggaaatatagcaaaataatgttactagataactgcactattaacgccatcctgcaaatctatttaccctaaacactgaactatttgtgctgaaaacaggaactttgtacccttgttttctctttggttgtgctatgattctatcgatagtgattgtggttgacaccccccacagacgtgcataccaaaattcatacagaaaaaaaaacaaagatggggctgtcgctaaacgggggatcacattttcgtgccactgccgtgtgactgcaacaagcatttctgggtacggcccgcacaaagaatatatattcaactttcttctggcctttttataaatggtgttcgagaattatcaaaaaacttatagggtcttaccccacaacttttacttcgctttcttggggaacacaaattacaccgtttttactcgcatcggggtggaagaaaatatggcaagaaagaggctcccttaaaaaggatttctcctcctttcttaacaaaaat

SEQ ID NO: 2322 - DNA, 2006 bp, Panicum virgatum
acgcgatccacgctgacgctgacgccgagggaggaaaaccatccagaaatatatacccgtaggccgtagatccacccatcccgtcccccccccccccccccaccgcgcagccaagccagagccgtccggagtccacgaggacagcgtcgtcctccactcctcctccgccgccgccgccgccggccgcagcagaacagaggagcccacgcgccggcgcgcgctccgtccgggcggagcgcacgagcgcgggtccagggagcgaggggggatcggggcggcggctctcggcttcactgctgcgcgggatggcgggccgcaacgatgtcgggatcctcgccatggacatctacttcccgcccacctgcgtgcagcaggaggcgcttgaggcccatgacggcgcgagcaaagggaagtacaccatcggccttgggcaagattgcatggccttttgcagcgaggtggaggatgtcatctcaatgagtttgaccgttgtcaattccctactaaaaaagtacaacattgatccaaagcttattggtcgcttggaggttggaagtgagacggttatagacaaaagtaaatccatcaaaacttggctgatgcaaatttttgagaaaagtggcaatactgacattgaaggagttgactccagcaatgcttgttatggtggaactgctgccctgctgaattgcgtgaattgggttgaaagtaactcctgggatggacgctatggtcttgtcgtttgcacagacagcgcggtttatgctgaagggccagctcgtccaactgggggtgctgctgcaattgcaatgctcattggccctaatgctcctatttcatttgagagcaaatatagagcttctcacatggctcatgtctatgatttctacaagcctgatcttgcaagtgaatatccggttgttgatggtaaactatcccaaacatgctacttgatggccctagactcatgctacagacaattttgcaacaaatacgagaagattgtggggaaacaattctcgatttctgatgcagaatattttgtgttccattctccatacaacaagctcgtgcagaagagttttgctcgactttactacaatgacttcatgcgcaactgcagctctattgatgatgatgctaaagagaaactccagccattttctaatctgactggtgaagagagctaccagagtcgcgacttggaaaagacctcgcaacaagtcgcgaagcacttgtatgacatcaaagttcaaccatcgactctgcttcccaaacaaattggcaacatgtatactgcatccctttatgctgcattggcatctgtactatataacaagcatgatagtctggatggacaaagaatcgtgatgttctcttacggcagtggcttgacatccactatgttttcgttgaggctaaacaatggccagcatcccttcagtttatcaaacattgcttcagtgcttggtgtcacagagaagcttcagtcaaggcatgagaccttgcccgagaagtttgttgacacactgaagctgatggagcaccggtacggtgcaaaggatttcgagaccagcagggacacgagcctgctgccgcctggcacgttttacctgacccatgtggactccatgtaccggaggttctatgaccagaagcctgcagaggaaacgaccggtggcaaagccaagtgctgcaacggcttcgcaaatggccactagtggtgtgccgtggactctaaggtctcctgccttgtttgttgctcatagactcatcgtgctctgcactctcatatgcttatggttagaatttccagcctagcgtgtttctgaaataatttattctctgcagctgttctcctagatcagctagtttttgtaattttttttaatctgaccggtgaattaagtcttggcatccttgtttctgtagttagtttttttttcgttcactgccacactggttagagttcttgtaagtttggcgtgcgaaattattccgtatcg

SEQ ID NO: 2323 - DNA, 2306 bp, Panicum virgatum
cggcctgccgtccgatccccgagatccccgccctcctccagtccagctggccctgcagccggcgggcccagcgccccacgcctcgagccgcttgtcgtgtccacgcccctcacgtgccgtgccggaatctcccagcgatccaacatctcgtgccgcgcgagctcaccaccacgccgacgctgacgccgaggaaatccatccagaaatatatacccgtaggccgtagatccacccatcccgtcccccccaccccgaaacgcagccagccagagccgtccggaatccacgaggacagcgtcgtcgtcctcctcctccgccgccgccgccggccgcagcagaacagagcccacgcgcgctccgtccgggtggagcgcacgagcgcgggttcagggagcgaggggatcggggcggcactcggcttgactgcgcgggatggcgggccgcaaggatgtcgggatcctcgccatggacatctacttcccgcccacctgcgtgcagcaggaggcgcttgaggcccatgacggcgcgagcaaagggaagtacaccatcggtcttgggcaagattgcatggccttttgcagtgaggtggaggatgtcatctcaatgagtttgaccgttgtcaattccctacttaaaaagtacaatgttgatccaaagcttattggccgtttggaggttggaagtgagacggttatagacaaaagtaaatccatcaaaacttggctgatgcaaatttttgagaaaagtggcaatactgacattgaaggagttgactccagcaatgcttgttacggtggaactgctgccctgctgaattgcgtgaattgggttgaaagtaactcctgggacggacgctatggtcttgtcgtttgcacagacagtgcggtttatgctgaagggccagctcgtccaactgggggtgcggctgcaattgcaatgctcattggtcctaatgcacctatttcatttgagagcaaatatagagcttctcacatggctcatgtttatgatttctacaagcctgatcttgcaagtgaatatccggttgttgatggtaaactatcccaaacatgctacttgatggccctagactcatgctacagacaattttgcaacaaatacgagaagattgtggggaaaccattctcgatttctgatgcagaatattttgtgttccattctccatacaacaagctcgtgcagaagagttttgctcgactttactacaatgacttcatgcgcaactgcagctctattgatgatgatgctaaagagaaactccagccattttctaatctgactggtgaagagagctaccagagtcgcgacttggaaaagacctcgcaacaagtcgcgaagcacttgtatgacatcaaagttcaaccatcgactctgcttcccaaacaaattggcaacatgtatactgcatccctttatgctgcattggcatctgtactatataacaagcatgatagtctggatggacaaagaatcgtgatgttctcttacggcagtggcttgacatccactatgttttcgttgaggctaaacaatggccagcatcccttcagtttatcaaacattacttcagtgcttggtgtcacagagaagcttcagtcaaggcatgagaccttgcccgagaagtttgttgacaccctgaagctgatggagcaccggtacggtgcaaaggatttcgagaccagcagggacacgagcctgctgccgcctggcacgttttacctgacccatgtggactccatgtaccggaggttctatgaccagaagcctgcagaggaaacgaccggtggcaaagccaagtgctgcaacggcttcgcaaatggccactagtggtgtgccgtggactctactgccttgtttgttgctcatagactcatcgtgctctgcactctcatatgcttatggttagaatttccagcctagcgtgtttctgaaataatttattctctgcagctgttctcctagatcagctagtttttgtaattttttttaatctgaccggtgaattaagtcttggcatccttgtttctgtagttagtttttttttttcgttcactgcctcactggttagagttcttgtaagtttggctgcgaaattattccgtatcggggcatcgggcgcctgacacttcggtgcttcggcacaaggctaagtgatgcggacgtgggcacgtggctgtgccgtgcgagcccgggggtgctcgaggggctaacaaaatcaaacagccagatatgacaatccgacgtgccagctgttactaatcttggcatcgagaaactttagttaa

SEQ ID NO: 2324 - DNA, 1901 bp, Pennisetum glaucum
cgtcccctcctcacccaaccagagccgtgcggagtccccgaagacagagcccttcctccgcgaccgccgccggccacagcaggagccccaccacgcgtcgacgcgctccccccgtctgtgcagagcgcactcccgccggccgccgtccagggaagagcgagcggatcgggagcggctcggccgagtggaggagatggaccgcaaggatgtcggcatcctcgccatggacatctacttcccgcccacctgcgtgcagcaggaagcgctcgaggcccatgacggtgccagcaaagggaagtataccattggccttgggcaagattgcatggccttttgcagcgaggtggaggacgtcatctcgatgagcttgacagttgtcaactccctactgaaaaagtacatggttgacccgaagcttatcggtcgcttggaggttggaagcgagacggttatagacaaaagtaaatccatcaaaacttggctgatgcaaattttcgaggaaagtggtaatactgacattgaaggagttgactccagcaatgcttgttatggtggaactgcggccttgttgaattgcgtgaattgggttgaaagcaactcctgggatggacgctatggtctcgtcgtctgcacagacagcgcggtttatgcagaagggccggctcgtccaacagggggtgctgctgctattgcaatgctcattggccctaatgctcctatttcatttgagagcaaatatagagcttctcacatggctcatgtttacgatttctacaagcctgatcttgcaagtgaatacccggttgttgatggtaaactatcccaaacatgctacttgatggccctagactcatgctacaggcagttctgcaacaagtatgagaagattacggggaaacaattctcaatttctgatgcagaatattttgtgttccattctccttacaacaaacttgtgcagaagagctttgctcgactttactacaatgatttcatgcgcaactgcagctctattgatgatgacgctaaagcgaagctccagccgttttcaaacctcactggtgaagagagctaccagagccgcgacttggaaaagacctcacaacaagtcgcaaagcacttatatgacatcaaagttcagccatcgactgtgcttccaaaacaaattggcaacatgtatactgcatctctctatgcagcgttggcatctgtgctatacaacaagaatgatagtctggatggacaaagaattgtgatgttctcttatggcagtggcttgacgtccactatgttttcattgaggctaaacaatggccagcatcccttcagtttatcgaacattgcttctgtgcttggtgtcacagagaagcttcagtccagacacgagacattgcccgaaaagtttgttgagactctgaagctgatggagcaccggtacggtggaaaggatttcgagacgaacaaggacaccagcctgctgccgcccggcaccttttacctcacccatgtcgactccatgtaccggaggttctatgaccagaagcctgtggaggaaatggtcggcagcaaagccaagtgctgcaacggcttcgcaaatggccactagtggcgtgccgtggactactaggttgcctgccctgttgatcatcgactcatcgtactctgtactttgatatacttatatggttagaattttcagcctagcgtgttctgaaataatttattctctgcagctgttctcctaaatcagctagtttttgtattttatatttatctaacaagtgaaatcagtcttgaagtctagctgttccactagatcggctagtttctgaaattcttgttttctttttatttttgtttgttttttctactcactggtccttgttgtaagtttagcttgg

SEQ ID NO: 2325 - DNA, 1886 bp, Cenchrus ciliaris
  misc_feature (147)..(147): n is a, c, g, or t
  misc_feature (154)..(154): n is a, c, g, or t
  misc_feature (1490)..(1490): n is a, c, g, or t
  misc_feature (1669)..(1669): n is a, c, g, or t
  misc_feature (1697)..(1697): n is a, c, g, or t
  misc_feature (1796)..(1797): n is a, c, g, or t
  misc_feature (1845)..(1845): n is a, c, g, or t
  misc_feature (1850)..(1850): n is a, c, g, or t
  misc_feature (1872)..(1872): n is a, c, g, or t
  misc_feature (1875)..(1875): n is a, c, g, or t
ccagccagagccgtgcggagtccacgaagacagagccctcctccgcgaccgccggcccacgcgtcgacgcgctccctccgtctgtgcggagcgcactcccgccggcggctagagagcgaggggatcgggagcggctcggccgagtgnaggaganggaccgcaaggatgtcgggatcctcgccatggacatctacttcccgcccacctgcgtgcagcaggaagcccttgaggcccatgacggcgcgagcaaagggaagtacaccattggccttgggcaagattgcatggccttttgcagcgaggtggaggacgtcatctcgatgagcttgacagttgtcaattccctactgaaaaagtacaaggttgacccgaagcgtatcggtcgcttggaggttggaagtgagacggttatagacaaaagtaaatccatcaaaacttggctgatgcaaattttcgaggaaagtggtaatactgacattgaaggagttgactccagcaatgcttgttatggtggaaccgcggccctgttgaattgcgtgaattgggtcgaaagtaactcctgggatggacgctatggtcttgttgtttgcacagacagcgcggtttatgcagaagggccagctcgtccaacagggggtgctgctgctattgcaatgctcattggccctaatgctcctatttcatttgagagcaaatatagagcttctcacatggctcatgtttacgatttctacaagcctgatcttgcaagtgaatacccggttgtcgatggtaaactatcacaaacatgctacttgatggccctagactcatgctacagactgttctgcaacaagtatgagaagattgcggggaaacaattctcaatttctgatgcagaatattttgtgttccattctccttacaacaaacttgtgcagaagagttttgctcgactttactacaatgatttcatgcgcaactgcagctctattgatgatgatgctaaagcgaagctccagccgttttcaaacctcactggtgaagagagctaccagagccgcgacttggaaaagacctcacaacaagttgcaaagcacttgtatgacatcaaagttcagccatcgactgtgcttccaaaacaaattggcaacatgtacactgcatccctctatgcagcgttggcatccgtgctatataacaagcatgatagtctggatggacaaagaattgtgatgttctcttatggcagtggcttgacgtccactatgttttcgttgaggctaaacaatggccagcatccgttcagtttatcgaacatcgcttccgtgcttggtgtcacagagaagcttcagtcgagacacgagacattaccggaaaagtttgttgagacgctgaagctgatggagcaccggtacggtggaaaggatttcgagacgaacaaggatacgagcctgctgccgcccggcaccttttacctcacccatgtcgactccatgtaccggaggttntatgaccagaagcctgtggaggaaatggccggcagcaaagccaagtgctgcaacggcttcgcaaatggccactagtggcgtgccgtggactcctatgttgcctgccctgttgctcatccactcatcgtgctctgtactttgatatgcttatgcttagaattttcagcctagcgtgtttntgaaataatttattgtcttcagctgttntcctagatcagctggtttttgtattttatttatctaaccagtgaaatcagtcttgaaattcttgtttcttttactttgttgtttttcgctcactgatcnnagttcttgtaagtttagctgggaatgtatgtagctcaagttatacagntcagnagggctactcgtcgaaaggatncanccattttatta

SEQ ID NO: 2326 - DNA, 2185 bp, Oryza sativa
atcgatcagctgcaaaaagcgctactactagtgcacacgggcgacaagccacacacgcaaaaatcgttcccgactcgtggcgacgcaaggccggcgacccgtacgtgtggcgcccacgacgagacgagagagagagagagagagagagagagagagacagctcgtgtggtctcgtctcatctggagctgagccgagtagccgacgcctccatctccatctctcctctctgctctagcgtgggcggagaacacgaggcgtggccgcgtcgtcgtcggaggagggagcagagatggacggccgcaaggatgtcgggatcctcgccatggatatctacttcccgcccacctgcgtcctccaggaatcgctcgaggctcatgacggcgccagcaaagggaagtacaccattggtctcggccaagattgcatggccttctgcagtgaggtggaggatgtcatctcgatgagcatgacagttgtcacatccctgctgaaaaaatacaaggtcgatccaaagctgattggtcgattggaggttggcagtgagacagtcatagacaagagcaaatccatcaagacttggctgatgcagattttcgaggaatgcggtaatactgacattgaaggagttgattccagtaacgcgtgttatggtgggacagcagcgctgttgaattgtgtgaactgggttgagagtaactcctgggatggacgctatggccttgttgtttgcacggacagcgcggtttatgcggaaggcccagctcgtccgacaggtggtgctgctgctattgcaatgctcattggtcctaatgctcctattgcattcgagagcaaatacaaagcttctcacatggctcacgtctatgatttctataagcctgatcttgcaagtgaatatccggtcgttgatggaaaactatcccaaacatgctacttgatggcgctagactcatgctacagacagttttgtaagaagtatgaaaagctggcggggaaacaattctcaatttctgatgcagattactttgttttccattctccatacaacaagcttgtgcagaagagttttgctcggctttactataatgatttcacgcgcgactgcagctctgttgacaatgatgctaaagagaagctccagcctttctcaaatttgactggcgaggagagctaccaaagtcgtgacttggaaaaggcttcacaacaagtagcaaagcccttgtatgacatcaaagttcaaccatcaactttgcttccaaaacaaattggtaacatgtacacagcatctctttatgctgcgttggcgtctgtactctataacaagcatgctagtctggatgaccaacgaattgttatgttctcgtacggcagtggcttgacatccactatgttttcgttgaaacttaacaatggccaggaccccttcagtttatcaaacattgcttcagtgcttaatgccacggagaagcttgagtcaagacatatgaccttgcccgagaaatttgtggagacgctgaagctgatggagcaccgatacggcgcaaaagatttcgagacgtgcaaagacacgagcttgttgcctcctgggacgttctacctcaccagggttgactccatgtaccgaagattctatgagaggaaggccgacgaggagatcgctgcagccaaagccaagtacagtaatggacatgccaccaatggctatgccaatggccactagtggcacgcatggcatgatggctgctgctgatattgatttctggtttgataagttcatgattaggtgtttccagcctagtgtagtagtttctcaaataagtgttctccacacctgttatccatatctcctctaatttttttgtattgaatcagacagactagtgagacatttctgtagtatcaatcattcttgtttcttctagcttgtgtttctgctgtcacttgaagttattactatggactagtttagcaatcttgagccaatagtagtcttataagtgcagcaaacagacttgagacctgtttaggagagctcgaaattctgagaagcacacgatgactactgatgagcagggctgtgtttgaagcttctagctcctagtttatattttttatcctataactatagattctgaattgtttgtttgggagagctggagattataaaaaaagctgcgactgtta

SEQ ID NO: 2327 - DNA, 1892 bp, Panicum virgatum
atctggtactggtgggtaccaaatccgtggccgattcccagattgcaaggcctccttcccctactgcttcggttaatcatcaattatcacttgctgtcttctcttgcacggttccagcttctccgcttcggttccggcggcgatggcgatggcggcggaggccaaggacgtcggcatcctcgccatggacatctacttcccgcccacctgcgtgctccaggaagagttggaaactcacgatggcgtgagcaaagggaaatacaccattgggcttgggcaggatagcatggcattttgcactgaagttgaggatgttatttcaatgagcttgacagtggtgaagtccctactgaaaaattataacattgacccgaagtgcattggacgtttggaagttggcagtgaaacagtaatagacaagagcaagtctataaagacatggttgatgcaaatttttgaggaatgtggcaacactgatattgaaggagttgactcctcaaatgcatgctatggtggaacagctgcgttgtttaattgtgttaactgggttgaaagcaactcgtgggatgggcgctatggacttgttgtttgcacagacagtgcggtttatgctgaaggtccggctcgtcctactggtggtgcagctgctattgcaatgttgattggaccaaacgctcctatttcttttgaaagcaaatataggggatctcatatggcccatgcatatgacttttacaagcctgatcttgcaagtgaatatccggtggttgatggaaagttgtcacagacatgctatctcatggcattggattcctgctataatgtattttgtaaaaagtatgaaaagcatgagggaaagcaattttcaatttttgatgcagattatgttgtattccattctccatacaacaagcttgtacagaaaagctttgctcgtttgtgctacaacgatttcttgagaaactgcagcacggttgatgaagagtctagggaaaaattggcaccctatgctggtttgtcatctgaagaaagttaccagagccgagaccttgaaaaggcatcccagcaagttgcgaagaaactgtacgagtccaaggttcagccaacaacattgatcccaaaacaagttgggaatatgtatacagcatcactctatgccgcttttgcttcagttatctataatagacatgaaactctggcaggccagaggattgttatgttttcatatggaagtggcttgacatcaacaatgttctctttcaaaattaatgaaggccagcatccattcagtctgctaaacattgcaaacatactggatatttccaagaaactggaggcacgacatgtggttcccccgaagaaatttatcgagacactgaaattgatggagcaccgctatggggcaaaagatttcgtgaccagtcaggacacaagtttgctacctgcaggcacatattatctcacccacgtcgactccatgtaccgaaggttctacgccgtgaaagatgacgctgtcaccactgcagtgtccaatggccactgatttgtcttcagcttgaagctgccacgagtcaataacagaggcaggtgtaataagcatgcgagttttcttagattatctgttaggaggggaagctggaggctggagcttaggtcaatctccagtcctaaggttgtaaagttagttagagctatgcgattgttgtaatggttgcttagtaaaaatgctcgcttagcaggaatggcagtgcctgcgaaattcagatcaagcacactgctgggttgtaagaattctgaataatctgccgaggaacagttggattaagttatgttgttgaaataaatgattacttgtactaatacgtaatacagttaatgcttaaaatcttgga

SEQ ID NO: 2328 - DNA, 2032 bp, Panicum virgatum
aaaaaaaaagcggcgctgccgagagcccgagcccgagcgcagtatatatacgggcgccgccgaggagtcgagtcgagtagagtagacgacgcccaacatccatctccctgcgatccgctcttgtaggctgcccccatccgctcctcccactcgtggcttctccggcggcggcgatggcggcggaggccaaggacgtgggcatcctcgccatggacatctacttcccgcccacctgcgtgctccaggaagagttggaaactcatgatggcgtgagcaaagggaaatacaccattgggcttgggcaggatagcatggcattttgcactgaagttgaggatgttatctcaatgagtttgacagtggtgaagtccctcctgaaaaattataacattgacccgaagtgcattggacgtttggaagttggcagtgaaacagtaatagacaagagcaagtctataaagacatggttgatgcaaatttttgaggaatatggcaacactgatattgaaggagttgactcctcaaatgcatgctatggtggaacagctgcgttgtttaattgtgttaactgggttgaaagcaactcatgggacgggcgttatggacttgttgtttgcacagacagtgcggtttacgctgaaggtccggctcgtcctactggtggtgcagctgctattgccatgctgattggaccaaacgctcctatttcttttgaaagcaaatataggggatctcatatggcccatgcatatgacttttacaagcctgatcttgctagtgaatatccggtggttgatggaaagttgtcacagacatgctatctcatggcattggattcctgctataatgtattttgtaaaaagtatgaaaagcatgagggaaagcaattttcaatttttgatgcagattatgttgtattccattctccatacaacaagcttgtacagaaaagctttgctcgtttgtgctacaacgatttcttgagaaactgcagcacggttgatgaagagtctagggaaaaattggcaccctatgctggtttgtcatctgaagaaagttaccagagccgagaccttgaaaaggcatcccagcaagttgcgaagaaactgtacgagtccaaggttcagccaacaacattgatcccaaaacaagttgggaatatgtatacagcatcgctctatgccgcttttgcttcagttatctataatagacatgaaactctggcaggccagaggattgttatgttttcatatggaagtggcttgacatcaacaatgttctctttcaaaattaatgaaggccagcacccattcagtctgctaaacattgcaaacatactggatatttccaagaagctggaggcaagacatgtggttcccccgaagaaatttgtcgagacactgaaattgatggagcaccgctatggggcaaaagatttcgtgaccagccaggacacaagtttgctacctgcaggcacatattatctcacccacgtcgattccatgtaccgaaggttctacgccatgaaagacgagggtgtcaccactgcagtgtccaatgggcactgatttgtcttcagcttgaagctgccacaattcaataacagaggcaggtgtattaagcatgcgagttttcttagattatctgttaggaggggaagctggaggctggagcttaggtcaatctccagtcctaagattgcaaagttagttagagctacgcgatggttgtaatggttgcttagtaaaaatgcttgcttagcagggatggcagtgcctgcgaaattcagatcaagaacactgctgggttgtaagaactctgaataatctgccgaggaactgttggactaagttatgttgtggaaataaatgattagttgtactaatacgtaatacagttaatgcttcaaatcttggactaggtgcattcgtgtgtctggatgagctgactgaaggtactatcaatatttgaatttgggaaacaatattccctgcagtttgtgtgccagttgaaaacttttcgaacctaattt

SEQ ID NO: 2329 - DNA, 2067 bp, Brachypodium distachyon
gtagttaccacagccacctaccgcccctccacaacgggggaaagaaacaccaaggaaggagaaacagaggattcaaaaggcggcgtgctccgcaggccgcagactgcagagtgtatatatacggcgcgagggcgaggctctcccccctatccctctcgcgtctcgctctcccccggcccgtcagcccgtgtgttcttcttcttctctcactgctgccgaggaggttttgaatccaggggaaggagagatggcggcggagaggatcaaggacgtgggcatcctcgccatggatatctactttcctcccaactgcgtcctccaggaagaactagaaacccatgatggtgtgagcaaaggaaagtataccattgggcttggccaggatagcatggccttttgtactgaagtggaggatgtcatttcaatgagcttgacagcggtgaagtccctgctggaaaattataagatcgatccaaagaccattggacgtttggaagttggcagcgaaacagtaatagacaagagcaagtctattaagacatggttgatgcaaatatttgaggaatgtggtaatactgatattgaaggagtcgactcctcgaatgcttgctatgggggaacagctgctttacttaattgtgttaattgggtcgagagcaactcatgggatgggcgttatggacttgttgtttgcacagacagcgcggtttatgctgaaggaccggctcgtcctactggcggtgcagctgctattgcaatgttgattggaccaaatgctcctatttctttcgaaagcaaatatagaggatctcatatggcacatgtttatgacttctacaagcctgatcttgcaagtgaatatccggtggttgatgggaagctatcgcagacatgctatctcatggcattggattcctgttacaataccttctgcaaaaagtatgaaaagctcgagggaaaacaattttcaattgttgatgcagattctttcgtattccattctccatacaataagcttgtacagaaaagctttgctcgtttgtactacaatgacttcttgagaaactgcagcattgttgacaaagactcaagagaaaaattggagccatattcgggcttgtcatctgaggaaagctatcagagtcgagaccttgagaaggtttgtcagcaagttgcgaagcacctgtatgatactaaggttcaaccaacaacattgatcccaaaacaactcgggaatatgtatacggcatcactctatgctgcttttgcatcagtcctccataataaacatgacacactggctggacagaggattgtcatgttctcctatggcagtggcttgacgtcgacaatgttctccttcaaaattaataaaggccagcacccgttcagcctgtcaaacatttcaaacgtactggacatttccaataaattggagtctaggcatgtggttccgccaaagaaatttgtcgaggcgctgaagctgatggagcaccgctacggggcgaaagattttgtcaccagccaggacataagcctgctcgttccgggaacctactacctcacccatgtggactccatgtacagaaggtactatgccgtgaaaggcgacgctgtcccggtatccaatgggcattgattgaccgtccccagattgaagctgcaataagcgtgcaaaccacaaatgctcttaggttacctggtaggaaagggaaaggaagctggagcctgcttagattaaacttctgtcaagttctaagcctgtaaagttagatagaggtgcatgcatgcacgattgttgtgatgctttgtttagtgaaaatcttttgctctttagtggaacactgtcaacactactgggctgtaacttgtaaggattgtgaataatctgccaaattacccggcaggtttgaggttatgccgacgacacattcatggcttgttttgctggcatttgtgtgccagagtcagagaaaatggtatgggcgcctggcgctgtaatttttctgctgctgctgtaggctgtttctccgtgcgaaatgttgggtcacaggttgtttggacatc

SEQ ID NO: 2330 - DNA, 2011 bp, Setaria italica
cccgaagtcccgagtcctgacggacgggaggagacgaggagtgaaacgaatcgcgaaaagaatttcaacaaaagaaaaagcggcgttgccgagagagcggagtatatatacggcgccgaggagagttttcgcgcatcccgcatctctgcttgcccgcgactgcgatccgctcttgtaggcttcccccatcctactgcttcttcggctgtagcggcggcggcggagggagagatggcgtcggaggccaaggacgtgggcatcctcgccatggacatctacttcccgcccacctgcgtgctccaggaagagttggaaactcatgatggcgtgagcaaagggaaatacaccattgggcttgggcaggatagcatggcattctgcactgacgttgaggatgttatttctatgagcttgacagttgtgaagtccctcctgaaaaattataacatcgacccgaagtgcattggacgtttggaagttggcagtgaaacagttatagacaagagcaagtctataaagacatggctgatgcaaatatttgaggaatatggcaacactgatattgaaggagttgactcctcaaatgcatgctatggtggaacagctgcgttgtttaattgtgttaactgggttgaaagcaactcatgggacgggcgttatggacttgttgtttgcacagacagtgcggtttatgctgaaggtccggctcgtcctactggtggtgcagctgctattgcaatgttgattggacctaatgctcctatttcttttgaaagcaaatataggggatctcatatggcccatgcatacgacttctacaagcctgatcttgcgagtgaatatccggtggttgatggaaagctatcacagacatgctatctcatggcattggattcctgttataatgtattttgtaaaaagtatgaaaaacatgagggaaagcaattttcaatttttgatgcagattatgttgtattccattctccatacaacaagcttgtacagaaaagctttgctcgtttgtgctacaacgatttcttgagaaattgcagcacggtcgatgaagagtctagggaaaaattggcaccctatgctggtttgtcatctgaagaaagctaccagagtcgagaccttgaaaaggcatctcagcaagttgcgaagaacctgtacgagtccaaggttcaaccaacaacattgatcccaaaacaagttgggaatatgtatacagcatcactctatgcggcttttgcttcagttatctataatagacatgaaactctggcaggccagaggattgttatgttttcatatggaagtggcttgacatcaacaatgttctctttcaaaattaatgaaggcgagcatccattcagcctgctaaacattgcaaacgtactggatgtttccaagaaactggaggcaagacatgtggtccccccgaagaaatttgtcgaggcactgaaactgatggagcaccgctatggggcaaaggattttgtgaccagtcaggacacaagcttgttacctgcaggcacttattatctcacacacgtcgactccatgtaccgaaggttctacgctgcgaaagatgacggtgtcaccactgcagtgtccaatggccactgatttgtcttcagcttgaagctgcaacaaatcaataacagaggcagtgtattaagcatgcgagtgttcttagattatctgttaggaggggaagctggggcatagatcaatctctacccagttctaaggttgtaaagttagttagagctacgtgattgttgtaatgcttgcttagcactagcaggaatcgcagtgcttccgaaattcaaatcaagcacactgctgggttgcaagaattctgaataatctgccaaggtactggttagatttaagttatgctggtgaaaaagaatgattgcttgttctaatacagttaatactccgattataggatcaggtgtattcttggagcatttggcatcgtgtttttttcccttaaagtttctta

SEQ ID NO: 2331 - DNA, 1941 bp, Oryza sativa
ggcgtatataaaaccgaccggtgcgagaggagaacccgcatcacatccacctcctcctcgctcgatccgctcctgtaggtactcgtactactccaattctttctctcgcctacgccttcctcccaatcttgttgtttcggcggcggcggcggcggcggcggtgagggagatggcggcggagaggaaggacgtgggcattctcgccatggacatctacttcccgcccacctgcgtgctccaggacgagctggagaatcatgatggcgtgagcaaagggaagtacaccattgggcttggacaggatagcatggccttttgcactgaagtggaagatgttatttccatgagcttgacagtagtgaagtcactcctggaaaactataagattgatccaaaatgtattggacgtttggaagttggcagtgaaacagtaatagacaagagcaagtctataaaaacatggctgatgcaaatatttgaggaatgcggtaatactgacattgaaggagttgactcctcaaatgcatgctacggtggaacagctgctttatttaattgtgttaattgggtcgagagcaactcatgggatggacgttatgggcttgttgtttgcacagacagcgcggtttacgctgaaggtccggctcgtccaaccggtggtgcagctgctattgcaatgttgattggaccaaatgctccagtttctttcgaaagcaagtatagaggatctcatatggcacatgtctatgacttttacaagcctgatcttgctagtgaatacccggtggtcgatggaaagctatcacagacatgctatctcatggcattagattcctgctacaatgtcttctgcaaaaagtatgaaaagcttgagggaaagcaattttctattcatgatgcagactattttgtatttcactccccatacaacaagcttgtgcagaagagctttgcacgcctatactacaacgattttctgagaaaatgcagcacggtggaagatggatcaagagaaaaactggagccttattcaggtttgtcatccgaggaaagctaccagagtagagaacttgaaaaggcttctcagcaagttgcgaagcacctctatgattcaaaggttcaaccaactacattaatcccgaaacaagtcgggaatatgtacacagcgtctctatatgctgctttggcatcagtgatgcataacaaaaatgaaactctggcaggccaaaggattgtcatgttctcatacggcagtggcttgacatcaacaatgttctctttcaagatcaatgaaggccagcatccattcatcctatcaaacattgcaggcatactggatgtctccaagaaactggagtccaggcatgtggttgcgccggagaagttcgtggcggcgctgaagctgatggagcaccggtacggcgccaaggatttcacgacgagccaggacacgagcctgctcgctccaggcacctactacctcacccacgtcgactccatgtacaggaggttctacgccgtcaaaggtcaagccgtcaccgaagtgtccaatggccattgaaaaaattgtgttgtgatgtgtggttcattcaacctgaagctgcaataagccaacggcatagagggttcagggcgtgggtgtaccaagttttctgatgaaagcttgtaaagggtgctaggttagagctgttggattagttggttcgctattcgctagtaaggcttacttggtgaaatggtatctccacttcgttaatgttcttcagtggaacacacggtagcgagctgtaagaattcttaataatctgccgtcccgttcttttctctcccacaagagtaggatgaagattaagattttcgtggcacgcttttcaaactgctaaacagtgcgttttatgcgaaaactttttatatgaaagttgttctaaaatatcatattaa

SEQ ID NO: 2332 - DNA, 2533 bp, Sorghum bicolor
agcacttatagtatactccaaatttacagtatggtaggaccatggtccaaaagccggatccgatcaggaaaaagaggccggagccaggagtctcacagctccaagccttgccaagaggcaagagggccaaaaccagatgctccccagaggcccaggactcgtggctggccacgtgctcggaccccgtggcaaccaggcgatacgaccgaggctcgaggagggcgagggaaaggacaagcccggacaggagcctccagccgtcgtcccgcgcccgcgcccttcccaccaccaaccgccggcagctcccactgccactgccaagtccaagtcctgacgggaggacgaggaccggagcccggaggagtgaaagaaaacgcgaaaagaatttcgaaaaagcggcgctgcgcgctgttgcccgggtgtatccttccttatatatacggcgccgaggagggggaagccttgcccgtccggcccatcccgcacccttttgcctgccaactgcgatccgctcttgtaggctcgctccccaatccgcttcttccctcccactgttttgcgtgcagcggcggcggcggcggaggaggaggagagatggcgtcggaggccaagaacgtgggcatcctcgccatggacatctacttcccgcccaactgcgtgctccaggaagagttggaaacacatgatggcgtgagcaaagggaagtataccattgggcttgggcaggaaagtatggcattttgcactgaagttgaggatgttatttcgatgagcttgacagtggtgaagtccctcctgaaaaattataacattgacccaaagtgcattggacgtttggaagttggcagtgaaacagtaatagacaagagcaagtctataaagacatggctgatgcagatatttgaggaatctggcaatactgatattgaaggagttgactcctcaaatgcatgctatggtgggacagctgcattgtttaattgtgttaactgggttgaaagcaactcatgggatgggcgttatggacttgttgtttgcacagacagtgcggtttacgctgaaggtccggctcgtcctactggtggtgcggctgctattgcaatgctgattggaccaaatgctcctatttcttttgaaagtaaatataggggatcccatatggcccatgtatacgacttttacaagcccgatctcgcgagtgaatatccggtggttgatgggaagctatcacagacatgctaccttatggcattggactcctgctacaatgtattttgcaaaaagtatgaaaagaatgagggaaagcagttttcaatttttgatgcagattatgttgtgttccattctccatacaacaagcttgtacagaaaagctttgctcgtttgtactacaatgatttcctgagaaactgcagcacggttgatgaagagtcaagggaaaaattggcaccctatgcaggcttgtcatctgaagaaagctaccagagtcgcgaccttgaaaaggcatctcagcaagttgcaaagaacctgtacgactccaaggttcagccaacaacattgatcccaaaacaagttgggaatatgtatacagcatcactctatgccgctcttgcatcgattattcataatagacatgaaactctggcagggcagaggattgttatgttttcatatggcagtgggttgacatcaacaatgttctctttcaagattaatgaaggccagcaccctttcagtctgctaaacattgcaaacataatggatgtttccaagaaattgaaggcaagacatgtggttcccccaaagaaatttgtcgagacactgaaactgatggagcaccgctatggggcgaaagattttgtgaccagtcaagatacaagtttgctatctgcaggtacatattatctcacgcacgttgactccatgtaccgaaggttctatgacgtgaaaggtgacagtgtcaccactgcaatctccaacggccactgatctgtcttctgctcgaagctgcaacaagttaaataacagaggcaggtgtcctaagtattctgagtgttcttagattatctattattaggagggtaagctggagcttagattaatctctgcccagttgtaaggttgtaaagttagttagagctgcgccattgttgtaatgcttgcttagtaaaaactctggtgctcttccgttctttattggtgtgaattgcagtgcttgcaaaattcaaatcaagcacactgctgagttattagaattctgaataatttgcagaatcactggttacatccaagttatgctgttgaatgcatctggattcagttgtactgttggagcagtcgtgtcatgtcttgtactttttttaattagtttctaacagtagattccagtgtccggatggatgactgactagagggaggttttctctttgttttttttttcctatagaatgtttcttgcactgtgagtagggctaaaggtacgcatatagtctatgctactccccccgtccaaaaaaaaatgttgttttaggtt

SEQ ID NO: 2333 - DNA, 1755 bp, Elaeis guineensis
taggggaagggagagctctgaagcgctgcggcgcttcctgtgctctccgggcctcgcatcaagacggggagagagagagtgggaaaagggggagaggagctcgtcttcatctgatctagggtttttggaatcggagagggagagatggaggaaaggaaggatgtgggaattctcgccatggatatctacttccctcccacttgcgtcgagcaggaagccctggaagcttatgatggggcgagtaagggaaagtacaccattggccttgggcaagattgcatggccttttgcacagaactggaagatgtgatatccatgagcttgacagttgttacatctctcttggagaagtatcagattgatccaaaacaaattggtcgcctggaagttggtagtgagacggtgatcgacaagagtaagtctatcaagacctggctgatgcaaatatttgaggaatatggcaacactgatgttgaaggtgttgactcaacaaatgcttgttatggggggacagctgctttatttaactgtgtcaattgggtggagagtagctcttgggatgggcgatatggacttgttgtttgtacagacagtgcggtttatgcagaagggccagctcggcctactgggggtgcagctgctatggcaatgctgattgggccaaatgctcccatttcttttgaaagtaaattcaggggaactcacatgactcatgtttatgatttttacaagcccaaccttgcaagtgaatatccggtcgttgatggaaagttatcacagacatgctacctcatggcacttgattcatgttacaaacatttttgtagcaagtatgaaaagtttgagggaaagcaattttcaattttcgatgcagactattttgttttccattctccatataacaagcttgtgcagaaaagttttgctcggctctactataatgattttttacacaatccaagctctgtcgagaaagattcaagggaaaagttggagcctttttcaaccttgactggtgacgaaagctatcagagtcgtgagcttgaaaagacttctcagcaagttgcaaagtgcttatatgacaaaaaggttcagccgtctactttgctaccaaaacagattgggaacatgtacactgcatctatttatgctgcatttgcgtctgtacttcataataaacatagcacgctgggagggcaacggattgtaatgttctcatatggtagtggcctgtcttccacaatgttctccctcaaacttcgggatggtcaacatcccttcagcctgtcaaacattgccaccatgttgaatgtatcagagaaacttgaagcgagacatgtgtttctgcctgaaaagtttgttgaaacattgaagttaatggagcaccgatatggagccaaggattttgtgacaggcaaggagacaagcttactgtctcccgggacattctacctcacaaaggttgattctatgtatcggaggtactatgccaagaaggttgctgagggcattacaaatgggaaagccgccgagtgcaataataagccactagccaatggccactcatgatgcgcctccacaattcatggaggcatggatgtccagtggtattattgttgtcccctttctatttgccgaaccaacgggcttattgtgcctaaccatgcctttgcttattagaaagttgttttgttgttctcaatgaattcagtttctaagctaatcaataatttctttgggataccaaaaaaaaaa

SEQ ID NO: 2334 - DNA, 1978 bp, Zea mays
aaaagcggcgctgccagtgtgtatattacacggcgcggaggacggggacgcggaggactcgcccggcccatcccgcaccccctacctccgaggctgcgatccgctcttgtaggctccctcgccaatccgctcctcctccctccctccaactgttgtgcgtgcagcggcgtcggagaagagatggcgtcggaggccaaggacgtgggcatcctcgccatggacatctacttcccgcccagctgcgtgctccaggaagagttggaaacacatgatggtgtgagcaaagggaagtacaccattgggcttgggcaggaaaatatggcattttgcactgaagttgaggatgttatttcgatgagcttgacagttgtgaagtccctcctgaaaaattataacattgacccaaagtgcattggacgtttggaagttggcagtgaaacagtaatagacaagagcaagtctataaagacatggctgatgcagatatttgaggaatctggcaatactgatattgaaggagtggactcctcaaatgcgtgctatggtggaacagctgcattgtttaattgtgttaactgggttgaaagcaactcatgggatgggcgttatggacttgttgtttgcacagacagtgcggtttatgctgaaggtccggctcgtcctactggtggtgcagctgctattgcaatgctgattggaccaaatgctcctatttcttttgaaagcaaatataggggatctcatatggcccatgtatacgacttttacaagcctgatctcgcgagtgaatatccggtggttgatgggaagctatcacagacatgctacctcatggcattggactcctgctacaatgtattttgtaaaaagtacgaaaagcatgagggaaagcagttttcaatttttgatgcagattatgttgtgttccattctccatacaacaagcttgtacagaaaagctttgctcgtttgtactacaatgatttcttgagaaactgcagcacggttgatgaagagtcgagggaaaagttggcaccgtatgcaggcttgtcatctgaagaaagctaccagagtcgcgaccttgaaaaggcatctcagcaagttgcaaagaacctgtacgagtccaaggttcagccaacaacattgatcccaaagcaagttgggaatatgtatacagcatcactctatgctgctcttgcatcggttatacataatagacatgaaactctggcaggccagaggattgttatgttttcgtatggcagtgggttgacatcaacaatgttctctttcaagattaatgaaggccatcaccctttcagcttgctaaacattgcaaacataatggatgtttccaagaaattgaaggcaagacatgtggtcccgccaaagaaatttatcgaggtactgaaactgatggagcaccggtatggggcgaaagatttcgtgaccagtcaagacacaagtttgctatctgtaggcacatattatctcacgcatgttgactccaagtaccgaaggttctatgacgtgaaaggtgacggtgtcaccactactgcaatgtccaacggccactgatctgtcttctgcccggagctgcaacaagtcaaataacagaggcaggtgttcctaagcattctgattcttcttagattatctattaggaagggacgctggagcttagattaatctctgccaagttgtaaggttgtaaagttagttagagctgcgtcattgctgtaatgcttgcttggtaaaagttctggcgctcttcagttcttcagtgcttgcaaaattcaaatcaagctcactactagttgtaagaattctgaataatctgcagaatcactggttacatccaagttacgctgttgaatgcatgatttcatgtttaacacgattaatgcatctggattcagctgtgttgttggagtactcgtgtcgtgtcttgtacctttttaaaaagaagtttcttaca

SEQ ID NO: 2335 - DNA, 1696 bp, Secale cereale
gactgccagcccctcccgcctaccgtacgtcacttgaccagccagccgccccactccagcctccactgcggcacgagctcccggcgatgtcgtggctcgcgcgctccattgcggccaccctctcctccgccccctccgacgacgaagacgaccactccgaggcagcctccggcgacaaaagcccggatcacgccgccaacgccgacgacgaggaggacgagcagccggacacccccggccgtggggtcaaaggcgacatctccgagctgaccgagtccctcacccgacgcttctggggcgtcgcctccttcctcgcgccaccgccgccggccggggccgaggccgccgagacgtcgacggcggcggctgaggcggaggcggagggagagcatgggccccagtccccgcgggtcgccgggatccggaacgacctggctgagatcgggggcagggtgaggagcggcatctcgatgctgtcgaacgccaacgccgtggcggagatctccaagatcgcctcgtccttcctgcctttcgtgccggaggaagaggaggaggaggaggtggatgcggtgggcgtgacggaggaggtggtggtgttcgtgaggcacatctcgacctctcccgagacgtggcgcgatttccccctcttcgtcaacgaccggcacgccgatgattttgaactgtcagatacacaatatgaacatgcattggctatagagcgtatagtaccaagcttatcatatctcagaaccgaactttgttcgaccaatatgagtgaagcatgcttttggaagatctattttgtgcttcttcactcaaagctcaacaaggaagatgctgaacttctttcaacgacacaaatcctggaagcaagagaggagttattgcaaagctccccaaggatgaaaaatgtagcgtctgagggtcttgggggctcatcagaaagcagcaatgttcgatctacccaagctgaagacatagagttgtcaccctcgagcatccaagacaagagtggaatggctgaagcaacatctttccaagaaccaactcctgatcctctgccaggggccgaggctgacaagcatcctatctcagccagcgagccagaaatagtcgacaaatctgtaattgaagaagagctggtggtgaaaactgaaatcaagaatcagggtggcaaacccaacctgtacactccggaggatgacgacgacaaagaagtggaggattggctagaggacgtggaccatgccgacaacaaaacaggcaatatcacctcgattgggcaggacgaagacgtgtcattcagtgacctggaggatgacgatgatgattaagggttggctggtggtatataccaagcccagtgcctgatacaaatgctgtggcttcaagagatacggccgctgttaaacgaaggatcatgtctccgtagctactacaaagcgaacagagcggaagcagaatcacggcaagttgataagtatgtctctggggctttgctttctcgattctagttgcacgtttacttgtgtgccgtcatggtctgtacatagaaacacttctaagccgcgttgatgcaagattctgaatgtagataccaattaccaaaacatgtttatttattttaatgaacgcacaatacgacacgaaactaaagctgtcagatattgtgtagctggtcaagttcaagtaaact

SEQ ID NO: 2336 - DNA, 1678 bp, Avena sativa
ggatattgcatccgtaggtctggtgcacggctgcacgctcctccgatccgccggccgtcactctccccgcaggcccgtagcgtacgtcttccctctgaccctctcttccgccaattgacccgccgccccactccaccatccactgcggcacgagctcgcagcgatgtcatggttcgcacgctccatcgcggccaccctctcctccgccccctccgatgatgacgacgacgaccactccggttcaaactccggcgacaaaagccccgatcacgccgccgacgctgacgtcgaagaggacgagcagccggatacccccagccgtggagtcaagggagacatctcggagctgacggagtccctcacccgccgcttctggggcgttgccaccttcctcgcgccgccgccggccgaggccgatgcagcggaggatggagcccagtccccgcgggtcgccgggatccggagcgacctcgcggagatcgggggcagggtcaggagcggtatctccatgctctccaacgccaacgccgtggcggagatctccaagatcgcatcgtcgttcctgcctttcgtgcctgaggaggaggaggacgaggtcgaggcggtgggtgtgacggaagaggtggtggtgttcgtgaggcacatctcgacgcatcccgaaacgtggcgcgatttccccctgttcgtcgacgaccggcacgccgatgattttgaactgtcagatacacaatatgaacatgcattggctattgagcgaattgtaccaagcttgtcatatctcaggaccgagctttgttcaaccaatatgaatgaagcatgcttttggaagatctactttgtgcttcttcactcaaaactcaacaagcaagatgctgaacttctctcaacgacacaaatcctggaagcaagagaagagttattgcaaagctctccaaggatgaaaaagctaggatctgaggggccagggggctcatcagaaaacaaggatactccatctaccgaagctgaagatagagagttctcaccctctagcatccaatacaagagtggggtgtctgaagcaacatcgttccaagaaccaactcctgatcctttgccaggtgttgaggccatcaagcatcctatttcaaccagcgagcctgaagtagttgacaagtctgtgattgaagaagagctagtggtgaaaaatgagacgaataatataccagctgagaagcctaacctttataccccggaggatgatgaagacaaagaagtggaggagtggctagaggatatggatgacgtttccagcaaaacaggcaacatcacttcggttgggaatgatgaagatgtgtcattcagcgacttggaggatgatgattaagagacggctggtagttaaggaagcccagtcaggtcgtggtatatactctgtctgccttgtgtcgaatacaaagcttgtggcttcaagagaaatgctcactgtcaatgaagcatcatagcttgctcgtagctattacaatgtgaacagtgtggtagcagaatcacggcaagttatgtctctgggttttgttttcctgattctcgttgtaatttactcatgtgccatcactgtctgtacatagaaaccggtacctggtgctggtatgtaaactaccactgctgcttcgtgcgttgatgctgagattctgaatgt

SEQ ID NO: 2337 - DNA, 1470 bp, Hordeum vulgare
gcgcggccagggccccagaagcttctggaacaccccgccccccgccgcaatgcagagcgcggcggccatcgggctcatccggccatgcgccgcgcggcccatcctcaagagccccagccccggggccgcccgcctcccggcctcccgcgtggccctccggctctccgccgcggcgccccgcgcgggcctcgtggccgcggcggggctcggccgcatcgggctcgtgccggcgtcgcccgagcaggagaagaggagcggcggcctcgtggccgccgcggccgccgggaaggcggcgccgggcgaggaggccggggaggaaagcggagcggcgctcgccaagacgctccagctcggcgtcttcttcgggctctggtacctcttcaacatctacttcaacatctacaacaaacaggtcctcaaggtttttccttatcccattaacatcacaactgttcagtttgctgtgggaactacgatttccttgtttatgtgggccacgggtatccttaaaagaccaaagatttccggtgcacagcttcttgctatcctccctctggctattgtgcataccatgggcaatcttttcaccaacatgagccttgggaaggttgcagtgtcattcacacatacaatcaaggccatggagcctttcttctcagttctactttctgcaatgttccttggcgagctgcctactccttgggttgttttgtctcttcttcctattgttggtggtgtggcattggcatctatttctgaagcttcttttaactgggctggatttttgagtgcaatggcttcaaatgtgaccttccagtcaaggaatgtcctcagcaagaagcttatgctgaagaaagaggcatctctggacaacatcaatctcttctcgattattacagtcatgtcattcttcctcttagcccctgtaaccttgttgacagaaggtgtcaaggtcactcctacttttctgcagtctgctggtctgaacctacagcaagtgtacacaaggtctttgattgcggcattctgtttccatgcataccaacaggtgtcatacatgatcctcgcaagggtgtcaccagttacccactcggtaggtaactgtgtcaagcgtgtggtggtcattgttacatccgttctgttcttcaagacccccgtgtctccaatcaactctatcggaaccgcgatcgctcttgcgggagttttcctgtactcacaactgaagagacttcagcccaagcccaaggctgcttgattgcattccgtttgtcaggatcaatagagcgttgccacactcatggaatcggtgctttagtttagccggacatattgggaagccttgttgagtaactagtaccgcgaaggatcatttgtaattcagtaatgagcattttgaccaggaaagttttggaatctatttcatggttctctacttggacgttctagttgctactttaataaaacctctgc

SEQ ID NO: 2338 - DNA, 1731 bp, Secale cereale
tccggaggctcccccggcctgcccggaacactccgcccccgccgcaatgcagagcgcggcggccatcgggctcctccggccatgcgccgcgcggcccatcctcaagagccctacccccggggccgcccgcctcccggcctcccgcgtggccctccgcctctccgccgcggcgccccgcgcgggcctcgtggcggcggccgggctcggccgcatcgggctcgtgccggcgtcgcctgagcaggagaagaggagcgactgcctcgtggccgccgcggcctccgggaaggcggtgggcggcgaggaggccgcagaggaaagcggagcggcgctcgccaagacgctccagctcggcgtcttcttcgggctctggtacctcttcaacatctacttcaacatctacaacaagcaggtcctcaaggtttttccttatcccataaacatcacaacagttcagtttgctgttggaactacaatttccttgtttatgtgggccacaggtatccttaaaagaccaaagatttccggtgcacagcttcttgctatcctccctctggctattgtccataccatgggcaatcttttcacgaacatgagccttgggaaggttgcagtgtcatttacacatacaatcaaggccatggagcctttcttctcagttttactttctgcaatgttccttggcgagctgcctactccctgggttgttttgtctcttcttcctattgttggtggtgtggcattggcatctatttctgaagcttcttttaactgggctggatttttgagtgcaatggcttcaaatgtgaccttccagtcaaggaatgtcctcagcaagaagcttatgctgaagaaagaggcatctctggacaacatcaatctcttctcgattattacagtcatgtcattcttcctcttagcccctgtaaccttgttgacagaaggtgtcaaggtcactcctacttttctgcagtctgctggtctgaacttacaacaagtgtacacaaggtctttgattgccgcattctgtttccatgcataccaacaggtgtcatacatgatcctcgcaagggtgtcaccagttacccattcagttggtaactgcgtcaagcgtgtggtggtcattgttacatctgttctgttcttcaagacccctgtgtctccaatcaactctatcggaaccgccatcgctcttgcgggagttttcctgtactcacaactgaagagacttcagcccaagcccaaggctgcttgattgcattccgttcgtcaggatcaatagagcgttgccacactcttggaatctgtgctttagtttagccggacatattgggaagccttgttgagtaacaccgtgcaggatcatttgtaattcagtaatgagcattttgaccaggaaagttttgaaatctcttttgccgttctctacttggtagttgccactttaataaaacctctgcagtttgatcgtgccgtgataaggtcaccgatgagcaacatccttaagggttcatttctgtcccttttagccattttcatagacaattaagaaactttacttgctaacactacatgaagatcatgaatgttgcaacttgcatcgtatttgaccagacagtacattactgtctgccctgatgccctgtatatctttgaggtgtaagggcatcgtgcaaggttgttaacttgcttggctgtaatcttgtttctaacaaacagtgactactttgagac

SEQ ID NO: 2339 - DNA, 1827 bp, Triticum aestivum
gccgccgccgcacccgcagcctcggcctcgaggcctccacccgccccccacgcgcggccgaggctccagaggcgccccccgtctgcccggaacagtccgctcccgccgcaatgcagagcgcggcggccatcgggctcctccggccatgcgccgcgcggcccatcctcaagagccctagccccggggccgcccgcctcccggcctcccgcgcggccctccgcctctccgccgcggcgccccgcgcgggcctcgtggctgcggccgggctcggccgcatcgggctcgtcccggcgttgcctgagcaggagaagaggagcgactgcctcgtggccgccgcggcctccgggaaggcggcggcgggcgaggaggccggggaggaaagcggagcggcgctcgccaagacgctgcagctcggcgtcttcttcgggctctggtacctcttcaacatctacttcaacatctacaacaagcaggtcctgaaggttttccctttcccataaacatcacaacagttcagtttgctgttggaactacgatttccttgtttatgtgggccacaggtatccttaaaagaccaaagatttccggtgcacagcttcttgctatcctccctctggctattgtccataccatgggcaatcttttcactaacatgagccttgggaaggttgcagtgtcatttacacatacaatcaaggccatggagcctttcttctcagttctactttctgcaatgttccttggcgagctgcctactccctgggttgttttgtctcttcttcctattgttggtggtgtggcattggcatctatttctgaagcttcttttaactgggctggatttttgagtgcaatggcttcaaatgtgaccttccagtcaaggaatgtcctcagcaagaagcttatgctgaagaaagaggcatctctggacaacatcaatctcttctcgattattacagtcatgtcattcttcctcttagcccctgtaaccttgttgacagaaggtgtcaaggtcactcctacttttctgcagtcttctggtctgaacttgcaacaagtgtacacaaggtctttgattgccgcattctgtttccatgcataccaacaggtgtcatacatgatcctcgcaagggtgtcaccagttacccattcggtaggtaactgtgtcaagcgtgtggtggtcattgttacatccgttctgttcttcaagacccctgtgtctccaatcaactctatcggaaccgcgatcgctcttgcgggagttttcctgtactcacaactgaaaagacttcagcccaagcccaaggctgcctgattgcattccgttcgtcaggatcagtagggagggagcgttgccacactcttggaatcggtgctttagtttagccggacatattgggatgccttgttgagtaactagtaccgtgcaggatcatttgtaattcagtaatgagcattttgaccaggaaagttttgaaatctttttcaccgttctttacttggacgttctagttgccactttaataaaacctctgcagtttgattgtgccgtgatgaagtcaccgatgagcaacatctgtaagggttcatttctgtcccttttagccattttcatagataattcagaaagctttagttgctaacactacatgaagttcatgaacaagatattgcaacttacattgtatttaaccggacagtactacattcatgtgtgccctgatgccctccatgtctggtgtcagggcatcgtgcatggttgtgaacttgcattgctgtaaccttgtttctaacaaacagtgctgactttttatgaaatgaacacta

SEQ ID NO: 2340 - DNA, 1579 bp, Pseudoroegneria spicata
  misc_feature (271)..(271): n is a, c, g, or t
  misc_feature (855)..(855): n is a, c, g, or t
accccgcctcctcgtgccctccgccgccgccgccgccgcagcctcgacctcgaggcctccgcccccccgcgcggccaaggccccagaagcacctccggtttgcgcgccacgcttctggaacactcagcccccgccgcaatgcagagcgcggcggccatcgggctcctccggccatgcgccgcgcggcccatcctcaagagccctagccccggggccgcccgcctcccggcctcccgcacggccctccgcctctcccccgcggcgccccgantgggcctcgtggcggcggcggggctcggccgcatcgggctcgtgccggcgtcgcctgagcaggagaagaggagcgactgcctcgtggccgccgcggcctccgggaaggcggcggcgggcgaggaggccggggaggaaggcggagcggcgctcgccaagacgctgcagctcggcgtcttcttcgggctctggtacctcttcaacatctacttcaacatctacaacaagcaggtcctcaaggtttttccttatcccataaacatcacaacagttcagtttgctgttggaactacgatttccttgtttatgtgggccacaggtatccttaaaagaccaaagatttccggtgcacagcttcttgctatcctccctctggctattgtccataccatgggcaatcttttcaccaacatgagccttgggaaggttgcagtgtcattcacacatacaatcaaggccatggagcctttcttctcagttctactttctgcaatgttccttggcgagctgcctactccttgggttgttttgtctcttcttcctattgttggtggtgtggcattggcatctatttctgaagcttcntttaactgggctggatttttgagtgcaatggcttcaaatgtgaccttccagtcaaggaatgtcctcagcaagaagcttatgctgaagaaagaggcatcactggacaacatcaatctcttctcgattattacagtcatgtcattcttcctcttagcccctgtaaccttgttgacagaaggtgtcaaggtcactcctacttttctgcagtctgctggtctgaacttacaacaagtgtacacaaggtctttgattgccgcattctgtttccatgcataccaacaggtgtcatacatgatcctcgcaagggtgtcaccagttacccactcggtaggtaactgtgtcaagcgtgtggtggtcattgttacatccgttctgttcttcaagacccccgtgtctccaatcaactctatcggaaccgcgatcgctcttgcgggagttttcctgtactcacaactgaaaagacttcagcccaagcccaaggctgcttgattgcattccattcgtcaggatcaatagagagggagcgttgccactgttggaatcggtgctttagtttagccggacatattgggaagccttgttgagtaactagtaccgcgcaggatcatttgtaattcagtaatgagcattttgaccaggaaagttttgaaatctctttcaccgttctgtatttgtacgttctagttgctactttaataaaacctctgcagtttgatcgtgccga

SEQ ID NO: 2341 - DNA, 1786 bp, Brachypodium distachyon
tctcccaccaacccacacactctctctcaccagaccctcctccgcctcgcgtcctcgtgccctccgccgccgcagcagcctcgaggcctccgccccccgcggccaaggctccggacgcttctagaacattccgcctccgccgcaatgcagagcgcggcggccatcgggctcctccggccatgcgccgcgcggcccttcctaaagaaccctagccccgggggcgcccgcctcccggcctcccgcagcgccctccgcctctccgccgtcgcgccccgcgctggcatcgcggcagcggcagggctgggccgcatcaggctcgtgccgctgtcgccggagcaggaggagcggagcggaaggtgcagccgcgacgtggctgctgcggcggcttccgggaaggcggcggcgggtgaggagtccggagaagaaggcggagcagcgctcgccaagaccctccagctcggcgtgttcttcggactctggtacctcttcaacatctacttcaacatctacaacaagcaggtcctcaaggtgtttccatatcccattaacatcacaacagttcagtttgctgttggaactgtcatttccttgttcttgtggatcactggtatccttaagagaccaaaaatttctggtgcacagcttgttgctattctccctctggctattgtccataccatgggcaatcttttcacaaacatgagccttggaaaggttgcagtgtcatttacacatacgatcaaggccatggagcctttcttctccgtactcctgtcagcaatgttccttggcgagctgcctactccatgggttgttttgtctcttcttccaattgttggtggtgtggcattggcatctatttctgaagcttcttttaactgggctggatttttgagtgcgatggcctcaaatgtgaccttccagtcaaggaatgtgctcagcaagaagcttatgctgaagaaagaggcatctctggacaacattaatctcttctcgattattacagtcatgtcattctttctcttggccccagtaaccttactcacagaaggtgtcaaggtcactcctacgtttctgcagtctgctggtctgaacttgcagcaagtatacactaggtctttgattgctgcattctgtttccatgcctaccaacaggtgtcatacatgatcctcgcaagagtgtccccagttacccattcagtgggcaactgcgtcaagcgtgtggtggtcattgttacatccgttctgttcttcaagacccctgtgtctccaataaactctatcggaaccgccattgcccttgcgggagttttcctgtactcacaactgaagagacttcagcccaaacccaaggcagcttgattgcatcatgttgttcattggggcaaattgtggaaggtgcatcgccacacccttggaatcagttcttagtgtaggcagttgtttctggaagccttgttgagtattagtatcgcaggataatttgtaattcagttatgagcatgtttaaccaggcaagttttggagtctctttccccattctgtactttgacggtctagttgctacataataaaatagctgcatttcgagttcctgatgacatccataagtgctcattggtgtcctcatttcttctattttcgtgaacacagttgagtaaagttacactacttgatactttgatagcactgagaaatattgtaagtttgtaacctacactgtattttgtttttgagggaacctacagtatttgacaggacagcactgtcttacgcctatgtgccc

SEQ ID NO: 2342 - DNA, 1594 bp, Avena sativa
cccatctcaccagaccgcaccaccgggcctcctcgtgccctccgccgccgccgcagcagtagcagcctcgaggcctccgccctccgcgtgtccgaccgaggctccagaagcatccgccccagcttccggaccatcccgcccacccgccgcaatgcagagcgcggcggcaatcgggctcctccggccatgcgccgcgcggcccatcctcaagaaccctagcccctccggcgcgcgcctccccgccgcccgcgccgccctccgcctctccgccgcagcgccccgcgcgggcctcgtgccggcggcggccgggctgggccgcatcgggctcgtgccggcgtcgcccgagcaggagaagaggggcgacctcgtcgtcgtggccgccgccgcggcgtccgggaaggcggaggaggccggggaggaaggcgggacggcgctcgccaagacgctgcagctcggggtcttcttcggcctctggtacctcttcaacatctacttcaacatctacaacaagcaggtcctcaaggtctttccatatccgataaacatcacaacagttcagtttgctgttggaactggcatttccttgttcctgtggttaactggtatccttaaaaaaccaaagatttctggtgcacagctccttgctatcctccctctggctattgtccataccatgggcaatcttttcacaaacatgagccttggaaaggttgcagtctcatttacacataccatcaaggccatggagcctttcttctccgttctcctttcagcaatgttccttggcgagctgcctactccttgggttgttttgtctcttcttcctattgttggtggtgttgcactggcatctatttccgaagcttcctttaactgggctgggtttttggctgcgatggcttcaaatgtgaccttccagtcaaggaatgtcctcagcaagaagcttatgctgaagaaagaggcatctctggacaacattactctcttctctattattaccgtcatgtcattcttcctcttggccccagttgccttactgacagaaggtgtcaaggtcactcctgcgtttctgcagtcttctggtctgaacttacaacaagtgtacacacggtctctgattgctgcattctgtttccatgcatatcaacaggtgtcatacatgatcctcgcaagggtgtcccctgttacccactcggtcggcaattgtgtgaagcgtgtggtggtcattgttacatccgttctgttcttcaagacccctgtgtctccaatcaactctatcggaaccgcgattgctcttgctggagttttcctctactcacaactgaagagacttcagcccaagcccaaggctgcttgattgaattctggtattcgtcaagatcagtagcgaaagggagcgtcgacaaaccgttggagtcggtgctctcttagtttagacggatattttgggaagccttgttgagtacgtactactagtgtaccgcacaggatcatttgtaattcagttatgagtatgttaaccaggcaatttttgaagtctccttcactgttctgtatgtagacggtctagtagcttctttttttcaaataaaat

SEQ ID NO: 2343 - DNA, 1716 bp, Sorghum bicolor
cgttgctgcattaaaagcccgtcctcctccaaatctcgcgcactgtccctcgacgccgccgccacccgccagcaacgccaggcctcaccaaccccgtcgaaacctcgtgctctccgcctccgcctccgccgcctcgagccctccgcccgcctcctccagagcaccactcttcggcggggaggcccgtggtcccatctcctccgcgggacgggcgatgcagagcgcggctgccgtcgggctcgtccggccatgcgccgcgcggccgctccccacctaccctagcccacgccgcggcgccggcgcgtgcagtccgccgctcctcacaacgccccgcggcctccgcctgtccgcccgcgccggactcgtgccggcctcgccgctggaggaggagaaccggagatgcaggcacgtggcagcggccgccgggaaggtggcggcggctgatacggccggagaggaagcgggaggagggctcgccaagacgctgcagctgggggcgctctttgggctctggtacctcttcaacatctacttcaacatctacaacaagcaggttctgaaggttttgccataccctataaacatcacaactgtgcagtttgctgttggaagtgccattgctttgttcatgtggatcactggtatccttaaaaggccaaagatttctggcgcccagctttttgctatccttcctctagctattgtccataccatgggcaatcttttcacaaacatgagccttggaaaggttgcagtgtcatttacacatactatcaaggccatggaacctttcttctcagttctcctttcagcaattttccttggtgagttgcctacgccttgggttgtgttgtctcttcttccaattgttggtggtgtggcattggcatcccttactgaggcctcctttaactgggctggattttggagtgcaatggcttcaaatgtaaccttccagtcaaggaatgtgctaagcaagaaacttatggtgaagaaagaggaatctctggacaacattaatctattctcgatcattacagtcatgtcatttttcctgttggccccagtaaccttacttacagaaggtgttaaagttagtccagcagttttgcagtctgcgggtttgaacttgaaacaggtatacacaaggtcattgatagctgcattctgcttccatgcataccaacaggtgtcatacatgatcctcgccagagtatccccagtcacacattcagtgggcaattgcgtcaagcgtgtggtggtcattgtgacctctgttctgttcttcaggacccctgtttctcccatcaactctctcggcaccgggatcgctcttgctggagttttcctatactcgcagttgaagagacttaagcccaagccaaaggctgcttgatcatagacatttgcaggtccatccaatagaactttggaagttatgctaccgttggagtgattagtgagtgcagtagttagaatgatgtttaaagaagagtaccactttggcggataatttgtgatttgattgctagcatttttggacgggtttgttcgtgtattaataattttgctgtgatgccactttcgttgtgctgttcataggcgtctgaaactgaactgcgatgtttcactgcaccattttcaaccgtgacactaatcaagatggtacatacaaaaaaaaagtgatggtgattgctaaaactttctcaatggaca

SEQ ID NO: 2344 - DNA, 1582 bp, Saccharum officinarum
cgccaccagcccaccaacaacgccaggcctcgccagccggtggaaacctcgtggtctccgccgccgccgccgcctcgagcccctccgccggcctcttgcagagcaccaactcttcggcggatcatgcagagcgcggctgccgtcgggctcgtccggccatgcgccgcgcggcctctccccacctaccctagcccacgccgcggcgccggcgcgtgcatcggcggcaccacccagccgccgctcctcacgccccgcggcctccgcctctccgcccgcgccggcctcctgccggcctcgccgctggaggaggaggagagccggagatgcagggcaggccggcacgtggcggcggcagccgggaaggtggcggcggctgagggggccggagaggaagcggggggagggctcgtcaagacgctgcagctcggggcgctcttcgggctctggtacctcttcaacatctacttcaacatctacaacaagcaggttctgaaggttttgccataccctataaacatcacaacagtgcagtttactgttggaagtgccattgctttgttcatgtggatcactggtatccttaaaaggccaaagatttctggtgcccagcttcttgctatcctccctctagctattgtccataccatgggcaatcttttcacaaacatgagccttggaaaggttgcagtgtcatttacacatactatcaaggccatggaacctttcttctcagttctcctttcagcaattttccttggtgagttgcctacgccttgggttgtgttgtctcttcttccaattgttggtggtgtggcattggcatcccttactgaggcctcctttaactgggctggattttggagtgcaatggcctcaaatgtaaccttccagtcaaggaatgtgctaagcaagaaacttatggtgaagaaagaggaatctcttgacaacattaatctattctcgatcattacagtcatgtcattcttcctgttggccccagtaaccttacttacagaaggtgttaaagttagtccagcagtcttgcagtctgctggtttgaacttgaaacagatatacacaaggtcattgattgctgcattctgcttccatgcataccaacaggtgtcatacatgatcctcgccagggtatccccagtcacacattcagtgggcaattgcgtcaagcgtgtggtggtcattgtgacctctgttctgttcttcaggacccctgtttctcccatcaactctctcggtaccgggatcgctcttgctggagttttcctatactcgcaattgaagagacttaagcccaagcccaaggctgcttgatcatagacatttgcaggtccatccaatagaactttggaagttatgctatgccattggagtgattagtgagtgccgtagttagaatgatgtttaaagagctaccactttggcggataatttgtgattttagcatttttggacggatttgttcgtgtattaataattttgcagtgatgccactttcgttgtgctgtttatagtctcctgaaactgaactgcgatgtttcattggaccattttcaaccgtgacact

SEQ ID NO: 2345 - DNA, 1742 bp, Oryza sativa
tgccagctcagctcggccgcgtcgctgcttaaaacctctctcccactctcacgctctcgccatcctcgagcactccgccgccgccgccgccgccgcctcgacgcatccgcttccccccacgcgagccgaagcttctagaaccttcgaggccgcggctcccacgggcggcaatgcagagcgcggcggccgtcgggctcctccggccatgcggcgccaccaccgccgccgccccgctccagctccgcaaccctagcccccggggcttcggcgtcggagtcgggcagccgctgctcccgccgagggggctccgcctctccgccgtggccccgcgcgcgggcatctccgcccggcgcatcgggctcgtgccggcctccccggagcaggaggatgagcggcggcggggcgcacgcgacgtggccgtggcggcgacagcggcggcggcgggtgaggcaggggcggaggagggtggagggctcgcgaagacgctgcagctcggcgcgctcttcgggctgtggtacctcttcaacatctacttcaacatctacaacaagcaggttttgaaggtttttccataccccataaacatcacaaatgtccagtttgctgtcggcactgtcattgctctgttcatgtggattaccggtatccttaaaagaccaaagatctccggtgcgcagcttgctgctatccttcctctcgctatggtccacaccatgggcaatcttttcacgaacatgagccttggaaaggttgcagtgtcatttacacatactatcaaggctatggagcctttcttttcagttctgctttcagcacttttcctcggagagatgcctactccttttgttgtattgtctcttgttccaattgttggtggtgtggcattggcatctcttactgaagcttcatttaactgggctggattttggagtgcaatggcctcaaatgtcaccttccagtcaaggaatgtgttgagcaagaagcttatggtgaagaaggaggaatctctggacaacattaccctcttctcaatcattacagtgatgtcattcttcctcttggccccagtaaccttgctaacagagggtgtcaaagtcactccgacagttctgcagtctgctggtctgaacttaaaacagatatacacaaggtcactgattgctgcgttctgtttccatgcataccaacaggtgtcgtacatgatcctggcaagagtgtcccctgttactcactcggtgggtaactgtgtcaagcgagtggtggtcattgtgacatccgttctgttcttccgcacccctgtttcgcctatcaactctctgggaaccggagtcgctcttgccggagttttcctgtactcacaattgaagcggcttaaacccaagcccaagactgcctgattgtgtcttggtatctatcgtgaagaaccgtagaagcattgccacacgccatcggaatgagtgccttagcttagaatgatccttggagaagctccatccagtgaactgatgctgctgtgtgtatcgtttgtagttgagttactagcgtgctaatcgtggcaaggtttttgtgtcttctttaccaccttatgcttgaacagtcaattattttgttgtatcaataaatttcgtgcaatataacgttatattatctctgtttctttatggaagtattactatccttgtattataaattaaaaagtaaatttcataaaactatagatatcttgatcaaactatcattta

SEQ ID NO: 2346 - DNA, 2141 bp, Panicum virgatum
tttatttttacaaagaggtataatttgtaaatttagctaataaattagaagaattcttaaagatgctctaactgttgtgattatactttttgaaaactctatttttttattggaaaactctgttcgtagtcattggattgtgcgtgcgggtccgcatctcattctcacctacccctcgaaaccgccgcagcacgcacgctcctccgatccagcgctgctcgacggatcccccggcgtttcaggcgccgagcggcggggcccgcaccgcctgcttgtttgccagcgacagctgttcgtcgcgctccacggagcggcgccacggtccaagcccacgtcggatccacccgcccactgcaagtgagtcccacgagctccgtcggccccgcatgccagtgacactgcctgggcctcgccgctgcataaagctcctccaaatctcgcgcacggcaccacctcgccaaacccggtgggaaacctcgtgctctccgccgccgccgcgtccgcctcgatccctccgcccgcctcccgaggctcaggcttcccggatcttcggcggggagccgcggcgaccctccccaggacgatgcagagcgcggcggccatcgggctagtccggccatgcgccgcgcggccgctcgccgcttgccctagccaccgccgctatggagccggcgccggacacaatccggtcctcccggcgcgcgccctccgcctctccgcccgcgccgggctcgtgccggcctcgccgcttgaggaggaggagaagcggagatgcagggacgtggcggcgtcggcgtcggcggcggccgcggcgcaggggggcggggaggaagccggaggagggctgatgaagacgttgcagctgggggcgctcttcggcctctggtacctcttcaacatctacttcaacatctacaacaagcaggttctgaaggttttgccgtaccctataaacatcacaactgtgcagtttactgttggaactgccattgctttgttcatgtggatcactggtatccttaaaagaccaaagatttctggtgcccagcttctcgctatccttcctctggctattgtccacaccatgggcaatcttttcacaaacatgagccttggaaaggttgcagtgtcatttacacatactatcaaggccatggagcctttcttctcagtcctcctttcagcaatcttccttggtgagttgcctactccttgggttgtattgtctcttgttcccatcgttggtggtgtggctttggcatctcttactgaggcttcctttaactgggctggcttttggagtgcaatggcttcaaatgtaaccttccagtcaaggaatgtgctaagcaagaagcttatggtgaagaaagaggaatctctggacaacattaatcttttctcaatcattacagtcatgtcattcttcctcttggccccagtaaccttactaacagagggtgtcaaagtcagtcctgcagtcttgcagtctgctggcttgaacttaaaacaggtctacacgaggtcgctgattgctgcattctgcttccatgcataccaacaggtgtcatacatgatcctcgctagggtgtccccagtcacccattcagtgggcaactgcgtcaagcgtgtggtggtcattgtgacttccgttctgttcttcaggacccctgtttctcctgtcaactctctaggtaccggggttgccctcgcaggagtcttcctgtactcgcaactgaagaggcttaagcccaagcccaaggctgcttaatgacatactatcaggtccatcggtccattagaactgtggaagaccttccgcatgagtgactagcgagtgctgtagtttagaatgatattgaaaggagcccctctggtttgctaccacttcatgtgattgtatgtgatttaattactagcatttttgaacggatttatggtttattggtgtattaataattttgatgtggtgccatttttcttgtgctttcttttacgcttctgaaactgaacttcgaggaagacagacaaaaataatagtgtggtggagatgtaatcctcgggagttaattctttcgtggtgagtcgtgattctttcggcatggacaatactacactactgggatcctttcgcggaactggga

SEQ ID NO: 2347 - DNA, 1582 bp, Zea mays
catccgcccactgccaaacggccccacaagctcagcgcggcggcctcgtcgctgcataaagcccctacctaactccaaatctcgccagcgccaggcctcgccgagccggtggaaacctcgtgatctccgccgcctcgagccctccgcgcgcctcttccagagcaccatccactcttcggtggcgaggccgcggccccccgagacgggcaatgcagagcgcggctgccatcgggctcctacggccatgtgccgcgcggccgctcgccgcctacactagcccacgccgcggcgccggcgcgtgcagcggcggcacccagccgctcatcacgccccgcggcatccgcctctccgcccgccccggtctcgtgccggcctcgccgctggaggagaaggagaaccggagatgcagggccagtatgcacgcggcggcgtcggccggagaggaagctgggggagggctcgccaagacgctgcagctgggggcgcttttcgggctctggtacctcttcaacatctacttcaacatctacaacaagcaggttctgaaggttttgccataccctataaacatcacaacggtgcagtttgctgttggaagtgccattgctttgttcatgtggatcactggtatccataaaaggccaaagatttcgggtgcccagcttttcgctatccttcctctagctattgtccataccatgggcaatcttttcacaaacatgagccttggaaaggttgcagtgtcatttacacatactataaaggccatggaacctttcttctcagttctcctttcagcaattttccttggggagttgcctacgccatgggttgtgttgtctcttcttccgattgttggtggtgtagctttggcatcccttactgaggcctcctttaactgggctggattttggagtgcaatggcttcaaatgtaaccttccagtcaaggaatgtgctaagcaagaaacttatggtgaagaaagaggaatctctcgacaacattaacctattctcgatcattacagtcatgtcattcttcctgttggccccagtaaccttacttacagaaggtgttaaagttagtccagcagtgttgcagtctgctggtttgaacttgaaacaggtatacacaaggtcattgattgctgcattctgcttccatgcataccaacaggtatcatacatgatcctcgccagggtatccccagtcacacattcagtgggcaattgcgtcaagcgtgtggtggtcattgtgacctctgttctgttcttcaggacccctgtttctcccatcaactctcttggtaccgggatcgctcttgctggagttttcctatactcgcaattgaagagacttaagcccaagcccaagactgcttgatcatatacatttgtaggtccattcaatagaactttggaagttatgctatgtcattggagtgatcagtgagtgccgtagttagaatgataagcctctccgttttgttaccagttgggtggataatttatgatttacttgctagcatttttggacggatttgttcgtgtattaataattttgcagggatggttgtcgttgtg

SEQ ID NO: 2348 - DNA, 1593 bp, Panicum virgatum
caccaaacccgctgggaacctcgtgctctccgccgccgccgcctcgatccctccgcccgcctcccgaggctcaggcttcccggaccttcggcggggcgccgcggcgatcctccccaggacaatgcaaagctcggctgccatcgggctagtccggccatgcgccgcccggccgctcgccgcttgccctagctaccgccgcggcggcgccggcgccggcgccggactccgcccggtcctcccggcgagcggcctccgcctctccgcccgcgccgggctcgtcccggcctcaccgcttgaggaggaggagaagcggagatgcagggacgtggcggcgtcggcgtcggcggcggccgcggcgcaggggggcggggaggaagccggaggagggctgatgaagacgttgcagctgggggcgctcttcggcctctggtacctcttcaacatctacttcaacatctacaacaagcaggttctgaaggttttgccgtaccctataaacatcacaactgtgcagtttactgttggaactgccattgctttgttcatgtggatcactggtatccttaaaagaccaaagatttctggtgcccagcttctcgctatccttcctctggctattgtccacaccatgggcaatcttttcacaaacatgagccttggaaaggttgcagtgtcatttacacatactatcaaggccatggagcctttcttctcagtcctcctttcagcaatcttccttggtgagttgcctactccttgggttgtattgtctcttgttcccatcgttggtggtgtggctttggcatctcttactgaggcttcctttaactgggctggcttttggagtgcaatggcttcaaatgtaaccttccagtcaaggaatgtgctaagcaagaagcttatggtgaagaaagaggaatctctggacaacattaatcttttctcaatcattacagtcatgtcattcttcctcttggccccagtaaccttactaacagagggtgtcaaagtcagtcctgcagtcttgcagtctgctggcttgaacttaaaacagatctacacgaggtcgctgattgctgcattctgcttccatgcgtaccaacaggtgtcatacatgatccttgcaagggtgtccccagtcacccattcagtgggcaactgcgtcaagcgtgtggtggtcattgtgacttccgttctgttcttcaggactcctgtttctcccgtcaactctctaggtaccggggttgccctcgcaggagttttcctgtactcacaactgaagaggcttaagcccaaggccaaggctgcttaatgacatatattatcagatccatccattagaactgtggaagacctgccgtctgagtgactagcgagtgctgtagtttagagcgatattgcaagaagtccctctggtttgctacgacttgaagtgattgttcgtgatttaattactagtgtttttgaacggatttatggtttgttggtgtattaataattttggtgtggtgccatttttcttgtgctgtttgtacgcttctgaaactgaacttcgaggaagacagacaaaaataatagtggtggtggagatgt

SEQ ID NO: 2349 - DNA, 1570 bp, Zea mays
attcaactcaatacagaaaccctggtctgaaagccctcactccaaatctcgcgcactgtcagctgacgccaccgcctgcgccagccctcgccaagccggtgaaaacctcgtgccctccgccgcctccgcccgcctcttccagagtaccgcggtctcatctcctcccgggacgggcatgcagagcacggctgccatcggtctcgttcggccatgcgccgcgcggccactccccacctaccctagcccacggcgcggcgccggcgcgtgcagcggcgccgcacagccgatcctcgcgccccgcggcctctgcctctccgcccgcgccagcctactgccggactcgccgctggaggaggagtaccggagatgcagggccggccggcacgtggccgcggccgggaaggtggcggcggctgatggggccgtagaggaagcggggggagggctcgtcaagacgctgcagctggggtcgctcttcgggctctggtacctcttcaacatctacttcaacatctacaacaagcaggttctgaaggttctgccataccctataaacatcaccacagtgcagtttgccgttggaagtgccattgctttgtttatgtggatcaccggtatccttaaaaggccaaagatttctggtgcccagctttttgctatccttcctctagctatcgttcataccatgggcaatcttttcacaaacatgagccttggaaaggttgcggtgtcatttacacatactatcaaggccatggaacctttcttctcagttctcctttcagcaattttccttggtgagttgcctacgccttgggttgtgttgtctcttcttccgatcgttggtggtgtggcattggcatcccttactgaggcctcctttaactgggctggattttggagtgcaatggcttcaaatgtaaccttccagtcaaggaatgtgctaagcaagaaacttatggtgaagaaagaggaatctctcgacaacattaatctattttcgataattacagtcatgtcattcttcctgttggccccggtaaccttacttacagaaggtgttaaagttagtccagcagttttgcagtctgctggtttgaacttgaaacagatatacacaaggtcattgattgctgcatgctgcttccatgcataccaacaggtgtcatacatgatcctcgccagggtatccccagtcacacattcagtgggcaattgcgtcaagcgtgtggtggtcattgtgacctcggttctgttcttcaggacccctgtttctcccatcaactcactcggtaccgggatcgctcttgctggagttttcctatactcgcaattgaagaggcttaagcccaagcccaaggctgcttgatcatagacctttgcaggtccatccaatagaacttttgaagttatgctatgccattggaatgattagtgagtgccgtagttagaatgatgtttaaagaagagctaccacttcagcagataatttgtgacttgcttgcattttttggacggatttgttcgtgtattaataattttgcagtgacgatacttctgttgtgctgtt

SEQ ID NO: 2350 - DNA, 1841 bp, Pennisetum glaucum
agggatcaggaagcctcgggaggccggaggaggtcactcgcccagcaccggtgcgatcctcgtgctctccgccgcagccgcctcgagacctcctccggcctcccgaggcttcctgatcccttgtgcggggaggcgcggcgaccctcctcccccgcgataatgcagagcgcggcggccatcgggctcgttcggccatgcgccgcgcgcccgctcgttgcttaccctagccaccgccgcggcggcgccgtctccggcggagggatcaggccggacctcccgcagcgcgggatccgcctctccgcgcgcgcggggctcgtgccggcctcgccgctggaggaggaggagaagaagcggagatgcagggccgagcgggacgtgtcggcggcggcgaccgcggcggccgcgcagggggccggggaggaggccggaggagggttggtcaagacgctgcagctgggcgcgctcttcggcctctggtacctcttcaacatctacttcaacatctacaacaagcaggttctgaaagttttgccatatcctataaacatcaccacagtgcagtttgctgtcggaactgccattgctattttcatgtggatcactggtatccttaaaagaccaaaaatttctggtacccagcttcttgctatccttcctctggcaattgtccacaccatgggcaatcttttcacaaacatgagccttgggaaggttgcagtgtcatttacacatactatcaaggccatggagcctttcttctcggttctcctttcagcaatcttccttggtgagttgcctactccttgggttgtgttgtctcttcttccaattgttggtggtgtggcactggcatctcttactgaggcatcctttaactgggttggcttttggagtgcaatggcttcaaatgtaacctttcagtcaaggaatgtgctaagcaagaagctgatggtgaagaaagaggaatctctggacaacattaacctcttctcaatcattacagtcatgtcattctgcatcttggccccagtcaccttactaactgagggtgtcaaagtcagtcctgcagtcttgcagtcagctggcttgaacttaaaacagatttacaccagatcgctgattgctgcattctgcttccatgcctaccaacaggtgtcatacatgatcctcgctagggtgtccccagtcactcactcagtgggcaactgcgtgaagcgagtggtggttatcgtgacctctgttctgttcttcaggacccctgtttcacccgtcaactctatcggtaccggggttgccctcgcgggagttttcctctactcacaactgaagaggcttaagcccaagcccaaggctgcttgatcgcatatatggttgtcaggtccacccagtacaactgtcgaagccctgccatgccgtaagagtgattagtgagagccctagtttagaatggtattgagagaagctcctctctggtttgctgccacttcatgtgatcgtgtgtgattttattactagcatttttgaacggatctgttggtgtatcaataattttgcagtagtgtttttttttcgttcttgtgctttttatacgcctctgaaactcaactgccagggagcattgtgcttgtgctaagttagtacttgtaggtcgttttggctttgtaagtgcttagtttttgttatgcatttggatatagtatatgtttttaagtgtaacaatatctatgaacgtagaaaactaatttgagggtgtataataagataagaaaaagtatggtgaggtcataatcttgggaataattctatttagcgatgattacatacaaacaaaaaagtaaaaa

SEQ ID NO: 2351 - DNA, 1672 bp, Setaria italica
cagcaccacctcgccaaaaccggtgggaacctcgtgcactccgccgccgccgcctcgagacctccgccggcctcccgaggcatccggaacccttcggcggggaggcgcggcgaccctcaccccgggacaatgcagagcgcggcggccatcgggctcgtccggccatgcgccgcgcggccgctcgtcgcttgccctagccaccgccgcggcggcgccgtcgccggcgaagggatccggccggtcctcccgcagcgcgggatccgcctatccgcgcgcgcggggctcgtgccggcctccccgctggaggaggaggagaagcggagatgcagggccgaacgggacgtgtcggcggcggcggccgcggcgcaggaggccggggaggaggcgggaggagggttcgccaagacgctgcagctgggcgcgctcttcggcctctggtacctcttcaacatctacttcaacatctacaacaagcaggttctgaaggttttgccatatcccataaacatcacaaccgtgcagtttgctgttggaactgccattgccatgttcatgtggatcactggtatccttaaaagaccaaagatttccggtgcccagcttcttgctatccttcctctggcaattgtccacaccatgggcaatcttttcacaaatatgagccttgggaaggttgcagtgtcatttacacatactatcaaagccatggagcctttcttctcggttctcctttcagcaatcttccttggtgagttgcctactccttgggttgtgttgtctcttcttccaattgttggtggtgtggcactggcatctcttactgaggcttcctttaactgggctggcttttggagtgcaatggcttcaaatgtaaccttccagtccaggaatgtgctaagcaagaagctgatggtgaagaaagaggaatctctggacaacattaacctcttctctatcattacagtcatgtcattctgcctcttggccccagtcaccttactaacagagggtgtcaaagtcagtcctgcagtgttgcagtctgctggcttgaacttaaaacagatatacaccagatccctgattgctgcattctgcttccatgcctaccaacaggtgtcatacatgatcctcgctagggtgtccccagtcacccactcagtgggcaactgcgtcaagcgagtggtggtcattgtgacttccgttctgttcttcaggacccctgtttcacctgtcaactctctcggtaccggggttgccctcgcaggagttttcctctactcgcaactgaagaggcttaagcccaaggcaaaggctgcttgatcgcatatatggtcaggtctatccagtagaactgtcgaagccttgccatgctgttggagtggctagtgagtgccgtagtttagaatgatattgagagaatcccctctggtttgctgtcagttaatgtgatcgtttgcgatttaactactagcatttttgaacggatctgttgatgtaatcaataattttgctgtggtgccatttttcttgtgctgtttatatgcctctgaaactgagctgcgtggatgttgctccaaggtaccattttcgatctagtatagtgctaaattagtaagatagacaaaaaaagagtggtgtaatgattacataatcgtgatcctttcggccaaaa

SEQ ID NO: 2352 - DNA, 969 bp, Triticum aestivum
tacataacccaccacgagcgcagcccgctagggtttcttctcccttcctggttgcgcagctcaccccgaacccccagctcccctccccggcgccgccgcagcagcaagatggtgaagggacgcaccggccagcgcgtgaggctctacgtccgcggcaccatcctcggatacaagaggtccaagtcgaaccagtacgagacggcgtcgctggtgcagatcgagggggtgaacaccagggaggacgtggcctggtacggcggcaagaggatggcctacgtctacaaggccaagaccaagagcaacggcacccactaccgctgcatctggggcaaggtctcccgcccccacggcaacaccggcgtcgtccgcgccaagttcacctccaacctgcccgccgaggccatggggaaaaaggtcagggtcttcatgtacccgagcagcatctaaaaggttattttgaagtgtggaggatttcgctcgtcccttaggtttcatttcagagtcttgtaagatggattcaggcctggatagcaagttgaactgctgtttccctgtgaagaactgtagtcttcatgttatcttgaatgtgtgggtcgcacattatatgatgttatatgtagttcgaacctgatgctgtgttttgcccactttttgcgttctatccttgcaattttagctatcaaatctgattcagtgatgtttttactcttcttttatgaatgtttgtatgcccttttgatgattggtggaagagtttaacttcttttggctgggtactgaccagcgcaagaacttgtttgattgagaagatctgttagactaccgaggttcatgtgcactttgtgcttatcctctcccggatcgttagcctctagcttgttgtcagtacctccccatgcacgtttccctgccccctgtgcatgtattttttgcccttggccaggaattttaatttctggaaaaacaatt

SEQ ID NO: 2353 - DNA, 758 bp, Secale cereale
tacataacccaccacgagcgccgcccgctagggttttctctccccttcctggttgcgcagctcaccccgaacccccagctcccctccccgccggcgccgcagcagcaagatggtgaagggacgcaccggccagcgcgtgcggctctacgtccgcggcaccatcctcggatacaagaggtccaagtcgaaccagtacgagacgacgtcgctggtgcagatcgagggggtgaacaccagggaggacgtggcctggtacggcggcaagaggatggcctacgtctacaaggccaagaccaagagcaacggcacccactaccgctgcatctggggcaaggtctcccgcccccacggcaacaccggcgtcgtccgcgccaagttcacctccaacctgcccgccgaggccatgggaaagaaggtcagggtcttcatgtacccgagcagcatctaaaaggttatttgaagtgtggaggatttcgctcgtcccttaggtttcattttgagtcttgtaagatggattcaagccgggatagcaagttgaactgctgtttccctgtgaagaactgtagttttcatgttatctcgaatgtgtggcgcattatatgatgttatatgtagttcgaacctgaagctgtgttttgcccacctttttgcgttatatccttgcaattttagctatcaaatcttattcagagatgtttttacttttcttttatgcatgtttgtatgcccttttgatgattggttgaagagtttaactt

SEQ ID NO: 2354 - DNA, 620 bp, Avena sativa
ctcctccgaaccccagctctcctctccggcggccgaagcagcaagatggtgaagggacgcaccggccagcgcgtgaggctctacgtccgcggcaccatcctcggatacaagaggtccaagtcgaaccagtacgagtctgcctcgctggttcagatcgagggggtgaacaccagggaggacgtggcctggtacggcggcaagcggatggcctacgtctacaaggccaagaccaagagcaacggcacccactaccgctgcatctggggcaaggtctcccgcccgcacggcaacagcggcgtcgtccgcgccaagttcacgtccaacctgccggccgaagccatggggcgcaaggtcagggtcttcatgtaccccagcagcatctaaaggtaatttggaagtgcagaagattttgcttatctgctagggtgtctcgtgagatggattcgggctgtgttgtcaaattaaacttctgtttccttgggaactgtagtttttatgttatctggaatgtgtggatcactcattatatgacgtcatatgcagttggaattattagttgtgttttgacttttggcccattttgtgttacaaggatcctacctgaatcagagatgatttta

SEQ ID NO: 2355 - DNA, 710 bp, Avena sativa
cctcgcagctcctccgaaccccagctctcctctccggcggccgaagcagcaagatggtgaagggacgcaccggccagcgcgtgcggctctacgtccgcggcaccatcctcggatacaagaggtccaagtcgaaccagtacgagtccgcctcgctggtgcagatcgagggggtgaacaccagggaggacgtggcctggtacggcggcaagaggatggcgtacgtctacaaggccaagaccaagagcaacggcacgcactaccgctgcatctggggcaaggtctcccgcccccatggcaacaccggcgtcgtccgcgccaagttcacctccaacctgccggccgaagccatggggcgcaaggtcaggatcttcatgtacccgagcagcatctaaaggtaatttggaagtgcagaagattttgcttatctgttagggtgtcttgtgagatggattcaggccgtgttggcaaattgaacttctgtttccttgagaactgtagtttttatgttatctggagcgtgtggatcactcgttatatgatgttatatgcagttggaactataagttgtgttttgacttttagcccattttgtgttacaaccatcctacctgaatcaaagatgattttactctttgaaggtgtttgtttcagctagcggtaatgtaaacgggaaaggaatcaggttacagtgggattgcactgtaatggaa

SEQ ID NO: 2356 - DNA, 532 bp, Lolium multiflorum
  misc_feature (186)..(186): n is a, c, g, or t
gccggcgtcgcagctcctccgcaccccagccctcgtctccggcggccgaagcagcaagatggtgaagggacgctccggccagcgcgtgcggctctacgtccgcggcaccatcctcggttacaagaggtccaagtcgaaccagtacgagtcggcctcgctggtgcagatcgagggggtgaacaccanggaggacgtggcgtggtacggcggcaagcggatggcctacgtctacaaggccaagaccaagagcaacggcacccactaccgctgcatctggggcaaggtctcccgcccgcacggcaacaccggcgtcgtccgcgccaagttcacatccaacctgccggcggaagccatggggcgcaaggtcagggtcttcatgtacccgagcagcatctaaaggtaatttggaagtgcagaagattttgctcatctgttagggagtcttgtgagatggattcaggcccggttggcaagttgaacttctgtttccctgagaactgtagtttttctgttacctggaatgtgtggatcg

SEQ ID NO: 2357 - DNA, 685 bp, Avena sativa
ataaaccaccactagcgccgcccgctagggtttctcccttccctgctagcgccggcctcgcagctcctccgaaccccagctctcgtctccggcggccgaagcagcaagatggtgaagggacgcaccggccagcgcgtgaggctctacgtccgcggcaccatcctcggatacaagaggtccaagtcgaaccagtacgagtccgcctcgctggtgcagatcgagggggtgaacaccagggaggacgtcgcgtggtacggcggcaagaggatggcgtacgtctacaaggccaagaccaagagcaacggcacgcactaccgctgcatctggggcaaggtctcccgcccccacggcaactccggcgtcgtccgcgccaagttcacgtccaacctgccggccgaagccatggggcgcaaggtcaggatcttcatgtacccgagcagcatctaaaggtaattggaagtgcggaagattttgcttatctgttagggtgtcttgtgagatggattcaggccgtgttggcaaattaaacttctgtttccttgagaactgtagcttttatgttatctggaatgtgtggatcactcattatatgatgttatatgcagttggaactgtaagttgtgttttgacttttagcccattttgtgttacaaccatcctacctgaatcaaagatgattttactc

SEQ ID NO: 2358 - DNA, 913 bp, Brachypodium distachyon
gataaatatcgctccgaaccccggcgcctagggtttctccccttcgtcgtcgcgccggcctccctcatcgcagctctctctccgccgcactccgccctagcagcccccgtctccggcgccggcggcgagatggtgaagggacgcacggggcagcgcgtcaggctctacgtccgcggcaccatcctcggatacaagaggtccaagtcgaaccagtacgagacgacgtcgctggtgcagatcgagggggtgaacaccaaggaggacgtggcgtggtacggcgggaagcggatggcgtacgtctacaaggccaagaccaagagcgacggcacgcactaccgctgcatctggggcaaggtctcccgcccccacggcaactccggcgtcgtccgcgccaagttcaagtccaacctgccggcggaggccatggggcgcaaggtcagggtcttcatgtatcccagcagcatctaaagataatcttgaagtgcggtggatgttgctcatctcttaggtttcatctgttagcaagttgaactgctgtttccccaagaatcccttggttgttttccccgtaattttgatgtcgaatgtgtggaccacttataccatgctatgttatatggagttggaatttcaaagcgtgtgatctgttcatctctcagtgggttgtgtgctgttgctccctctcaatttcagtcattgattcctgttaggagataattttccttttgttcattgatgtatttatcctttctgaccagctttagacgacttttaacttattttttgtgattatatgcggcaaactaggctcgtggcttggaggtgcatatcctgttcgaactgtagatattcctctcttaacaagggtctggacgttacattttacaaaaataataaattcatatttctaatt

SEQ ID NO: 2359 - DNA, 722 bp, Cynodon dactylon
gcatcgtcttcccctactcctcgagttcgcgtctccggtggcagcagcaccagcaggtaggaaggaagcaggcggcggccatggtgaagggacgcacgggtcagcgcgtcaggctctacgtccggggcaccatcctcgggtacaagaggtccaagtccaaccagtacgagaccacgtcgctggtgcagatcgagggcgtcaacaccaaggaggacgtcgcgtggtacgccggcaagcgcatggcgtacatctacaaggccaagaccaagagcaacggcacccactaccgctgcatctggggcaaggtcacccgcccccacggcaactctggagtcgtccgcgccaagttcaagcacaacctcccggcggagtccatgggacgcaaggtcagagtgttcatgtacccaagcagcatctaaggttttattgaggtagaaatggtcatgttcatttcttgtcacaagctgaaaatgtcactttggtgaacctatgctgtgttggcaaattagatgttcatgtactaagaacctgtggaagttttgcctaaatttgttgtcagatggatgaacctttgtcttaatgttatgatcatcagtttgaagcatggtttaccataccaattgccacgtttgtcagttttacatcgtcaatgcactttactcacatgaacttgttatctctcggggttttgtgaccatataagttcaccaaatatttgtagc

SEQ ID NO: 2360 - DNA, 544 bp, Cenchrus ciliaris
  misc_feature (53)..(53): n is a, c, g, or t
  misc_feature (188)..(188): n is a, c, g, or t
  misc_feature (233)..(233): n is a, c, g, or t
  misc_feature (332)..(332): n is a, c, g, or t
  misc_feature (353)..(353): n is a, c, g, or t
  misc_feature (420)..(420): n is a, c, g, or t
gaagcggcagcggcgagatggtgaaggggcgcacggggcagcgcgtcaggctntacgtccggggcaccatcctcggatacaagaggtccaagtcgaaccagtacgagaccacgtcgctggtgcagatcgagggggtgaacaccaaggaggacgtcgcgtggtacgccgggaagcgcatggcgtacatntacaaggccaagaccaagagcaacgacactcactaccgctgcatntggggcaaggtcacccgcccgcacggcaactccggcgtcgtccgcgccaagttcaagtccaacctgccgccggaatccatggggcgcaaggtccgggtnttcatgtaccccagcagcatntaaagataatttcaaggtgcggagtatcgtgcttatctgttaggtttatcttgagctaaaaagtttnttgtgaggggtctgttcaggttgagttagcaacttgaattgtctatttgagaaccctttgaagttctccctggttttggtgttgtggaccacttaaatcaatatggagttgaagttagaactga

SEQ ID NO: 2361 - DNA, 760 bp, Setaria italica
ttcaccttcgaatccgaaggatacttatgcgctgctagcgccgcccgctagggtttcttcccttcgttgttgcgccgtcccctccgctaccccgcactccacctccgaagctatcgtctccggcggcagaagcggcagcggcgagatggtgaaggggcgcacggggcagcgcgtcaggctctacgtccggggcaccatcctcggatacaagaggtccaagtcgaaccagtacgagaccacgtcgctggtgcagatcgagggggtgaacaccaaggaggacgtcgcgtggtacgccgggaagcgcatggcgtacatctacaaggccaagaccaagagcaacgacacccactaccgctgcatctggggcaaggtcacccgcccacacggcaactccggcgtcgtccgcgccaagttcaagtccaacctgccgccggaatccatggggcgcaaggtcagggtcttcatgtaccccagcagcatctaaaagataatttcaaggtgtggacgatcgtgcttatctgttaggttttatcttgagctaaaaagttccttgtaaggggtctgttcaggttgagagttagcaacttgaattgtctatttgagaacccttcgaaagttctccctggttttggtgttgtggaccacttaaatcattatatggagttgaagttagaactgaaaagtaacttgtcatattttgttcgttgcccacattgcatcatttttctgggttctgaatcagaggtgatatacttctgtt

SEQ ID NO: 2362 - DNA, 665 bp, Pennisetum glaucum
cgtccccctccccaacctccgaagctattgtctccggcggcagaagcggcagcggcgagatggtgaaggggcgcacgggtcagcgcgtcaggctctacgtccggggcaccatcctcggatacaagaggtccaagtcgaaccagtacgagaccacgtcgctggtgcagatcgagggggtgaacaccaaggaggacgtcgcgtggtacgccgggaagcgcatggcgtacatctacaaggccaagaccaagagcaacgacacccactaccgctgcatctggggcaaggtcacccgcccgcacggcaactccggcgtcgtccgcgccaagttcaagtccaacctgccgccggaatccatggggcgcaaggtccgggtcttcatgtaccccagcagcatctaaagataatttcaaggcgtggagtatcgtgcttatctgttaggttttatcttgagctaaaaagttccttgtaaggggtctgttcaggttgagagttagcaacttgaattgcctattcgagaaccctttgaagttctccttggttttggtgttgtggaccacttaaatcattatatggagttgaagttagaactgaatgtaacttgtcacatttgttcgttgcccacattgcatcagttcggggttctgtatcagagatgatatactgtt

SEQ ID NO: 2363 - DNA, 721 bp, Pennisetum glaucum
gcgcgacctctcttctccggcggcggaagcggaagggagcaggcggcaaccatggtgaagggacgcacggggcagcgcgtgaggctctacgtccggggcaccatcctcggatacaagaggtccaagtcgaaccagtacgagaccacgtcgctggtgcagatcgagggggtgaacaccaaggaggacgtcgcgtggtacgccgggaagcgcatggcgtacatctacaaggccaagaccaagagcaacgatacccactacaggtgcatctggggcaaggtcacccgcccgcacggcaactccggcgtcgtccgcgctaaattcaagtccaacctccccccggagtctatggggcgcaaggtcagagtgttcatgtacccgagcagcatctaaggttttgttggagtaggattggtcgtcgtatttctcatcttgagctgaaaatgtcatgttttggtgaactcttgatgtgttggcaacttagattgttcgtgtactgaacctgtggaagttttgcccaaaatttactgttgaacagatgaaccattgtctaatgttatgccagcacctgtgcttattttcctcatcagctgcttatttgattagttggtattttatcttgtgctctgtctgccatgtttgtgtgccgtgtatcaaatgccagtgcagtattgttttgatgttttcgactctgaatggcagccgaaatacatttcatgcagtg

SEQ ID NO: 2364 - DNA, 1493 bp, Panicum virgatum
gtgcggtaatctttaaataaatcgcgcttctattttgtagtgatgatgggtgcagatcgatgtcttgagctatccacacacagcgtttcttactgttaattactgcaacatgtgactatataattggcttagatctaagcccggtcagctcgtggctgccgccggtgcaatcgtcttcgccggagctcttcgaccccatttattgcgtagatcgggagcgagcaggatccgaggaaggaaacgtgcactcgttgaccaataccacccaatgccgaccttatcacatctccctctttctgcgtttgtcttttttgagtcaaatgctaatgaatccaaaattaacgggccagatttttgtcctttcttgttttcgcccatccgtactgccattcacatgggccgtagaagtagccggcccaattacgatgccgggtgggaagtgtaaaccctagcccaccatatccgcaataactccactgaatacatcgatcagaaccgtcgatgcatcaacgatccaatctcgaccgttcaccttcgaaaccggaggatacttaacccctgctagcgccgcctgctagggtttcctcccttcgtagttgcgccgtcccctcccatccccagcaccccacctccgaagctctcggctccggcggcaacggcgagatggtgaaggggcgcactgggcagcgcgtgaggctctacgtccggggcaccatcctcggatacaagaggtccaagtcgaaccagtacgagaacacgtcgctggtgcagatcgagggggtgaacaccaaggaggacgtcgcgtggtactgcggcaagcggatggcgtacatctacaaggccaagaccaagagcagcggcacccactaccgctgcatctggggcaaggtcacccgcccgcacggcaactctggcgtcgtccgcgccaagttcaagtccaacctgccgccggagtctatggggcgcaaggtcagagtcttcatgtaccccagcagcatctaaagataatttcaagatgtggaggattgtgcttatctgctaggttatcttgagctaaaaagttccttgtaaggggtctgttcaggttaagagttagcgacatgaactgtctatttgagaaccatttgaagttctccctggttttggtgttgtggacctaaatcttatatggagttgaagttggaactgaaagtaatttgtcatgttttgttcgtagcccacattgcatcagttgtcgggttcttaatcagttattgaccaaaaggctatgccggcacaaacaaatttgtgtttttgaaattcaaaaggacccaaatttgagtccgagggtcgcactacaatactagtatatttttttgtcgaggttattacaataagatatcttcgaagcgggtgtagcccgagctgtgaagagcgggcgatgttgagatgtggcggcaaccaacagggccatctctccaactgcactcaaggtaccccatttcgtgatcaaa

SEQ ID NO: 2365 - DNA, 646 bp, Eragrostis curvula
cgccctttttcttggtacgcgtcgtctcccctcctccggactccatctccgagctctcgtctccggcggcagaagcagcggcagcgagatggtgaaggggcggacgggtcagcgcgtgaggctctatgtccggggcaccatcctcggatacaagaggtcgaagtcgaaccagtacgagaacacttcgctggttcagatcgagggggtgaacaccaaggaggacgtggcgtggtactccggcaagcggctggcctacatctacaaggccaagaccaagagcagcggcacgcactaccgctgcatctggggcaaggtcagccgccctcacggcaactccggcgtcgtccgcgccaagttcaagtccaacttgcctccggaatccatgggtcgcaaggtcagggtcttcatgtacccgagcagtatctaaagataattccaaggtgtggaggatcgtgcttatctgctagattttattttgagctaaaagatatccttgtaaggtgtgaactcaggtcaagagttagcaaattgaactgtttctttgagaaccctttgtgaagttctccgtagttttgatgttatggacctctcaaatcattataagatggatttagaacctggatgtgcaatttgcgatacttattgg

SEQ ID NO: 2366 - DNA, 683 bp, Zea mays
ttcacttgcgtacctgacgggtacttaagcactgctaccgccgccgtctaggtttcttcgatcgtggttgcgccatccctcactctcctccgaagccatcgtccacgtcccagcctccccggactctaggggcagaagctgcagcgtcgagatggtgaaggggcgcacggggcagcgcgtgaggctctacgtccggggcaccgtccttggatacaagcggtccaagtcgaaccagtacgagactacgtcgctggtgcagatcgagggggtgaacaccaaggaggacgtcgcgtggtactgcgggaagcggatggcctacatctacaaggccaagaccaagagcagcggcacccactaccgctgcatctggggcaaggtcgcccgcccgcatggcaactccggcgtcgtccgcgccaagttcaggtccaacctgccgccggaatccatgggccgtaaggtcagggtgttcatgtaccccagcagcatctaaagataatctgaatgtgtggaggacccttttcttctagattttatcttcagctgtccttgtaagggttgtgttcaggttgagagttagcaggttgagctgtctatctgagaaccatttaaagttctctgagttttggtgttatggatcactggaagtattatatgaagtttaagttagaactaatttgtttgcc

SEQ ID NO: 2367 - DNA, 902 bp, Zea mays
gatcgctcttctctccgtcccctgctacatataaggtacctccggccccaaactgcacgagctctctctagcattacccggcggcggaagcgtaagcgcaaaacgaagcaagcggccgccatggtgaagggacgcacgggacagcgcgtcaggctctacgtccggggcaccatccttggatacaagaggtccaagtcgaaccagtacgagaccacgtctctcgtgcagatcgagggggtgaacaccaaggaggatgtcgcgtggtacgctggcaagcgcatggcgtacatctacaaggccaagaccaagagcaatgagacccgctacaggtgcatctggggcaaggtcacccgtccgcacggaaactcgggcgtcgtccgtgccaagttcaagtccaacctcccgcctgagtccatggggcgcaaggtcagagtgttcatgtacccgagcagcatctaaggttttgttggagtaaagatggactagaaatggccatgtgtttatttctcacttttctctgaacttaaaatgccttgtgttggtaacttagattgttcaagtgctgaacctgtggaagttgtgccaaaatttgttgtcgaacggatgaactattgtcgtaatgttatgccagcagcagatcttaatttgccccgttacatcgatgtctgattgcagtatcttcaaattgaaaggagttccgtttggtatgaatgtgtaatgttctacgctgctctgggatgcttctttcaatatcatttctgcaaaatttattggcacaagaggctctaatttatgggcacagggcctttgtgtgtgggtctagtttacttttttattcagtaaacagttgtggaagatactatctagcgtaataagtgcataatcccgttagcatcctaaaa

SEQ ID NO: 2368 - DNA, 933 bp, Sorghum bicolor
cgatcccagccgttctcttgcgaaactgacggatacttaagtgctgccaccgccaccctctagggtttcttctcctcgtggctgcgccgtcccccgcactcgagctccgaagccatcgtatccggcggcagaagcagcggcggcgagatggtgaaggggcgcacggggcagcgcgtgaggctctacgtccggggcaccgtcctcggatacaagaggtccaagtcgaaccagtacgagaccacgtcgctggtgcagatcgagggggtgaacaccaaggaggacgtcgcgtggtactgcggcaagcggatggcctacatctacaaggccaagaccaagagcagcggcacccactaccgctgcatctggggcaaggtcacccgcccgcacggcaactccggcgtcgtccgcgccaagttcaggtccaacctgccgccggaatccatgggccgcaaggtcagggtcttcatgtaccccagtagcatctaaagataatttgaaggtttggaggatcatgcttttcttctagattttatctaaagctgtccttgtaagggttgtgttcaggttgagagttagcaggttgagctgtctatttgagaaccctttaaagttctccaagttttggtgttatgaatcacttgaaacattattatatggagttgaagttagaactgagttaatttgccatatttttgtatgatgatgcgttaatcttatatgctctcgttgcatcttgagcaacggttatgtgatttcatgagcctttcatgagcctgctatctctggctctattggtcgttaactagtagttttgtttcatgatgctccggaatggccagtggtataaagtaccatgtcagtgacacagtgtaagacgtaataatggtaaatatataaatgcccctgatgctccggaaccggagtaaccgttgc

SEQ ID NO: 2369 - DNA, 648 bp, Saccharum officinarum
tcccactcgacctccgaacccatcgtctccggcggcagcagcggcagcggcgagatggtgaaggggcgcacggggcagcgcgtgaggctctacgtccggggcaccgtcctcggatacaagaggtccaagtcgaaccagtacgagaccacgtcgctggtgcagatcgagggggtgaacaccaaggaggacgtcgcctggtactgcggcaagcggatggcctacatctacaaggccaagaccaagagcagcggcacccactaccgctgcatctggggcaaggtcacccgcccgcacggcaactccggcgtcgtccgcgccaagttcaggtccaacctgccgccggaatccatgggccgcaaggtcagggtcttcatgtaccccagcagcatctaaagataatttcgaggtgtggaggactgtgcttttcttctagattttatcttccttaaactgtcattgtaagggttgtgttcaggttgagagttagcaggttgagctgtctatttgagaaccctttaaagttctccaagttttggtgttatggaccgcttgaaacattatatggagtttaagttagaactgagttatctgccatattttttgtatgatgattgcgttaatggtatatgctctcatcgcatcttgagc

SEQ ID NO: 2370 - DNA, 746 bp, Panicum virgatum
cttcccttcgtagttgcgccgtcccctcccatccccagcaccccacctccgaagctctcggctccggcggcaacggcgagatggtgaaggggcgcactgggcagcgcgtgaggctctacgtccggggcaccatcctcggatacaagaggtccaagtcgaaccagtacgagaacacgtcgctggtgcagatcgagggggtgaacaccaaggaggacgtcgcgtggtactgcggcaagcggatggcgtacatctacaaggccaagaccaagagcagcggcacccactaccgctgcatctggggcaaggtcacccgcccgcacggcaactctggcgtcgtccgcgccaagttcaagtccaacctgccgccggagtctatggggcgcaaggtcagagtcttcatgtaccccagcagcatctaaagataatttcaagatgtggaggattgtgcttatctgctaggttgtcttgagctaaaaagttccttgtaaggggtctgttcaggttaagagttagcgacatgaactgtctatttgagaaccatttgaagttctccctggttttggtgttgtggacctaaatcttatatggagttgaagttggaactgaaagtaatttgtcatgttttgttcgtagcccacattgcatcagttgtcgggttctgaatcagttattgaccaaaaggctatgccggcacaaacaaatttgtgtttttgaaattcaaaaggacccaaatttgagtccgaggg

SEQ ID NO: 2371 - DNA, 631 bp, Panicum virgatum
cttcgtggttgcgccgtcccctcccctcccgagcactccacctccggcggcagagcggcagcggcgagatggtgaaggggcgcactgggcagcgcgtgaggctctacgtccggggcaccatcctcggatacaagaggtccaagtcgaaccagtacgagaccacgtcgctggtgcagatcgagggggtgaacaccaaggaggacgtctcgtggtactgcggcaagcggatggcgtacatctacaaggccaagaccaagagcagcggcacccactaccgctgcatctggggcaaggtcacccgcccgcacggcaactctggcgtcgtccgcgccaagttcaagtccaacctgccgccggagtctatggggcgcaaggtcagagtcttcatgtaccccagcagcatctaaagataatttcaagatgtggaggattgtgcttatctgctaggtttatcttgagctaaaatgttccgtgtaaggggtctgttcaggttgagagttagcaacatgaactgtctatttgagaaccctttgaagttctccctggttttggtattgtggaccacctaaatcttatatggagttgaagttagaactgaaagtaatttgtcatattttgttcgttgcacatt

SEQ ID NO: 2372 - DNA, 1028 bp, Panicum virgatum
gggcacgtctgtcttcttttcaagtttttagaatgccgatgcatcacaaaaataacgggccagatttttgtccttttttagaagcgctagtgttttggcccattcgtactgaaaaataactggagccagcacatgggccttacaagtacccggcccatttatagcaccgggcgtgaagtgtaaaggaaaccctagcccaccatatccgcaataattatacggaatgcatcgatcaggaccgtcgatacatcaaccatccaatcccagccgttcactcgtgaaaccgaaggatacttaacccctgctagcgccgcctgctagggtttcttcccttcgtggttgcgccgtcccctcccctcccgagcactccccctccggcggcagagcggcagcggcgagatggtgaaggggcgcactgggcagcgcgtgaggctctacgtccggggcaccatcctcggatacaagaggtccaagtcgaaccagtacgagaccacgtcgctggtgcagatcgagggggtgaacaccaaggaggacgtctcgtggtactgcggcaagcggatggcgtacatctacaaggccaagaccaagagcagcggcacccactaccgctgcatctggggcaaggtcacccgcccgcacggcaactctggcgtcgtccgcgccaagttcaagtccaacctgccgcggagtctatggggcgcaaggtcagagtcttcatgtaccccagcagcatctaaagataatttcaagatgtggaggattgtgcttatctgctaggtttatcttgagctaaaatgttccgtgtaaggggtctgttcaggttgagagttagcaacatgaactgtctatttgagaaccctttgaagttctccctggttttggtattgtggaccacctaaatcttatatggagttgaagttagaactgaaagtaatttgtcatattttgttcgttgcgcattgcatcagttgtctgggttcgaaatcagagatgatatatacttctgttttcatttgcatgcctaaaca

SEQ ID NO: 2373 - DNA, 732 bp, Hordeum vulgare
gagcccctcgtctccggcggcggtaggaagaagcagcagcggcggcagcagcaatggtgaagggacgcacggggcagcgcgtcaggctctacgtcaggggcaccatcctcggcttcaagaggtccaagtcgaaccagtacgagaacacgtcgctggtgcagatcgagggggtgaacaccaaggaggacgtggcgtggtacggcggcaagcgcctggcgtacgtgtacaaggccaagaccaagagcaacggcacccactaccgctgcctctggggcaagatcacccgcccgcacggcaactccggcgtcgtccgcgcccagttcaagtccaacctccccgccgagtccatggggcgcaaggtcagggtgttcatgtacccgagcagcatctaaggttaattcgagctagggccagtaatgcttgtttcttgcgattgtcatgagctgagaaatgtcattttatggtgaatcgaatctatgttggtgactgaaactgttcatgtattcggagaacctgtggaagttttggctagacttgtttgtcaaatgtgcggaccattttagtatttctatatcagcactaaagcgtaatctcatgagttcttgactgttttgcaatgtttgtgactttgtgtgttatctcagatgttctgtgctgtttgatgcttatgataatatgttgaagaagatgcatccgcaggtaaagtggtgatccaaaatcctgatgccagca

SEQ ID NO: 2374 - DNA, 976 bp, Setaria italica
atggagaccgaatttttcgtacttgatagggaacaagagacatccacccccaagagagctagggttacttacccacggaagaagaacacgatccacgcccggatgggtctcaactccacaccactagaataccggaggagtacgctgcggccgcggcgtctgcggactcaggagcggcgccggagggaggccacaccggcgtcgagctcggccgcgccggagggaggctgtggcgtctacccccaacctgcgcgagctctcttctccggcggcggaagcggaaggaagcaggcggccacaatggtgaagggacgcacggggcagcgcgtgaggctctacgtccggggcaccatcctcggatacaagaggtccaagtcgaaccagtacgagaccacgtctctggtacagatcgagggggtgaacaccaaggaggacgtcgcgtggtacgccgggaagcgcatggcgtacatctacaaggccaagaccaagagcagcgagacccgctacaggtgcatctggggcaaggtcacccgcccgcacggcaactccggcgtcgtccgcgccaagttcaagtccaacctccccccggagtccatggggcgcaaggtcagagtgttcatgtacccgagcagcatctgaggttctgttggagtaggaatggtcatgcttatttcttcccttgagctgaaaatgccatgttttggtgaacccgtgacgtgttggcaccttagattgttcatgtactgagaacctgtggaagttttgccaaaaatttgttatcgaacagatggaccattgtcttaatgttatgctagcaccagagcttatttgtccatcagttggttatttgattctgttaacagccttattttccctcatctgcttgccgtgttcgtgcgccatgtatccgctgcagtatggatgtgatgttttcgtgcctgaatgtttctggttgctgaaaggcgttcattcagtg

SEQ ID NO: 2375 - DNA, 821 bp, Zea mays
atttaagctggcgaccgtccgctggaggctggactctgcgagacgatcgaggccgttcgttcttctctccgcctgcggccgtctcgttgtcttccccaatctgcacgagctctctctctctccgtatccggcggcggaagcggaagcggaagcggaaggaagtaggcggccaccatggtgaagggacgcacggggcagcgcgtcaggctctacgtccggggcaccatcctcggatacaagaggtccaagtcgaaccagtacgagaccacgtcgcttgtgcagatcgagggggtgaacaccaaggaggacgtcgcgtggtacgctggcaagcgcatggcgtacatctacaaggccaagaccaagagcagtgagacccgctacaggtgcatctggggtaaggtcacccgcccgcacggcaactccggcgttgtccgcgccaagttcaagtcgaacctcccgcctgagtctatggggcgcaaggtcagagtgttcatgtaccctagcagcatttaaggttttgttggagtaaagatggactaaaaatgtcatgcgtatttcttacttttttctgagcttaaaatgctatttgttggcaacttagattgttcatgcagtcatgcacttgaccggtggaagttctgtctaaatttgttgtcgaacggatgaactatatattgtcggtgttatgccagcagcagagcttattttgtcccgtgccaccgatgtccgatgctatctcttcaacagatcccctatcatatccgctatttcaaactacactttataaatattgtcatcaacggttccgcgcccccgatttt

SEQ ID NO: 2376 - DNA, 625 bp, Avena sativa
atcgtcatccccacgaagcctccccaaacctccgagctctcgtccccgtcggcggaaggaagcagcagccatggtgaagggacgcaccggccagcgcgtcaggctctacgtccggggcaccatcctcggattcaagaggtcgaagtcgaaccagtacgagaacacctcgctggtgcagatcgagggggtcaacaccaaggaggacgtggcgtggtacgccgggaagcgcttggcgtacgtctacaaggccaagaccaagagcaacgggacccactaccgctgcctctggggcaaggtcatccgcccgcacggaaactccggcgtcgtccgcgcccagttcaagtccaacctccccgcggagtccatggggcgcaaggtcagggtgttcatgtacccaagcagcatctaaggttttgttgatctagggccagtaatgcttatttcttgctattgtcatgagctgaaaatgtcatttgtggcgaatctatcctatgttggcaacttaaaaactgttcatgtattcagagaacctgtcgaagttttggcttgttgaatgtgtggaccttttagcattttatatcagcactaaaatagtaatttgccagtgaacaaaaaaaaaaaaaaa

SEQ ID NO: 2377 - DNA, 943 bp, Sorghum bicolor
cacgaccgttcgttggaacctgcgagccaatcgagaccgctcttccgtccatccgctgctacatataaggcgcctccggccgtcctctgtctcgtctccggcggcggaagcgtaagcggaaggaagcaaggcggccaccatggtgaagggacgcacgggacagcgcgtgaggctctacgtccggggcaccatcctcggatacaagaggtccaagtcgaaccagtacgagaccacgtcgctggtgcagatcgagggggtgaacaccaaggaggacgtcgcgtggtacgctggcaagcgcatggcgtacatctacaaggccaagaccaagagcagcgagacccgctacaggtgcatctggggcaaggtcacccgtccgcacggcaactccggcgtcgtccgcgccaagttcaagtccaaccttccgcctgagtccatggggcgcaaggtcagagtgttcatgtacccgagcagcatctaaggttttattggagtacagatggactaggagtggccatgcttatttcttacttttctctgagcttaaaatgccatgtgttggcaagttagattgttcaagtactgaacctgtggaagtcctgccaaaatttgttgtcaaacggatgaactattgtcgtaatgttatgccagcagcatatctcattttgccccgtgccatcggtgtctgattgcagtattttcaaattcatatagccatattttacacttgtttaccttgtgttcgtctgccacgtctctagtgttgaaaagagtttagtttggtgtgaatgtgtagtattctacgctgctctgggatgttttttttttcaaaaccatttgtgcaaaatttatgggcacaggaggccctagccctactaggtgatttgtgtcctggggggtctagctatctttttcttttacatagtgtaaacagtgctgaaagaca

SEQ ID NO: 2378 - DNA, 885 bp, Sorghum bicolor
atggactctgcgagacgatcaaggccgttcttctcttcgtccgctgctccatacaagccgcctgccccgcctccggcccgtctcgttgtcttccccaatctgcacgagctgtctatcgtctccggcggcggaagcggaaggaagcagaggcggccaccatggtgaagggacgcacggggcagcgcgtcaggctctacgtccggggcaccatcctcggatacaagaggtccaagtcgaaccagtacgagaccacgtcgctcgtgcagatcgagggggtcaacaccaaggaggacgtcgcgtggtacgccggcaagcgcatggcgtacatctacaaggccaagaccaagagcagtgagacccgctacaggtgcatctggggtaaggtcacccgcccgcacggcaactccggtgtcgtccgcgccaagttcaagtcgaacctcccgcctgagtccatggggcgcaaggtcagagtgttcatgtaccctagcagcatctaaggttttgttggagtaaagatggactagaaatggccatgcgtatttcttacttctctgagcttaaaatgccatgtgttggcaacttagattgttcatgtactgaacctgtcgaagttctgccaaaatttgttgtcgaacggatgaactattgtcatattgttatgcccgcagcagagcatatttttgccccgtgacatcaatgtctgattgcagtattttcaagttcttgtgccacgtctcgaataccatcgtgcaatatgatgtcggtgtgggtgtgtgatatcttttacactgctctgagattctctgatgctttgatgtacgctttttcaaaaccatttctgcaaaatttatggacacacgattagctggtggcgatgtacctggc

SEQ ID NO: 2379 - DNA, 721 bp, Saccharum officinarum
gcacgagctctctatcgtgtccggcggcggaagcggaaggaagcaggcggccaccatggtgaagggacgcacggggcagcgcgtcaggctctacgtccggggcaccatcctcggatacaagaggtccaagtcgaaccagtatgagaccacgtcgctcgtgcagatcgagggggtgaacaccaaggaggacgtcgcgtggtacgctggcaagcgcatggcgtacatctacaaggccaagaccaagagcagtgagacccgctacaggtgcatctggggtaaggtcacccgcccgcacggcaattccggcgtcgtccgcgccaagttcaagtcgaacctcccgcctgagtccatggggcgcaaggtcagagtgttcatgtaccctagcagcatctaaggttttgttggagtaaagatggactagaaatggccatgcgtatttcttacttctctctgagcttaaaatgccgtgttggcaacttagattgttcattactgaacctgttgaagttctgccaaaatttgttgcccaacggatgaactattgtcatattgttatgtccgcagcagagcttattttgccccgtgacatcagtgtctgattgcagtattttcaaattcctatagtactttccctattgtctacaatggttttgaagcacaatggtatttgagatgcggcacaagaacattgtagacaatagggaaagtactattgtgcttc

SEQ ID NO: 2380 - DNA, 746 bp, Saccharum officinarum
cggcgtaagcggaaggaagcaggcggcaaccatggtgaagggacgcacgggacagcgcgtcaggctctacgtccggggcaccatcctcggatacaagaggtccaagtcgaaccagtacgagaccacgtcgctcgtgcagatcgagggggtgaacaccaaggaggacgtcgcgtggtacgctggcaagcgcatggcgtacatctacaaggccaagaccaagagcagtgagacccgctacaggtgcatctggggcaaggtcacccgcccgcacggcaactcgggcgtcgtccgcgccaagttcaagtccaacctcccgcctgagtccatggggcgcaaggtcagagtgttcatgtacccgagcagcatctaaggttttgttggagtacagatggactaggaatggccacgcttatttcttacttttctctgagcttaaaatgccatgtgttggcaacttagattgttcatgtactgaacctgtggaagttatgccaaaatttgttgccagacggatgaactattgtagtaatgttatgccagtagcagagcttattttgccccgtgccatcgatgtctgattgcagtattttcaaattcatatagccatattttaacactgggtggcctcatggtcggctgccacgtctaaaatgttgaaaatagttttctttggggggaatgtggaataattcttctcatgctagaaaaatttgtaatcttatcaatataatgggggggactatttc

SEQ ID NO: 2381 - DNA, 810 bp, Panicum virgatum
ggcagatgcagccgacaggcaggggaacctgcgcgagctctcgtctccggcggcggaagcggaaggaagcaggcggccaccatggtgaagggacgcacggggcagcgcgtcaggctctacgtccgtggcaccatcctcggatacaagaggtccaagtcgaaccagtacgagaccacgtcgctggtgcagatcgagggggtgaacaccaaggaggacgtcgcgtggtacgccggcaagcgcatggcgtacatctacaaggccaagaccaagagcagcgagacgcgctacaggtgcatctggggcaaggtcacccgcccgcacggcaactccggcgtcgtccgcgccaagttcaagtccaacctcccgccggagtccatgggacgcaaggtcagagtgttcatgtacccgagcagcatctaaggttttgttgaagtagggatggccatggttatttcttacttatcttgagctgaaaattccatgttttggtgaacccctgctgtgttggcaacttagattgttcatgtactgcgaacgtggaagttttgccaaaatttgttgtctaaaggatgaaccattatcgtgatgttatgccagcaccagagcttattttgagcatcagatgccttgccattgttgtttaatattattatcttccaagatcctacgggctacgggtatattttcccctgtggtcagtctgccatgttcatgcgccatatatatcaaataacgtgcaatgtggatgtgatgtttttgtgcttttgttcctgtagccagtgcatttctttattgaggatgtatgtttag

SEQ ID NO: 2382 - DNA, 473 bp, Triticum aestivum
aaacgaagcaagcggccgccatggtgaagggacgcacgggacagcgcgtcaggctctacgtccggggcaccatccttggatacaagaggtccaagtcgaaccagtacgagaccacgtctctcgtgcagatcgagggggtgaacaccaaggaggatgtcgcgtggtacgctggcaagcgcatggcgtacatctacaaggccaagaccaagagcaatgagacccgctacaggtgcatctggggcaaggtcacccgtccgcacggaaactcgggcgtcgtccgtgccaagttcaagtccaacctcccgcctgagtccatggggcgcaaggtcagagtgttcatgtacccgagcaacatctaaggttttgttggagtaaagatggactagaaatggcatgtgtttaattctcacttttctctgaacttaaaatgcctgtgttggtaactaaattgttcaagtgctgaacctgtggaa

SEQ ID NO: 2383 - DNA, 1274 bp, Panicum virgatum
gtagcggcgccggagggaggccgcacctgcgtggagctcggccgcgccggaggcaggctgggcgcgcgcgtggagaagtcggtcggggagggagggctgggtgcccggttcgttttttttttctttttccctcctgcttgcgattctgacacgactatagtcgtgtgcctgggaccactgtcagagagataccacgggataagacatttatttgcaatcgagcccattagatagcccagcaggcccagaatggcccagatgggaagacgaaaactgaagcccagtaacccaaccggcccgtttaacctcgcgaccctaaaccctagcttcccccgaccccttcgagagatccgcactgtccgtttggacccgtgagctgatcctggccgttggtctgtccgtcccctgctctacatataagccgcctccggcgcgcgccgtctcagcgtcttcctcaacctgcgcgagctctcgtctccggcggcggaagcggaaggaagcaggcggccaccatggtgaagggacgcacggggcagcgcgtcaggctctacgtccgtggcaccatcctcggatacaagaggtccaagtcgaaccagtacgagaccacgtcgctggtgcagatcgagggggtgaacaccaaggaggacgtcgcgtggtacgccggcaagcgcatggcgtacatctacaaggccaagatcaagagcagcgagacgcgctacaggtgcatctggggcaaggtcacccgcccgcacggcaactccggcgtcgtccgcgccaagttcaagtccaacctcccgccggagtccatgggacgcaaggtcagagtgttcatgtacccgagcagcatctaaggttttgttgaagtagggatggccatggttatttcttacttatcttgagctgaaaattccatgttttggtgaacccctgctgtgttggcaacttagattgttcatgtactgcgaacgtggaagttttgccaaaatttgttgtctaaaggatgaaccattatcgtgatgttatgccagcaccagagcttattttgagcatcagatgccttgccattgttgtttaatattattatcttccaagatcctacgggctacgggtatattttcccctgtggtcagtctgccatgttcatgcgccatatatatcaaataacgtgcaatgcggatgtgatgtttttgtgcttttgttcctgtagccaatgcatttcatttattgaggatgtatgtttagaatatcttgtcctaataattctggttgactga

SEQ ID NO: 2384 - DNA, 1038 bp, Brachypodium distachyon
atcggccgcctcccatataaagcgcctccaacgcgcgccgtcgcatcgccctcaagaagcctccaccaaactccccagctctcgtctccggcggcggaaggtaaacagcagcagccatggtgaagggacgcacgggacagcgcgtcaggctctacgtcaggggcaccatcctcggattcaagaggtcgaagtcgaaccagtacgagagcacttcgctggtgcagatcgaggggctcaacaccaaggaggacgtgtcgtggtacgccggcaagcgcatggcgtacgtctacaaggccaagaccaagagcagcggcacccactaccgctgcatctggggcaaggtcacccgcccgcacggcaactccggtgtcgtccgcgcccagttcaagtccaacctcccggcagagtccatggggcgcaaggttagggtgttcatgtacccaagcagcatctaaggttttattgaactagggccagtaatgcttatttcttacttttgccgtgagcccaaaatgtgatgaatctatgctatgttggcaattgaaactgttcgccatgtattcagggaccctgttgaagttttggttagactcgttgtgaaatgtgcggaccattttagtattgttatatcagcactgaagcgtaatttgccatcactttatttgcgttgtttgcattttttaccaccagccgtttttggttctcaccaagttgatttcgatgatggttcagtgctgttcttttgtttataaattccttttgtggattaacgctcatggtatgcccagtttctgaccattgggaatcggcattgctgaccagtgaccaagtagttgtatctaaataatcatattgtatgcgccggctttattttctacttaatcttttcatttggaaaaccttcatctaagttgaattgccaggtagacgccagcttaaatatagtcgattcaataactgtgtaaagcaagtatcgaactatttctcatcccattaagttacactgttggattagccaagttccttgcagaagtgcgt

SEQ ID NO: 2385 - DNA, 835 bp, Zea mays
gggagctgatggagtgatgagcacgagacgtgctatttgcaattaggcctgtcatgttgctggtccatcttttatcagatggaaagacaaaaaaaaaacgaaaaagcgttttaacacctcgcgatctaaaaccctagctttctccagacagcccttcggaacatcaggaccgttggttgcaatctgcgagccaatcgagaccgctcttctctacttccgctgctacatataaacctgcacgagctctctctcgtctccggcggcggaagcagaagtggaaggaagcaggcggccaccatggtgaagggacgcacgggacagcgcgtcaggctctacgtccggggcaccatcctcggatacaagaggtccaagtcgaaccagtacgagaccacgtcgctcattcagatcgagggggtgaacaccaaggaggacgtcgcgtggtacgctggcaagcgcatggcgtacatctacaaggctaagaccaagagcagcgagacccgctacaggtgcatctggggcaaggtcacccgcccgcacggcaactcgggcgtcgtccgcgccaagttcaagtccaacctcccgcctgagtccatggggcgcaaggtcagagtgttcatgtacccgagcagcatctaaggttaggtttttgttggagtaaaggtggactctaaatggccatgcttagttcttctctctgagcttaaaatgccatgtgttggcaacttagattgttcatgtactgaacctgttgaagttctaccaaaatttgttgtcgaacggctgaacagttgtcctaatgttatgctataaacagagcttatttccccccgtgcca

SEQ ID NO: 2386 - DNA, 619 bp, Avena sativa
gatcgtcatccccacgaagcctcccccaaacctccgagctctcgtctccggcggcggaaggaagcagcaaccatggtgaagggacgcaccggccagcgcgtcaggctctacgtccggggaaccatcctcggattcaagaggtcgaagtcgaaccagtacgagaacacctcgctggtgcagatcgagggggtcaacaccaaggaggacgtggcgtggtacgccgggaagcgcttggcgtacgtctacaaggccaagaccaagagcaacgggacccactaccgctgcctctggggcaaggtcatccgcccgcacggcaactccggcgtcgtccgcactcagttcaagtctaacctccccgccgagtccatggggcgcaaggtcagggtgttcatgtacccaagcagcatctaaggttttgttgaactagggccagtaatgcttatttcttgctagtgtcatgagctcaaaatgtcatttgtggcgaatctatcctatgttggcaacttaaactgttcatgtattcagaaaacctgtggaagttttggcttgttgaatgtgtggaccttttagtattttatatgagcactaaaaatagtaattcgcctgtgagcttaaactc

SEQ ID NO: 2387 - DNA, 668 bp, Pseudoroegneria spicata
gccctcaacccccgagctcctcgtctccggcggcggaaggaagcagcagcaccggcagccatggtgaagggacgcacggggcagcgcgtcaggctctacgtccggggcaccatcctcgggttcaagaggtcgaagtcgaaccagtacgagaacacgtcgctggtgcagatcgagggggtgaacaccaaggaggacgtggcgtggtacgccgggaagcgccttgcgtacgtgtacaaggccaagaccaagagcaacggcacccactaccgctgcctctggggcaagatcacccgcccccacggcaactccggcgtcgtccgcgcccagttcaagtccaacctccccgccgagtccatggggcgcaaggttagggtgttcatgtacccgagcagcatctaaggtttttcgaactagggccagtaatgcttgtctcttgtgattgtcatgagctgagaaatgtcattttatggtgaatctatgctatgttgacaactgaaactgttcatgtattccgagaacctgtagacttgtttgtcaaatgtgcggaccattttagtatttctatatcagcaccacagcgtaatttctcatcagtttttgactgttttgcaatgttcgcgtgatgttctgtgcttttcaatgcctatgtttaacatataagatgatga

SEQ ID NO: 2388 - DNA, 897 bp, Oryza sativa
aatcacagccgtagaaaaatctgcaccggaagatcgccgccgttcatttctgctactgacgggtacataagagctaccagcgccgctggctagggtttcttcttcccctcgtggccgcgcctccgaaacccccacctccgcgagctcccagtctctctccggcggcagaagcggcggcgacgacgagatggtgaagggacgcaccgggcagcgcgtgcggctctacgtccgcggcaccatcctcggatacaagaggtcgaagtcgaaccagtacgagaacacgtcgctggtgcagatcgagggggtgaacaccaaggaggaggtggcgtggtactgcgggaagaggatggcgtacgtgtacaaggccaagaccaagagcggcggcacgaactaccgctgcatctggggcaaggtcacccgcccccatggcaactccggcgtcgtccgcgccaagttcaagtccaacctgccccccgcttccatggggcgcaaggtcagagtcttcatgtacccgagcagcatctaaagactcttgaagtgtggaggatgttgcttatctctcttagattttacttctggctgaaaatgtcttgaaaggagccgtattcatgttgagtttgcaagttgaactgctgttccctgagaacccctggaagttctccgtagttttgatgtcgaatgtatgcaccacttctattatattatgtcatatggacttatgatggagtcagggttggaacttgtaagcttgatttgtcatgtttcacagcatctatcttcttcgtatcatttgctcgcatttctgagtcacaaccactgttattccctcagttttcttagttgcagtttgctttcttcgaagtggaaagctgaatcagatttgacaagctagaactc

SEQ ID NO: 2389 - DNA, 708 bp, Triticum aestivum
tggaaggaagcaggcggccaccatggtgaagggacgcacgggacagcgcgtgaggctctacgtccggggcaccatcctcggatacaagaggtccaagtcgaaccagtacgagaccacgtcgctgatgcagatcgagggggtgaacaccaaggaggacgtcgcgtggtacgctggcaagcgcatggcgtacatctacaaggccaagaccaagagcagcgagacccgctacaggtgcatctggggcaaggtcacccgtccgcacggcaactccggcgtcgtccgcgccaagttcaagtccaaccttccgcctgagtccatggggcgcaaggtcagagtgttcatgtacccgagcagcatctaaggttttattggagtacagatggactaggagtggccatgcttatttcttacttttctctgagcttaaaatgccatgtgttggcaagttagattgttcaagtactgaacctgtggaagtcctgccaaaatttgttgtcaaacggatgaactattgtcgtaatgttatgccagcagcatatctcattttgccccgtgccatcggtgtctgattgcagtattttcaaattcatatagccatattttacacttgtttaccttgtgttcgtctgccacgtctctagtgttgaaaagagtttagtttggtgtgaatgtgtagtattctacgctgctctgggatgtttttttttc

SEQ ID NO: 2390 - DNA, 1016 bp, Panicum virgatum
aacgaaactaatcgagccatggatagattgactaagctcctagggcacaaaactgcacgcaattcggcaactaacaaaatggagatcggaagtttccaacttgattgtaaacaaggggcaaccaccccaagcgagctagggttacttacccacggaagaaggacacgatccacgcccagatgggtctcaactccacaccaatagaccgcgggagaagagaccctgcgccgccgccggctccggattgtgtgcctgggaccactcgtcttccccaacctgcacgagctctcgtctccggcggcggaagcggaaggaagcaggcggccaccatggtgaagggacgcacggggcagcgcgtcaggctctacgtccggggcactatcctcggatacaagaggtctaagtcgaaccagtacgagaacacgtcgctggtgcagatcgagggggtgaacaccaaggaggacgtcgcgtggtacgccggcaagcgcttggcgtacatctacaaggccaagaccaagagcagcgagacccgctacaggtgcatctggggcaaggtcacccgcccgcacggcaactccggcgtcgtccgcgccaagttcaagtccaacctcccgccggagtccatgggacgcaaggtcagagtgttcatgtacccgagcagcatctaaggttttgttggagtagggatggccatgattatttcttacttatcttgagctgaaaattccatgttttggtgaaccactgctgtgttggcaacttagtttgttcatgtactgagaacatgtgtaagttttgccaaaatttgttgtctaaaggatgaaccattatcgtaatgttatgccagcaccagagcttattttcagcatcagatgccttgccatttttttattatcttcaatttcctacggcaatattttccctgtggtcagtttgccattttcatgctccataatatatattatgtatcaaataacgtgcaatgtggatgtgatgttttttttcgcttttgttcc

SEQ ID NO: 2391 - DNA, 856 bp, Brachypodium distachyon
aaatatcggccgcttactacatacacataaggcgcctccaacgcgcgccgtcgcatcgccctcaagaagcctccaccaaactacccagctctcgtctccggcggcggaaggtaaacagcagcagccatggtgaagggacgcacgggacagcgcgtcaggctctacgtcaggggcaccatcctcggattcaagaggtcgaagtcgaaccagtacgagagcacgtcgctggtgcagatcgaggggctcaacaccaaggaggacgtgtcgtggtacgccggcaagcgcatggcgtacgtctacaaggccaagaccaagagcagcggcacccactaccgctgcatctggggcaagatcacacgcccgcacggcaactccggtgtcgtccgcgcccagttcaagtccaacctcccggcagagtccatggggcgcaaggtcagggtgttcatgtacccaagcagcatctaagaatggagggagtattagtttttgaagctggagagttctgcctggtactttctaggaagtcatgtaattcactaatggatgccgtatttctcagtaaagaatggattaacaattacaaattgtttgtagacaagaatgagtcagcatgttctgatgattgaatagtatcaaaatcaaatgtttggaacatactccctccgttccaaaaaggagggcgcataacctcttgcagccaaaccaatgcagggcaaagttatctcattttggacctgtttgccttttgagtagtactctgtgcgtgcgcaatctcctcttgctgtgggctgctgtcgctatcactagtcagctccttgcatgcaaacaattcggaagaatttgcattgggcccacc

SEQ ID NO: 2392 - DNA, 700 bp, Secale cereale
gtcgccctctcccccacgaagcacccccaacccccgagctcctcgtctccggcggcggaaggaagcagcggcagccatggtgaagggacgcacggggcagcgcgtcaggctctacgtccggggcaccatcctcgggttcaagaggtccaagtcgaaccagtacgagaacacgtcgctggtgcagatcgagggggtgaacaccaaggaggacgtggcgtggtacgccgggaagcgcctggcgtacgtctacaaggccaagaccaagagcaacggcacccactaccgctgcctctggggcaagatcacccgctcgcacggcaactccggcgtcgtccgcgcccagttcaagtccaacctccccgccgagtccatggggcgcaaggtcagggtgttcatgtacccgagcagcatctaagggttttccgaactaggaccagtaatgcttgtttcttgtgattgtcatgagccgagaaatgtcattttatggtgatgaatctatgctatgttggcaactgaaactgttccatgtattctgagaacctatggaagttttggctagacttgtttgtcaaatgtgtggaccatttcagtattactatatcagctctaaagcgtaatttctcctcggtttttgactattttgcaatgtttgcgtgatgttctgtgctgtttgattcctatgataaacatacgagattat

SEQ ID NO: 2393 - DNA, 657 bp, Secale cereale
cgtctccggcggcggaaggaagcagcggcagccatggtgaagggacgcacggggcagcgcgtcaggctctacgtccggggcaccatcctcgggttcaagaggtccaagtcgaaccagtacgagaacacgtcgctggtgcagatcgagggggtgaacaccaaggaggacgtggcgtggtacgccgggaagcgcctggcctacgtctacaaggccaagaccaagagcaacggcacccactaccgctgcctctggggcaagatcacccgctcgcacggcaactccggcgtcgtccgcgcccagttcaagtccaacctccccgccgagtccatggggcgcaaggtcagggtgttcatgtacccgagcagcatctaagggttttccgaactaggaccagtaatgcttgtttcttgtgattgtcatgagccgagaaatgtcattttatggtgatgaatctatgctatgttggcaactgaaactgttccatgtattctgagaacctatggaagttttggctagacttgtttgtcaaatgtgtggaccatttcagtattactatatcagctctaaagcgtaatttctcctcggtttttgactattttgcaatgtttgcgtgatgttctgtgctgtttgattcctatgataaacatacgagattat

SEQ ID NO: 2394 - DNA, 649 bp, Secale cereale
agcagcggcggcagccatggtgaagggacgcacggggcagcgcgtcaggctctacgtccggggcaccatcctcgggttcaagaggtccaagtcgaaccagtacgagaacacgtcgctggtgcagatcgagggggtgaacaccaaggaggacgtggcgtggtacgccgggaagcgcctggcctacgtctacaaggccaagaccaagagcaacggcacccactaccgctgcctctggggcaagatcacccgctcgcacggcaactccggcgtcgtccgcgcccagttcaagtccaacctccccgccgagtccatggggcgcaaggtcagggtgttcatgtacccgagcagcatctaaggttttttcgaactaggaccagtaatgcttgtttcttgtgattgtcatgagccgagaaatgtcattttatggtgatgaatctatgctatgttggcaactgaaactgttcatgtattctgagaacctgtggaagttttggctagacttgtttggcaaatgtgtggaccatttcagtatttctatatcagctctaaagcgtaatttctcctcggtttttgactattttgcaatgtttgtgtgatgtccatgtgctgttcgattcctatcgagattatgaaacatgtgcaaaaagtc

SEQ ID NO: 2395 - DNA, 601 bp, Secale cereale
gcggcagccatggtgaagggacgcacggggcagcgcgtcaggctctacgtccggggcaccatcctcgggttcaagaggtccaagtcgaaccagtacgagaacacgtcgctggtgcagatcgagggggtgaacaccaaggaggacgtggcgtggtacgccgggaagcgcctggcctacgtctacaaggccaagaccaagagcaacggcacccactaccgctgcctctggggcaagatcacccgctcgcacggcaactccggcgtcgtccgcgcccagttcaagtccaacctccccgccgagtccatggggcgcaaggtcagggtgttcatgtacccgagcagcatctaaggttttttcgaactaggaccagtaatgcttgtttcttgcgattgtcatgagccgggaaatgtcattttatggtgatgaatctatgctatgttggcaactgaaactgttcatgtattctgagaacctgtggaagttttggcaaatgtgtgaaccatttcagtattactatatcagctctaaagcataatttacccctaaaaaaaaaaaactaacgaagactgtccaacgacacacagggagtaggggggggggg

SEQ ID NO: 2396 - DNA, 700 bp, Panicum virgatum
aacctgcacgagctctcgtctccggcggcggaagcggaaggaagcaggcggccaccatggtgaagggacgcacggggcagcgcgtcaggctctacgtccggggcactatcctcggatacaagaggtctaagtcgaaccagtacgagaacacgtcgctggtgcagatcgagggggtgaacaccaaggaggacgtcgcgtggtacgccggcaagcgcttggcgtacatctacaaggccaagaccaagagcagcgagacccgctacaggtgcatctggggcaaggtcacccgcccgcacggcaactccggcgtcgtccgcgccaagttcaagtccaacctcccgccggagtccatgggacgcaaggtcagagtgttcatgtacccgagcagcatctaaggttttgttggagtagggatggccatgattatttcttacttatcttgagctgaaaattccatgttttggtgaaccactgctgtgttggcaacttagtttgttcatgtactgagaacatgtgtaagttttgccaaaatttgttgtctaaaggatgaaccattatcgtaatgttatgccagcaccagagcttattttcagcatcagatgccttgccattttttttattatcttcaatttcctacggcaatattttccctgtggtcagtttgccatgttcatgctccataatatatattatgtatcaa

SEQ ID NO: 2397 - DNA, 743 bp, Triticum aestivum
ccgaagcccccacccaacccccgagctcctcgtctccggcggcggaaggaagcggcagtcatggtgaagggacgcactggacagcgcgtcaggctctacgtccggggcaccatcctcggcttcaagaggtcgaagtcgaaccagtacgagagcacgtcgctggtgcaggtcgagggggtgaacaccaaggaggacgtggcgtggtacgccgggaagcgcctggcgtacgtgtacaaggccaagaccaagagcaacggcacccactaccgctgcctctggggcaagatcacccgcccgcacggcaactccggcgtcgtccgcgcccagttcaagtccaacctccccgccgagtccatggggcgcaaggtcagggtgttcatgtacccgagcagcatctaaggttttttcgatctagggacagtaatgcttgtttcttgtgattgtcatgagctttttatggtgaatctatgctatgttggcaaccgaaactgatcatgtattctgagaacctgtggaagttttggctagacttgtttgtcaaatgtgcggaccattttagtatatttctatatcagcactaaagcgtaatttgtcatgagtttgtgactgttttccaatgttttagtgttatatcagatgttctctgctgtttgatcttatgataactcaagatatattcctgatgccagcatgaatgatggtctatttatttatgttcttgtggcctgctagtttggcgaacc

SEQ ID NO: 2398 - DNA, 761 bp, Triticum aestivum
gtcgccctctcccacacgaagcccccaccccaacccaccgagctcctcgtctccggcggcggaaggaagcagcagccatggtgaagggacgcactgggcagcgcgtcaggctctacgtccggggcaccatcctcgggttcaagaggtccaagtcgaaccagtacgagagcacgtcgctggtgcaggtcgagggggtgaacaccaaggaggacgtggcgtggtacgccgggaagcgcctggcgtacgtctacaaggccaagaccaagagcaacggcacccactaccgctgcctctggggcaagatcacccgcccgcacggcaactccggcgtcgtccgcgcccagttcaagtccaacctccccgccgagtccatggggcgcaaggtcagggtgttcatgtacccgagcagcatctaaggttttttcgatctagggccagtaatgcttgtttcttgtgattgtcatgagctgagaaatgtcattttatggtgaatctatgctatgttggcaaccgaaactgatcatgtattccgagaacctgtggaagttttggctagacttgtttgtcaaatgtgcggaccattttagtatatttctatatcagcactaaagcgtaatttgtcatgagtttgtgactgttttgcaatgtttgagtgttatatgataggttatctgctgtttgatccatatgataactcagacatatatgatcatgaagcagattgcatccataggtactgctgatccaaattcctgatgcca

SEQ ID NO: 2399 - DNA, 1280 bp, Panicum virgatum
accgaaaatcattgcaagaacgcataagcacgcacaatttttatttggcactataaaaaaaaacttgcaaaaaaaaaagaaagaggagagagagctcatgccggcccactagaaattgcatttagcctgagaactcagattaacgggctgatttcgacgcggccacacgggaaaatttgtgggccggacagggttgccaggctggaccacaatttcttaaggtggactaggcccatcttactgacacgaccgacgcccttcgatgcaatcgcagccgtccaatcaagcaccggaaacttttaaatccccaccaccacaaacctactctactaaggttcattcgctgcgccgccacttctttccactctccccaacctctcaaaccctcgtcggcgaggcctctggcggcggcgaagtatggtgaagggacgccaaggccagcgcgtcaggatgtacgtgcggggcacgatcctgggctacaagcggtccaagtcgaaccagtacgagaacacgtcgctgctgcagatcgagggcgtcagcaccaaggaggatgtggcgtggtacggcggcaagcggatcgcctacgtctacaaggctaagaccaagagcgacggcaccagcatccggtgcatatggggcaaggtgacgcgcccgcacggcaactccggcgtcgtgcgcgccaagttccggtccaacctcccgcccagctccatgggtaagaaggtccgcgtcttcatgtaccccagcagtatctaatcaaggtagaatgccttgcctcaattgttttcatgattcgatatcttatgcggccttgctaagtgttcgatgatgcaagctcttgattgtcgcatgtatcagacttctaatcgaaatgcgattggtgtgatcttagcttgcattttattcttgtgttgtttgtgtgtaagggtcccatgccaattgggggaagctctgcttgtagcttcgaaatacctgcaggttctctgcagggtgctcggaagttggggccctagagcaaatgcagtggtctcatagtacgaggctgtacttggttaatgagtctctcatcaaccggttcctcacagccttgcctccaatgaccacaatattcattatttgtgtcttggcatttgtgttgtctggcgaagtgtagcatgtatgttgggagctttagatgattctgttatttatcgtgtatagtcatacattacctatctgtttaggtgtagcatgtaggtagggagctttagataattcccaaattggtgaccattaggtgc

SEQ ID NO: 2400 - DNA, 2829 bp, Panicum virgatum
ctcatcctcgaagtccgcgtcccgacctcggcaccccgacgccgccctgcgccggccccgtgcgccgccgccacgacctcatccccggcgccgcgccccgacgtcgccctgcactggccacgaccaccacgggtgcactcttggtaccaagatctaggtgtacgactcgttaaggcaagataaatcaaagtaccaagatctcatcgaggtgataaatactgcatggagtcgctacctccgcaaacacataggcttgaaaggtgaaatcgagcctcttcgttggctgactgattttccgtgttggagacaggagctaggaaacaacttatatggatactacgtatgcgagtggatcaacacctatgcgagtgaaaaagggcaaatgacacaggaggtattcaatgtacgtgagcacaatcatatctgctcattatctgtttgcgctcggcctgcgcgtttcagaaatccagaagcatattccattcccacacaccagcgaacttgtccatttctatttagactatactagatagatagtcaccgtgttcagcaggctggagctggagtagtgtgagagaaaaacactgttacctggctggtggctggaggatggagctggagtaacgtgagagagagttactgtagggctggaggctcaatccaccggccgaacagggtgagtaacacaaaactattattttattatggattgtatctaacagttacaagtcatcagagcccaatccttcaaaaggatccagaaatttatttaagttccggagaggaggagcgagaaataaaaatatttgccagtggtttttcttgctgcaggagtcctctttgcccaagtcaatttgtgagcaagctcaggtccacgtcggtgatttgtgatcatcacaagagccggccagggttagttttgtcacgacgatggcgtcacgggggataggaaaaccgaacatctcgatctgcgtggcttgccacttgccggtcatggtcgacacttggcaaagcgcctccgcgttgaggcacacacctaggcctacacacaccacacagaaaatcattgcaagaacacgtcagcacgcatagtatgcaattatgcatgacgcgagagagagagagagagctcatgccggactacactacaagttgcatttttttttttgagaaaccactacaagttgcatttaggcctgagaacccagattaacgggctgatttcgacgcggccacacgggaacatttgtgggccggacagagttgctaggctggaccaccatttcttaaggtgggctaggcccattttactgacgcgccattcgatgcaatcgcagccgtccaatcaagcaccggaaacttttaaatccccaccaccacagacctagggttcattcgctgcgccgtcacttccttccactcccctcaacctctcaaaccctcgtcggcgaggcctccggcggcggcgagtatggtgaagggacgccaaggccagcgcgtcaggatgtacgtgcggggcacgatcctgggctacaagcggtccaagtcgaaccagtacgagaacacgtcgctgctgcagatcgagggcgtcagcaccaaggaggatgtggcgtggtacggcggcaagcggatcgcctacgtctacaaggctaagaccaagagcgacggcaccagcatccggtgcatctggggcaaggtgacgcgcccgcacggcaactccggcgtcgtgcgcgccaagttccggtccaacctcccgcccaactccatgggtaagaaggtccgcgtcttcatgtatcccagcagtatctaaacaaggtatcttccatattcggtcaagcttcctacttttgaggatgtttagctgaaaagtttccatggcgattttgagtagtttagctttgctcttttttttactgaacaggctgttagtcgcaggtccaacttgggtgcaaacagcacacccgtgcaagggtgcaagcagcgcccctgggccgcccgatggtcatcctacggtaccttgtattttcatttttcacacagaagcccccgacggtcctctctccagtgcaaagggaaatcaccaaaacctcccttcctttgcattcatttgtgtttgagctcggcctgggacgacctgtgccgtcgccgtcgggcgtccctgcgccgtcgccgccgggcacgcccaggtcctgcgccgcctctagagccactgggtccatgggcttgcacctgtctcgtggcctcctggccgtcaatggaggtctgctccttcctccgatatgcacggcagtgccctgcccctggtccgctgccgcgctgccgcgctgtcgccaggcggccagggcagatgcgtggccgcaccgccgccaggcgtccagggcagccgcgccctcatgccaatgcggatccacctgcgctgccgctcctccaagcgggcgtgcagtacctccatccgagctggcctgcaggcttcaataggtctgcccctgggccgctgttgcgccggcgccgccttgaagctgatacacctgcgccaccgctcctccaagacggcgtgcagcggtgcccctccatccaagctggcatgtaggctgcagcggttgcctgcagggatgcccgtctatggaatggaagatgttactgtgtaattgttgctctctgtgagatgattgtaatcgattttctgttatgtggtgtgaaaaaaatagcaacatcatttggaatgctgcagccaataaaaagttcatgttcttgtctggtgcgagagcaaggctaaaacaacaatgatagagattctaaattttgtaacagaatatccatgcccctgtc

SEQ ID NO: 2401 - DNA, 622 bp, Pennisetum glaucum
ccagtatccccaacctctcaaaccctcgtcggcgaggcctccgccagcggcgaccatggtgaaggggcgccaaggccagcgcgtcaggatgtacgtgcggggcacgatcctgggctacaagcggtccaagtcgaaccagtacgagaacacctcgctgctgcagatcgagggcgtgagcaccaaggaggacgtggcgtggtacggcggcaagcggatcgcctacgtctacaaggccaagaccaagagcgacggcaccagcatccggtgcatctggggcaaggtcacgcgcccgcacggcaactccggcgtcgtgcgcgccaagttccggtcaaacctcccccccagctccatgggtaagaaggtccgtgtcttcatgtaccctagcagtatctgatcaaggtatcctgcatattcggtcgcacttgtactatgacgagggttccgctggaaagatcccatggaaattttgagtagtctagctctttgctctcttcatttttctactgaacacgctgttattcgcaacctagacgacttgtgtcaattgtataactcgttggccttgtggaatgaaagtaccgtgctttgttaatggtgttcgctgtgttcgctggggtccgtg

SEQ ID NO: 2402 - DNA, 655 bp, Panicum virgatum
ggctcgctgcgccgtcacttccttccactccccccaacctctcaaaccctcgtcggcgaggcctccggcggcggcgagtatggtgaagggacgccaaggccagcgcgtcaggatgtacgtgcggggcacgatcctgggctacaagcggtccaagtcgaaccagtacgagaacacgtcgctgctgcagatcgagggcgtcagcaccaaggaggatgtggcgtggtacggcggcaagcggatcgcctacgtctacaaggccaagaccaagagcgacggcaccagcatccggtgcatctggggcaaggtgacgcgcccgcacggcaactccggcgtcgtgcgcgccaagttccggtccaacctcccgcccaactccatgggtaagaaggtccgcgtcttcatgtatcccagcagtatctaatcaaggtatcttccatattcggtcaagcttcctacttttgaggatgtttagctgaaaagtttccatggcgattttgagtagtttagctttgctctttttttttactgaacaggctgttagtcgcgacctagacaacttatgtcaattgtaactggcttttagtcgcaacctagacaacttttgtcaattgtaactcattggccttgaaatgaaagtattatgctgtgttaatggtgt

SEQ ID NO: 2403 - DNA, 4963 bp, Eutrema parvulum
gagagaactagggtaggactatataaattcgtagttatgttttagggtttttcttctccgttttcctcagtagcagcagtcttgtgtgtttatcggccgtcgcgaaatggtgaagggacgccaaggagaacgtgtcagactctacgttagaggaaccatcctcggatacaaaaggtcgaagtccaaccagtacccaaacacttcccttgtccagattgaaggagtcaacactcaggaggaggtaacatggtacaagggaaagaggatggcttacatctacaaggctaagaccaagaagaacggtagccactaccgctgcatctggggaaaagttgctaggcctcatggtaacagcggtgttgtccgtgcgaaattcacatcaaacctgcctcctaaggccatgggaatgaaggtcagagtcttcatgtatccgagtaacatatgaagcaactaaaacagcataaactttgatttagctgtggtttttgttcactagttcgttattttgtatctgatattgaaagcattgtcctttctttgtttgaagtgttttggagattctctgaatagactttgatcatggatctggtttttaatcgcaatttagaatgttttttctccttatatcgaggttccaatagacaaacgacgcttttgcaacgaagctcaacaagtcaattgtggggttctgttagatttggaacctcacaacggctgtctctgaatagagcaaaagctgctagcttgagatgttctactggttctgttgtttctgttgttgagcaaccgagcttggttgagaaacctgcttcagaggtcatccatttctatcgcgtgcctttgattcaagaaagcgcaaatgctgagcttctcaaggcggttcaaaccaaaatcggcaaccagattgtcagtttcacaacagagcagtgtttcaacattgggctcgaatcggagttagcagacgaaaagctatcggttctgaagtggattcttcaagaaacatttgagccagagaatttaggcgcggatagttttcttgagaggaagaagcaggagggacttcatgctacaattgttgaagttggtcccagattgtcctttacaacagcatggtccaccaatgcagtttcaatatgtagagcttgtgggttaaacgaagtgactcgcttggaaaggtctaggaggtacctcttgttcagcaatgagccactcttggagaatcaaataaaggaatttgctgctatggttcatgatagaatgactgagtgtgtgtaccctcagaagctgatttcgtttgagacaaatgtagttcctgaggaagtaatgtatgtgcctgtgatggagaaaggtcggaaagcgcttgaagaaatcaaccagaagatgggtttagcctttgatgagcaagatttgcagtattatacgagacttttcaaagacgacattaagcggaacccaacaaatgtggagctatttgatatcgcccaatccaacagtgagcacagtcgacactggttctttgctgggaacattgttattgatggaaagccaatggataggtcacttatgcaaattgtaaagagcacgtgggaggcaaatcggaataattccgtcattgggtttaaggataactccagtgcaattaggggctttatggtgaaccagctacggcctctacttcctggttctacttgcttacttgatgtcagtgcacgtgacctcgacattttgttcactgctgagacccataatttcccttgtgcggtggctccttatcctggtgctgagacaggtgctggaggtcgaattagggacacgcatgcaactggaaaaggttcttttgtggttgcatccacttctggttactgtgttgggaacctcaacatggagggatcttatgctccatgggaagactcatctttccagtatccatcaaacctagcttcacccttacagatactcatcgacgctagcaatggtgcatctgactatgggaacaaatttggagaacctatgattcaaggatataccaggacttttggaatgagactaccaagtggggatagaagagaatggttgaagccgataatgtttagtgcaggtattggacagattgatcatactcatataactaaaggggagccagaagttgggatgcttgttgttaagattggtggacctgcttaccgtattggtatgggaggaggtgcagcttcgagtatggttagtggtcagaatgatgcagagcttgatttcaatgctgtgcagcgtggagacgctgagatgtctcagaaattgtaccgtgttgtccgtgcttgcattgagatgggcgagaagaatcccattatcagcattcatgatcaaggcgctggggggaactgcaatgttgtcaaagagattatttatccaaagggtgcagagattgacataagagcagttgttgtgggtgatcatactatgtcagtactggagatatggggagcagagtatcaagagcaagatgcaattttggtgaaagctgagagccgagagattttgcaatcaatctgtaagagggaaaggctttcaatggctgtgcttggaacaatcaacggggaaggtcgctgtactttaattgacagcacagctgctgcgaagtgcaagaaagaagggctacctccacctcctcctgctgtggatcttgaactcgagaaggttcttggtgatatgcctaagaaaacgtttgagttcaaccgcgttgcttatgcacgggaaccacttgatgttgctcctgggattacattgatggactctttgaaaagggttctgcgattgccatctgtttcttcaaagcggttcttgacaaccaaagtagatagatgtgtgacaggtcttgttgcccagcaacaaacagttggaccattgcagatcacccttgctgatgttgcagtcatcgcacagacattcacggatctaacaggtggtgcatgtgccattggcgagcaaccgattaaaggtcttcttgatccaaaagccatggctagactagctgttggagaggccttgacaaatctcgtttgggcaaaggtcactgcactttctaatgttaaagctagtggtaactggatgtatgctgccaagcttgaaggagaaggatcagcgatgtatgatgctgcaattgctctatctgaagcgatgatcgaacttggcattgcaattgatggtggaaaagacagtctttcaatggcagctcatgcggatggtgaagttgttaaagctccaggaaatcttgtgattagtgcctatgttacctgtccagacataacaaaaacagtgactccggatctgaagctaggagatggtgatggtgttctcttgcatgttgatttggcaaaggggaagcggagattaggtggatctgcactggctcaggttttcggtcagattggaaacgactgtcctgatattgatgatgtgccatatctgaagaacgttttcgagggcgttcaagctctcatttcagagaacttggtatctgctggacacgacatcagcgatggtggactaattgtagcagctttggaaatggcttttgctggaaacaaaggtataaaccttaacttggtttcaaacgggataagcctctttgagactttgttttctgaagaactcggtctggtaatggagattagcaacaagaatctagacgctgtgttggaaaaactccgtggttatgatgttactgccgagatcattgggaaagtcactgactctcctttgatagaggtgaaagttgatgggattactcacctgagtgagaaaacttcattcctcagagacatgtgggaagacaccagtttccagttagaaaagcttcagcgactggcgtcttgtgtggagatggagaaagaaggtttgaagttgaggcatgagcctaactggaagctctcatttactccttcgtggaccaacgataactatatgtctaaggatgttaaaccgaaagtagctgtgatccgagaggaaggcagcaatggagatagggaaatgtcggctgcattttacgctgccggttttgaaccttgggacgtgacagtttctgatcttctagccggagcaatcactcttgatcagttccgtgggattgtgtttgttggagggtttagttacgccgatgtccttgactcagccaaaggatgggctgcttcaataaggttcaacgagcctctgctcagtcaatttcaggagttctacaaaaggccagacacgttcagccttggaatctgcaatggttgtcagttaatggccttgttaggatgggttccaggtcctcaagttggcgggtcactagacacctcgcagccaaggtttgttcacaacgaatcaggaagatttgagtgcaggttcacaagcgtgaccatcaaggactcgccatcgataatgctgaaaggaatggagggaagtacgttaggagtttgggcggctcatggagaagggcgggcttatttcccagacgaaggagtcttggaccatatgcttcactcagatttggctccgttgagatactgtgatgatgatgggagcgtgactgaagcttacccttttaacctcaatggttcaccgttgggaatagcggctatatgttcgcctgatggaagacacttggcgatgatgcctcatcctgaacgttgtttcttgatgtggcagtttccttggtacccgacaagctgggacgttgagaaagctggtccgagtccgtggttaaagatgttccagaatgctagggactggtgctctcagctttagagtcatgtttaagccttgcgtcataaatcttttctacaggattttgttgtgcggtttggtgttttgcagagctttcgaaagaagttattggagatacaattgggtctacgttttgtttcaattgataatgcatttttcacatgaaaaataaataaataatcgagcacggcatcgatgtata

SEQ ID NO: 2404 - DNA, 627 bp, Setaria italica
gctgcgccgtcacttccttcccccgtctctaacttctcaaaccctcgtcggcgaggcctccggcggcggcgactatggtgaaggggcgccaaggccagcgcgtcaggatgtacgtgcggggcacgatcctgggctacaagcggtccaagtcgaaccagtacgagaacacgtcgctgctgcagatcgagggcgtcagcaccaagcaggatgtggcgtggtacggcggcaagcggatcgcctacgtctacaaggccaagaccaagagcgacggcacaagcatccggtgcatctggggtaaggtcacgcgcccgcacggcaactccggcgtagtgcgcgccaagttccggtcaaacctcccgcccagctccatgggtaagaaggtccgtgtcttcatgtaccccagcagtatctaatcaaggtatcttgcctactgcctgctatggaggaggttcagctggaaagactccatggaaattttgagtagtctagcttactctttgctttcttttctttttttttttactgaacaggctgttagtcgcaacctggacaacttatgtcaattgtaactcattggccttgtggaatgaaagtattatgctttgttaatggcatttgctggagtgt

SEQ ID NO: 2405 - DNA, 686 bp, Saccharum officinarum
  misc_feature (623)..(623): n is a, c, g, or t
  misc_feature (651)..(651): n is a, c, g, or t
cgtcccctatcccccaacctcgtcctgcggcgctccggcggcggcgagtatggtgaagggacggcagggccagcgagtcaggacgtacgtgcggggcacgatcctgggctacaagcgctccaagtcgaaccagtacgagcacacgtcgctgctgcagatcgagggcgtcagcaccaaggaggacgtggcgtggtacggcggcaagcggatcgcctacgtctacaaggccaagaccaagagcgacggcaccgccgtccgctgcatctggggcaaggtcactcgcccgcacggcaactccggcgtcgtccgcgccaagttccggtctaacctcccgcccagctccatgggcaagaaagtccgcgtgttcatgtaccccagcagtgtctgactctaaccgagtcctaccctgtcgttgctgccacagcagttaaggaatcgttgccttggcacatcagcgcctctgtccggcggagccagccaagttgtcatttcttctgcttgtgattttattgcttgattaggatctgttctctcttctgtgtcctgtattttgattgccgtcgggtgttcattgcttgatgtttgatctggtatctcttctggtggtcctctttcttcctcgnatgcagaggaaagctaggcttgtagggncaatgatgatgcaagtcatgcaccactctgaatga

SEQ ID NO: 2406 - DNA, 646 bp, Elaeis guineensis
cgcctgctgccgtctaaaaccatcttcgggtctcactccgaagaaccctcgcgtgaaaatggtgaaggggcggcagggagagcgcgttaggctttacgttcgtgggacgattcttggctacaagaggtcgaagtcgaaccagtatgagaacacgtcgttgatccagatcgagggggtgaacaccaaggaggaggtggcctggtactgcggcaagcgcatggcgtacatctacaaggccaagaccaagtcggacggggacccgctaccggtgcatctggggcaaggtcacccgccctcacggcaacagcggcgtcgtccgcgccaagttcaagtccaacctcccacccaaatccatgggcgggaaagttagggttttcatgtatccgagcaacatttgaggtgtagccatgcaatgcaaatgtgacagaaggcggacctatagtttagcggccattgaattttaatgctcgattttagtatgtcaaaatttttgatactctgtgaactggttgctattttttacagtgttctttgagaggaagtggaacttacttcgcatattagaattatcgaattatgttcttttataaaaaaaaaaaactaagagaatgtcaacgagacacaagggaggtagagcccccccccc

SEQ ID NO: 2407 - DNA, 577 bp, Cenchrus ciliaris
  misc_feature (161)..(161): n is a, c, g, or t
  misc_feature (165)..(165): n is a, c, g, or t
  misc_feature (448)..(449): n is a, c, g, or t
aaaccctcgtcggcgaggcctccggcggcggcgactatggtgaggggacgccaaggccagcgcgtcaggatgtacgtgcggggcacgatcctgggctacaagcggtccaagtcgaaccagtacgagaacacctcgctgctgcagatcgagggcgtgagcancaangaggacgtggcgtggtacggcggcaagcggatcgcctacgtctacaaggccaagaccaagagcgacggcaccagcatccggtgcatctggggcaaggtcacgcgcccgcacggcaactccggcgtcgtgcgcgccaagttccggtcgaacctcccgcccagctccatgggtaagaaggtccgcgtcttcatgtaccccagcagtatctgatcaaggtgtcctgcatatccggtcaagcttgtactatggagaaggttcagctggaaagaccccatggaaattnngagtagtctagctctttgctctctttttttccctactgaacaggctgttagtcgcaacctagacaacttgtgtcaattgtaactcattggccttgtggaatgaattaccgtgctttgttaatggttta

SEQ ID NO: 2408 - DNA, 712 bp, Elaeis guineensis
cggttacgtccggtttcgggacgtcgtactctagactgacgacgaaaatggtgaaggggcggcagggggagcgtgtgaggctttacgttcgcggcacgatactcggctacaaaaggtcgaagtcgaaccagtatgagaacacatcgttgatccagatcgagggggtgaacaccaaggaggaggtggcctggtactgcggcaagcgcatggcgtatatctacaaagccaagaccaagtcggacgggacccgctaccgctgcatttggggcaaggtcacccgccctcacggcaacagcggcgtcgtccgcgccaagttcaagtccaacctcccacccaaatccatgggcggcaaggtcagggttttcatgtacccgagcaacatctgaggtgtatcgatctggtgcaaatatgacacaaggcggactttgtactttagtaacaattgaagttcaatgcttatttttagcatgtcaaattattgatactttagttaactggtcgctatatttgtattcatcgttgaggaagtgaaacttaatttacgcattcgaattatcatgttttttattatgaggacatttggaaaaatggccatacataagttttcgctgaatggattgttcagggagtcaggtttgtagggtgagcttgtgcccatggttgatctacctaacacaagaatcattgttattaaaagacaaaaaaaactaag

SEQ ID NO: 2409 - DNA, 629 bp, Elaeis guineensis
ctcgacaccagcggcgccgcttcccccctccaaaaaaatcctcgtcgtcggcgaaaatggtgaagggcaggcaaggcgagcgcgtcaggctctacgtccggggaacgatcctgggatacaagagatcgaagtcgaaccagtatgagaacacgtcgttgatccagattgagggggtgaacaccaaggaagaggtcgcctggtactgcggcaagagaatggcgtatatctacaaggccaagaccaagtcggacgggactcggtaccggtgcatctggggcaaggtcacacgtccccatgggaacagcggtgttgttcgtgccaagtttaagtccaaccttccgcctaaatccatgggtgggaaggttagagttttcatgtacccgagcaatatataaggtgcagtgcagttgcataatttaaggaggctgaattctagctgagtttgtggcatagggactttgatgtttctattagttgtttgaaaagttttgatcctatttttgtgacgttttttgacgcttggacatttgtgacattttgattgtgtcaactgaacgtacgagtatttcttcaatcttttcctaactgacgaagtggaatattaattttgcccatgaacgtgatgatag

SEQ ID NO: 2410 - DNA, 505 bp, Elaeis guineensis
agcgaaccttcctcccaaaaactctagcgcgaaaatggtgaaggggcggcagggggagcgtgtgaggctttacgttcgcggcacgatactcggctacaaaaggtcgaagtcgaaccagtatgagaacacatcgttgatccagatcgagggggtgaacaccaaggaggaggtggcctggtactgcggcaagcgcatggcgtatatctacaaagccaagaccaagtcggacgggacccgctaccgctgcatttggggcaaggtcacccgccctcacggcaacagcggcgtcgtccgcgccaagttcaagtccaacctcccacccaaatccatgggcggcaaggtcagggttttcatgtacccgagcaacatctgaggttgtatcgatctggtgacaaatatgacacaaggcgtactttgtactttagtaacaattgaagttcaatgctttatttttagcatgtactaaattattgatactttagttaactggtcgctatatttgtat

SEQ ID NO: 2411 - DNA, 746 bp, Phalaenopsis aphrodite
tttaatcccgaccgtccaaatcctctttatctttccatcggctactataaaatgatctgctagggcttttgttttccggctccgctctccgtcgctcgctcagaaaagatggtgaagggtaggcaaggcgagcgcgtcaggctgtacgttcgcggaactattcttggatataagagatcgaagtcgaatcagtatgagaatacgtctctggtgcagatagagggcgtgaacacgaaagaggaggttggatggtatgctggtaagcgaatggcgtacatctacaaggcgaagacgaaaaagaatggcacgcactatcgctgcatatggggaaaagtcactcgaccccacggcaacagtggcgtcgtcagggctaagttcaaaaccaatttgccaccccaatcaatgggccgcaaagtcagggttttcatgtatccgagcaacatatgaggtgtaaaatctccatgtgctgttgcggttgatgctgtggagagtcttttgatttagctttatattaaaattgcataactctttattttaaaatttgttgcctactgtttgcttaaaccccccttcaatctcttattttatgtttatgggtactgcttttttttaaagtctcatgttactcaatgcttgtcagttacgcagatattggttttatccaaattttactttagagaatttcagtgcatttagacattgagacattcaaattaatatttttgatgactggtattgaatacagg

SEQ ID NO: 2412 - DNA, 842 bp, Ananas comosus
ctccaagccgatattgtctccttcgcgcctgcgcctctcgacctcggagctacccgcggcgtcaacaatggtgaagggtcgacaaggagaacgcgtgaggttgtatgtgcggggcacgatccttggatataaaagatcgaaatcaaatcaatatgagaacacgtcgctgcttcagatcgagggggtgaccaccaaggaggacgtcgcctggtactgtggcaagaggatggcctacatatacaaggccaagacgaagtcgaaggggacgcactaccgctgcatctgggggaaggtcacacgcccccacggcaacagcgacgtcgtccgcgctaagttcaagtcgaacctccccccgaaatctatgggagcgaaggttagggtttttatgtatccgagcaacatctgaggtaccgccgactaccttttgctttaggttttcagtttccaattgatgtcagttttgccatgtagctggactatgtttagcaccttgttatttctcattttcttttgttaagagagtttgaggcggctctgcgtcaccgtttgtccaatggttggtggaatttggtgaagtatccgaatttgaatgagagcttgaatgcagattctccgaacgaccgagctcgcatgctgaggatctgtatttgagttctattcaaattcatgctcattctttttcccactctagtcactatatccccttgcgccgctatccatcatccaggaacaaaagcgttcggactagaatgcagttaaacctctctagatatattgcgattgtgactcttaaattcgttaagaccttaatagttatctagaagttatgcttgtccttgttt

SEQ ID NO: 2413 - DNA, 771 bp, Sorghum bicolor
cgaactagggtttcattcgcccctcccctcccctcccctcccctatcagtctatccccagcctcgtcgtacggcactccggcggcggcgagtatggtgaagggacggcagggccagcgagtcaggacgtacgtgcggggcacgatcctgggctacaagcgctccaagtcgaaccagtacgagcacacgtcgctgctgcagatcgagggcgtcagcaccaaggaggacgtggcgtggtacggcggcaagcggatcgcctacgtgtacaaggccaagaccaagagcgacggcaccgccgtccgatgcatctggggcaaggtcacgcgcccgcacggtaactccggcgtcgtccgcgccaagttccggtcccacctcccgcccagctccatgggtaagaaggtccgcgtgttcatgtaccccagcagtgtctgactctaaccgagcaagcttttaccatgaaggagattgatccggaaagcttctgacgacgattttgagtagtttagtttaggagtttcctctttttcttttactacaggttggctgtggttcgcaactgacagcttatgtcaactgtaactctgttttgttgcgttgatctgaagcaaagcattaatgttgtttctttgtatgtttagttgaggctgaatttactgttgactgatttattctgagatcatgggagctggggggatatattacacaaacttgattaatacagtgatcctattagtctgatttaatcaaaattgtgtgaaatctgcaccattgc

SEQ ID NO: 2414 - DNA, 680 bp, Tripterygium wilfordii
attccgcagaccagaggcaggagcttcaaaccaaactctaaaatggtgaagggtcgtcaaggagagcgcgtgagactttatgttcgaggaaccatcctcgggtacaaaaggtcgaaatcgaaccagtacccaaacacctcgctggtacagatcgagggtgtgaacaccaaggaggaggttgcgtggtacgctgggaagcgaatggcctacatatacaaggccaaggtgaagaagaatggcacccattatcgctgtatttggggcaaagtatctcgacctcacggtaacagtggcgttgttcgcgcaaagttcaagtctaatcttccaccaaaatccatgggaactagggttagggttttcatgtatcccagcaacatataaggttgtgtggtttttagagatgcaagacttgggatttactatggatctttgagtttgctattgctgtatattaacagctaagttttaatattttgaacttattatttgtactagcccacagtttttcctttgcccatttagttataatggattgtagaagtaatgactgaatggctacaatttgttatgacttaagaactttgttgtttggagatgtgttttcttttactatcaattttgatacaccttggagtacatattgtgtcaggcacagtggaaacaccacctgcctgttgaat

SEQ ID NO: 2415 - DNA, 625 bp, Allium cepa
ctcctaccctccgtgtgtcgtcgtcgcgtctcagaagaggtagtgtacacacagagagggggggctcccataaaggccgccacttccaatctcagattcaacaatggcgaaggagcgacaaggccagcgcgtcagacttacgttcgaggaacggttttggggtacaagagatcgaaatcgaatcagtatgaaacacttcattgatgcaaattgaaggagtgaatacgaagaagacgtggcctggtattgtggtaagcggctggcatatatttacaaggcgaaagtgaagaaaaatggaacacattttaggtgtatttggggaaaagtcactcgtcctcatggaaatagtggagttgtgagagctaagttcaggtcgaatctgcctcctaaagcaatgggtgctaaggttagggtgtttatgtacccaagcagtatctgagctaactggcttgattaaagagtgctagctgtaagcagtggagaactcgttagttccgtaggaatatcaaaattgtgtctgaactgtgaacttatatgttattattttgaattttatttatctctgagttggtttttatcacatttgcatcgattttgatttatagcttatacggttatcctaatt

SEQ ID NO: 2416 - DNA, 634 bp, Ambrosia trifida
cggggaggggttttagttcatttcttactttcatcagcgccggcgatcagtaacaatctggtgaatcacaatggtgaagggccgtcaaggagaacgcgtcagactctacactagaggaacaattcttggctacaaaaggtcaaagtcaaaccagtacccaaacacatcgttggttcaaatcgaaggagtgaacacaaaggaggaggttgcatggtatcaagggaaacgtatggcgtacgtatacaaggctaaagtgaagaagaacggatcacattatcggtgcatctgggggaaagttacaaggcctcatggtaacactggtgttgtgcgagcaaagttcaagtctaatcttcctcctaaatctatggggtctagggttagagtgttcatgtacccaagcaacatttaagtttctttgaagaacatgaagattgttgctgctggtaattcaatcgtttttgtagtagttgtgttgaccgtttgttatggaacatctttcttttcacatgaacatcatcatatctttgaatctttacaccgaatttcgatgacatcaattccatcatattcgagttttagttttcattgttttgccttttcacaaggcggacctttatacgattacaacgcatat

SEQ ID NO: 2417 - DNA, 529 bp, Ambrosia trifida
tcagtacaatctggtgaatcacaatggtgaagggccgtcaaggagaacgcgtcagactctacactagaggaacaattcttggctacaaaaggtcaaagtcaaaccagtacccaaacacatcgctggttcaaatcgaaggagtgaacacgaaggaggaggtcgcatggtaccaagggaaacgtatggcatacgtatacaaagctaaagtgaagaagaacggatcacattatcggtgcatttgggggaaagttaccaggcctcatggtaacactggtgttgtgcgagcaaagttcaagtctaatcttcctcctaaatctatgggatctagggtcagagtgttcatgtacccaagcaacatttaagtttctttgaagaacatgaagattgttgctgctggtaatttaatcgtttttgtagtagttgtgttgaccgtttgttatggaacatctttcttttcacatgaacatcatcatatctttgaatctttacaccaaatttcgatgacatcaattccatcatattcgagttt

SEQ ID NO: 2418 - DNA, 661 bp, Amorphophallus konjac
tgtacgaagccgaccgcaccggggatcttccagcgggggtcggcgccaccgcggagatggtgaagggccggcagggcgagcgcgtcaggctatacgtccgggggacgattctcggatacaagaggtcgaagtcgaaccagtatgagaacacgtccctgatccagatcgagggtgtcaacaccaaggaggaagtggcgtggtactgcgggaagcgcatggcctacgtctacaaggccaaggtgaagaagaatgggtctcagtaccggtgcatctggggcaaggtcacccgcccccacgggaacagtggcgtcgttcgcgccaagttcaagtccaacctcccgcccagatccatgggtgctaaagtcagggttttcatgtacccgagcaacatttgaggcttatcgggagtttctgaggcattgtgacagaagctaggaaggccaagatgtcatgatttcttttgcaattttgtgacggtgtaacttgtgttgttttttttaccgtttctcaagcaatatgacgttaccccctaaatttggttttcctacaaaggtcatcttgaattgagttaggtgtagcagatgctgaaaatattgatgtggttatataagaaattggatttagttacctgccattatctgatctgaagatttttgttgtc

SEQ ID NO: 2419 - DNA, 559 bp, Arabidopsis lyrata
tagcagcagactttggatattcggcggaatcgaaaatggtgaagggacgccaaggagaacgagtcagactctacgtgagaggaaccatcctcggatacaagaggtcaaagtcgaaccagtatcccaacacgtccctcgtccagatcgaaggagttaacactcaggaggaggtaaactggtacaagggaaagaggatggcttacatctacaaggctaagacaaagaagaacggtagccactaccgctgcatctggggaaaggttaccaggcctcacggtaacagtggtgttgtccgagctaaattcacgtccaacctgcctcctaagtccatgggaagcagggtgagagtcttcatgtatccgagtaacatatgaagcaaatgcaaaatggcttaaacttataatttagccgccttggttttgttcactagtttgttattttgtattttgatattgaaagcatttcctttctttgtttgaagtgtttggagattctctaaattgactttgatcatggatctggtttttcatcacaaattagaatcctttttccccttata

SEQ ID NO: 2420 - DNA, 617 bp, Arabidopsis thaliana
gcagcagcctttggatattcggcggaatcgaaaatggtcaagggacgccaaggagaacgagtcagactctacgtgaggggaaccatcctcggatacaaaaggtcgaagtccaaccagtatccaaacacgtccctcgtccagatcgaaggagttaacactcaggaggaggtaaactggtacaagggaaagaggatggcttacatctacaaggctaagacaaagaagaacggtagccactaccgctgtatctggggaaaggttaccaggcctcacggtaacagcggtgttgtccgtgccaaattcacatccaaccttcctcccaagtccatgggaagcagagtgagagtcttcatgtatccgagtaacatatgaagcaatgcaaaaatggcttaaacttataatttagccgccttggttttgttcactagtttgttattttgtattttgatattgaaagcatttcctttctttgtttgaagtgtttggagattctctaaattgactttgatcatggatccggtttttcatcccaaattagactcccttttccccttttataacgaattaaaacagacgaatggtaacatattttctcaaatcactattacaactttata

SEQ ID NO: 2421 - DNA, 626 bp, Arnica chamissonis
ggcgcaggtaaaacgaaaatggtgaagggccgacaaggtgaacgcgtccggttgtacacccgtggaacgattctcggctacaaaaggtcaaaatcgaaccagtatccgaacacatcgttggtccaaatcgaaggagtgaacacgaaggaggaggtatcatggtaccaagggaaacgtatggcctacgtctacaaagctaaggtgaagaagaacggatcgcactacaggtgcatttggggcaaagttaccaggcctcatggtaacaccggtgttgttcgtgctaagttcacatcaaatctccctcccaaatccatgggatctagggtcagagtcttcatgtatccaagcaacatttaagtagagcaagaagaaaggaggttgctgctgttgctggtgtcctttttagatattcttgcatcttttcaatggcaacactggaactttcaagaaagtgatgttattatctttgttatattttggaatccatgaatttttattttctaattttgttaagatgctaagcgactgatcttaatttcggggtgtttatggtttggtttggtttgttttggttcggtatgtttgttaaaactctcggctaaaccgttaaatattgtttttaaagc

SEQ ID NO: 2422 - DNA, 693 bp, Musa acuminata
gggtttctcgctgcttcgttgggccgctgtctctctctcgcaccgtctcttgtcgaaccactctcgtcggcggaaatggtgaaggggcgacagggcgagcgcgtcaggttgtacgttcgtgggacaatcctcggatacaagaggtcgaagtcgaaccagtacgagaacacctcgttggttcagatcgagggtgtgaacacgaaggaagaggtcgcctggtactgcggcaagaggatggcgtacatatacaaggcgaagacgaagaccaaggggacgcggtaccggtgcatatggggcaaggtctgccgcccccacgggaacagtggagtgattcgcgccaagttcaagtccaacctcccgcctaaatccatgggtggaaaggtcagggttttcatgtaccccagcaacatatgaggtgaattggtgcaatagatcagatgttttctggcagctgtagctcggattttttagtgggaccggaggaaaaagcgaattccaagttggtgttgcagttatttaagttttgattattttttatgtgttctttcttgtcggggaacttgaacattatttactatttgaaacttctattttccatatatggatgatgactttttataaatctcttgaatgccttaatgaatgtcgttgtcaagaatagctagcattagctaattgcaaaagaagttattt

SEQ ID NO: 2423 - DNA, 959 bp, Musa acuminata
ataaggcccaaatcgagctggagaagcctaagccctttttcattcggagatgcaactacgaccgtccggtctgctgatctcgctctcgctctcgctctcgctcgcgctctctcctatttaactgctcttcgtctcccaaaccctacttcgattctcgttcttgagttgcggtctgttcgtcggcgcaccactcgtgagcaccaagatggtgaaggggcggcaaggcgagcgcgtgaggttgtacgtccgcgggacgatcctcggttacaagaggtcgaagtccaaccagtacgagaacacctcgctggtgcagatcgagggcgtgaacaccaaggaggaggtggcatggtactgcggtaagaggatggcgtacatctacaaggcgaagacgaagaccaaggggacgcggtaccggtgcatctggggcaaggtcacgcgcccacacggcaacagcggcgtcatccgtgccaagttcaagtccaacctcccgcctaaatccatgggtggaaaagtcagggttttcatgtatcccagcaacatctgaggaggtgattggtgcagcagagctgatgtcttggtgcagctgcggctgggtttctagtgggattggagccaaaacatttcctagatattagaagtatatctatatccttctttttgggaaacttgaacttaatttacaagttggaacaactgtattttgataaggagaaagttagcaatggcttaataaaagctcgccatcgatgattgcttgctggtcgtttaagaagattataatcattttattttgggttcctgattggatagagtgttgaacagtgttttttaagtttttggttcttccatggaaaatgtgatggctgtttgtataagattacttaaatagataaatataattgacagctctaaattggatgctatctgcaagagatattaggaaaaagtgttgttaaaaa

SEQ ID NO: 2424 - DNA, 1497 bp, Musa acuminata
gacgccgactagggtttctccgtctcgtctgcgaaaatggtgaagggccgacaaggcgagcgcgtcaggttgtatgtccggggcacgatactcggatacaagaggtcgaagtcgaaccagtacgagaacacctcgctggtccagatcgagggggtgaacacgaaggaggaggtcgcgtggtactgtggcaagagaatggcgtacatctacaaggccaagacgaagaacaaggggacccagtaccggtgcatctggggtaaggttgctcgccctcacggcaacagcggcgtcgtccgcgcgaagttcaagtccaatctcccgccaaaatccatgggtggacgggttagggttttcatgtatccgagcaacatatgaagtggattaccatttgggaatacacttcatggcattttggttttttgttgggtttgatctttcctcttttttcattttcagtgtcatcctttagcttcacttatgatactactggtgatcatttttgtgaaattttttgttgtctgtttcttcagtttgctttgtgcttgcataataattttcttcaagcttataatttcttctgttaagaagtaaaagaaaatggatgaaagcttcaatactgttctatataccaaaaatatgtttttgaatgtctgattttataggaaatgtcacatcatatatcttttgttcattcatttaggttcattttcagtagaagcatgttgcctatcgatggttaaatttttacagagcatttgaagattgttatgtttagattttcagtcattatcatggatcttcccattaacctaatatagagaatgagtatcatttagaggattcgaagagggagtgttctctgcctcttggcagggtaattgaagtgtataatcatttacattagttaagagtgttagagaaagtttagcagataatagaaataaaaggtgtctggatcttgttgaatcaacagtaattctgttgtgattggctggaagaggtaatttgtgtgtttgaatttatgtgagaactttacaatatttgccaaagttcacttgagttggcagattttccaaacaccatggctctttcggcctctcacttctccgtgagtattatagcatgtattgtaatgggagtcgaaatggagcttgacgcaaatactctgggtgatgatgagagaatcatgaatctggcacactaggacagcataaatgcaattatgaaccagaaggagaaaagcaggtggaaatgtcttcaaaagtgagaagctgttatgggtttgtgtatatttcattgttaacaataaataagctgaagaaagttttgttggttttgaatttatcaagataatgtttttgatgagatagatgcttgtattgaccaatttcacgtatatttcattgtagtgatttcttcctaacattcctttcataaactgtgcatcatctgaagtttactattaatatactgaggtaacatgaagcatcatcttta

SEQ ID NO: 2425 - DNA, 917 bp, Brachypodium distachyon
ctctagggttcattcctctgcgccgtcacgtctttcccttcccagttcccaccaccacccctccccggcgaccggcggcgacgataatggtgaagggacgccaaggccagcgcgtcaggctctacgtgcgaggaaccatcctgggctacaagaggtccaagtcgaaccagtacgagagcacgtcgctgctgcagatcgaggggctgagcaccaaggaggacgtgtcgtggtacgccgggaagcgcatcgcctacgtctacaaggccaagaccaggagcagcggcaccaccgtccggtgcatctggggcaaggtcacgcgcccgcacggcaactccggcgtcgtgcgcgcgcagttccggtccaacctcccggccacctccatgggcaagaaggtccgcgtcttcatgtaccccagcagcatctaaggcatctaagggactctgtttagttgtagctggcttcaaggaggtttcatatcagtttgtcacccggttaaccaagcagaaaagttttcttgcgattttgaagagtttagcttttcctttttactggacaggcggttggttaattgcatcttctgtaacttgtcaatcgctcattttctttgaaacgaagtatcatgcattgttcatgtttcgatggaagatttatcctgtcatcaaatgaggttatctcaaccttgcttctgagtttgcaactgttacgtagagatgcttttaccatcaatgtgccatcatattgtgtcaccgaagtctggttgagatgttgatggcacgtttgtaatgcttgggttttcaagtttgttaaatgtggatgcggtaaaagagcctgataacccgttattcgcaaggggcactcccctgatgaacagagggcgagcaattgctatcaatacaacaggagatgttcatgccgtc

SEQ ID NO: 2426 - DNA, 694 bp, Epimedium sagittatum
agggagaggaaaagaagcagagcaaagatggtgaaaggaaggcagggagaacgagtgaggctgtacgtgagagggacggttctgggatacaagagatcgaaaagcaaccaatacccaaacacatcgttggtgcagatcgaaggagtgaacactaaagaggaggttgcttggtacgccgggaagcgcatggcctatatttacaaggccaaggtgaagaagaatgggtctcattaccgttgcatttggggcaaagtcacccgcccccatggtaacaccggtgttgttcgcgccaagttcacatctaacttgcctcccaaatccatgggcgccagagttagggttttcatgtatcccagcaacatatgatgacagagtctcagagatggaggttccatgttggcgagtttagcaagtaattgaaaatgtggtcatggcattttgggttaatcctagttccagagtatttgtttttgatttcgttgatacaatagttaattaatactgtattagttaagttaattctccgtcagtctttccccccgtcaaaaaaacaacatttatcgttggatacattgttttctgagaatgcttttgattatcttgtcagaaatgttatccgacttgatacaagaccaactccatttatttttgctaatgtgatcccaatgtctcatggcatacgatgtggcagctc

SEQ ID NO: 2427 - DNA, 593 bp, Fagopyrum esculentum
gacgaatccgcgataatggtgaagggtaggcaaggagagcgtgtcaggttgtacgtaaggggatcgatcttggggtacaagaggtcgaagtccaaccagtatccaagcacatccttggtccagattgaaggagtgaacaccaaggaagaggtgtcatggtaccagggaaagagaatggcttacatttacaaggccaagacaaagaagaaaggctcccattacaggtgcatttggggaaaggttactaggcctcatggaaacaccggagtcgttcgtgctaagttcacgtccaacttgccccctaaatctatgggtgacaaggtccgggttttcatgtaccccagcaacatctgagtgtaatcctccctcaagattccaggctttgtatgaggcattggagaagtcggttggatcattcagtttttttaaggtttaggctgtattgcagaatatttatccgtttttgtgtaacttttgcttcattttagaacacaaaccagccaattttgtttcttacgaaagtcaggaggatgtgtgtttggcttactgcacttttctttctaattgatcttcgctggctatctctttgcata

SEQ ID NO: 2428 - DNA, 576 bp, Flaveria ramosissima
tccagggtttatcattgcttcatcaccgccggcgatctgcaagcatttgctcaagcaacaatggtgaagggacgtcaaggagaacgcgtaagactctacaccagaggaacgattctcggctacaagaggtcgaaatcgaaccagtatccgaacacatcgttggttcagattgagggagtgaacacgaaggaggaggtcgcatggtacgaggggaaacgcatggcgtacgtctacaaagcgaaagtgaagaagaatgggtcgcattacaggtgcatttgggggaaagttacaaggcctcatggtaacactggtgttgttcgagctaagttcaagtccaatcttcctcctaaatccatgggatctagggttagagtgttcatgtacccaagcaatatttaagttctattgaaaaagattggaggttgttggtgctggtagttttattgctcgtgtggtagttcacttgtttgaccatttattatggaagattttatatttgttacatggaatgttacattgttactagatcttaaatatcttgagtttttttattgaaagaatgcaagattgcctatc

SEQ ID NO: 2429 - DNA, 673 bp, Elaeis guineensis
cgctccggtcctccggactcgaggcgtgcataaaccccattcccaaccgtcggctagggtttctcccactcgacaccagcggcgctgcgctccccggaaaaccccgtcgccgtcggcagaaatggtgaagggcaggcaaggcgagcgcgtcaggctgtatgttcggggaacgatccttggatacaagagatcgaagtcgaaccagtatgagaacacgtcgctgatccagatcgagggggtgaacaccaaagaggaggtcgcctggtactgcggcaagaggatggcgtatatctacaaggccaagaccaagtcggacgggagccggtaccggtgcatctggggcaaggttacacgcccccacgggaacagcggtgttgttcgcgccaagttcaagtccaaccttccgcccaagtccatgggtgggaaggttcgagttttcatgtacccgagcaacatataaggtatgatgatttggtgtgactgaaggcagcctggcagctgagttagtgacatctgaatttagaggtttttcttttaacatgtcaaaaatgatgtttaataccaggaccatttactgtttctgcagtcttctcattacaaatgcggaacttaaatttttacctttagaagttattgcatgtcgttttgtttcctttatgaagcaacccgaaat

SEQ ID NO: 2430 - DNA, 690 bp, Elaeis guineensis
atgcgctccggtcctccggactcgaggcgtgcataaaccccattcccaaccgtcggctagggtttctcccactcgacaccagcggcgctgcgctctccggaaaaccccgttgccgtcggcagaaatggtgaagggcaggcaaggcgagcgcgtcaggctgtatgttcgaggaacgatccttggatacaagagatcgaagtcgaaccagtatgagaacacgtcgctgatccagatcgagggggtgaacaccaaagaggaggtcgcctggtactgcggcaagaggatggcgtatatctacaaggccaagaccaagtcggacgggagccggtaccggtgcatctggggcaaggttacacgcccccacgggaacagcggtgttgttcgcgccaagttcaagtccaaccttccgcccaagtccatgggtgggaaggttcgagttttcatgtacccgagcaacatataaggtatgatgatttggtgtgactgaaggcagcctggcagctgagttagtgacatctgaatttagaggtttttcttttagcatgtcaaaaatgatgtttaataccaggaccatttactgtttctgcagtcttctcattacaaatgcggaacttaaatttttacctttagaagttattgcatgtcgtgttagttttacccaaaaaaaaaaaactacgtagactacgaccg

SEQ ID NO: 2431 - DNA, 520 bp, Elaeis guineensis
gttctagggtttctcccactcgacaccagcggcgctgcgctccccggaaaaccccgtcgccgtcggcagaaatggtgaagggcaggcaaggcgagcgcgtcaggctgtatgttcggggaacgatccttggatacaagagatcgaagtcgaaccagtatgagaacacgtcgctgatccagatcgagggggtgaacaccaaagaggaggtcgcctggtactgcggcaagaggatggcgtatatctacaaggccaagaccaagtcggacgggagccggtaccggtgcatctggggcaaggttacacgcccccacgggaacagcggtgttgttcgcgccaagttcaagtccaaccttccgcccaagtccatgggtgggaaggttcgagttttcatgtacccgagcaacatataaggtatgatgatttggtgtgactgaaggcagcctggcagctgagttagtgacatctgaatttagaggtttttctttaactatgtacaaaatagatgtttaataccaggacc

SEQ ID NO: 2432 - DNA, 468 bp, Elaeis guineensis
ccagcggcgctgcgctccccggaaaaccccgtcgccgtcggcagaaatggtgaagggcaggcaaggcgagcgcgtcaggctgtatgttcggggaacgatccttggatacaagagatcgaagtcgaaccagtatgagaacacgtcgctgatccagatcgagggggtgaacaccaaagaggaggtcgcctggtactgcggcaagaggatggcgtatatctacaaggccaagaccaagtcggacgggagccggtaccggtgcatctggggcaaggttacacgcccccacgggaacagcggtgttgttcgcgccaagttcaagtccaaccttccgcccaagtccatgggtgggaaggttcgagttttcatgtacccgagcaacatataaggtatgatgatttggtgtgactgaaggcagcctggcagctgagttagtgacatctgaatttagtaggttttttctttaactat

SEQ ID NO: 2433 - DNA, 515 bp, Elaeis guineensis
agcggcgctgcgctccccggaaaaccccgtcgccgtcggcagaaatggtgaagggcaggcaaggcgagcgcgtcaggctgtatgttcggggaacgatccttggatacaagagatcgaagtcgaaccagtatgagaacacgtcgctgatccagatcgagggggtgaacaccaaagaggaggtcgcctggtactgcggcaagaggatggcgtatatctacaaggccaagaccaagtcggacgggagccggtaccggtgcatctggggcaaggttacacgcccccacgggaacagcggtgttgttcgcgccaagttcaagtccaaccttccgcccaagtccatgggtgggaaggttcgagttttcatgtacccgagcaacatataaggtatgatgaattgtgtgactgaaggcagcctggcagctgagttagtgacatctgaatttagtaggtttttctttaacatgtacaaaaatgatgtttaataccaggacctattactgtttctgcagtcttct

SEQ ID NO: 2434 - DNA, 636 bp, Allium cepa
tcccataaaggccgccacttccaatctcagattcaacaatggcgaaggagcgacaaggccagcgcgtcagactttacgttcgaggaacggttttgggatacaagagatcgaaatcgaatcagtatgaaaacacttcattgatgcaaattgaaggagtgaatacgaaagaagacgtggcctggtattgtggtaagcggctggcatatatttacaaggcgaaagtgaagaaaaatggaacacattttaggtgtatttggggaaaagtcactcgtcctcatggaaatagtggagttgtgagagctaagttcaggtcgaatctgcctcctaaagcaatgggtgctaaggttagggtgtttatgtacccaagcagtatctgagctaactggcttgattaaagagtgctagctgtaagcagtggagaactcgttagttccgtaggaatatcaaaattgtgtctgaactgtgaacttatatgttattattttgaattttatttatctctgagttggtttttatcacatttgcatcgattttgatttatagcttatacggttatcctattatttctgagttgggtatctgctttctgttcttgctttctgttcttatgttcaaacacagtggaggttatgagtt

SEQ ID NO: 2435 - DNA, 651 bp, Primula obconica
agtctttctctcgtcgtcggctgtttcctgaatcgtctttctctctctaccctccggcaaaaatggtgaaggggcgccaaggcgaacgcgtccgactatatgtcaggggaaccatcctcggctacaagaggtcaaagtcgaaccagtatccaaacacgtcactggtacaaattgagggagtgaacactaaggaagacgtgacatggtatcagggaaagcgtatggcgtatatctacaaggctaaagtgaagcagaatgggtctcactaccgttgcatatggggaaaggtctcgaggcctcatggtaacagtggtgtggtccgtgccaaattcacgtccaacctacctcctaaatccatgggtgctagagtgagggtcatgatgtaccccagtaacatttaagtttgcaagaaatttgagagacaactggcagagataattgctagagtatctttaagtttctcgaattgttggagtattctgaggtttttgtgtgttatgtggagcttaaaagcttatggcattaattttgttgtttagacttgaagaatagaatgtttctacagatgtttgctacttatgtgtttatttagctttgtgcttaccgttttgtgtccatggagttttagtttgctcgttatgcacctcttct

SEQ ID NO: 2436 - DNA, 665 bp, Primula obconica
agggctttctctctcgtcggctgttttctgaatcgtctttctctctctaccctccggcaaaaatggtgaaggggcgccaaggcgaacgcgtccgactatatgtcaggggaaccatcctcggctacaagaggtcaaagtcgaaccagtatccaaacacgtcactggtacaaattgagggagtgaacaccaaggaagacgtgacatggtatcagggaaagcgtatggcgtatatctacaaggctaaagtgaagcagaatgggtctcactaccgttgcatatggggaaaggtctcgaggcctcatggtaacagtggtgtggtccgtgccaaattcacgtccaacctacctcctaaatccatgggtgctagagtgagggtcatgatgtaccccagtaacatttaagtttgcaagaaatttgagagacaactggcagagataattgctagagtatctttaagtttctcgaattgttggagtattctgaggtttttgtgtgttatgtggagcttaaaagcttatggcattaattttgttgtttagacttgaagaatagaatgtttctacagatgtttgctacttatgcgtttatttagctttgtgcttaccgttttgtgtccatggagttttagtttgctcgttatgcacctcttctttcaccctgcttgg

SEQ ID NO: 2437 - DNA, 649 bp, Primula obconica
tcgtcggctgtttcctgaatcgtctttctctctctaccctccggcaaaaatggtgaaggggcgccaaggcgaacgcgtccgactatatgtcaggggaaccatcctcggctacaagaggtcaaagtcgaaccagtatccaaacacgtcactggtacaaattgagggagtgaacactaaggaagacgtgacatggtatcagggaaagcgtatggcgtatatctacaaggctaaagtgaagcagaatgggtctcactaccgttgcatatggggaaaggtctcgaggcctcatggtaacagtggtgtggtccgtgccaaattcacgtccaacctacctcctaaatccatgggtgctagagtgagggtcatgatgtaccccagtaacatttaagtttgcaagaaatttgagagacaactggcagagataattgctagagtatactttaagtttctcgaattgttggagtattctgaggtttttgtgtgttatgtggagcttaaaagcttatggcattaattttgttgtttagacttgaagaatagaattgtttctacagatgtttgctacttatgtgtttatttagctttgtgcttaccgtttttgtgtccatggagttttagtttgctcgttatgcacctcttctttcaccct

SEQ ID NO: 2438 - DNA, 645 bp, Primula obconica
ccgaaaaggctttctctctcgtcggctgttttctgaatcgtctttctctctctaccctccggcaaaaatggtgaaggggcgccaaggcgaacgcgtccgactatatgtcaggggaaccatcctcggctacaagaggtcaaagtcgaaccagtatccaaacacgtcactggtacaaattgagggagtgaacaccaaggaagacgtgacatggtatcagggaaagcgtatggcgtatatctacaaggctaaagtgaagcagaatgggtctcactaccgttgcatatggggaaaggtctcgaggcctcatggtaacagtggtgtggtccgtgccaaattcacgtccaacctacctcctaaatccatgggtgctagagtgagggtcatgatgtaccccagtaacatttaagtactaaggatgatgtttgatatcatacacttttatcgtcattgcagtttgcaagaaatttgagagacaactggcagagataattgctagagtatctttaagtttctcgaattgttggagtattctgaggtttttgtgtgttatgtggagcttaaaagcttatggcattaattttgttgtttagacttgaagaatagaatgtttctacagatgtttgctacttatgcgtttatttagct

SEQ ID NO: 2439 - DNA, 474 bp, Eutrema halophilum
gctttatggttttttttcctttgcctccgttttctgaaggcaagtgccaatttcttccaccggacgattcgacaaaatggtgaaaggacgccaaggagaacgtgtcagactctatgtcagaggaaccatacttggatacaaaaggtcaaagtcgaaccagtacccaaatacgtccctagtccaagtcgaaggagttaacacaacagaggaagtggcatggtacaaagggaaacgaatggcttacatctacaaagccaagaccaagaagaatggtagtcactaccgttgcatttggggcaaagtcacaaggcctcacggtaacagcggcgtggttcgagccaaattcacatccaacttgcctcctaaatcaatgggagcccgagttcgagtgtttatgtatccgagcaatatctaaaactttgtgaactgttttttttgttctgcaagtcaagtcttcgttagtggaccttgttt

SEQ ID NO: 2440 - DNA, 501 bp, Eutrema parvulum
tattagggtttttccagttttttctgaaagcaactgccgattacttccaccgggcgattcgacagaatggtgaaaggacgccaaggagaacgtgtcagactctatgtcagaggaaccatacttgggtacaaaaggtcaaagtcgaaccagtacccaaacacgtcgctagtccaagtcgaaggagttaacaccacagaggaagtggcatggtacaaagggaaacggatggcttacatctacaaagctaagaccaagaagaacggtagtcactaccggtgtatttggggcaaagtcacaaggcctcacggtaacagcggcgtggttcgagccaaattcacatcaaacttgcctcctaaatcaatgggatctcgagttcgtgtgtttatgtatccgagtaacatctgaagctttgtgtactgatcaactggctttttgtctgcaagtcttttttaatgaactttcactattgtttgactcgatattttggagaaactatttggt

SEQ ID NO: 2441 - DNA, 4962 bp, Brassica rapa
atataagctcctacttatgttttagggttttgcttcttccgtcttcctcattttgcagcagtcttgttcgttttatcagccgacgcgaaaatggtgaagggacgccaaggagaacgtgtcagactctacgttaggggaaccatcttgggatacaaaaggtccaagtccaaccagtacccaaacacatcccttatccagatcgaaggagtcaacactacagaggaggtaacatggtacaagggaaagaggatggcttacatctacaaggctaagaccaagaagaacggtagccactaccgctgcatctggggaaaggttaccaggcctcatggtaacagcggtgttgtccgtgccaaattcacatcgaacttgcctcctaagtccatgggaatgagggtcagagtcttcatgtatccgagcaacatatgaagaacagcatcaactttgagttagctgtggttttgtccactagttcgttgttttgtattttgatactgaaagcattttcctttctttgttttaagtgttttggtgattatctgaacgacttcaaaatcatgaaactggtttttgatcccaaattaaaatctctcccatctttctttcacctcataggttccaatagacaaacaacgcttctgcagagaagctcaacaaatcaattatggggttccgttagattccaaacctcaaagccgcggtctttgaatttgaaccgaactaaagctgctggcttgagatgctctacgcctagagcgtctctctccgttgttgagcaaccgagcttggttgagaagcctgcttcagaggttatccattactaccgagtgccattgattcaagaaagcgcaaacgctgagcttctcaaggcggttcaaaccaaaatcagcaaccaggttgtcggtttatcaactgagcagtgtttcaacattggtcttgagactgaattagcagaagaaaaggtgtctgttctgaagtggattcttcaagaaacatttgagccagagaatctaggaactgatagttttcttgagaggaagaagcgggaaggacttcacgctacaatcattgaagtaggtcccaggctctctttcacaacagcatggtccaccaacgcagtttcgatatgcagagcttgtggtttaaacgaagtgactcgcttagaaaggtctaggaggtacctcctgtttagcaacgagccactctcagagaatcaaacaaacgagttcgctgcaatggttcacgatagaatgaccgagtgtgtctaccttcaaaagctgacttcatttgagactaacgtggttcctgaggaagtgaagtatgtgcctgtgatggagaaagggagagaggctttggaagaaatcaaccagaagatgggtttagcatttgatgagcaagatctgcagtattacacaagacttttcagagatgacatcaagcgtaaccccaccaatgtggagctgtttgacatcgctcagtccaacagcgagcatagtaggcactggttcttcgctgggaacattgttattgatgggaagccaatggataggtctcttatgcagattgtaaagagcacttgggaggcaaatagaaacaactcagtcattgggtttaaggacaactccagtgctataagaggcttcatggtgaaccagctacgtcctctccttcctggctccacttgcttacttgatctcagtgcacgtgatcttgacatactcttcactgctgagacacataacttcccttgcgcggtggctccttaccctggcgctgagacaggcgctggaggaagaatcagagacacgcacgcaactggaagaggctctttcgtggttgcatccacctctggctactgtgttgggaacctcaacatggaaggctcttacgctccatgggaagactcttctttccaatacccatcaaaccttgcctcaccgttgcagatacttgtagacgctagcaacggtgcgtctgactatgggaataaatttggagagccgatgattcagggatacaccaggacctttgggatgaggctgccgagtggggagagacgagagtggctgaaaccgattatgttcagtgctgggattggacagattgaccactctcatataaccaaaggcgagccggaagttgggatgcttgtagtcaagatcggtggacctgcgtaccgtattggaatgggaggaggtgctgcttcgagtatggtcagtggtacgaacgatgctgaccttgatttcaacgctgtgcagcgtggagacgctgagatgtctcagaagctctaccgtgtggttcgtgcttgcattgagatgggggagaagaatcctattgttagtattcatgatcaaggcgctggtgggaactgtaatgtggtgaaagagattatttatcccaaaggtgctgagattgatataagagctgttgttgttggtgatcacactatgtcggtgttggagatttggggagctgagtatcaagagcaagatgctattttagtgagagctgagagtagagaggttttggagtcgatctgtaagagggagaggctttcaatggctgtgcttgggacgattaatggagaaggtcgttgtactttaatcgacagcacagctaaagcgaagtgtgagaaggaaggcttacctccacctcctcctgctgttgatcttgagctggagaaggttcttggcgacatgcctaagaagacgtttgagttcaagcgcgttgattacgcgcgggagccgcttgatatagctcccgggattacgttgatggactctttgaaaagagttctgaggttaccctcggtgtcttcaaagcggttcttgacaaccaaagttgatagatgcgtgactggtctagttgcgcagcagcaaacagttggaccgttgcagatcactcttgctgacgttgcagtgatagcacagacgttcactgatcttacaggcggtgcgtgtgccattggtgagcaacctattaaaggtctgctttatccaaaagccatggcgagactagccgttggagaggcgttgacgaatcttgtttgggcgaaggttactgcgttgtctgatgttaaagctagtggtaactggatgtatgctgctaagcttgaaggagaaggttcagcgatgtatgatgctgcgattgctctagctgatgccatgattgagcttgggattgcgattgatggtgggaaagatagtctctcaatggcagctcatgcggatggtgaggttgttaaggctccagggaaccttgtgatcagtgcttatgttacatgtcctgacatcacaaagacagtgactccagatctgaagcttgatggtggtgttctgttacatgttgatttggcaaaggggaagcggaggttaggtggatctgcactggctcaggtctttggtcagattgggaacgactgtcctgatgttgatgatgttccttatctgaaaaacgtcttcgagggagttcaagctctcatctcagaggacttggtatctgctggacatgatatcagcgacggtggactaatcgtagcagctttggaaatggcctttgctggaaacaaaggtgtaagcctcaacttagattcaaacgggataagcctctttgagactttgtttgctgaagaactcggtctcgtgatggagattagcaacaagaacttagacgctgtgttggagaagctccgtggttttaatgttgcggctgagatcattgggaaagtcaccgagtctcctttgattgaggtgaaagtggatgggatcactcatttgagtgaggaaacttctttcctcagagacatgtgggaggacacgagtttccagctggagaagcttcagagactagcgtcttgtgtggagatggagaaagaaggtttgaagctgaggcatgagcctaactggaagctctcatttactccttcctggaccaatgatagttatatgtctaaggatgttaaaccgagagtagctgtaatccgagaggaaggcagcaacggagacagggagatgtcagcagcattctacgctgctggttttgaaccgtgggatgtgacagtgtctgacctcttagctggagcaatcactcttgatgagttccgtgggatagtctttgttggagggtttagttacgctgatgtactcgactcagccaaaggatgggctgcttcaatcagattcaacgagcctcttctaagtcagttccaggagttttacaaaagaccagacaccttcagcctcggaatctgcaacggctgtcagctaatggcattgttaggatgggttccaggccctcaagtcggcgggtcactcgacacggcgcagccgaggtttgtccacaacgagtcaggaaggtttgagtgcaggttcacaagcgtgaccattaaggactcgccgtcgataatgctgaagggaatggagggaagcaccttaggagtttgggcggctcatggagaaggacgagcttatttccctgacgaaggagtcttggaccgtatgcttcattcagatttggctccgttgagatactgtgatgatgatgggagcgtgactgaagcttatccttttaatcttaatggttcaccgttggggatagcggctatatgctcgcctgatgggagacatttggcgatgatgcctcatcctgaacggtgtttcttgatgtggcagtatccgtggtacccgaaggggtgggaggttgagaaagctgggccgagtccgtggttgaagatgttccagaatgctagggactggtgctctcagctttaagagtcatcttttaagcatatggcgttatgaatctttttctagagtgttttgttgtgcgtttggtatttgccgagttttcgaatctgctgtttagtgagagtgctctgacacttgggtctacgttttgaatttgattatacattttcatatgaagaaataagaaaatagtaaatcgagtatgttatctaataga

SEQ ID NO: 2442 - DNA, 416 bp, Heritiera littoralis
gaggtctctctcttgtagtcgcctttaatagaatagaaaggaagaagcttcagcttccaaatcggaaaaaatggtgaagggacgccaaggagagcgagtcagactctatgtaagaggcaccatcttgggttacaagaggtcaaagtcaaatcagtacccaaacacctcattgatccagattgagggagttaacaccaaggaggaagtagcttggtatgctggcaaacgtatggcttatatttacaaggctaaggtgaagaagaacggctcacactatcgctgcatttggggaaaagttactagacctcatggtaacagtggtgttgttcgtgctaagttcaagtctaacccttccccccaaatctatgggagataaagtcagagtcttcatgtaccccagcaatatatgagttgtc

SEQ ID NO: 2443 - DNA, 599 bp, Primula obconica
cgaaaaggctttctctctcgtcggctgttttctgaatcgtctttctctctctaccctccggcaaaaatggtgaaggggcgccaaggcgaacgcgtccgactatatgtcaggggaaccatcctcggctacaagaggtcaaagtcgaaccagtatccaaacacgtcactggtacaaattgagggagtgaacaccaaggaagacgtgacatggtatcagggaaagcgtatggcgtatatctacaaggctaaagtgaagcagaatgggtctcactaccgttgcatagtgggggaaagtctcgaggcctcatggtaacagtggtgtggtccgtgccaaattcacgtccaacctacctcctaaatccatgggtgctagagtgagggtcatgatcgtaccccagtaacatttaagtttgcaagaaatttgagagacaactggcagagataattgctagagtatctttaagtttctcgaattgttggagtattctgaggtttttgtgtgttatgtggagcttaaaagcttatggcattaatttgttgtttagacttgaagaatagaatgtttctacagatgtttgctacttatgcgtttatttagct

SEQ ID NO: 2444 - DNA, 456 bp, Primula obconica
tcgtcggctgtttcctgaatcgtctttctctctctaccctccggcaaaaataggtgaaggggcggccaaggcgaacgcgtccgactatatgtcaggggaaccgatcctcggctacaagaggtcaaagtcgaaccagtatccaaacacgtcactggtacaaattgagggagtgaacactaaggaagacgtgacatggtatcagggaaagcgtatggcgtatatctacaaggctaaagtgaagcagaatgggtcgtcactaccgttgcatatggggaaaggtactcgaggcctcatggtaacagtggtgtggtccgtgccaaattcacgtccaacctacctcctaaatccatgggttggctagagtgagggtcatgatgtaccccagtaacatttaagtttgcgagaaatttgagagacaactggcagagatgattgctagagtatctttaattttct

SEQ ID NO: 2445 - DNA, 677 bp, Secale cereale
tcccgtgatgggatcttgacacaatctggaccgtccaatccacgaccacgaacttttaaaaccccgtgctctagggttcattcctctgcgccgcccacctccccccccccttcccaccaccaccttcctcggccaccggcggcggcgacaatggtgcagggacggcaaggtcagcgcgtcaggctctacgtgcggggcaccatcctgggctacaagaggtccaagtcgaaccagtacgagggcacgtcgctgctgcaggtgagggggtgaacaccaaggaggacgtgtcgtactacgccggcaagcgcatcgcctacgtgtacaaggccaagaccaagagcagcggcaccaccgtccgctgcatctggggcaaggtcacgcgcccccacggcaactccggcgtcgtgcgcgcgcagttccggtccaacctccccgccacctccatgggcaagaaggtccgcgtctttatgtaccccagcagcacctgaagggtgtgttgcctgttctatttagttgtagctgtcttcctggatgtctgttatcagtttgatgacaggtttatgaccaaagattttgtcgttgattttggaagagtttagttatagaatgttagtttcatctcatgtactgtaactcagaaatgaagtattcataatatattgatcgagatgaggttt

SEQ ID NO: 2446 - DNA, 4955 bp, Eutrema halophilum
gacgagaagcaggggagcaatatataaattcgttgttgatctattagggttttcttctccgtcttcctcagcagcatcagtcttgctttaatcggccgacgcaaaaatggtgaagggacgccaaggagaacgagtcagactctacgttagaggaaccatcctcggatacaaaaggtcgaagtcgaaccagtacccaaacacatcccttatccagatcgaaggagtcaacacccaggaggaggtaacatggtacaagggaaagagaatggcttacatctacaaggctaagaccaagaagaacggtagccactaccgttgcatctggggaaaagttacaaggcctcatggtaacagcggtgttgtccgtgctaagttcacatcgaacttgcctcctaagtccatgggaaacagggtcagagtcttcatgtatcccagtaacatttgaagcgaagtgaaacagcataaacttgatttagctgtggttttgtccactagttctttattttgtacttgatattgaaagcatttttcttgttcttcgtttgaagtgtttggagattatctgaatagactttgagcatggatctggtttttaattccaaattagaatctttttccccctcgtactgccatgttctcaagcgtcataggttccaatagacagacgacgcttttgcagcgaagctcaactagtcaactgtggggttctgttagatatcaaacctcacaaaggctgtctctgaatcgaacaaaagctgctggcttgatatgttctgctcagcctaataagcctggagcagctgtttctacaggtcctgttgtgtctgttgaggagcaaccgagcttggttgagaaacctgctgcagaggttatccatttctatcgcgtgcctttgattcaagaaagcgcaaacgctgaacttctcaagtctgttcaaaccaaaatcagcaaccagattgtcagtttggcaactgagcagtgtttcaatattggacttgaatcggagttagaagatgaaaagctcttggttctgaagtggattcttcaagaaacatttgagccagagaatttaggcacggatagttttattgagaggaagaagcaggaaggacttcatgctacaattgttgaagttggtcctagattgtcttttactacagcatggtccaccaatgcagtttcaatatgtagagcatgtgggttaaacgaagtgactcgcttggaaaggtctaggaggtacctcttgttcagcaaggagccactgttggagaatcaaataaaggaattcgctgcagtagttcacgatcgaatgaccgagtgtgtgtactcccaaaggctgatttcatttgagacaaatgtagttcctgaggaagtaaagtatgtgcctgttatggagaagggtaggaaggcgctggaagaaatcaaccaggagatgggtttagcctttgatgagcaagatttgcagtattatactagactgttcaaagatgacattcagcgtaaccccaccaatgtggagctttttgatatcgctcaatccaacagcgagcacagtcgacattggttctttgctgggaaaattgttattgatggaaagccaatggataggtctcttatgcaaattgtaaagagcacttgggaggcaaatcagaacaattccgtcattgggtttaaggataattctagtgctataagaggctttatggtgaaccagctacggcctctacttcctggttctacctgcttgcttgatatcagtgcacgtgatctcgacatattgttcactgctgagacccataatttcccttgtgcggtggctccttatcctggtgctgagacaggtgctggaggtcgaatcagggatacacatgcaacaggaagaggctcttttgtggttgcatccacttctggttactgtgttgggaacctcaacatggagggatcttatgctccatgggaagactcgtctttccagtacccgtcgaacctagcttcacctttacaaatactcatcgatgctagtaatggtgcatcagattatgggaacaaattcggagagcctatgattcaaggatataccagaacttttgggatgagactgccaagtggggatagaagagaatggttgaaaccgattatgtttagtgcaggtattggacagattgatcatactcatataactaaaggggagccagaagttgggatgcttgttgttaagattggtggtcctgcttaccgtattggaatgggaggaggagcagcttcgagtatggttagtggtcagaatgatgcagagcttgatttcaatgctgtgcagcgtggagatgctgagatggcgcagaagttgtaccgtgtggtccgtgcttgcatcgagatgggcgagaagaatcccattatcagcattcatgatcaaggtgctggtgggaactgcaatgtcgtcaaagagattatatatccacagggtgcagagattgacataagagcggttgttgttggtgatcatactatgtcggtattggagatatggggagcagaatatcaagagcaagatgccattttggtgaaagctgagagccgagagattttgcaatcgatctgtaagagggaaaggctttcaatggctgtgattggaacaatcaatggggagggtcgctgtactttaattgacagcacagctgcagcaaagtgcagtaaagaggggctacctccacctcctcctgctgtggattttgaactcgagaaggttcttggtgatatgcctaagaagacgtttgagttcaaccgcgtggcatatgtacgggaaccacttgatattgctcctgggattacattgatggattctttgaaaagggttctgcgtttgccatcagtttcttcgaagcgtttcttgacaaccaaagtggatagatgtgtgacaggtcttgttgcacagcagcaaacagtcggaccattgcagatcacccttgctgatgttgcagtaattgcacagacattcacagatctaacaggtggtgcgtgtgctattggcgagcaaccgattaaaggtctgcttgatccaaaagccatggctagactagctgttggagaggctttgacaaatcttgtttgggcaaaagtcactgcactttctgatgttaaagccagtggtaactggatgtatgctgccaaacttgaaggagaaggatcagcaatgtatgatgctgcaattgctctatctgaagcgatgatcgaacttggcattgcaattgatggtggaaaagacagtctttcaatggcagctaatgcggatggtgaggttgttaaagcgccaggaaatcttgtgattagtgcctacgttacctgtccagacataacaaagacagtgactccggacctgaagcttggagatgatggtgttctcttgcatgttgatttggccaagggaaagcggagattaggtggatctgcactggctcaggtttttggtcagatcggaaacgactgtcctgatgttgatgatgttccatatctgaaaaacgttttcgagggcattcaagctctcatttcagaaaacttggtatctgcgggacatgacatcagcgatggtggactagttgtagcagctatggaaatggcttttgctggaaacaaaggtataaacctcaacttggcttcgaacgggattagcctctttgagactttgttttctgaagaactcggtctcgtgatggagattagcaacaagaacttagacgctgtgatggaaaaactccgtggtttcgatgttactgctgagatcattgggaaagtcactgacgctcctttgatagaggtgaaagttgatgggattactcatttgagtgagaaaacttcgttcctcagagacatgtgggaagacaccagtttccagttggaaaagctgcagcgactggcatcttgtgtagagatggagaaagaaggcttgaaattgaggcatgagcctaactggaaactctcatttactccttcctggaccaacaatagttatatgtccaaggttgttaaaccaaaagtagctgtgatccgagaggaaggcagcaacggagacagggaaatgtcggctgcattttacgccgccggttttgaaccgtgggacgtgacggtgtctgatcttctagccggagcaatcactcttgatcagttccgtgggattgtgtttgtgggagggtttagctacgcggatgtccttgactcagccaaaggttgggctgcttcaataagattcaacgagcctctcctcactcaattccaggagttctacaaaagaccagacacgttcagcctgggaatctgcaatggatgtcagttaatggccttgttaggatgggttccaggtcctcaagttggcgggtcactcgacacgtcacagccaagattcgttcacaacgaatcaggaaggtttgagtgtaggttcacaagcgttaccataaaggactcgccatcgataatgctgaaaggaatggagggaagtactttaggggtttgggcagctcatggagaaggacgggcttatttcccggacgaaggagtcttggaccatatgcttcactcagatttggcaccattgagatactgtgatgatgatgggagcgtgactgaagcttacccttttaacctcaatggttcaccgttggggatagctgctatatgttcccctgacgggagacatttggcgatgatgcctcatcctgagcgttgtttcttgatgtggcagtttccttggtacccgacaagctgggacgttgagaaagctgggccgagtccgtggttgaagatgttccagaatgctagagactggtgctctcagctttagagtcatgttatgacaattttgttgtttggtgtttgcagagtttttgaaagaagttgtcgaatctgctatgacaattgacttttacgttttgtttcaattgattgcacattttacacagtggaaa

SEQ ID NO: 2447 - DNA, 751 bp, Zostera marina
gcttaacataccagacacggcgccgtcggcatcacatcgacaagcaaatcagcacaaagatggttaagggaagacaaggcgaacgcgtcaggttgtacgttcgtggaaccattctgggttacaaaagatcgaaatcgaaccaatacgagaacacatccttggtccagatcgagggagtgaatacgaaggaagaggtttcatggtacgctgggaagagaatggcttacatttacaaggcgaagactaagaaagatgggtcactttacaggtgcatttgggggaaagtaactcgttcccatggaaacacagggatcgttcgggctaagttcaagaggaatttgccagccaaagcaatgggcgataaagtgagggtcttcatgtaccctagcaatatttgaagttttttgcttaattggcgtcatggacggacatggatggaattctctacatgaagctaattttgagttttgttttattttctatgttaagaacagacgacatgcgtttaatttcttgtggatgttattgttatcgtgctatttcgactattttttggtcattctgttgttttattctgctagattttaggttttttcagtcatacttgcttggggtacttctaaagttatatttttattttcgtaatcttgatgctattatttattaatctccattgattagagtctttgagttttaaaaaagttgtggtttcaaatagtgctgcgtatgaagtgtgtattgtattaatcca

SEQ ID NO: 2448 - DNA, 903 bp, Amborella trichopoda
tgggcatttgttttctcgataaataagaggagttacgccctctagggggtctctcatttttagggtttgtagttcactccccttcgtctgcaacttttggcgaaaatggtgaaggctcagggggagcgcgtaagattatatgtgagggggactatccttggatacaagaggtccaaatcgaatcagtatgagaatacttccttggtccagattgagggggttaacactaaggaggaggtagcctggtaccttgggaagcgtatggcctatatttacaaggctaaggtgaagaagaatggctcccactataggtgcatttggggaaaggtcaacaggccccatggtaacagtggtgtagttcgagccaagttcaagtcgaacttgccacctaggtctatgggagcgaaggtcagggttttcatgtacccaagcaggatttgagtgcaaggattcttttcgaggctcgatctccagagtaccagtttgggaagttagaatgttttttccagattgcttttttttttttctttttaactagtgttggtactaggtgacatgactctcgattattcgcacactttcctttccccatctgcactatataaatggaacatacatgatgctttggggtattgattggattagtatggatgtttttcaatgtttatttgttcataggttgcaaattaaagtcctatgctactggaaacttgttttactttatgcgatttcaatattcagatcagtgcatttacatggggccttgtgcccttaggtcctgtgaatgtattttacaagtgttccatgtatgtttcagtattatgacattcttttttgcttgttaatcttactcaatttattttaataaaatgggtcgtatgatccatgttatattgagaaatt

SEQ ID NO: 2449 - DNA, 523 bp, Ambrosia trifida
gtacaatctggtgaatcacaatggtgaagggcggtcaaggagaacgcgtcagactctacactagaggaacaattcttggctacaaaaggtcaaagtcaaaccagtacccaaacacatcgttagttcaaattgaaggagtgaacacgaaggaggaggttgcatggtatcaagggaaacgtatggcgtacgtatacaaagctaaagtgaagaagaacggatcacattatcggtgcatttgggggaaagttaccaggcctcatggtaacactggtgttgtgcgagcaaagttcaagtctaatcttcctcctaaatctatggggtctagggttagagtgttcatgtacccaagcaacatttaagtttctttgaagaacatgaagattgttgctgctggtaatttaatcgtttttgtagtagttgtgttgaccgtttgttatggaacatcgttcttttcacatgaacatcagcatatctttgaatctttacaccaaatttcgatgacatcaattccatcatattcgag

SEQ ID NO: 2450 - DNA, 725 bp, Amorphophallus konjac
gccgcccgccgtcttctccgagctctgccccgcaggaggaggaagcaagaccttcggcgccgctgcagaaatggtgaaagggcggcaaggcgagcgcgtcaggttatacgtccgggggacgatcctcggatacaagaggtcgaagtcgaaccagtatgagaacacttcgctgatccagattgagggtgttaacacgaaggaggaggtggcgtggtactgcgggaagcgcctggcttacgtctacaaggccaaggtgaagaagaacgactcccattaccggtgcatctggggaaaggtcgctcgcccccatggcaacagcggcgtcgtgcgcgctaagttcaagtccaacctcccacccagatccatgggcgctaaagtcagagttttcatgtacccgagcaatatttgagtgagatttctctgaaagcatgaagctctggagcatgtgaaaaagcagctagacggaagaaaacgtttttttgtaatctagcgttttgatatgcgatataagtttgaactttgttttcctacgcattgttgtcagttaaaatgaactggagtagattgagaccatcttgatgtgcttttgtttttggtatgaagtattcgttcaagaaatagattctttgttctctgcgcgttgatgttaagcggttcaagttttaacctgctcaggaggaattctaagtaccgcactttttgtttctttgtcatttatcttgagt

SEQ ID NO: 2451 - DNA, 640 bp, Amsonia hubrichtii
ttcctccactcgttaaatccccgcctccccaccccagcccttgcccctgccgccgccgatcgaaaatggtcaaaggacgccaaggagaacgtgtcagactctatgttagaggtacagtattgggatacaagaggtccaaatcaaatcagtacccaaacacctcattgattcagatcgagggggtgaacaccaaggaggacgtagcttggtacctcgggaagcgcatggcctacatttacaaggctaaggtgaagcagaatggatctcactaccgttgcatttggggaaaggtctgcaggccacacggaaacagcggagttgtccgagctaagttcaagtccaacctccctcctaaatccatgggagctaaggttagggtgttcatgtaccccagcaatatataagtgtcgcaagaactgtagaagaaaaatcttaaagtcatctgtgattttgggaggcatacatggctagatcaaggtcatggtgattcaaggattttactagatagtaattagagtcaatttcctgtgtttttggtcttacccagtgcttggttttttatactgagaattacaaaacagattcgatatgaccaattttgattatttggattctctggcttctaattatctgtgtgatt

SEQ ID NO: 2452 - DNA, 547 bp, Antirrhinum majus
catcgccgacggagcacaatggtgaagggtcgccaaggagaacgcgtcagactttacgtccgtggaacaatccttggttacaagaggtcgaaatcgaatcagtatccgaacacatcgttgatacagattgaaggagtgaacacgcaggaggaagtggcgtggtaccttgggaagcgaatggcgtacatttacaaggctaaggtgaagaagaacggttcacattatcgttgcatttggggaaaagttgctcgtcctcacggaaacagcggcgttgttcgtgctaagtttacgtcgaatctaccacccaagtcaatgggagctagagtgagggtgttcatgtatcccagcaacatttgagtggattgtggatcggaaagtgaagccagctcattaaagattagacttatatttttagttttgaaactttgtattgttaattgagattttcagcttttattctccttatttgactctgaatatgaatgctcacacggagcatgactaccaaagttttgagctaaaattctgttctgtttttttctctctg

SEQ ID NO: 2453 - DNA, 590 bp, Antirrhinum majus
  misc_feature (587)..(587): n is a, c, g, or t
gcggccgctctcagatcctcacacaggcagcagcagcagcaatggtgaaggggcgacaaggagaacgcgtcagactctatgtccgtggaacaattctcggttacaagaggtcgaagtcgaatcagtatccgaatacatcgttgattcagattgagggagtgaacacgcaggaggaagtggcgtggtacttggggaagagaatggcctacatttacaaggccaaggtgaagaagaacggctctcactaccgttgcatttggggcaaagttgctcgtcctcatggaaacagtggcgtggttcgtgctaagttcacgtcgaatcttccacctaaatccatgggagctagagtcagggtcttcatgtatcccagcaacatttgagtgcagagcacaaggtgaagccgagtcatgaagatcaagactattattttcagttatgaaacttttgtattagattagcactttcttttatgttatgttgaggagaatgggagtattgggtttattaatgaagttttgttttatttttttcgtaaaatgcatttatgtggggtttgtcgggattcggacagcttctgcgtttacacngaa

SEQ ID NO: 2454 - DNA, 342 bp, Aquilegia formosa
aaaatggtgaaaggacgacaaggtgaacgtgtgaggctatacgtgcgaggaactgttcttggatacaagaggtctaagagcaaccagtacccaagtacatcgttggttcagattgaaggagtgaacactaaggaagatgtggcatggtatgctgggaagaagatggcttacatttacaaggcgaaggtgaagaagaatggatctcactacaggtgcatctggggaaaggttacaaggccacatggtaacagtggtgttgttcgagctaagttcaagtccaaccttcctccaaaatctatgggaatgaaggtcagagtgtttatgtacccaagcaatatctaa

SEQ ID NO: 2455 - DNA, 539 bp, Arabidopsis lyrata
gataaggatacgcttattagggtttgtgagctttcgtctccgttttttgaaggcaactctgctaatttcttccaccggacgattcgataaaaatggtgaaaggacgccaaggagaacgtgtcaggctctatgtcaggggaaccatacttggctacaaaaggtcgaagtcaaaccagtacccaaacacgtccttagtccaagtcgaaggagtgaacaccactgaggaagtgtcatggtacaaaggtaaacgaatggcttacatctacaaagccaagaccaagaagaacggtagtcactaccgatgcatttggggcaaagtcactaggcctcacggtaacagtggcgttgttcgagccaaattcacatcaaacttgcctcctaaatcaatgggatctcgagttcgagtgttcatgtatccgagtaacatttaaagctctgtgtactcgtcattttttttgtctgcaagtcttgttaatggaccttgcttattatttgactcttttatcttgaactattttggagtaacaacaattttggtt

SEQ ID NO: 2456 - DNA, 593 bp, Arabidopsis thaliana
gataaggattcgcttattaggtttttttgagttttcgtctccgttttctgaaggcaactgctaatttcttccaccggacgattcgacaaaaatggtgaaaggacgccaaggagaacgtgtcagactctatgtcaggggaaccatacttggctacaaaaggtcgaagtcaaaccagtatcccaacacgtcactagtccaagtcgagggagttaacaccactgaggaagtgtcatggtacaaaggtaaaaggatggcttacatctacaaagccaagaccaagaagaacggtagtcactaccgatgcatttggggcaaagtcacaaggcctcacggtaacagtggcgttgttcgagccaaattcacatcaaacttgcctcctaaatcaatgggatctcgagttcgagtgtttatgtatccgagtaacatttaaagcagtgtgtactcgtcatcaagtggtttattatctgcaagcctttgtttatggaccttgtttattatttgactctttatcctgaaccttttttggagttaacaattttggttaaaatgagcctttttgataagtcgagttcacaagtttacccaaattttgc

SEQ ID NO: 2457 - DNA, 602 bp, Brassica juncea
gaaaatggtgaagggacgccaaggagaacgtgtcagactctatgtcagaggaaccatcttgggatacaaaaggtcgaagtcaaaccagtacccaaacacatcccttatccagatcgaaggagtcaacactacagaggaggtgacatggtacaagggaaagaggatggcttacatctacaaggccaagaccaagaagaacggtagccactaccgatgcatctgggggaaagttacaaggcctcatggtaacagcggtgtcgtccgtgccaaattcacgtccaacttgcctcccaagtccatgggaatgagggtgagagtcttcatgtatccgagcaacatttgaagcaaagtattacagcataaactttgattttagctgttgtttttttttgcccactagttcgttgttttgtatttgatactgaagcagtttctttactttgttcgaatcatggatcttgttttgaataccaagttagaatctttcttccatctctttttgatttccagccgatgaatgtcatggtttatggatttatccaaagaagtctatggatagttttttggttatgctgtaaattcgttagttaggtcagtttgat

SEQ ID NO: 2458 - DNA, 607 bp, Brassica juncea
ttgcaacagtctttgcgtttatcagcagccaacgcggaaatggtgaagggacgccaaggagaacgtgtcagactctacgttaggggaaccatcttgggatacaaaaggtcgaagtctaaccagtacccaaacacatcccttattcagattgaaggagtcaacactacagaggaggtgacatggtacaagggaaagaggatggcttacatctacaaggccaagaccaagaagaacggtagccactaccgctgcatctggggaaaagttacaaggcctcatggtaacagcggtgttgtccgtgccaaattcacatcgaacttgcctcccaagtccatgggaatgagggtcagagtcttcatgtatccgagcaacatatgaagcaaagtacaacagcatgatctttgatttagctgtggttttgtccactagttcgttgttttgtattttgatattgaaaccagtttcctttctttgtttgaattgttttggtgattatcggaacgactttaagatcatggatctagttttcaatcctaaagtaaaatctatcccagttttatttcaactcaatagtattgaagcagaagattatcggaacgactttaag

SEQ ID NO: 2459 - DNA, 413 bp, Brassica juncea
atcagccgacgcgaaaatggtgaagggacgccagggagaacgtgtcagactctacgtcaggggaaccatcttgggatacaaaaggtcgaagtcaaaccagtacccaaacacatcccttatccagatcgaaggagtcaacactacagaggaggtgacatggtacaagggaaagaggatggcttacatctacaaggctaagaccaagaagaacggtagccactaccgctgcatctggggaaaggttacaaggcctcatggtaacagcggtgttgtgcgtgccaaattcacttccaacttgcctcctaagtccatgggaatgagggtcagagtcttcatgtatccgagtaacatatgaagcaaactttgatgttgtagctgtggtttttgtccactagttcgttattttgtatttt

SEQ ID NO: 2460 - DNA, 579 bp, Brassica juncea
ggcttcctccgtcttcctcattttgcagcagtcttgttcgttttatcagccgacgcgaaaatggtgaagggacgccaaggagaacgtgtcagactctacgttaggggaaccatcttgggatacaaaaggtccaagtccaaccagtacccaaacacatcccttatccagatcgaaggagtcaacactacagaggaggtgacatggtacaagggaaagaggatggcttacatatacaaggctaagaccaagaagaacggtagccactaccgctgcatctggggaaaggttaccaggcctcatggtaacagcggtgttgtccgtgccaaattcacatcgaacttgcctcctaagtccatgggaatgagggtcagagtcttcatgtatccgagcaacatatgaagcaaagtacaacagcatgatctttgatttagctgtggttttgtccactagttcgttgttttgtattttgatactgaaaccattttcctttctttgtttgaattgttttggtgattatcggaacgactttaattaagatcatggatctagttttcaatccaaaattaaaatctatcccag

SEQ ID NO: 2461 - DNA, 666 bp, Brassica juncea
caccggagttccctcctccgttctcgcctccgcagcttcctcctccggtagcagctgcagcagtcttgcgaaaatggtgaagggacgccaaggagaacgtgtcagactctacgtcaggggaaccatcttgggatacaaaaggtcgaagtcaaaccagtacccaaacacatccctaatccagatcgaaggagtcaacactacagaggaggtgacatggtacaagggaaagaggatggcttacatctacaaggctaagaccaagaagaacggtagccactaccgctgcatctggggaaaggttacaaggcctcatggtaacagcggtgttgtccgtgccaaattcacttccaacttgcctcccaagtccatgggaatgagggtcagagtcttcatgtatccgagtaacatatgaagcaaactttgatttttagctgtggtttttctccactagtttgttattttgtatttttgatattcgaaagcagtttcctttctttgtttgaaatgttttggagattctctggttttaatcgcaaaattagaaatgttgttttctccttataattgagctggaacatatggatatctttgtcttattgactttaaataatccatgaatgacatccacactgttattgacgaacgtaattgtttttgttctatttt

SEQ ID NO: 2462 - DNA, 834 bp, Brassica juncea
ggtctctctcagtagcagcagtcttgttcgattattagccgaagcgaaaatggtgaagggacgccaaggagaacgtgtcagactctacgttaggggaaccatcttgggatacaaaaggtccaagtccaaccagtacccaaacacatcccttatccagatcgaaggagtcaacactacagaggaggtgaattggtacaagggaaagaggatggcttacatctacaaggccaagaccaagaagaacggtagccactaccgctgcatctggggaaaggttacaaggcctcatggtaacagcggtgttgtccgtgccaaattcacttccaacttgcctcccaagtccatgggaatgagggtcagagtcttcatgtatccgagcaacatttgaagcagcaaagtattacagcataaactttgatttagctgttgtttttttgcctactactagttcttcgttttgtacttgatacttaaagcagtttcccttctttgtttgaagtgcttggaagatctttaaatagactttgaatcatggatctgtttttttttatctcaaattagaatcattcttcctctctttccaagtttcagcagatgaatatcatggtttatggattgttttggctattctgtaaaatctttagttaggtcaatattgataaaacctcagcaaggcaagccagtgtagaagctgatagcttagctggagaaaaggtagaagcactagtagagcttatgtaatgtcatggatataaatgtccaaccttattttacttgtatattttgtttacatcaatggattatattccccgacaaaacaaagaatctagttcc

SEQ ID NO: 2463 - DNA, 616 bp, Brassica juncea
agcagcagcagcagtcttgcgaaaatggtgaagggacgccaaggagaacgtgtcagactttacgtcagaggaaccatcttgggatacaaaaggtcgaagtccaaccagtacccaaatacatcccttatccagatcgaaggagtcaacactacagaggaggtgacatggtacaagggaaagaggatggcttacatctacaaggctaagaccaagaagaacggtagccactaccgctgcatctggggaaaggttaccaggcctcatggtaacagcggtgttgtccgtgccaaattcacatcgaacttgcctcctaagtccatgggaatgagggtcagagtcttcatgtatccgagcaacatatgaagaacagcatcaactttgagttagctgtggttttgtccactagttcgttgttttgtattttgatactgaaagcattttcctttctttgttttaagtgttttggtgattatctgaacgacttcaaaatcatgaaactggtttttgatcccaaattaaaatctctcccatctttctttcacctcatagtaagttaaagctgaaaaaatatcattttctttagctattggttatgcaaactgaatttggggtctcg

SEQ ID NO: 2464 - DNA, 533 bp, Brassica oleracea
ggtctcctccgtttacctcagtaatagtagcagcagtcttgcgaaaatggtgaagggacgccaaggagaacgtgtcagactctacgtcaggggaaccatcttgggatacaaaaggtcgaagtcaaaccagtacccaaacactagccttatccagatcgaaggggtcaacactacagaggaagtgacatggtacaagggaaagaggatggcttacatctacaaggctaagaccaagaagaacggtagccactaccgctgcatctgggggaaggttacaaggcctcatggtaacagcggtgttgtccgtgccaaattcacttccaacttgcctcctaagtccatgggaatgagggtcagagtcttcatgtatccgagcaacatttgaagcgaaagtagaacagcataaactttgatttagctgttgtttttttgcactagttcgttgttttgtatttgatattgaaaacattttcctttcgttgtttgaatcatggatcttgtttttaatcccaagttagaatctttcttccaat

SEQ ID NO: 2465 - DNA, 547 bp, Brassica oleracea
gcttctccgttttcatcactagcagcagagtcttgcgtttttatcagccgacgcgaaaatggtgaagggacgccaaggagaacgtgtcagactctacgttaggggaaccatcttgggatacaaaaggtcgaagtctaaccagtacccaaacacatcccttatccagatcgagggagtcaacactacagaggaggtgacatggtacaagggaaagaggatggcttacatctacaaggctaagaccaagaagaacggtagccactaccgctgcatctggggaaaggttacaaggcctcatggtaacagcggtgttgtccgtgccaaattcacatccaacttgcctcctaagtccatgggaatgagggtcagagtcttcatgtatccgagtaacatatgaagcaaagtttgatgatgtagctgtggtttttgtccactagttcgttattttgtattttgatatttaaagaattttactttctttcttttgaagtgttttgttgatcatggttcatggatttggtctttaatcccaagttagaatctctct

SEQ ID NO: 2466 - DNA, 655 bp, Brassica oleracea
ggcttcctccgtcttcctcattttgcagcagtcttgttcgttttatcagccgacgcgaaaatggtgaagggacgccaaggagaacgtgtcagactctacgttaggggaaccatcttgggatacaaaaggtccaagtccaaccagtacccaaacacatcccttatccagatcgaaggagtcaacactaccgaggaggtgacatggtacaagggaaagaggatggcttacatctacaaggctaagaccaagaagaacggtagtcactaccgttgcatctggggaaaggttaccaggcctcatggtaacagcggtgttgtccgtgccaaattcacatcgaacttgcctcccaagtccatgggaatgagggtcagagtcttcatgtatccgagcaacatatgaagcaaagtacaacagcatgaactttgatttagctgtggttttgtccactagtttgttattttgtattttgatactgaaagcattttcttttctttgtttgaagtgttttggtgattatctgaacgactttatggtcattagatctggtttttgatcccaaattaaaatctctcccatctttctttcacctcatagcaagttaaagctgtattaaactaaacttaataatattctgaatgctcccgatgtttagaac

SEQ ID NO: 2467 - DNA, 799 bp, Brassica rapa
gtcttcctctcagtagcagctgcagcagtcttgcgaaaatggtgaagggacgccaaggagaacgtgtcagactctacgtcaggggaaccatcttgggatacaaaaggtcgaagtcaaaccagtacccaaacacatccctaatccagatcgaaggagtcaacactacagaggaggtgacatggtacaagggaaagaggatggcttacatctacaaggctaagaccaagaagaacggtagccactaccgctgcatctggggaaaggttacaaggcctcatggtaacagcggtgttgtccgtgccaaattcacttccaacttgcctcccaagtccatgggaatgagggtcagagtcttcatgtatccgagcaacatttgaagcagcaaagtattacagcataaactttgatttagctgttgtttttttgcctactactagttcttcgttttgtacttgatacttaaagcagtttcccttctttgtttgaagtgcttggaagatctttaaatagactttgaatcatggatctgtttttttttatctcaaattagaatcattcttcctctctttccaagtttcagcagatgaatatcatggtttatggattgttttggctattctgtaaaatctttagttaggtcaatattgataaaacctcagcaaggcaagccagtgtagaagcggatagcttagctggagaaaaggtagaagcactagtagagcttatgtaatgtcatggatataaatgtccaaccttattttacttgtatattttgtttacatcaatggattatattccc

SEQ ID NO: 2468 - DNA, 740 bp, Brassica rapa
gagagaactagggcaacacgttataaactcgtggttatgtgttagggttcggcttctcggttttcatcactagctggcagctgcagagtcttgcgtttttatcagccgacgcgaaaatggtgaagggacgccaaggagaacgtgtcagactctacgttaggggaaccatcttgggatacaaaaggtcgaagtctaaccagtacccaaacacatcccttatccagattgaaggagtcaacactaccgaggaagtgacatggtacaagggaaagaggatggcttacatctacaaggctaagaccaagaagaacggtagccactaccgctgcatctggggaaaggttacaaggcctcatggtaacagcggtgttgtccgtgccaaattcacttccaacttgcctcctaagtccatgggaatgagggtcagagtcttcatgtatccgagtaacatatgaagcaaactttgatgttgtagctgtggtttttgtccactagttcgttattttgtattttgatatttaaagaatttgactttcttttgttttgaagtgttttggttcatggatttggcctttaatcccaagttagaatctctcaaatctttttttcctcatcatatagtaagttgaatcagaatgaatatcattttctttggctattgttatcatttaaagaaattgataacgtacttgttataaacatatttcacattttatagaagataaaaaatttatatctat

SEQ ID NO: 2469 - DNA, 771 bp, Musa acuminata
agggtttcccgcagttggggttggctgctcttagtcggcgcatcggtcgcgggcaccctcatcggcggagatggtgaaggggcggcaaggcgagcgcgtcaggctgtacgtccgcgggacgatcctcggatacaagaggtcgaagtcgaaccagtacgagaacacatcgctggtccagatcgagggggtgaacaccaaggaggaagtcgcttggtactgcggcaagaggatggcgtacatctacaaggcgaagacgaagaccaaggggacgcggtaccggtgcatctggggtaaggtcgcacgcccccacggcaacagtggcgtcatccgcgccaagtttaaatccaatctgccgcctaaatccatgggtggaacggtcagggttttcatgtaccccagcaacatttgaggaggtgagtcaatgctgcagtggagatgcttttcggaatttgtagctgagattttaagggggattgaagctaaattgtgttccttgttactaaaagtagcttgactagttatgatactttatttggactacttactactcgtgttagttttgggggttaatttgctctttgaacttaaattgactcgtcggaaaactgcttctactgtgaagggtgatgttcaagttcatctcttgtgtaacttattgagctaattagaaaacattaggcagttgtgatattgtgtctccttgcggttcctggtaagataatgttgaacagcacagtagcagatagcagcaatctacctacatggaatttt

SEQ ID NO: 2470 - DNA, 522 bp, Fagus grandifolia
ctggaccttggctgtcactcagttagtcttcaattagggtttccgtctttctcagaccagagacacacagctccactcgaaaatggtgaagggtcgtcaaggagagcgcgtcagactctatgtacgaggaaccatcctcggatacaagaggtcgaagtcgaaccagtatccaagcacgtcgctgatccagatcgagggcgtgaacacgaaggaagaggtgacatggtacgcaggaaagcgcatggcttatatctacaaggctaaggtgaagaagaatgggacccactatcggtgcatttggggcaaggtttctaggcctcatggtaacagtggtgttgttcgcgccaagttcaagtctaacctccctcccaaatccatgggagctagagtgagagtcttcatgtaccccagcaacatatgagtacggtggtttatatagaggctagtttggaatcagaggtgaaacagtgaaaatttcaatttatttttgtactcaggaatcaaattagattgttgttctgg

SEQ ID NO: 2471 - DNA, 800 bp, Fagus grandifolia
ctggaccttggctgtcactcagttagggttttaggttcttctatataacttggcctctctacggtttcactctctgaatcgagcgcctccaaaaagcaaagaaaatggtgaagggacgccaaggagagcgagtcaggctctatgttagaggaacaatcctcggctacaagaggtcgaagtcgaaccagtacccgaacacatccctgatccagattgagggagtgaacaccaaggaggaggttggatggtacgctggcaagcggatggcttatatctacaaggccaaggtgaagaagaatggaactcactatcgctgcatttggggaaaggtgtctaggcctcatggtaacagcggggttgttcgtgctaagttcaagtccaatcttccaccaaaatccatgggtgccagagttagggttttcatgtaccccagcaatatataaggttgtgtagatgctggattgagctctggtgacagaagaattatgcagttacttcttttatgaactaagcttatgtcgtgttttggagctgagtcatttttgtttatttaggttggtggatgatggaacatggtttgactctttactaatctcattgagaagtttctacctgtttgtttcttgattttgagtatttggattatcattttttcatagaaatggatattgagcaatgttagttctttgtagttatatttccagtactagttttttttttttccctcttatgcttattcttaatctacattctgaggctagattaaaaaataaggttactttgaaattagaaatagcttc

SEQ ID NO: 2472 - DNA, 802 bp, Bruguiera gymnorhiza
  misc_feature (477)..(477): n is a, c, g, or t
  misc_feature (488)..(488): n is a, c, g, or t
  misc_feature (507)..(508): n is a, c, g, or t
  misc_feature (538)..(538): n is a, c, g, or t
  misc_feature (541)..(541): n is a, c, g, or t
ggttcgccaacgcagcgcggaagagactgagagctccaatcaagaggcaataatggtgaagggccgccaaggagagcgcgtcaggctctatgtgcgaggaaccgttctcggatacaagaggtcgaagtcgaaccagtatccaaacacgtcgttggtacagatcgagggagtgaacaccaaagaggaggtggcatggtacgcaggcaagcggatggcgtacatctacaaggcaaaggtgaagaagaatggtacccattatcgctgcatttggggcaaggtcactcgtcctcacggtaacagtggcgttgttcgtgcgaagttcaagtctaatctccctccaagatcaatgggagctagggttagggtcttcatgtaccccagtaatatataagtggcaataatgtgatgcggttgattttgggattatcagttgcccccgtctgtagtagcttagttctaaattttgtactcgctagnggtactagctngtcttagtatatgattttnntgcaatgaaagtgtttgtggtctacccttnaantatgatcttgaatttctttatttttttgatttttgggttttagtgaggcctgttttctttgtttttaaatttgggaacctaccaattttcccattcctggtcgggcgttcttttatgttttttttctgattttccttccttttctggttggcaggggttatcataggtatgtttggagtcgttgacattgtgtaggtcgggggagagtggatagattgagttgttgaaggtcttattacaagagttattaacgccggaggt

SEQ ID NO: 2473 - DNA, 634 bp, Brassica napus
actagcagcagagtcttgcgtttttatcagccgacgcgaaaatggtgaagggacgccaaggagaacgtgtcagactctacgttaggggaaccatcttgggatacaaaaggtcgaagtctaaccagtacccaaacacatcccttatccagatcgagggagtcaacactacagaggaggtgacatggtacaagggaaagaggatggcttacatctacaaggctaagaccaagaagaacggtagccactaccgctgcatctggggaaaggttacaaggcctcatggtaacagcggtgttgtccgtgccaaattcacatccaacttgcctcctaagtccatgggaatgagggtcagagtcttcatgtatccgagtaacatatgaagcaaagtttgatgatgtagctgtggtttttgtccactagttcgttattttgtattttgatatttaaagaattttactttctttcttttgaagtgttttgttgatcatggttcatggatttggtctttaatcccaagttagaatctctcaaatctttttttcctcatcatatagtaagttggatcagaatgaatatcatttaaatagattgataacgtacttgttataaacatattcactattttatagaagta

SEQ ID NO: 2474 - DNA, 703 bp, Brassica napus
ctccccttactccccttcggtcgttcggccgtttcgggtccgacgtacgtctagcatttgcagcagtcttgttcgttttatcagccgacgagaaaatggtgaagggacgccaaggagaacgtgtcagactctacgttaggggaaccatcttgggatacaaaaggtccaagtccaaccagtacccaaacacatcccttatccagatcgaaggagtcaacactacagaggaggtaacatggtacaagggaaagaggatggcttacatctacaaggctaagaccaagaagaacggtagccactaccgttgcatctggggaaaggttaccaggcctcatggtaacagcggtgttgtccgtgccaaattcacatcgaacttgcctcctaagtccatgggaatgagggtcagagtcttcatgtatccgagcaacatatgaagaacagcatcaactttgagttagctgtggttttgtccactagttcgttgttttgtattttgatactgaaagcattttccgttctttgttttaagtgttttggtgattatctgaacgacttcaaaatcatgaatctggtttttgatcccaaattaaaatctctcccatctttctttcacctcatagtaagttaaagctgaaaaaatatcattttcttttgttattggttatgcaaactgattttggggtcttaacttaaacttacaatg

SEQ ID NO: 2475 - DNA, 601 bp, Brassica napus
aatagtagcagcggtcttgcgaaaatggtgaagggacgccaaggagaacgtgtcagactctacgtcaggggaaccatcttgggatacaaaaggtcgaagtcaaaccagtacccaaacactagccttatccagatcgaaggagtcaacactacagaggaagtgacatggtacaagggaaaaaggatggcttacatctacaaggctaagaccaagaagaacggtagccactaccgctgcatctggggaaaggttacaaggcctcatggtaacagcggtgttgtccgtgccaaattcacttccaacttgcctcctaagtccatgggaatgagggtcagagtcttcatgtatccgagcaacatttgaagcgaaagtagaacagcataaactttgatttagctgttgttttttgcactagttcgttgttttgtatttgatattgaaaacattttcctttcgttgtttgaatcatggatcttgtttttaatcccaagttagaatctttcttccatctaacaaaaaaaaaaactagaagtactacgtaccgaaacggaccgaaccaacgaacgggggtaagtaagggtagtcagcccacccccacccc

SEQ ID NO: 2476 - DNA, 625 bp, Brassica napus
gtggttatgtcttaaggttcggcttctccgttttcatcactagctgcagagtcttgcgtttttatcagccgacgcgaaaatggtgaagggacgccaaggagaacgtgtcagactctacgttaggggaaccatcttgggatacaaaaggtcgaagtctaaccagtacccaaacacatcccttatccagattgaaggagtcaacacgacggaggaggtgacatggtacaagggaaagaggatggcttacatctacaaggctaagaccaagaagaacggtagccactaccgctgcatctggggaaaggttacaaggcctcatggtaacagcggtgttgtgcgtgccaaattcacttccaacttgcctcctaagtccatgggaatgagggtcagagtcttcatgtatccgagtaacatatgaagcaaactttgatgttgtagctgtggtttttgtccactagttcgttattttgtattttgatatttaaagaatttgactttctttgttttgaagtgttttgttgattatggttcatggatttggtctttaatcccaagttagaatctctcaaatctttttttcctcatcatatagtaagttgaatcagaatgaatatcattttctttc

SEQ ID NO: 2477 - DNA, 1106 bp, Brassica napus
tctgttttgcctaagtattttctagaagatgtcgggctttgagatgttcgaggtttgtaagagaggaggcgaagagagttggtgtgagtgatttgcacaagtgatgattgatgggttcttgggagagtacttggggattgaagttgtggtcgggagagagatgaaaatgatcggtggctactactcaggcatcttggaggatagaaaaacatgagttttatttaggtgaattggttcaagaagagaaactaagtagtggtcatgtcattggtatcacttcctataatttgccaagtcaccgatctttattctctcaattttgccaggagatctactttgtccgaaactctgacaagaaaagttggcaaaccttaccacgaaatcaatatcctaaaccattgattttccacgacggtcgtttagccattaagccaacacctataaacacactcgcactattcatgtgggccccatttgccgcagtcttagccaccgcaagagtcgtggccggcctaaaccttccttactccttagccattcctttccttgccttctccgtcttcctcattttgcagcagtcttgttcgttttatcagccgacgcgaaaatggtcaagggacgccaaggagaacgtgtcagactctacgttaggggaaccatcttgggatacaaaaggtccaagtccaaccagtacccaaacacatcccttatccagatcgaaggagtcaacactaccgaggaggtgacatggtacaagggaaagaggatggcttacatctacaaggctaagaccaagaagaacggtagtcactaccgttgcatctggggaaaggttaccaggcctcatggtaacagcggtgttgtccgtgccaaattcacatcgaacttgcctcccaagtccatgggaatgagggtcagagtcttcatgtatccgagcaacatatgaagcaaagtacaacagcatgaactttgatttagctgtggttttgtccactagtttgttattttgtattttgatactgaaagcattttcttttctttgtttgaagtgttttggtgattatctgaacgactttaaaatcatgaatctggtttttgatcccaaa

SEQ ID NO: 2478 - DNA, 556 bp, Brassica napus
gccgacgcgaaaatggtgaagggacgccaaggagaacgtgtcagactctacgttaggggaaccatcttgggatacaaaaggtcgaagtctaaccagtacccaaacacatcccttatccagattgaaggagtcaacacgacggaggaggtgacatggtacaagggaaagaggatggcttacatctacaaggctaagaccaagaagaacggtagccactaccgctgcatctggggaaaggttacaaggcctcatggtaacagcggtgttgtgcgtgccaaattcacttccaacttgcctcctaagtccatgggaatgagggtcagagtcttcatgtatccgagtaacatatgaagcaaactttgatgttgtagctgtggtttttgtccactagttcgttattttgtattttgatatttaaagaatttgactttcttttgttttgaagtgttttggttcatggatttggcctttaatcccaagttagaatctctcaaatctttttttcctcatcatatagtaagttgaatcagaatgaatatcattttctttggcctga

SEQ ID NO: 2479 - DNA, 649 bp, Manihot esculenta
gagtgctgctagggttttccgccaccgcagttcagagaagcagagcctcaagcagaaccgaagatggtgaaaagccgccaaggagagaatgtcagactctatgttcgaggaactattctcggatacaagaggtccaagtcgaaccagtacccaaacacgtcgctgatacagatcgagggcgtgaacaccaaggaggaggtagcttggtactgtggtaagcgtatggcctatatatacaaggctaaggtgaagaagaatggtacccactatcgctgcatttggggcaaagtaagtaggcctcacggtaacagtggtgttgttcgtgccaagttcaagtctaacctacctcccagatctatgggagacagggttagagtcttcatgtaccccagcagcatataagctgtgcgattcttcgttgcgggtaaaaggtggaatagttgagtttggatcatacccttacacaagagttgagctttttaggttgtgttatcaagagcaaatactagctagctgttttgtcttgttctgtttaatttgtttggattttgaaacatgagacaaatgtccgtggtctatctcgaaactgagatccattttttggcatcggaaccttttaatctcattggattttgaagtttatgcagtc

SEQ ID NO: 2480 - DNA, 683 bp, Chelidonium majus
gcagctattagaagaagaagtagcagaagggtttagctttcaggaacgaaaaaatggtgaagggacgcgaaggagagcgagtcaggttatacgtcagaggaacaattctagggtacaagaggtcaaaatcgaaccagtacccaaacacttcgttgattcagattgaaggagtgaacacaaaagaggaggtagcatggtacgctggaaagagaatggcttacatttacaaggctaaggtgaagaagaatggttctcactaccgatgcatctggggaaaagttaccaggcctcatggtaacagtggtgttgttcgtgctaagttcacctccaacttgccccccaaatccatgggaaacagagttagggttttcatgtacccaagcaacatatgagtgccataccagattgaggagcatcagcgagaataggatttggtttgaccagttgttttctcttatgttttgacttgtttatgtatgaagacaataggtataattctagttattttagtactggttatttgtttagactggagagcataatgttatgtggttccccaactagttttgatattgagattcaaactttctgttggcaagtaaaattttcgattacatgagagtttcattttgattgaatggttaaatcataatatgtatatttaatttaggatctttgtactc

SEQ ID NO: 2481 - DNA, 692 bp, Cleome spinosa
gagggttttatttctctctcgcacttgggttaattcgccggaggctggaggaagatcatcttggatcgaaaatggtgaagggtcgtcaaggagagagagtcagattgtacgtaagaggaacagtccttggatacaagagatcaaaatcaaaccagtacccgaacacgtccctcgtccagatcgagggtgtgaatacccaggaagaggtggcatggtacttggggaaacgtatggcttacatctacaaggcaaagactaaacagaacgggtcacactaccgttgcatatggggaaaggtcaccagacctcatggtaacagtggcgttgtccgagccaagttcaagtcaaaccttcctccaaagtctatgggagctagagtccgtgtcttcatgtacccaagcaacatataaggaggcaagattcgaaatcttggttcattctgcaacaatcagaaggcaacaagtttatctatcaccttgtttctggagttttgatccctttcattctgcaacatccaccagtgcttgatgtcatatgtctttgtcctcactcgacttagatacattatttttcttggaaaatttacagttttgatgaattgaattccatcaatcattgtttcttacgttgctcaattgtataacactgttcttcagttagaaatcatccctccattatgtctaaaaaaaaaa

SEQ ID NO: 2482 - DNA, 444 bp, Cleome spinosa
ggggggggaaggaataggtggaggaataaggcagagatcattttggatcgaaaaatggtgaagggtcgtcaaggagagagggttaggttgtacgtgagaggaacggtcctcggatacaagaggtctaagtcaaaccaatacccaaacacgtcccttgtccagatcgaaggtgtgaacacccaagaagaagtggcgtggtacttgggaaagcgtatggcttacatctacaaagcaaagactaagcagaacggatcacactatcgttgcatatgggggaaggtcactcggcctcacggcaacagcggtgttgtccgagccaagttcaagtcaaaccttcctccaaaatcaatgggagctagagtccgtgtgttcatgtaccccagcaacatatgaggagtcaaaccaagattctcagaacccaggttcatttatcatcttgtctct

SEQ ID NO: 2483 - DNA, 685 bp, Fagopyrum esculentum
ttactgagtttctcttacgccgaactccgaaaagcagcgaaagcaaccaacaatggtgaagggccgtgaaggagagcgtgttaggctgtacgtgaggggttcaatcctggggtacaagagatcgaagtcgaaccagtacccgagcacttccttgatccagatcgaaggagtcaacaccaaggaagaggtgtcatggtatcaagggaagcgtatggcgtacatttacaaggcgaagacgaagaagaagggctcccactacaggtgcatttggggtaaggtcactaggccccacggcaacacaggggtcgttcgtgctaagttcacctccaacttgcctcctagatctatgggtgacaaggttagggtgttcatgtaccccagcaacatctaagtgcatacctgaggcttggggaagatgcatcagaggggaagaaggttggatagcgttgttatttgaaaatgttagatcttaaagagtctgttgaaaatttcatctgatatattggattgttactgcagtctagaacacaaaaccaaacatttttgcttgcttgaattttcttctgccaaattttgaaaacaagtcatatggccttgtgaccattgcatgcatctgatatgagctgtaaaatcttgtacgagggttttgctagctcaactagtcccgaccataatcttagcaaat

SEQ ID NO: 2484 - DNA, 624 bp, Fagopyrum esculentum
tcccttccgccgagctcaaggggagaagaagaagaaacaaatacgcactaatggtgaagggtaggcaaggagagcgtgtcaggttgtacgtgaggggttcgatcttggggtataagaggtcgaagtccaaccagtatccaagtacttccttgatccagattgaaggagtgaacaccaaggaggaggtgtcatggtaccaggggaagagaatggcttacatttacaaggccaagacaaagaagaaaggctcccattacaggtgcatttggggaaaggttactaggccccatggaaacaccggggtcgttcgtgctaagttcacctccaacttgccccctaaatctatgggtgacaaggtccgggttttcatgtaccccagcaacatctgagtgtcatcctcccttgagactccaggctttagatgaggcattggagaagtcggtgggatcattcagttttaaggtttaggctgtattgcagaatatttttccgttttatgtaactgttgcttcatttctaaaatcaaaccagccaattttgtttactcacgaaagtcaggaggatgtttgtgtgtggctcgctgcacttttcttttagttgatcttcgttggccatctctttgac

SEQ ID NO: 2485 - DNA, 663 bp, Flaveria ramosissima
tcacccgatctactcacacttcactgattccagaccgatcatcagatgtaccctagcacgcacgtcacacccactccccccgtattacccctcgtcgttgggcctttggccgagtcgtcataaagtcatgggtatcaacggcagaagtacatgggcgggtttagtcatttcttcatcaccgccggcgatactgcaagcattgcccaaacaacaatggtgaagggccgtcaaggagaacgcgtcagactctacaccagaggaacgattctcggctacaagaggtcgaaatcgaaccagtatccgaacacatcgttgattcaaattgaaggagtgaacacgaaggaggaggtggcatggtacgaggggaaacggatggcgtatgtctacaaagcgaaagtgaagaagaacggatcgcattatcggtgcatttgggggaaagttactaggcctcatggtaacactggtgttgttcgagctaagtttaagtccaatcttcctcctaaatccatgggatctagggttagagtgttcatgtacccaagcaatatttaagttctattgaagaagattagagattgttggtgctggtagtttaattgctattgtagtagttgtttggccatttattatggaagattttatatttgttacatggaatgttac

SEQ ID NO: 2486 - DNA, 474 bp, Flaveria ramosissima
ccgccggcgatcagcaagcatttgctcaagcaaaatggtgaagggacgtcaaggagaacgcgtaagactttacaccagaggaacgattctcggctacaaaaggtcgaaatcgaaccagtatccgaacacatcgttgattcaaattgaaggagtgaacacgaaggaggaggtggcatggtacgaggggaaacgcatggcgtacgtctacaaagcgaaagtgaagaagaatggatcgcattatcggtgcatttgggggaaagttacaaggcctcatggtaacactggtgttgttcgtgctaagttcaagtccaatcttcctcctaaatccatgggatccagggttagagtgttcatgtacccaagcaatatttaagttctattgaagaagactggaggttgttggtgctggtagtttaattgctcttgtggtagttgtttgaccatttattatggtagattttatatttgttacat

SEQ ID NO: 2487 - DNA, 504 bp, Flaveria ramosissima
tttcttcatcaccgccggcgatctgcaagcatttgctcaagcaacaatggtgaagggacgtcaaggagaacgcgtaagactctacaccagaggaacgattctcggctacaagaggtcgaaatcgaaccagtatccgaacacatcgttgattcaaattgaaggggtgaacacgaaggaggaggtcgcatggtacgaggggaaacgcatggcgtacgtctacaaagcgaaagtgaagaagaatggatcgcattacaggtgcatttgggggaaagttacaaggcctcatggtaacactggtgttgttcgtgctaagttcaagtccaatcttcctcctaaatccatgggatctagggttagagtgttcatgtacccaagcaatatttaagttctattgaagaagattggaggttgttggtgctggtagtttaattgctcttgtggtagttgttcacttgtttgaccatttattatggaagattttatatttgttacatggaatgttac

SEQ ID NO: 2488 - DNA, 661 bp, Ipomoea nil
gcttaggtctctgaatcactctccgcagctgctccgccttccaacggtgaaaatggtgaaaggacgtcaaggcgagcgtgtcagactgtatgttagaggaacggttctcggttacaagaggtcgaagtcgaatcagtatccgaacacctcactgattcagatcgaaggagtgaacacccaggaggaagtggcatggtacctgggaaagcgcatggcctacgtctacaaggctaagaccaagaagggcggctctcactaccgctgcatctggggaaaggtctgcaggcctcacggcaacagtggcgtcgtcagagctaagttcaagtccaacctcccacccaaatccatgggtaacaaggttagagttttcatgtacccaagcaacatctaagctagaatgttgaagatgcatggtgggttgcttttgaagatctccagtgatttatgtagctgcatctttactacatactccagttatatttgtgtcttgttttgatcatatgtgccttttgtcattcaaccttgttttagtagcacaaaaccattggacatcttgttagatgaaactaattttgctcattttttgtacttacacatgatttctgccgcatgcttttgtttactatctttgtcccagcacaaatttcagttatctcactac

SEQ ID NO: 2489 - DNA, 833 bp, Lactuca sativa
gggctaagcaaccttgaaagttgaaacccaaccatcttcaagcccacaaaattacatccaaagccctaactttgctcccgaataatccacatctataaaagtataaatcatcgtctcgtatgagatctagggttttattttttcttatcagtgcaggcggtcggtaagtttctgctcaaggaaaatggtgaagggtcgtcaaggggaaagagtcagactctacaccagaggaacgattctgggctacaagaggtcgaagtcgaaccagtacccaaatacatcgttggttcaaattgaaggagttaacacgaaagaggaggtaggatggtatcaagggaaacgcatggcgtacgtgtacaaggcaaaggtgaagaagaacggatcacattacagatgcatttggggaaaggttactaggcctcatggtaacactggtattgtgcgtgctaagttcacgtctaatcttcctcccaaatccatgggatctagggttagagtgtttatgtacccaagcaatatttaaggtttattcaacattggtatgaggatgttgctgcttttattttcattgttcttgtagtagttttttgatggtttgtgatggaagcttttatttttttatatggaaaaacatgtctagagcattacaatgccttctaccttttcttaaagattgcgagactacatgttcaaatgaatttcatcattatatacaatgcatgtaatgatcaaattctaataggatctagttttggaccaaggtaaaattgtttaaatcaagttgaagtttgatggttttcactcgcaagagcctaccaaattgaaataattgt

SEQ ID NO: 2490 - DNA, 687 bp, Allium cepa
tttcgtttcttcatttctcttttgttttccgccggcttaatccattcaccagtaccagaatacaataacaatggtgaaagaaagacaaggacaacgcgtcaggctttatgtacgtggcactgttctcggctacaaaaggtccaagtcaaaccagtacgagaatacatctttgatgcaaattgaaggagtgaataccaaggaagacgctcgctggtatgctggaaaaagagtagcttatgtttacaaggctaaggttaagaagaatggaactcattatagatgcatttgggggaaagtgactcgtcctcatggcaacagtggtgttgttaggtctaagttcaggtccaacttacctcctaaagccatgggacgtaaagttcgagtttttatgtacccgagcaacatttgagcatctttgctaatcctggtcatggagaaaaagcttttatggacgtcgcagctgaatcttttttatatctatttgtcgcagtaatttcaaattttgtttttgtatggaacttgcgtttttactgttgggagaatgttgaaccatcttttcaattttaaattagacatggcttatttgtgccttaattgcgttttccttattgttaggttttttggctagtttgagttcatgaaaattctgaatacaaagcaattggtctttgctcaggcagtgcatcc

SEQ ID NO: 2491 - DNA, 540 bp, Papaver somniferum
agcacaagggtttagctttcaggaacgaaaaaatggtaaagggacgcgaaggagagcgagtcaggttatacgtcagaggaacaattctagggtacaagaggtcaaaatcgaaccagtacccaaacacttcgttgattcagattgaaggagtgaacacaaaagaggaggtagcatggtacgccggaaagagaatggcttacatttacaaggctaaggtgaagaagaatggttctcactaccgatgcatctggggaaaggtcaccaggcctcatggtaacagtggtgttgttcgtgccaagttcacctccaacttgccccccaaatccatgggaaacagagttagggttttcatgtacccaagcaacatatgagtgcggtcatcagattcaggagcagctgcgagaataggaattggtcaaaccaactgttttctcttatgttttgacttgtttatgtacgatgtcggtagctacaattctagttatttcagtactggtttatttgttttagagttggagagcataatatgttatgtggtcc

SEQ ID NO: 2492 - DNA, 773 bp, Primula obconica
ccattacggccgaaaagggttttgagctttctctctctagtcggctgtttcctgaatccactttctctctctaccctcttaacaaaaatggtgaaaggacgccaaggagaacgcgtcaggttatatgtcaggggaacgatcctcggctacaagaggtcaaagtcgaaccagtatccaaacacgtcactggtacaaattgagggagtgaacaccaaggaggaggtgacatggtaccaggggaagcgcatggcatacatttacaaggccaaagtgaagcagaatgggtcccactatcgctgcatttggggaaaggtctcgaggcctcatggtaacagtggtgtggtccgtgccaagttcacctccaacttacctcccaaatccatgggtgctagagtgagggtcatgatgtaccccagtaacatttaagtttgcgagaaatcggaacgcctgacagggatgtttgctggagcatctttgtttttctctaatagcaatagttggagtctttcgaatttcttgtgttatgtggagcttcaaaacctttggcatcaattttgttgtttaaacttcaaggatatattgtttcaacagatatttgcttccttggcatttatttagatttgtgttgtcattttgtttctttgaagttttgagttttgctctttatgcacttctttcaccctgcttatgtggttggtcattttctagttttggtttcttttcctgtgtgtgaaatatgtctgcataaaccatgatttgtagtccatcggaaa

SEQ ID NO: 2493 - DNA, 568 bp, Primula obconica
catctcagtgaatcatatctctctctctctctctctctctctacacttctgtggcgaaaatggtgaagggtcgccaaggtgaacgcgtcagactatacgttaggggaacgatccttggctacaaaaggtcaaagtcgaaccaatacccaaacacgtccctagttcagatcgagggagtgaacaccaaggaggaggtgacatggtaccagggaaagcgtatggcgtatatatataaggccaaggtgaagcagaatgggtcccactatcgctgcatttgggggaaggtctcgaggccccatggtaatagcggtgtggttcgtgccaagttcacatccaacctccctcccaaatccatgggtgctagagtcagggtcatgatgtatcccagtaacatctaagttcattcctgatcgagatgattgtcgttgcagatgaagtttttgtgtgttaccttgagctccagaaattgtcatggcactatttttgtttagacttgaatgaatgtttcagcagatgtttggtacttatgatttatgaattatcaattcatttctgcaccattttgttc

SEQ ID NO: 2494 - DNA, 541 bp, Raphanus sativus
cttctccgtcttcctctcagcagcagcagcagcagcagcagcagtcttgcgaaaatggtgaagggacgccaaggagaacgtgtcagactctacgtcagaggaaccatcttgggatacaaaaggtcgaagtcaaaccagtacccaaacacatccctgatccagatcgaaggagtcaacactacagaggaggtgacatggtacaagggaaagaggatggcttacatctacaaggccaagaccaagaagaacggtagccactaccgctgcatctggggaaaggttactaggcctcatggtaacagcggtgttgtccgtgccaagttcacttccaacttgcctcctaagtccatgggaatgagggtgagagttttcatgtatccgagtaacatttgaagcaaagtattacagcataaactttgatttagctgttgtttttgcccactagttcttcgttttgtatttgatactgaaagcattttcgtttctttgtttgaatcatggatcttgtttttggataccaagttagaatatttcttccagc

SEQ ID NO: 2495 - DNA, 572 bp, Raphanus sativus
ggattgcttctccgtcttcctcatttgcagtagcagtcttgtgcgtgtttatcagccgactgagaaaatggtcaagggacgccaaggagaacgtgtcagactctacgttaggggaaccatcttgggatacaaaaggtccaagtccaaccagtacccaaacacgtcccttattcagattgaaggagtcaacactacagaggaggtgacatggtacaagggaaagaggatggcttacatctacaaggctaagaccaagaagaacggtagccactaccgctgcatctggggcaaagttaccaggcctcacggtaacagcggtgttgtccgtgccaaattcacatccaacttgcctcctaagtccatgggaatgagggtcagagtcttcatgtatcctagcaacatatgaagcaaaagtacaagagcaagaactttgatttagctgtggttttgtccactagttcgttattttgtattttgatactgagaccgttttcctttctttgtttgaagtgttttggtgattatctgaacgactttaaaatatcatggatctggtttttaatctcaaacta

SEQ ID NO: 2496 - DNA, 661 bp, Raphanus sativus
agtgtttggcttctccgttttcatcactagcagcagactttgcgttaatcagccgacgcgaaaatggtgaagggacgccaaggagaacgtgtcagactctacgtcaggggaactatcttgggatacaaaaggtcgaagtctaaccagtacccaaacacatcccttatccagatcgaaggggtcaacactacagaggaggtgacatggtacaagggaaagaggatggcttacatctacaaggctaagaccaagaagaacggtagccattaccgctgcatctggggaaaggttacaaggcctcatggtaacagcggtgttgtccgtgccaaattcacatccaacttgcctcctaagtccatgggtatgagggtcagagtcttcatgtatccgagtaacatctgaagaaaacttttatttttagctgtggtttttgtccactagtttgttattttgtatttttgatattcgaaagcattttcctttctctgttttgaaatgttttggagattctctctggttttaatcgcaaaattagaatgtgttttctccttataattgagttggaacatatgaatatcactgcctctattcgtttgcatgctatacgatctatgttaaatgacctccacattggtatggatgaacttaattgtttttgttc

SEQ ID NO: 2497 - DNA, 577 bp, Raphanus sativus
ggaaactcgtggttatgttttagtgtttggcttctccgttttcatcactagcagcagactttgcgtttatcagccgacgcgaaaatggtgaagggacgccaaggagaacgtgtcagactctacgtcaggggaaccatcttgggatacaaaaggtcgaagtctaaccagtacccaaacacatcccttatccagatcgagggagtcaacactacagaggaggtgacatggtacaagggaaagaggatggcttacatctacaaggctaagaccaagaagaacggtagccattaccgctgcatctggggaaaagttacaaggcctcatggtaacagcggtgttgtccgtgccaaattcacatccaacttgcctcctaagtccatggggatgagggtcagagtcttcatgtatccgagtaacatctgaagttctgaacaagcttttgaagtagctgtggtttatgtccactagtttgttattttgtatttttgatattcggaagcattttcctttctctgttttgaaatgttttggagattctctggatttaatcgcaaaattagaatgtgttttctcctta

SEQ ID NO: 2498 - DNA, 607 bp, Raphanus sativus
ggggtcttctccgtcttcctctctcagtagcagcagcagcagtcttgcgaaaatggtgaagggacgccaaggagaacgtgtcagactctacgtcagaggaaccatcttgggatacaaaaggtcgaagtcaaaccagtacccaaacacatccctgatccagatcgaaggagtcaacactacagaggaggtgacatggtacaagggaaagaggatggcttacatctacaaggccaagaccaagaagaacggtagccactaccgctgcatctggggaaaggttacaaggcctcatggtaacagcggtgttgtccgtgccaaattcacttccaacttgcctcctaagtccatgggaatgagggtgagagtcttcatgtatccgagtaacatttgaagcaaagtattacagcataaactttgttttagctgttgttttttgccctctagttcgttgttttgtatttgatattgaaaacattttcctttcgttgtttgaatcatggatcttgttttgaataccaagttagaatttttcttccaatcttttattgagttccagcagatgaaatgtcatggtttatggatatattcttcaaataggtttattgac

SEQ ID NO: 2499 - DNA, 548 bp, Raphanus sativus
  misc_feature (480)..(480): n is a, c, g, or t
gtcttcctcatttgcagtagcagtcttgtgcgtgtttatcagccgactgagaaaatggtgaagggacgccaaggagaacgtgtcagactctacgtgaggggaaccatcttgggatacaaaaggtccaagtccaaccagtacccaaacacgtctcttattcagattgaaggagtcaacactacagaggaggtgacatggtacaagggaaagaggatggcttacatctacaaggctaagaccaagaagaacggcagccactaccgctgcatctgggggaaagttaccaggcctcacggtaacagcggtgttgtccgtgccaaattcacatccaacttgcctcctaagtccatgggaatgagggtgagagtcttcatgtatccgagcaacatatgaagcaaaagtacaagaactttgatttagctgtggttttgcccaccagttcgttattttgtattttgatactgagagcgttttcctttntttgttttaagtgttttggtgattatctgaacgtctttaaaatatcatggattctgtttttaatccca

SEQ ID NO: 2500 - DNA, 989 bp, Oryza sativa
ctccaccacgccgccacgcgctcgatttcactcgccgccgccgccgccgcctccctactctctgccgccgccgtcgccgccgcttgctccgtactcctcctcttcagcggcgatgaagggacggcaaggccagcgcgtgaggctgtacgtccgcggcaccatcctcggctacaagaggtcgaagtcgaaccagtacgagaacacgtcgctgctgcagatcgagggggtgaacaccaaggaggaggttgggtggtacgccgggaagcgcatcgcctacgtctacaaggccaagacgaagagcaacgactccaccatccgctgcatctggggcaaggtcacccgcccgcacggcaactccggtgtcgtccgcgccaagttccggtccaacctcccgcccacctccatgggcaagaaggtccgcgtcttcatgtaccccagcagcatctaaaagcatccaaggtttcttgcctatgctgcgaaactgatagttgtcaccgtggagggttttatatcagctagtcacttggttaaccagtcagaaatttaagcggttttgaggagttttagcttttctttttatttcggactatttgctgtatcatgatgacaattatttgaaggctttttagcggatttgaagctacagaggtttagcatttgtatcgtgatctcagccgtttgatatcgtatctgtatatctaaatttggttggcactgctcgttgagtatatttgaaaatgataggcagatggattcagtggttcagatatctggtgtccaatcgagaaggtggtcatttagacggacagagtgccggtacctgatttttctgctgattgcttagtcatgacacagcacaaatgctggtgccattgctgtagtactccctataatgctggagtatttccgaagagaaatgtacgccctataatcagggattccctagtgtttacacttaaatctaaatgagcggcgatgatattttgttg

SEQ ID NO: 2501 - DNA, 889 bp, Oryza sativa
catctcatctcattcccctgcgccgtcacttcccctcctcctcggttcccgccgccgccgccatcgccatctccaccctcctcggcggccgccggcgacgatgaagggacggcaaggccagcgcgtgaggctgtacgtccgcggcaccatcctcggctacaagaggtcgaagtcgaaccagtacgagaacacgtcgctgctgcagatcgagggggtgaacaccaaggaggaggttgggtggtacgccgggaagcgcatcgcctacgtctacaaggccaagacgaagagcaacgactccaccatccgctgcatctggggcaaggtcacccgcccgcacggcaactccggcgtcgtccgcgccaagttccggtccaacctcccgcccacctccatgggcaagaaggtccgcgtcttcatgtaccctagcagcatctaaggtttcttgcctattctgcaaaactggtagttggcatcgtggaggttttatatcagctagtcacttggtttaccggccagagaaatttaagcgattttgaggagtttagcttttgttttactgcacagactatctggttgcatcttgtacaacgcatgccaatcactcatttgcgttgaaatgatatttccatgcggtgttaactctttatctgtaatttctgtctgattgtcatggtgactgtcaaatgcaaccttctatagctttccatgaaccagatgccctttgatctatacaaacataacatcgctattgtgaaccaaatcatcgtatcaaaagttcaaaactgttggcttgcagtattttaggatagtgatcttgcgactgctaaagtgttgttttttactacgtagcaacattttgtggtggaggtagtagttggcttccattatc

SEQ ID NO: 2502 - DNA, 713 bp, Secale cereale
gcggcggcgacaatggtgcagggacggcaaggccagcgcgtcaggctctacgtgcggggcaccatcctgggctacaagaggtccaagtcgaaccagtacgagggcacgtcgctgctgcaggtggagggggtgaacaccaaggaggacgtgtcgtactacgccggcaagcgcatcgcctacgtgtacaaggccaagaccaagagcagcggcaccaccgtccgctgcatctggggcaaggtcacgcgcccccacggcaactccggcgtcgtgcgcgcgcagtttcggtccaacctccccgccacctccatgggcaagaaggtccgcgtcttcatgtaccccagcagcacctgaagggtgtgttgcctgttctatttagttgtagctggcttcgtggatgtctgttatcggtttgatgacaggtttataaccaaagattttgtcgttgattttggaagagtttagttgcagaatgttagtttcatctcatgtaactcgaaatgaagatttataatatattaactgagatggttttctcaacccttctttgtttgatgagcttttaattcttgtgtagtgtgattaggtgagtatcttctgtcctgagtcatgcggcattgtctgttacacaagacactcagtttttggcgcgcccgtctgcgattgtatcatcgaacttttcaagtttttgggtgtcactaggcaagcttagaaac

SEQ ID NO: 2503 - DNA, 799 bp, Secale cereale
ccccttcccaccaccaccttcctcggccaccggcggcggcgacaatggtgcagggacgccagggccagcgcgtcaggctctacgtgcggggcaccatcctgggctacaagaggtcaaagtcgaaccagtacgagagcacgtcgctgctgcaggtggagggggtgaacaccaaggaggacgtgtcgtactacgccggcaagcgcatcgcctacgtctacaaggccaagaccaagagcagcggcaccaccgtccgctgcatctggggcaaggtcacgcgcccccacggcaactccggcgtcgtgcgcgcgcagttccggtctaatctccccgccacctccatgggcaagaaggtccgcgtcttcatgtaccccagcagcacctaagggtatgttgcctattctattttgttgtagctggcttcatggatgtctgttatcagtttgatgacaggttataaccaaagattttgtcgatgatttaggaagagtttagttacggattgtcagtttcatctcatgtaactcaacttagtcacacattttgctctgaaatgtagtatgatgtggcattactgtttctctggaggatccgtgaggttctctcaaacctttgtttgatgagctttgagatggggtgtagtgcaattagttgagtgttttctgtatctacaatcagttaactattcaagttttcttatgtcactaggcaagcttgcatagctgcaagcatgcaagaactaggtttccccagttgatcctgaaagcagcacatttctaggaccaaaaaaaaaaaaaactga

SEQ ID NO: 2504 - DNA, 614 bp, Secale cereale
gggatcttgacacaatctggaccgtccaatccacgaccacgaacttttaaaaccccgtgctctagggttcattcctcctccgccgcccacctccccccccccttcccaccaccaccttcctcggccaccggcggcggcgacaatggtgcagggacgccagggccagcgcgtcaggctctacgtgcggggcaccatcctgggctacaagaggtcaaagtcgaaccagtacgagagcacgtcgctgctgcaggtggagggggtgaacaccaaggaggacgtgtcgtactacgccggcaagcgcatcgcctacgtctacaaggccaagaccaagagcagcggcaccaccgtccgctgcatctggggcaaggtcacgcgcccccacggcaactccggcgtcgtgcgcgcgcagttccggtctaatctccccgccacctccatgggcaagaaggtccgcgtcttcatgtaccccagcagcacctaagggtgtgttgcctgttctatttagttgtagctggcttcgtggatgtctgttatcggtttgatgacaggtttataaccaaagattttgtcgttgattttggaagagtttagttgcagaatgttagtttcagggg

SEQ ID NO: 2505 - DNA, 608 bp, Tabernaemontana elegans
ccgcctcctcccaccccgacccccagcacttgctgccgccgatcgaaaatggttaagggacgccaaggagaacgtgtccggctctacgttagagggacggtgttgggatacaaaaggtccaaatcaaatcagtatccaaacacctcgttgattcagatcgagggagtgaacaccaaggaggatgtctcttggtacctcgggaagcgcatggcatacatctacaaggctaaggtgaagaagaatggaactcactaccgttgcatttggggaaaggtctgtaggccacacggaaacagcggcgttgtccgagctaagttcaagtccaacctcccacctaaatccatgggtgctaaggttagggtgttcatgtaccccagcaatatataagcgtccgaagaatcatagaagaaagcttcagatcatccgtgactttggaggctttacatgctagatcaaggtcattggtgattgaaggatcttttactagatagtaattagagtcattttctcgtgtttttggtccttacccagtgtgtgttttttgatactgagaattggaaaaacagattcgatatgaccaattttgattatttggattctctggctta

SEQ ID NO: 2506 - DNA, 786 bp, Zostera marina
cacgcttaacataccagacacggcgccgtcggcatcacatcgacaagcaaatcagcacaaagatggttaagggaagacaaggcgaacgcgtcaggttgtacgttcgtggaaccattctgggttacaaaagatcgaaatcgaaccaatacgagaacacatccttggtccagatcgagggagtgaatacgaaggaagaggtttcatggtacgctgggaagagaatggcttacatttacaaggcgaagactaagaaagatgggtcactttacaggtgcatttgggggaaagtaactcgttcccatggaaacacagggatcgttcgggctaagttcaagaggaatttgccagccaaagcaatgggcgataaagtgagggtcttcatgtaccctagcaatatttgaagtttttttgcttaattggcgtcatggacggacatggatggaattctctacatgaagctaattttgagttttgttttattttctatgttaagaacagacgacatgcgtttaatttcttgtggatgttattgttatcgtgctatttcgactattttttggtcattctgttgttttattctgctagattttaggttttttcagtcatacttgcttggggtacttctaaagttatatttttattttcgtaatcttgatgctattatttattaatctccattgattagagtctttgagttttaaaaaagttgtggtttcaaatagtgctgcgtatgaagtgtgtattgtattaatccatgattcttctttttatctagtgactcagtga

SEQ ID NO: 2507 - DNA, 991 bp, Olea europaea
tcatttttccccctttttacaactagagcccaataatcccgaaatgagcttcgtagcccaacctgcaatatcaacctaaatagccatatatatataagggccatgttcttcacctgggccaaattagggttttagttttcatcttctccggcaattacactcagtcgccgttcccaaaagaagcattcaaaaatggtgaagggtcgacaaggagagcgtgtcaggttgtacgtcagaggaacgatcctagggtacaagaggtcgaagtcgaaccagtacccaaacacgtccttgattcagatcgagggagtgaacagcaaggaagaggtagcgtggtaccaggggaaaaggatggcgtacatttacaaggctaaggttaagcagaatggaacccactacaggtgcatttggggtaaggtgattcgtccccacggaaactccggcgttgttcgtgctaaattcaaatccaaccttcctcccaagtccatgggggcccgagttcgcgtcttcatgtaccctagcaacatttgaagcgtttgcagcgtttttaagtagcggaacagagtttgagctttggtggttaatagaaggatctttcatgccttatttttactccctattttgttcatgtttgtttatcatcaaggattttgacaatgtggtcactgttttaatcattattatcaatgatttccagttttgacgtttgcttgccagaaaatgcttctgagggaggtccgtaagtatggtttcattagcttcatatataagatcactggaggtggcttatttgaatttgtttcgagctctagcgccaaactaacttagttctcgtggctttagtttaccattgtacacattcaaatgctttgatgatttagaatttgttaggggggatctagcttgctcaaaatatgtttatcaagataacagttgcaaggagatgttagtaaaatatgcaccaagccattttgaccgagcaaaacggcag

SEQ ID NO: 2508 - DNA, 803 bp, Olea europaea
cttcgtatacgtaatagtgtattatttttgttcgtgtttgttgtattgtatagaattagaacttagctaatagtcgactcttgcgttgattaccactgctaagacagtggtagtcaacgacagagtcggcaggggagtgcctctagggttttcttcatttgacttctgcacttcctaatacggcataacaaacgcccacccggtcaattcgataacgagcagccggaaatggtgaagggacgtcaaggagaacgtgtcaggctatacgtgagagggacgatactggggtacaagagatcgaagtcgaaccagtacccgaacacttcgttgattcaaatcgagggagttaacaccaatgaggaggtgtcatggtaccaggggaagcgaatggcatacatttacaaggccaaggtgaagacgaatgggtcacattacaggtgcatttggggcaaggtcattaggccccatggaaacagcggcgttgttcgcgccaagttcaagtctaatcttccccccaaatccatgggcgctcgtgttcgtgtcttcatgtacccgagcagcatttgatgatgttttaaagctgcagaagggagtgaagtcttagctggctttagaaggttcatattctgtagtcattagagattgtataatttctttgtaagagttatattattagtggcatttggtgctttctcgaatcataatggtgattttatttttgtcgtgtttgtgtattgataagaattgaacttgctatatattttgatggtttgtgttccatttcaatcatattattgactccc

SEQ ID NO: 2509 - DNA, 664 bp, Olea europaea
agggttttagttttcatcttctccggcaattacactcagtcgccgttcccaaaagaagcattcataaatggtgaagggtcgacaaggagagcgtgtcaggttgtacgtaagaggaacgatcctggggtacaagaggtcgaagtcgaaccagtacccaaacacgtccttgatccagatcgagggagtgaacagcaaggaggaggtagcgtggtaccaggggaaaaggatggcttacatttacaaggctaaggttaagcagaatggaacccactacaggtgcatttggggtaaggtgattcgtccccacggaaactccggcgttgttcgtgctaaattcaaatccaaccttccccccaagtccatgggagcccgagttcgcgtcttcatgtaccctagcaacatttgaagcgtttttaggtagcggaacagagtttgagctttggtggttaatagaaggatctttcatgccttatttttactccctattttgttcatgtttgtttatcatcaagaattttgacaatgtggtcactgttttaatcattattgtcagtgatttccagttcttgacgtttgcttgacagaaaatgctcctgaggggaggaccggaagtatggtttcattagcttcaaatataagatcaatggagttgggttatttgaat

SEQ ID NO: 2510 - DNA, 571 bp, Acacia harpophylla
ggcgccgttctaatctctctcagctcctgcatcgattcagcgcctccgagacgacaatggtgaagggccgccagggtgaacgtgtcagactgtacgtgagagggtcaatccttggatacaagaggtctaagtcaaaccagtatcctaacacctctcttattcaaattgaaggggtgaacaccaaggaagaggtagcatggtattgtggcaagcgaatggcatatatttacaaggccaaggttaagaagaatggaactcattaccgctgcatttggggtaaggttatcaggcctcatggtaacagtggtgtcgtccgagcaaagttcaaatcagatcttccacccagatcaatgggagcaaaggttagagtattcatgtaccctagcaacatatgaggttcacaggatatgatgcttcgtaggatttgttgttgacaagtagcacatggagttttgttctttttgtgagctaaatttatctggcctttgtacattggagcacaattaaatttttgttacgatggttatctgtgttggctatattctcgatgaagattatatatccgtttctg

SEQ ID NO: 2511 - DNA, 544 bp, Ambrosia trifida
ctcatcctcatcacaggcggcggctgctattcagagaagcaaaaatggtgaagggccgtcaaggagaacgtgtcagactttacaccagaggaactgttcttggctacaagaggtcgaagtcgaaccagtacccgaacacgtcgttggtacagatcgaaggagtgaacacgaaggaggaggtagcatggtaccaagggaaacgcatggcgtacatctacaaagctaaggtgaagaagaacggatcgcactatcggtgcatttgggggaaggtgactaggcctcatggtaacactggtgttgttcgtgctaagttcaagtctaatctgccgcctaaatccatgggagctagggttagggtgttcatgtacccaagcaacatttaagatgatcgccgaactacgaagatatcattgctggtgtggttataacagttttgtgatatttgctttttctgtagcatgtgtgattttgctcaagtgtgttggaatatgaatttagcttaactgagcagatattcaaatgactcgtcctggttcttatttaa

SEQ ID NO: 2512 - DNA, 613 bp, Ambrosia trifida
gcacagcacagcacaggcatctcctcaaacacaaaatggtgaagggccgtcaaggagaacgcgtcagactctacaccagaggaaccattctcggttacaaaaggtcaaagtcaaaccagtatccgaatacgtcattggtacaaatagaaggagtgaacacgaaggaggaggtagcttggtaccaagggaagcgtttggcgtacgtatacaaagctaaggtgaagaagaacggctcacattatcggtgcatttggggcaaagttacgaggcctcatggtaacactggtgttgtccgtactaagtttaagtctaatcttcctcctaaatctatgggatctcgggttagagtgtttatgtacccaagcaacatttaagttacagtgaggaaaagtatggtgagttttgctgctggcactttcattgttcttgtattagttgtgttgaccatttggtattaaagatttttatttttcacatgtaacatcactagtttaaaattttgtcatataagacgtgttatgatcaatgtgaaaaaagaatttgaacccaccatactatcatacccaccctacttccagtttgtgttatgacatagcgtttttcgatacctttg

SEQ ID NO: 2513 - DNA, 536 bp, Antirrhinum majus
  misc_feature (16)..(16): n is a, c, g, or t
  misc_feature (25)..(25): n is a, c, g, or t
  misc_feature (28)..(28): n is a, c, g, or t
  misc_feature (533)..(533): n is a, c, g, or t
ctctctccatcagatngcaaactcnaanactgtaatcatggtgaaaggccgtcaaggagaacgcgtcagactctacgttcgtggaacaattctaggttacaaaaggtcgaagtcgaatcagtatccaaacacgtcgttgattcagattgagggagtaaacactcaggaggaagttgcttggtacttggggaagagaatggcgtacatttacaaggctaaggtgaagaagaacggttctcattaccgttgcatttggggaaaagttgctcgtcctcacggaaacagcggcgttgttcgcgctaagttcacgtcgaatcttcctcctaaatcaatgggagctagagtgagagtgatgatgtacccgagcaacatctgagcggactgtggagcttaaggtgaagcatgtgcatcaaatttagtctttcattttgatttagaaactttttgtattgctaattgaaattagccaagttcttgaggacctcaaatggagtataagtaatgaagttttgagcttgcattttgttctgatnaag

SEQ ID NO: 2514 - DNA, 544 bp, Bruguiera gymnorhiza
ggtttttcgttcaccgccgtagacaagaagaaccagaggtgcgtgcggacagaggcgaaaatggtgaagggccgccaaggagagcgcgtcaggctttacgttagaggcaccattctcggatacaagaggtcgaagtcgaaccagtatccaaacacgtcgttgatacagatcgagggcgtgaacacgaaagaggaggtggcatggtactgcggcaagcgcatggcgtatatttacagggcgaaggtgaagaagaacgggacccactaccgctgcatttggggcaaggtcactcggccacacggtaacagcggcgtcgttcgtgccaagttcaagtccaatcttcctcctcggtccatgggagctagggttagggtcttcatgtaccccagcaatatatgagtggcagcaaggtggcggcggttgatttttggattatcagttgctctcacctgtagcagttctatattttgtacctgtcagtggcaccagctagttcctagtctgtgattttcatgcattggcaatgttcccggtctacccctta

SEQ ID NO: 2515 - DNA, 641 bp, Bupleurum chinense
agtttcggctgaattcacaagttcctcagaaatggtgaagggcagacaaggcgagcgcgtcaggctgtatgttcgaggaacagtcttgggttacaaaaggtcgaaatcgaaccagtacccaaacatatccttagttcaaatcgaaggagtgaacacaaaggaagatgtgagttggtatcagggtaagcgcgtggcttacatttacaaagccaaggtcaaagttaatggctcccattatcgttgcatttggggaaaagttattaggccccatggtaacactggtattgttcgtgcaaagttcacctccaatctccctcccaaagccatgggagcaagagtgagggtgatgatgtacccaagcaacatataagcatcttcggattggtggaaatatatcgtctcttgctttggaaggtgtctgcatactatgttgaagctagtgatgatgtatttgatagattgtttgtagtggaaacttagaatgtaagacttgatattatgtaatttctggatattaaggagccttatttttggcataagttttgtcaatttgaactgcaatcttcgaaatctcttggatgagtttgatcagtgttttaattattaggatttccatttgacttaatatataggagttatgg

SEQ ID NO: 2516 - DNA, 1124 bp, Cannabis sativa
caaagcttgataggctttacaataaactgaagcaggtcagtataaatacttattcttcaccttcgcaaactagggttttagggcttctcctctgcaggcgtctctggttaacttccgaagatcacgagagaacaaaccctaagacgaaaaatggttaagggacgccaaggagagcgagtcagactctacgtcagaggaacagtcctcggatacaagaggtccaagtcgaaccagtatccaaacacttctttggtccagattgagggagtaaacacaaaggaggatgtttcatggtactgtgggaagcgcatggcgtacatctacaaggctaaggtgaagaaggacggttcccactatcggtgcatttggggcaaggttatcaggcctcacggtaacagtggtgtcgttcgtgctaagttcacttctaacctgcctcccaaatctatgggtgctagagttagagtgttcatgtaccccagcaatatataaggacttcttgatgacagagattggtcatttgaagcatctgcattttatgttttttcaaccaaatttaaatgtcatgtttgtttagaagtgaagcagttttgttattttaggatattgaatgaagccactattcaggaactaatttaatgtcgattttcttatttttctgtctcctactgcataattggatgtaagttatcttcaatgcgttgctgtatgccgtatagtttattttttctactttttgcctgcccttgcaccttatctcagtcaacattcgtgcaaaaggaaaacataaatttgtttttcattttggcgttaatttggatagtgaagcatttgtcactcgtgcaaaaagaaaacgtaatttgtttctcagtttgggttaagttgaatagtaaagtatttgtcaaagttctgatgtggtcttgcaccatgtagcttatgcttggaattattttcactgcatagaacatagcaatgaacaagctcatcaagtgaccttaattttgtgcaccctttttcttttcaatatgatgctagatttgaatttttatcagtgttttgggtattattggctttttaaatgtatcataaaatttggcgttccttattaaatatacatttaaataaag

SEQ ID NO: 2517 - DNA, 901 bp, Cannabis sativa
tgataggctttacagatcttaaatatccatcaataaactgaagcaggtcagtataaatacttattcttcaccttcgcaaactagggttttagggcttctcctctgcaggcgtctctggttaacttccgaagatcacgagagaacaaaccctaagacgaaaaatggttaagggacgccaaggagagcgagtcagactctacgtcagaggaacagtcctcggatacaagaggtccaagtcaaaccagtatccaaacacttctttggtccagattgagggagtaaacacaaaggaggatgtttcatggtactgtgggaagcgcatggcgtacatctacaaggctaaggtgaagaaggacggttcccactatcggtgcatttggggcaaggttatcaggcctcacggtaacagtggtgttgttcgtgctaagttcacttctaacctgcctcccaaatctatgggtgctagagttagagtgttcatgtaccccagcaatatataaggacttcttgatgacagagattggtcatttgaagcatctgccttttatgttttttcaaccaaatttaaatgtcatgtttgtttagaagtgaagcagttttgttattttaggatattgaatgaagccactattcaggaactaatttaatattgtttttcttatttttctgtctcctactgcataattggatgtagttatcttcaatgagttgctgtatgccgtatagattattttttctacttgcttagtttgcccgtttgctcttgcaccttatctcagtctgcattcaagcaaaaggaaaacataaatttgtttctcattttggggttaatttggatagtgaagcatttgtcattcatgctaaaagaaaacgtaatttgtttctcagtttgggttaagtt

SEQ ID NO: 2518 - DNA, 528 bp, Brassica napus
gtcctccgtttacctcagtaatagtagcagcagtcttgcgaaaatggtgaagggacgccaaggagaacgtgtcagactctacgtcaggggaaccatcttgggatacaaaaggtcgaagtcaaaccagtacccaaacactagccttatccagatcgaaggggtcaacactacagaggaagtgacatggtacaagggaaaggggatggcttacatatacaaggctaagaccaagaagaacggtagccactaccgctgcatctgggggaaggttacaaggcctcatggtaacagcggtgttgtccgtgccaaattcacttccaacttgcctcctaagtccatgggaatgagggtcagagtcttcatgtatccgagcaacatttgaagcgaaagtagaacagcataaactttgatttagctgttgttttttgcactagttcgttgttttgtatttgatattgaaaacattttcctttcgttgtttgaatcatggatcttgtttttaatcccaagttagaatctttcttccaa

SEQ ID NO: 2519 - DNA, 573 bp, Manihot esculenta
agttatccatctcgcagcccttcaactgtagccaatttcagcggcagaggatacagcttgacggaaaatggtgaagggacgccaaggggagcgagtcaggctctacgtcagagggaccatcctcggatacaagaggtccaagtcaaaccagtacccaaatacatcattgatccagattgagggagtgaataccaaggaagaggttgcctggtatgctggaaagcgcatggcatatatctataaggcaaaggtaaagaagaatggatcccactatcgctgcatttggggcaaggtcaccaggcctcatggtaacagtggtgttgtacgagccaagttcaagtccaatctgcctccgaaatcaatgggagatagggttcgagtcttcatgtatcccagcaacatataagattgcagattgtgttcattgttgacttggagcaatatgtatgttacttattttataagccaaatttaaactagtcgtttgcttttgagttttgattattgtttatgtagaatgctggatgaacgttattttgcctccttattaatctcagtcaggatttttttgcc

SEQ ID NO: 2520 - DNA, 783 bp, Citrus clementina
attaatttaattaagaagggtagggttttagggtttctcctgctcttattttgtatcgctcgcagcctcagtctcacttgcagagcttgttgtgttgttcagtcaaaatggtaaagggacgacaaggagagcgagtcagactctatgtcagaggaaccatcctcggatacaagaggtcgaagtccaaccagtacccaaacacttcattgattcaaattgagggagtgaacaccaaggaagatgtgtcatggtactgtgggaagcgtatggcttacatttacaaggctaaagtgaagaagaatggatcacactatcgttgcatctggggcaaggtcgcaaggcctcatggaaacagtggggttgttcgtgctaaattcaagtccaatctgcctccaaagtccatgggagacagagttagggtcttcatgtaccccagcaacatctgaggtccttcggcccatagatgtcagattgaggttgttgacaactcgaaagaatctgctttttaacttgtgttataagctagatttgaattcatgtgtgttatggagctgaatcatttttgtttcattaggatagtaaatgagacattattttcgctaaaactgatgtcagaattttttgccccagctgtttctatcttactgcatatttgggtgatttacattgttgatctaaaacttcagtccgattctagcaaccaaattctgctattatttcaagtactacttgtccgtgtaccaaatttatgcaagccattagccttattgcttatttgttgac

SEQ ID NO: 2521 - DNA, 623 bp, Cleome gynandra
cattctccaaatcggccgactcaacaatggtgaagggacgtcaaggagagcgtgtcagactctatgtgagaggaactatccttggatacaagaggtcgaagtcaaaccagtatccaaacacatcccttatccagatcgagggagtcaacacccaagaggaggtctcatggtacaagggtaagcggatggcttacatctacaaggctaagacaaagaagaatggtagccactacagatgtatctggggtaaagtcaccaggcctcatggtaacagcggtgtggttcgcgccaaattcaagtcgaacttgccacctaagtcgatgggagctcgggttagagtcttcatgtaccctagcaacatatgaacaatgcatgctccaaaacgcattctagttttcacaggacgattaggtacatcaatgcggtcctgtttgaaggactagttttgttggaagagttctcatatgttataaactgagacattggcaattgacggccatagttttctctgcaagtttttattgtattggataacttcttcatttgaatgtttgtggtaatcgttttatcagttggttattgcatttcatgaattactcccagtataatataagatatttatt

SEQ ID NO: 2522 - DNA, 588 bp, Cleome spinosa
agtacgcgggggttctccgcttcttcggcgtaggcattctccagtcaggcgatacaacaacaatggtgaagggacgtcaaggagagcgcgtcagactctatgtgaggggaaccgtccttggatacaaaaggtccaagtcgaaccagtacccaaacacatctcttgtccagattgaaggagttaacacccaagaggaggtgtcgtggtatcagggaaagcggatggcttacatctacaaggctaagacaaagaagaacggaagccattaccgatgcatctggggaaaagtcacgaggcctcacggtaacagcggtgtggttcgggccaaatttaagtcgaacttgccaccaaagtcaatgggagctcgggtcagagtcttcatgtatccgagtaacatatgaacagggtaggcttcaaaacgcattctagttctctgcaggaggtttaggtacatctgtgctgtatcctcccatgtgaaggacttgttttgtttgaagcgttcatctgttataaactgagacatagattggtgtttaatcactactatagtttgtttttgtttttttagtgtattagattcggtttttc

SEQ ID NO: 2523 - DNA, 609 bp, Cleome spinosa
ttttatcactgggtttcttcgccgtagcagattatcgtggatttgaaaatggtgaagggtcgccagggagagagagtcagattgtacgtaaggggaacagtcctcggatacaagaggtcgaaatcgaaccaatacccaaacacatctctagtccagatcgagggcgtgaacacacaagaagaagtctcatggtacttggggaagagaatggcttacatctacaaagcaaagaccaagcagaatggatcgcactatcgttgcatatgggggaaggtcactaggcctcatggtaacagcggtgttgtccgagccaagttcaagtcgaaccttcctccgaaatcaatgggagctagagtccgcgtcttcatgtacccaagcaacatatgaggagtcaggaattcaacatctgcgacaattagcaggctacaagtttatcatcttacttatgtagtttgatcttttcacttgggtctggaactttatgtcagttgttttcgttctctcttcagaaatcatttgtcccatggaaccctgacttgtttttctcagcaaggattttgtcttcacttcccccgtttatgttttgcaaattatatttgacagtcgatt

SEQ ID NO: 2524 - DNA, 669 bp, Gossypium hirsutum
taaatttcccccaaatcggaaatcttattagggttttagagctttttcaggattcgaaaggaataagcttcagcgtccgaatcgggaggaaatggtgaagggacgccaaggagagcgtgtcagactctatgtaagaggaaccatcttgggttacaagaggtcaaagtcgaaccagtacccaaatacttctttgatccagattgagggagttaacaccaaggaggaagtagcttggtatgcaggaaagcgcatggcttatatatacaaagctaaggtgaagaagaatggctcacactatcgctgcatttggggaaaggtcactagacctcatggtaacagtggtgttgtccgtgctaagttcaagtctaaccttcccccaaaatctatgggagatcgagtcagagtcttcatgtaccctagcaatatctaagctgtctcgatgccgaacggcttgtgattgactacttgagtgactctgccttttcactttgttttgataaacttattcaacatgttttgtgtttatttttggtttgtttaggatggtgtatgaaataagacaatcagcattttgtttacacatattttcttctctcaaggatttttacttaaatttgaagattttggataatcattcattttttgggaatctattgtcatctttggtct

SEQ ID NO: 2525 - DNA, 698 bp, Gossypium hirsutum
ctttggatgccggttaattaacctgcggtcgacactagtggctccaaccattcggcacgagtgtctctcttgcagtcgcctttatcagaagcaaaaacactaagctttagcttctacatcggagaaaatggtgaagggacgccaaggagagcgagtgagactctatgtaagaggaaccatcttgggttacaagaggtcaaagtcgaaccagtatccaaacacttcattgatccagattgagggagttaacaccaaggaggaagtagcttggtatgctggcaagcgtatggcttatatctacaaggccaaagtgaagaagaatggctcacactatcgctgcatttggggaaaagttactagacctcatggtaacagtggggttgttcgtgctaagttcaagtctaaccttcccccaaagtctatgggagatagagtcagagtcttcatgtaccccagcaatatatgagtagtgtagatcgacgactcgaatgacgctctaccatttcacttttgtttttatgaacttagtcaagattttgtgtgctttgaatcagtcattttgtttctttgggatggtgaaatataagacttatttatctttacatatttctatcaagggttttccacctattttctccttgaattcggagtttcgagtaatcaatcattaatggaactgaatagcaaggttgatcttc

SEQ ID NO: 2526 - DNA, 1160 bp, Gossypium hirsutum
ccctaaattagggtttttatttctaccctgtgcagccacctttatcagatatcaaaaggagtaaacctcagattccaaatcggaaaaaagaaaatggtgaagggacgccaaggggagcgagtcagactctatgtaagaggaaccatcttgggttacaagaggtcgaagtcaaaccagtatccgaacacttcattaatccaaattgagggagttaacaccaaagaggaagtagcttggtatgccggcaagcgtatggcttatatttacaaggctaaggtgaagaagaatggttctcattatcgctgcatttggggcaaggtaactagaccgcatggtaacagtggtgtcgttcgtgctaagttcaagtcgaaccttccccctaaatctatgggagatagggtcagagtcttcatgtaccccagcaacatttgagttgtctagacgcctgacggcattcaatcgatgactcaagtgactctgcctttccaccaggttttacaaacttcgtcgaaatgttttgttttcgaatagtcattttgtttctttactaccatagaaactccgcttttgtccaaaatgtctcttctatctcggattttttgcgtgtttgttcatggacttcgaagttttgggtaatcaatcatttatggaactgaatagcaactttgttcttcttggaccatgcatatcgttatcgaagtgttgggtcgggtcaggttagcccgaattcatgaaacttttgttcgaggcccatattcgtacaggtcagatgcaccatatctatcatggtagtttgatttacatgcaattctgaatccaaaatatatcggttaaattatggttttagaccctctaccttgctcaagttgtatattttggtcctctacttttaaaatgttaagtaggtcgaaatctgtgaacactttaatgtcattaaagtgatgacatagatttttactgtaagaaaattctattttgaccgtaagaaagttactaacaaaaaaagatctttttaaccacttcaacatgttatcaatatgcatttattaataacattatatcagcatacaatcagatcataccaaatagtatcaaatcttaaatctgagtataatcgagggactaaagtcataattagactaaaaatattatgataatac

SEQ ID NO: 2527 - DNA, 994 bp, Gossypium hirsutum
caaactactttatgatataaattcctcaaaccctaaccttaccagggtttctcacttgcagtcgccattatcggaatcaaaaggaataagcttcgatttccgaatcgggaaaaaaatggtgaagggacgccaaggagagcgagtcagactctatgtaagaggaactatcttgggttacaagaggtcaaaatcaaaccagtatccaaacacttcattgatccagattgagggagttaacactaaggaggaagtagcttggtatgccggcaagcgaatggcgtatatttacaaagctaaggtgaagaagaatggctcgcactatcgctgcatttggggaaaggttactagacctcacggaaatagtggtgttgttcgtgctaagttcaagtctaatcttccccccaaatctatgggagatagagtccgagtcttcatgtaccccagcaatatataagttgtctaaatgcccgttgttcgatcgatgactcgagtgattctatcttttctctccgtctatctcaaaatgttgtgtgtttttgaggccatttttttcttcattaggatgacagtggattagactttagtgttatcaaagattttccagtaattaattttgacgattgaagtttttggtaatcaatcatttatggaattgaatagcaaagattgttctacttgagcatcttctttcttctgttaggttaaattactcgacatcgcatggaattagaaccgttgtcctcgctggtttggtggttaccgttgagtaatatatatattattttattgaactgaaaatggggcataaattagcaatatatgctgattttggaagataatggggaaataggtgatgtttccaatatttaggtaaatagattgattttgcagagagaattttgtaagaggcgtttcttttttatgtgtctgaaagtgcattttctttaataacttgactcgtcagatggttaaatgttaataattttatcttttg

SEQ ID NO: 2528 - DNA, 704 bp, Gossypium hirsutum
gcctttatcagaagcaaaaacactaagctttagcttctacatcggagaaaatggtgaagggacgccaaggagagcgagtcaggctctatgtaagaggaaccatcttgggttacaagagatcaaagtcgaaccagtacccaaacacttcgttgatccagattgagggagttaacaccaaggaggaagtagcttggtatgctggcaagcgtatggcttatatctacaaggccaaagtgaagaagaatggctcacactatcgctgcatttggggaaaagttactagacctcatggtaacagtggggttgttcgtgctaagttcaagtctaaccttcccccgaaatcaatgggagatagagtcagagtcttcatgtaccccagcaatatatgagtagtgtagatcgacgacccgagtggcactctaccttctcacttttgtttttatgaacttagtcaagattttgtgtgctttgaatcagtcattttgtttctttaggatggtgaaatataagacttatttatctttacatatttctatcaagggttttccacctattttctccttgaattcggagtttcgagtaatcaatcattaatggaactgaatagcaaggttgatcttctgcatacactgcttagttcactacttttatggcattataatatatagagcatacaaggatttaagttttactaaaaaaaaaaa

SEQ ID NO: 2529 - DNA, 823 bp, Gossypium hirsutum
ccctgtgcagccacctttatcagaaatcaaaaggagtaaacctcagattccaaatcggaaaaagaaaaatggtgaagggacgccaaggggagcgagtcagactctatgtaagaggaaccatcttgggttacaagaggtcgaagtcaaaccagtatcctaacacttcattaatccaaattgagggagttaacaccaaagaggaagtagcttggtatgccggcaagcgtatggcttatatttacaaggctaaggtgaagaagaatggttcgcattatcgctgcatttggggcaaggtaactagaccgcatggtaacagtggtgtcgttcgtgctaagttcaagtctaaccttccccctaaatctatgggagatagagtcagagtcttcatgtaccccagcaacatttgagttgtctagatgcctgacggcattcgatcgatgactcaagtgactgtgcctttccaccaggttttacaaactttgtcgaaatgttttgttttcagtcattttgtttctttactaccatagaaactctgcttttgtccaaaatgtctcttctatctcggattttttgcgtgtttgttcatggacttcgaagttttgggtaatcaatcatttatggaactgaatagcaactttgttcttcttggaccatttatttcgttatcgaagttttgggttgggtcaggttagcccaaattcatgaaacttttgttcgaggcccatattcatacaggtcagatgcaccatatctaccattgtagtttgatttacattcaattctgaacccaaaatatatcggttaaattatggtttagtccctc

SEQ ID NO: 2530 - DNA, 529 bp, Epimedium sagittatum
cggctataaatacacatttagggtttactctagggttggctagctcgaaaactgcagacgaacgaaaatggtgaagggcaggcaaggagagcgagtcagattgtacgtcaggggaaccgtcttgggctacaagaggtccaaaagcaaccagtacccaaacacatctctggtgcagattgaaggagtgaacaccaaagaagaggttgcctggtatgccggaaaaaagatggcgtacatctacaaggccaaggtgaagaagaacggatctcactacaggtgcatttggggcaaggtcacaaggccccatggtaacaccggtgttgttcgtgctaagttcaagtccaacttgcccccaaaatctatgggtgccagagttcgggttttcatgtaccctagcaacatttaaggcttttggcagtgttcatgtgatgggtggtgcagaattttgattggttagccagtgtttgaattagaaacttgtttgcttaattttatctttataatctgcatttgaaccatcaaattgttg

SEQ ID NO: 2531 - DNA, 815 bp, Eucalyptus grandis
attacggccggggaggatctctcgcactctctctcttcctccgcgagccgaccgaagaagctccactccatcgccccttggagagcgaaaatggtgaagggacgccaaggagagcgcgtcaggctctacgtgagagggacgatcctcgggtacaagaggtcgaagtcgaaccagtacccgaacacgtcattgatccagattgagggagtgaacacccaagaggaggtggcatggtactgtggcaaacgcatggcctacatctacaaggccaaggtgaagaagaacggttcgcactaccgctgcatttggggcaaggtcatcagacctcatggtaacagtggcgttgtacgggctaaattcaagtccaacttgcctcccaagtccatgggagtgagagtcagagtcttcatgtatcccagtaacatatgaggtcctgcttcctcaggggcatctgaatcccagcttcgtgatggctgatttgagaggacctacatagacatgtagctaaagtgaaatcgattcttctgaattcattaggaaaacgatgcgtctgcgtatttatatttgaaattgttgaatttcaactagttgtattggattagatgccgattttgacagatgtgcattttgcttgggtgctggttttggttttcttccaggctgcttttaacatcattttgagaaactctaatgcgaacatggttgaattccatcagccatggaatgccattgcaacagatgatggtggggagagaatgcaatggcagacttatttgcatgttcgatcttaatcgtccggtcataataatcgcgtt

SEQ ID NO: 2532 - DNA, 695 bp, Euonymus alatus
cgcgattcgctccccgattgctttccctctcgaaattagggtttccgtcttccgcagactagaggcaggagcttcaaactaaacccgaaaatggtgaagggacgtcaaggagagcgcgtgagactgtatgttcgaggaaccgtgctcgggtacaaaaggtcaaagtcgaaccagtacccaaacacatcgctgatacagatcgagggcgtgaacacaaaggaagaggttgcgtggtactgtgggaagcgcatggcctacatatacaaggccaaggtgaagaagaacggcactcattatcgctgtatttggggcaaagtaactagacctcatggtaacagtggtgttgttcgtgctaagttcaagtctaatcttccacccaaatccatgggaactagggttagggttttcatgtatccgagcaacatatgaggctgtgtggtttttagagctgtcaagatttgggatgtaatgtggggcttttgagtttgccattgttgtctgttaagggctaagttctaagattttgaacttcattatttgtaatagctaacagttttgtgtttgcccctttaattataatggattgtagaagttatgagaatgcctacaatcagttacgagtttagaactttgctgttcaaagctgtggtttcttttactatcaattttgacaccttggagtagtgcgtcgggta

SEQ ID NO: 2533 - DNA, 502 bp, Euphorbia peplus
gggcaagcaggaaccagaacctcaaccaagagcgaaaatggtgaagagccgccaaggtgagaacgtcagactgtatgttcgagggactattctcggatacaagaggtcaaagtcgaaccagtatccaaacacgtcgcttgttcagatcgagggagtaaacacaaaggaggaggtagcatggtacgctggtaagcgaatggcctacatctacaaggccaaggtgaagaagaatggcagtcattatcgttgcatttgggggaaagtttctaggcctcacggtaacagcggtgttgttcgcgccaagttcaagtctaacctccctcctagatctatgggagacagagttagagtattcatgtatcccagcaacatttgagtgatatgaagttggctcatgctactatggaggatgaaggtaagttagtcagaatatggattttacccacatacaagtgttttgagctattagattttgtattcagtagtaatactagcaaagctg

SEQ ID NO: 2534 - DNA, 729 bp, Unknown
  Sequence found in Organisms: Euphorbia peplus, Euphorbia esula
  misc_feature (9)..(10): n is a, c, g, or t
gcagctccnncctccttacttcaacctgctaatctaaggagtcgtttttcagaaccctagactgcggcagccatggtgaagggaaggcagggagaaagagtcagactctacgtcagaggaacggtccttgggtacaagaggtcgaagtcaaaccaatatccaagaacatccctgatccaaattgaaggggtgaacactagggaagaggtggcatggtatgctggaaagcgcttggcgtacatttacaaggccaaagtgaagcaaaatggaactcactaccgatgcatttggggcaaggtttccaggcctcatggtaacagtggcattgttcgagctaagttcaagtcgaacttgcccccaaaatccatgggtgataaaattagggtatttatgtaccccagcaatatatgagttactctgtcatcagctagctagaggtcaggtttcatttctttgttgacttgggtggatcgatatttttgtttcttttcttcctactggacccagtgcttaggtgttatgttttcgtgtaaaactttaactaaatttggaacgttcattgtggaatatttttactttcaattttgaccgtgtttcatttcttatcaaggcttctgtggcaagacatgctgagtattaatggtcacttcgcttgcatttacatatatattacacttgatagttgtagttcatcttgatcctttgtactttacaatgttaattttgatc

SEQ ID NO: 2535 - DNA, 609 bp, Fagopyrum esculentum
atttactgagtttctcgtacgccgaactccgaaacgcagcgaaagcaaccaacaatggtgaagggccgtcaaggagagcgtgttaggctgtacgtgaggggttcaatcctggggtacaagagatcgaagtcgaaccagtacccgagcacttccttgatccagattgaaggagtcaacaccaaggacgaggtctcatggtatcaggggaagcgtatggcgtacatttacaaggcgaagacgaagaagaagggctcccactacaggtgcatttggggtaaggtcaccaggccccacggaaacactggcgttgttcgtgctaagttcacctccaacttgcctcctagatctatgggtgacaaggttagggtgttcatgtaccccagcaacatctaagtgcatttcttgtgttttgaggcttggggaagatgcatcatcagaggggaaggacgttggctagcgttgttatttgaaaatgttaaatcttaaagagtatgttgaaaatttcatctgatatattggattgttactgcagtctagaacacaaaccaaacatttttgcttacttgaatctctattctgttaatttttgaaaacaaatcatatgacctt

SEQ ID NO: 2536 - DNA, 583 bp, Flaveria ramosissima
gggactcttcatcatcttcttcatctcatcacaggcgtcggctgccttctgttgaatcaaaaatggtgaagggccgccaaggagaacgcgtaagactttacaccagaggaacgattctcggctacaagaggtcgaagtcgaaccagtacccgaacacatcgttgattcaaattgagggagtgaacacgaaggaggaggtagcgtggtaccaagggaaacgcatggcgtacatctacaaagcgaaggtgaagaagaatgggtcgcactatcggtgcatttgggggaaagtgacgaggcctcatggtaacactggtgttgttcgtgcgaagtttaagtctaatcttcctcctaaatcgatgggagctagggttcgggtgttcatgtacccaagcaacatctaagatggtagccgaaagatggaaaaagagcgaagatatcattgctgatatttaaaggctagttataccagttttgtgatgtttgctttcttgctttctgtagcatgtgtgataaacctttttgtcttagtgaattcatatctcatgtttattcggcttaactgatcagacattcgaatgaattg

SEQ ID NO: 2537 - DNA, 587 bp, Flaveria ramosissima
caccgcagcatcggccacatttcagagcaacaaaaatggtgaagggccgtcaaggagaacgcgtcagactctacaccagaggaacgattctcggttacaaaaggtcgaaatcgaaccagtatccaaacacatcgttgattcaaatcgaaggagtgaacacgaaggaggaggtggcatggtaccaagggaagcgtatggcgtacatctacaaagcgaaggtgaagaagaatggatcgcactatcggtgcatttgggggaaagttacgaggcctcatggtaacactggtgttgttcgtgctaagtttaagtctaatcttcctcctaaatctatgggagctagggttagggtgttcatgtacccaagcaacatttaagttttgcagcccggagaagtaaaaggaatatatcattgctggtgtttaaagggtctttacaactaattttgtgatatttgccttatggttctatgcaatatttgtcgacgagtgcatgtttcttttgtatttcaagtgaagttgagttttgttcaatggtcagactgttagttcttgtggatcttaaagcacaattagtttcagcttgttatt

SEQ ID NO: 2538 - DNA, 525 bp, Flaveria ramosissima
ttgtttcttcatcaacacaggcggtcggcatctgctcaagcaaaatggtgaaggatcgtcaaggagaacgcgtcagactctacaccagaggaacgattctcggctacaagaggtcaaagtcgaaccagtatccgaatacatctttgattcaaattgaaggtgttaacaccaaggaggaggtagcatggtacgaagggaaacgcatggcgtacgtttacaaagctaaagtgaagaggaatggatcacattatcggtgtatttgggggaaagttacgagacctcatggtaacactggtgttgtgcgggctaagttcaagtctaatctgccacccaaatctatgggagctagggttagagtgttcatgtacccaagcaatatctaagctgtgatgaagaagattatgatgattgttgctactggtattttagttgttcttgtattagttgtgttgaccctttgctatgaaggatttttatttcttacaaggaacatcacaagatatttaaaacatcttgtactatttt

SEQ ID NO: 2539 - DNA, 724 bp, Fraxinus spp
gagttttcatcttctccggcacttacactcagtcgcccttcccaaaagaagcagtcgaaaatggtgaagggtcgccaaggagagcgcgtcaggttgtacgtccgaggcacgatcctggggtacaagaggtcgaagtcgaaccagtacccgaacacgtccttaatccagatagagggagtgaacagcaaggaggaggtagcttggtaccaaggaaaaaggatggcgtacatttacaaggctaaggtgaagcagaatgggactcactatcggtgcatttggggtaaggtgattcgtccccatggaaactccggtgttgttcgtgccaagttcaaatccaacctgccccccaagtccatgggagcacgagttcgcgtcttcatgtaccctagcaacatttgaagcattttaagaagtagtggaacagagtttgagcattggtggcttttagaaggatctgttttgccccttttctttttctgtattttggtcatgtttgtttatcaccaagtattggacatcaaactagatataactgattttgacaattttgggtcactgttttaatcttattatcaatgattttccaattttgtatatatttgatgcttgctcgtcgtgctccaggggaaaatggaggttagtaaatatggttacgttagattcaatcctaagagcatgtttggtatgcaattttgtacaacacaatggagcaagattttggcct

SEQ ID NO: 2540 - DNA, 559 bp, Fraxinus spp
atcttctccggcaattacactcactcgccgttcccgaaagaaacattcaaaaatggtgaagggtcgccaaggagagcgcgtcaggttgtacgttagaggaacgatcctggggtacaagaggtcgaagtcgaaccagtacccaaacacgtccttgattcagatcgagggagtaaacagcaaggaggaggtagcgtggtaccaggggaaaaggatggcgtacatttacaaggctaaggttaagcagaatggaacccactacaggtgcatttggggtaaggtgattcgtccccacggaaactccggtgttgttcgtgctaagttcaaatccaaccttccccccaagtccatgggagcccgagttcgcgtcttcatgtaccctagcaacatttgaagcgtttttaagaagtagcggaacggagtttgagcattggtggctattagaaggatctgtttttgccttctttttactccctattttggtcgtgtttgtttatcgtcgtcaaggatttttacaatctggtcactgttttaatcattattatcaatgatttccagtttt

SEQ ID NO: 2541 - DNA, 538 bp, Fraxinus spp
atcttctccggcaattacactcagtcgccgttcccgaaggaaacattcagaaatggtgaagggtcgccaaggagagcgcgtcaggctgtacgttagaggaacgatcctcgggtacaagaggtcgaagtcgaaccagtacccaaacacgtccttgattcagatcgagggagtaaacagcaaggaggaggtggcgtggtaccatgggaaaaggatggcgtacatttacaaggctaaggttaagcaaaatggaacccactacaggtgcatttggggtaaggtgattcgtccccacggaaactccggtgttgttcgtgctaagttcaaatccaaccttccccccaagtccatgggagcccgagttcgcgtcttcatgtaccctagcaacatttgaagtgttcttaagaagtaggggaacagagtttgagcaatggtggctattagaaggatctgttttgccttctttttactccctattttggtctatgtttgtttatcatcaaggattttacagtctggtcactgtttaatcattattatc

SEQ ID NO: 2542 - DNA, 1229 bp, Gossypium raimondii
cccaacttcatttcataatttccttcatgtctaaaaacttacagccgctctatataaatttcccccaaatcggaaatcttattagggttttagagctttttcaggattcgaaaggaataagcttcagcgtccgaatcgggaggaaatggtgaagggacgccaaggagagcgtgtcagactctatgtaagaggaaccatcttgggttacaagaggtcaaagtcgaaccagtacccaaatacttctttgatccagattgagggagttaacaccaaggaggaagtagcttggtatgcaggaaagcgcatggcttatatatacaaagctaaggtgaagaagaatggctcacactatcgctgcatttggggaaaggtcactagacctcatggtaacagtggtgttgtccgtgctaagttcaagtctaaccttcccccaaaatctatgggagatcgagtcagagtcttcatgtaccctagcaatatctaagctgtctcgatgccgaacggcttgtgattgactacttgagtgactctgccttttcactttgttttgataaacttattcaacatgttttgtgtttatttttggtttgtttaggatggtgtatgaaataagattttggataatcatcattttttgggaatctattgtcatctttggtcttctgctaggtttttagctaggggctaatcgagctcgactcagataggaatctttataaaactactttgattttctttatttattaaaatgatcattttttgcttaacttttcaatcttaattaaaagaacgaaataattcatttctctttaattttgtatctaaaattgagctaacatatttctaataaacccaaacgaataaactaatgagtctcaattaattaattagtaaacccaccttgtcctcttccatgaggtcctagataaataacattaggaaaaattcaaaaagaaaaacagaaacacacaagcttttaaatcccatttcttcctctctctttattccttctcttcagaaaaatctgtagagagacagccacattctttccatttggtgttcctcaaaacacgaaaagctttcttttaaaaaaaaagaaaaaaaattctcttttaaggtcacgtttctagattttcttccattttggaaatgggaatccttgattttctaaagagaaacttcaattaaatccatagaagctaattcaatcccatcattccaaaaaaaat

SEQ ID NO: 2543 - DNA, 924 bp, Gossypium raimondii
atatattccccaaacccttagccaaattagggttaaggtctgtctctcttgcagtcgcctttatcagaagcaaaaacactaagctttagcttctacatcggagaaaatggtgaagggacgccaaggagagcgagtcagactctatgtaagaggaaccatcttgggttacaagaggtcaaagtcgaaccagtatccaaacacttcattgatccagattgagggagttaacaccaaggaggaagtagcttggtatgctggcaagcgtatggcttatatctacaaggccaaagtgaagaagaatggctcacactatcgctgcatttggggaaaagttactagacctcatggtaacagtggggttgttcgtgctaagttcaagtctaaccttcccccgaagtctatgggagatagagtcagagtcttcatgtaccccagcaatatatgagtagtgtagatcgacgactcgaatgacgctctaccatttcacttttgtttttatgaacttagtcaagattttgtgtgctttgaatcagtcattttgtttctttaggatggtgaaatataagacttatttatctttacatatttctatcaagggttttccacctattttctccttgaattcggagtttcgagtaatcaatcattaatggaactgaatagcaaggttgatcttctgcatacactgcttagttcactacttttatggcattataatatatagggcatacaaggaattaagttttctagtccatgacttggatttgatttgtgttttgagttgctaaacgaaaagaatcagtgcatcatcggtctcttggacttgaacattttgtgcccattgaccatttttagatgatgatgtagaacaatctcattttgtcacatatcaaaacatcagattctgatcggttcaattgttaa

SEQ ID NO: 2544 - DNA, 1686 bp, Gossypium raimondii
ttgggtttttcagtcatgtttttgagtcattttttaagtcatttctagtgctcggctcgggagaatttaggggatgttcaaatggtgaatttggttagaatgtttaactgttatcggttattaaattttataattgaatcctcgattgaaccgacttaataaatattatttttagtataataaatatataatacataaattaaataaaatctaatccaatttacaaagcgaacccaacagatcaacccaacccaagtttatatcaaaataaaaaaaattaataaaaagaacttacaataaaaaattatcaactaaccgactgaatatattaaagttaaaaagacaacatcactcttccaaaaggtccaatgactcaatactaaggcccaaatccatatatggttatacattcgacttacagtcttttatatttcagcccccttatataaattccccaaaattagggtttttagttctaccctgtgcagccacctttatcagaaatcaaaaggagtaaacctcagattccaaatcggaaaaagaaaaatggtgaagggacgccaaggggagcgagtcagactctatgtaagaggaaccatcttgggttacaagaggtcgaagtcaaaccagtatccgaacacttcattaatccaaattgagggagttaacaccaaagaggaagtagcttggtatgccggcaagcgtatggcttatatttacaaggctaaggtgaagaagaatggttcgcattatcgctgcatttggggcaaggtaactagaccgcatggtaacagtggtgtcgttcgtgctaagttcaagtctaaccttccccctaaatctatgggagatagagtcagagtcttcatgtaccccagcaacatttgagttgtctagacgcctgacggcattcgatcgatgactcaagtgactctgcctttccaccaggttttacaaacttcgtcgaaatgttttgttttcgaacagtcattttgtttctttactaccatagaaactccgcttttgtccaaaatgtctcttctatctcggattttttgcgtgtttgttcatggacttcgaagttttgggtaatcaatcatttatggaactgaatagcaactttgttcttcttggaccatgcatatcgttatcgaagtgttgggtcgggtcaggttagcccgaattcatgaaacttttgttcgaggcccatattcatacaggtcagatgcaccatatctatcatggtagtttgatttacatgcaattctgaatccaaaatatatcggttaaattatggttttagaccctctaccttgctcaagttgtatattttggtcctctacttttaaaatgttaagtaggtcgaaatctgtgaacactttaatgtcattaaagtgatgacatagatttttactgtaagaaaattctattttgaccataagaaagttactaacaaaaaaaagatctttttaaccattttaacatgttatcaatattcatttattaataacattatatcagcatacaatcagatcataccaaatggtatcaaatcttaaatttgagtataatcgagggactaaagtcaaaattagactcaaaagtatgatgatagtacgagtgcatgtggtgtctactttttttgcgttaataaacgtgtcataaattattaattctattagacacttt

SEQ ID NO: 2545 - DNA, 1024 bp, Gossypium raimondii
ctacaaactacttttactctataatgataaaaattcctcaaaccctatcctaagtagtgtttctcacttgctgtcgccgttatcggaatcaaaaggaataagcttcgatttccgaatcgggaaaaaaatggtgaagggacgccaaggagagcgagtcagactctatgtaagaggaactatcttgggttacaagaggtcaaaatcaaaccagtatccaaacacttcattgatccagattgagggagttaacactaaggaggaagtagcttggtatgccggcaagcgaatggcgtatatttacaaagctaaggtgaagaagaatggctcgcactatcgctgcatttggggaaaggttactagacctcacggaaatagtggtgttgttcgtgctaagttcaagtctaatcttccccccaaatctatgggagatagagtccgagtcttcatgtaccccagcaatatataagttgtctaaatgcccgttgttcgatcgatgactcgagtgattctatcttttctctccgtctatctcaaaatgttgtgtgtttttgaggccatttttttcttcattaggatgatagtgttatcaaagattttccagtaattaattttgacgattgaagtttttggtaatcaatcatttatggaattgaatagcaaagattgttctacttgagcatcttctttcttctgttaggttaaattactcgacattgcatggagttagaaccgttgtcctctctggtttggaggttaccgttgagccatatatatattattttattgaactgaaaatggggcataaattagcaatatatgctgattttggaagataacggggaaataggtggtttttccgatatttaggtaaatagattgattttgtagagaggaacaaaaacgcgttttgtaggaagcgtttctttttgatgtgtccgaaagtgcgttttctttaattacttgactcattaccttctttggttggtcagatggttaaatgttagtaattttgtttcggattcaa

SEQ ID NO: 2546 - DNA, 631 bp, Heritiera littoralis
gctcttgcagtcgcctttatcggaatcaaaaggactaagcttcagcttccaaatcggagaaaatggtgaagggacgccaaggagagcgagtcagactctatgtaagaggaaccatcttgggttacaagaggtcaaagtcgaaccagtatccaaatacttcattgatccagattgagggagttaacaccaaggaggaagtagcttggtatgctggcaagcgcatggcttatatttacaaggctaaggtgaagaagaatggctcacactatcactgcatttggggaaaggttactagacctcatggtaacagtggagttgttcgtgctaagttcaagtctaaccttccacccaaatctatgggagataaagtcagagttttcatgtaccccagcaatatatgagctgtctagttgcctgatagagttcaattgttgagtcaagcaactcatcactttgttttacaaacttagtcaagatgttgtgtgttttggaatggtcattttttttctttaggatggtggatgagactctgcttctgtttatgtatttctatgaaggattttccacctatttgttcagaagttttgcataatcaatcatttatggaattgaatggaaaggtttatctaat

SEQ ID NO: 2547 - DNA, 578 bp, Hevea brasiliensis
cgaaaatggtgaagggacgccaaggagagcgagtcagactctacgtcagagggaccatcctcggatacaagaggtccaagtcaaaccagtatccaaacacgtcattaatccagattgaaggagtgaataccaaggaagaggttgcctggtatgctggaaagcgcatggcttatatatacaaggctaaggtaaagaagaatggatcacactatcgctgcatttggggcaaggtcaccaggcctcatggtaacagtggtgttgtacgagctaagttcaagtccaatctgcccccaaaatcaatgggagatagggttagagtcttcatgtaccccagcaacatatgagtgtcacaagatggcagattgagttcattgttgacttggagcgatctgtgttacttgttttgtaagccaagtttaaacttgttatgtgctttttagttttgagagagttattattgtttgtttagaagctggatgaacattattattttttgctgccttattaatctcactcaggaatttttaaacctttgttgtttattaaattgttgagtatattagagttttctttgaact

SEQ ID NO: 2548 - DNA, 672 bp, Carpinus betulus
agtctgcattagggtttccgtcttcctcagaccagacacaacagctccgttcgaaaatggtgaagggtcgccagggagagcgcgtcagactctatgtacgaggaaccattctcggatacaagaggtcgaagtccaaccagtatccaaacacgtcgctcatccagatcgagggtgtgaacaccaaggaggatgtgtcatggtacgcaggcaagcgcatggcgtacatctacaaggcgaaggtaaagaacaacggtacccactaccggtgcatttggggcaaggtcatcaggcctcatggtaacagtggcatcgtgcgcgcaaagttcaagtctaacctccctcccaaatccatgggagctagagttagggttttcatgtaccccagcaacatttgagtttggttacgtagatgctagattggagatcagaggtgaaatagtcaaattttgtatgaactccagagcctagtcttaatggtgttgtactcgggaatcgaactagcatgttctgtttttttttgctctctttggttattaatggatatgtaacattcatggtaatgctaataccagttttggattgggagttgttagtattttgtcttctcatgtggagtagttatggttttctgcactatctctctctcttgcattggaaatttgaggctgaatg

SEQ ID NO: 2549 - DNA, 738 bp, Humulus lupulus
acggccggggagggtttccgattttcgtcttcatacaccagtgttcagaacaaagcttcgatcgaaaatggtgaagggtcgccaaggagagcgcgtcaggctttatgtgcgaggcacagttcttggatacaaaaggtcgaagtcgaatcagtacccaaccacttctctggttcagatcgagggtgtgaacacaaaggaggaggtagcatggtactgcgggaagaaaatggcttacatttacaaggccaaggtgaagaaggacggtagccattaccgttgcatttggggaaaggttattagacctcacggtaacagtggtgtcgtccgtgctaagttcacgtcaaaccttcctcccaaatccatgggtgctagggtcagagtcttcatgtatcccagcaacatatgaggtgttcctcatttagatgatagagtggactactgcaaggagagacaaccgagttttggatttatttttgtttaatagacttaattttccagatctgtactcagcaagaacgctagctacttattgtgcctttgttattgtattggtattgattttcagatattttgatacaattttttgttcccggttttgaaagacctcactatactttgcttcccttttaatgatcccattaacgggctgtctcccttgaattgagcctaatcaagcataggtttatgtaaggtcattttgaccccaaaaaaggaggaccacagctattttaggaaagt

SEQ ID NO: 2550 - DNA, 710 bp, Humulus lupulus
taccctaatcttcaccttcgcaaactagggttttagggcttctcctctgcaggcgtctctggttaacttccgaagatcaagagagaacaaaccctaagagaaagatggtgaagggtcgacaaggagagcgagtcagactctacgtcagaggaacagtcctcggatacaagaggtccaagtcgaaccagtatccaaacacttctttggtccagattgagggagtgaacaccaaggaggaggtctcatggtactgcgggaagcgcatggcgtacatctacaaggccaaggtgaagaaggacgggtcccactatcggtgcatttggggcaaggttatcaggccgcacggtaacactggcgtcgttcgtgctaagttcacatctaacctgcctcctaaatctatgggtgctagagttagagtgttcatgtaccccagcaatatataaggacttctagatgacagagattggtcactagcatctgcattttatgtttttttgaaccaaatttaaatgtcatgtttgtttagagatgaatcagttttgttattttaggatattgaatggagccactattcaggaactaatttaatgtcgattttctttcattctactgctatagcgttattggataaaatatcttcaatgtggtttcagtttgccctgtagtttatgcttttgaattattattttgaccaaattgggttacacttg

SEQ ID NO: 2551 - DNA, 571 bp, Ipomoea batatas
cagctgctccgccttccaacggtgaaaatggtgaagggaagtcaaggcgagcgtgtcagactctatgttagaggaacggttctcggttacaagaggtcgaagtcgaatcagtatccgaacacctcactgattcagatcgaaggagtgaacacccaggaggaagtggcatggtacctgggaaagcgcatggcctacgtctacaaggctaagaccaagaagggcggctctcactaccgctgcatctggggaaaggtctgcaggcctcacggcaacagtggcgtcgtcagagctaagttcaagtccaacctcccacccaaatccatgggtaacaaggttagagttttcatgtacccaagcaacatctaagctagaatgttgaagatgcatgatgggttgcttttgaagatctccagtgatttatgtagctgcatctttactacatactccagttatatttgtgtcttgttttgatcattttgtcattcaaccttgttttagtagtacaaaaccattggacatcttgttagatgaaactaattttgctcattttttgtacttacacatgatttct

SEQ ID NO: 2552 - DNA, 645 bp, Ipomoea nil
gaactagggtttagcttcttcttcgcaggcgccaccgtcactctccgccgtagctcccgttctgcagtcaaaaatggttaagggacgtcaaggagagcgcgtcagactttatatcagagggacgattctcgggtacaagagatcgaagtcgaaccagtatccaaacacttccctgattcagattgagggagtgaacactaaagaggaagtggattggtaccagggaaagcgcatggcgtatgtctacaaggctaagaccaagaagggcgggtcccactaccgttgtatctgggggaaggtctgtcggccacacggcaatagcggcgtcgtcagagcgaagttcaagtccaacttgccgcctaagtccatggggaacaaagttagggttttcatgtacccaagcaacatataagagaagagaagatgaagatgagagttgtagcgggttttggagcctaatatttatatagtagtcaaatttgccatgttctactcttttttgttagacaatgttggagttgtacgaatgaacatatatggtcaaatgcaactacttttggtcatttgacatcctttttgactgtgtttgtgttttgttcatttgaaatccttattttccatagtgttttctcaagaaaaaaaaaa

SEQ ID NO: 2553 - DNA, 698 bp, Actinidia deliciosa
agctttcagcttcgcagacgtctctatagtggccgattccctcaaatctcaagcgaaaatggtgaagggacgccaaggagagcgtgtcagattgtacgtcagaggtaccattctcggctacaagaggtcgaagtcgaaccagtacccaaacacatcactcattcagattgaaggagtgaacacgaaggaggaggttgcatggtaccaagggaagcgcatggcatacatctacaaggccaaggtgaagaaggatggatcacattatcgttgcatttggggaaaggtctctaggcctcacggtaatagtggtgttgttcgagctaagttcaagtccaacctccctcccaaatccatgggatctagggttagggttttcatgtaccccagcaacatatgagaaggcacagattgtcattggtgatttcagaaggttttcgttgcctgattgagatcgttgatgatttgaaacgtctgcattttaccttagagacgagagttcaagtatcttctgttttccggagctaaaataggcttctattctggcgccatttttttgtttgttttttcagtacaaggatagaacaattgaaatattgcttttaagcaagttggatttatgcacaatttgtcctttgattagggcagtctgacgaccctaaatttgttgagctacacgtgttttgcagtatttttctaat

SEQ ID NO: 2554 - DNA, 660 bp, Actinidia deliciosa
  misc_feature (570)..(570): n is a, c, g, or t
tcatcgctgccgcgtctggttcgtgttctatagagcgaaaatggtgaagggacgccaaggagagcgcgtcagattgtacgtcagaggaaccatcctcggctacaagaggtcgaagtcgaaccagtacccaaacacgtcgctgatccagatcgagggagtgaacacgaaggaggaggtggcgtggtaccaagggaagcgcatggcgtacatatacaaggccaaggtgaagagggacggatcgcattaccgttgcatttggggaaaagtttccaggcctcatggtaacagtggtgtcgttagagctaagttcaagtcgaatctccctcccaaatccatgggagctagggttagggtcttcatgtaccccagcaacatatgagttgctccaggcgtatcttggcaatttcggaatgttacgcatgctggcttgagataatgggtgattcaggacatctggattttacattgtagttatgggaagttttgaagtatcttgtgttttctcgagctaaaaatcctctgtttctggctttcatttttgtttgtttagtacaagggtagaacatttcngaaagcttgcttctgattaacctttggatttatgcactttattttagttgcactttgcagtggatatatttgatcaaaccatgtgtttgc

SEQ ID NO: 2555 - DNA, 678 bp, Actinidia deliciosa
tatatcttccttcagcgcaggcgtctccggttcgggttctagagagcgaaaatggtcaagggacgccaaggagaacgcgtcagattgtacgtcagaggaaccatcctcggctacaagaggtcgaagtcgaaccagtacccaaacacgtcgctgatccagatagagggtgtgaacacgaaggaggaagtggcgtggtaccaagggaagcgcatggcgtacatttacaaggccaaggtgaagagggacggttcgcattaccgttgcatttggggaaaagtttccaggcctcatggtaacagtggtgtcgttagagctaagttcaagtcgaatctccctcccaaatctatgggagctagggttagggtcttcatgtaccccagcaacatctgaggcgtatctggcaatttcagaaggttatgaatgccagccggagatcattgatgtgattccaggcatcaacattttattttatagttagagatggtgagttttgaagtgtcttattttctcgatctaaaatccttctgtttctagcattcatttttgtttgtttagtacaagggtagaacatttgagaaatatgttcctgcttaacttttggatttatgcaccttttctttgcactttgcaatggattaccgtatatttaatcaaactacatgtttgccaaaaaaaaaa

SEQ ID NO: 2556 - DNA, 670 bp, Lactuca sativa
cgagaatataaaggacatggtggaaaactagaactagggtttatacacatcggcgcaggctttcgtctatcttctggaaatcgaaaatggtgaagggacgtcaaggtgaacgcgtcagactctacacccgaggaacgattctcggctacaaaaggtcgaaatcgaaccagtatccgaacacatcgttggttcaaatcgaaggagtgaacacgaaagatgaggtatcatggtatcaagggaaacgtatggcgtacgtctacaaagcaaaggtgaagaagaacggatcacactatcgttgcatttggggaaaagttaccaggcctcatgggaacaccggtattgttcgtgctaagttcacctccaatctccctcctaaatccatggggtcgagggtcagagtgttcatgtacccaagcaacatttaagtttgagcaggaagaaggaagtaaagtctgtttttcaagtggtttttgtcaacatattgcctgaacttcagaatttctttagtctttttgtcaaaggcaaatcctctttttgagttgtagtacaattttcttcatcattttagttttatttgagaatttacagttgtttttaatgggtgtgcattgctaattgtttctgaatatcaacttttttataggggtaaaatttgatggtaaaattggtc

SEQ ID NO: 2557 - DNA, 603 bp, Glycyrrhiza uralensis
gagggttacgccgcgcatctgctggttcagtcgttgtgtatcagctgcatcaaccaacaacgaagatggtgaagggacgccaaggagagcgcgttagactctacgtgagaggtacaatccttggatacaagagatccaaatcaaaccagtacccgaacacatctctcatccaaatcgagggagtgaacaccaaggaagaggtagcgtggtatgctggcaagaggatggcatatatctacaaggccaaggtgaagaagaatggaactcattaccgctgcatttggggcaaggttacaaggcctcacggtaacagtggtattgttcgtgcaaaattcaagtcaaaccttcctcctagatcaatgggagcacgggtaagagtatttatgtatccaagcaacatatgaggttcaggcgatatgatatgctcattagaattctcagctgatttgtagccacaaggatttttgtttcattttcgatgaagtctgtcttcgtttatgctttaacttttgagaatttgtttttcggtttagacagttagaggaccgaatggtgttctctattgtattgtctatgtctattgtctatgaaagattatatatt

SEQ ID NO: 2558 - DNA, 631 bp, Quercus alba
taggttcttatatataatttggcctctcatcgatttcactctctgaaaagcaagcgcctccaaaatcgaagaaaatggtgaagggacgccaaggagagcgagtcaggctctatgttagaggaacaatcctcggctacaagaggtccaagtcaaaccagtaccccaacacatccctgatccagattgagggagtgaacaccaaggaggaggttgggtggtatgctggcaagcgtatggcttatatctacaaggccaaagtgaagaagaatggaagtcactatcgctgcatttggggtaaggttgctaggcctcatggtaacagtggcgttgtccgtgccaagttcacgtccaatcttccaccaaaatccatgggggctagagttagggttttcatgtaccccagcaatatatgagctcaggttgtgtagatgctggatttagctggtgacagaagaattatgttttttatgagctaaatttatgtcatgtactttcgagctgagtcatttttgtttatttaggttggtggatggaactttgaatctttactaatgtcattgagaagtttcttcttgtttgtttcttgatacaagtatttggattatcaacatttcatagaaatggatattga

SEQ ID NO: 2559 - DNA, 653 bp, Quercus alba
atggggagggttttaggttcttctatataatctggcctctcatcgatttcactctctgaaaagcaagcgcctccaaaatcgaagaaaatggtgaagggacgccaaggagagcgagtcaggctctatgttagaggaacaatcctcggctacaagaggtccaagtcaaaccagtaccccaacacatccctgatccagattgagggagtgaacaccaaggaggaggttgggtggtatgctggcaagcgtatggcttatatctacaaggccaaagtgaagaagaatgggagtcactatcgctgcatttggggtaaggtggctaggcctcacggtaacagcggcgttgtccgtgccaagttcacgtccaatcttccaccaaaatccatgggggctagagttagggttttcatgtatcccagcaatatatgagctcaggttgtgtagatgctggatttagctggtgacagaagaattatgtcttttatgagctaatttatgtcgtgttttggagttgagtcatttttgtttatttaggttggtggatggaactttgaatctttactaatgtcgttgagaagtttcttcctgtttgtttcttgatacaagtatttggattatcaacatttcatagaaatggatattgagcaaacttagtt

SEQ ID NO: 2560 - DNA, 657 bp, Olea europaea
atgtatttatttcactcgaattagggttttaacgtctctccgcctgaatcagcattagcacagggacgaaacaacgcaaaaatggtgaagggtcgccaaggagaacgcgtcagactttacgtgagaggcacaatcctgggatacaagaggtcgaaatccaatcagtatccaaacacgtccttaatccagatcgagggagtgaacagcaaggaagaggtggcgtggtaccaggggaagcggatggcttacatctacaaggccaaggtgaagcaaaatggaacccattataggtgcatttggggcaaggtaattcgcccccatggtaacagtggcgtcgtcagggctaagttcaagtccaacctcccaccaaaatccatgggcgcccgcgttcgcgttttcatgtaccctagcaacatttgaagtgcgttcagaaattgcttaaaagagttaaaagacattggtggctcaaaaaaaagtcttcgttgattgttagggtctatttataagagctgaatgttatactggcgtttctgttttggtaatctttgtgtaccttcaactatttgagcatttcaatataattagatggcactggattttactattgttgtcattctgttttaatcgtttttgaagttactatttgtaatgtggcta

SEQ ID NO: 2561 - DNA, 1007 bp, Olea europaea
gttaaggtacgagtaggtagtcaacgacgagagtacgccggggaggcggcggaccgagctcaagtccctcgaaggggcggccggagagggtttaacgtctctccgcctgaatcagcattagcacagggacgaaacaacgcaaaaatggtgaagggtcgccaaggagaacgcgtcagactttacgtgagaggcacaatcctgggatacaagaggtcgaaatccaatcagtatccaaacacgtccttaatccagatcgagggagtgaacagcaaggaagaggtggcgtggtaccaggggaagcggatggcttacatctacaaggccaaggtgaagcagaatggaacccattataggtgcatttggggcaaggtaattcgcccccatggtaacagtggcgtcgtcagggctaagttcaagtccaacctcccaccaaaatccatgggcgcccgcgttcgcgttttcatgtaccctagcaacatttgaagtgcgttcagaaattgcttaaaagagttaaaagacattggtggctcaaaaaagtcttcgttgattgttagggtctatttataagagctgaatgttatactggcgtttttgttttggtaatctttgtgtaccttcaactatttgagcatttcaatataattagatggcactggattttactattgttgtcattctgttttaatcgtttttgaagttgctatttgtaatgtggctatgcttgtttattggaaaatgtgctcgccttttggttttacattgatcagttattcaaggtcaatgcgtactcgtgcgttagataccatgctttaagctaggtgggtataccgaacgctaggtacgtaccgacgtacgtagacgtacctgaccgtaaggctaaccgtacgtagggggtaactagggagagggtagctgagttacgatgagtcgtagatcgtaatggtatggtactagtacgtacagtcgtacgggtaccgtagtaacgtccgtaagtccgtagttaccgg

SEQ ID NO: 2562 - DNA, 594 bp, Olea europaea
gggttttagttttcatcttctccggcactaacgctcagtcgctgttcccaaaagcagcagtcgaaaatggtgaagggtcgccaaggagagcgcgtcaggttgtacgttcgaggcacgatcctggggtacaagaggtcgaagtcgaaccagtacccgaacacgtctttaatccagatcgagggagtgaacagcaaggaggaggtagcttggtaccaggggaaaagaatggcgtacatttacaaggctaaggtgaagcttaatgggactcactatcgttgcatttggggtaaggtgattcgtccccatggaaactccggtgttgttcgtgctaagttcaaatccaaccttccccccaagtccatgggagcccgagttcgcgtcttcatgtaccctagcaacatttgaagcgtttcaagtggccgaacggagttcgagtattggtggcttttagaaggatctcttttgccttttctttctccatattttggtttatgtttattttattcaccaaggattggacatcaaactagatataactgattctgacaatttgggttcactatttttaattcataattatcaatgatttaccgt

SEQ ID NO: 2563 - DNA, 458 bp, Olea europaea
atcttctccggcactaacgctcagtcgccgttcccaaaagcagcagtcgaaaatggtgaagggtcgccaaggagagcgcgtcaggttgtacgttcgaggcacgatcctggggtacaagaggtcgaagtcgaaccagtacccgaacacgtctttaatccagatcgagggagtgaacagcaaggaggaggtagcttggtaccaggggaaaagaatggcgtacatttacaaggctaaggtgaagcagaatgggactcactatcgttgcatttggggtaaggtgattcgtccccatggaaactccggtgttgttcgtgctaagttcaaatccaaccttccccccaagtccatgggagcccgagttcgcgtcttcatgtaccctagcaacatttgaagcgtttcaagtggctgaacggagttcgagtattggtggcttttagaaggatctcttttgccttttt

SEQ ID NO: 2564 - DNA, 457 bp, Olea europaea
gccggaaatggtgaagggacgtcaaggagaacgtgtcaggctatacgtgagagggacgatactggggtacaagagatcgaagtcgaaccagtacccgaacacttcgttgattcaaatcgagggagttaacaccaaggaggaggtgtcatggtaccaggggaagcgaatggcatacatttacaaggccaaggtgaagacaaatgggtcacactacaggtgcatttggggtaaggttattaggccccatggaaacagcggcgttgttcgtgccaagttcaagtctaatcttcccccaaaatccatgggcgctcgtgttcgtgtcttcatgtacccgagcagcatttgatggtatttatatctttgttttcatttgaactgggtttagattttatttttaagtacgaattgatttgatgtttatgtattttgatgaataattaatgctagttgctagaag

SEQ ID NO: 2565 - DNA, 496 bp, Olea europaea
gccaacaatacgacaaccagctgccggaatggtgaagggacgtcaaggagaacgcgtcaggctgtacgtgagagggacgatactggggtacaagagatcaaagtcgaaccagtatccaaacacgtcgttgattcaaatcgagggagttaacaccaaggaggaggtgtcatggtaccaggggaagcgcatggcatacatttacaaggccaaggtcaagacaaatgggtcccactacaggtgcatttggggtaaggttattaggccccatggaaacagcggcgttgttcgtgccaagttcaagtctaatcttcccccaaaatccatgggcgctcgtgttcgtgtcttcatgtacccgagcagcatttgatggtattcatatctttgttttcatttgaactgggtttagattttatttttaagtacgaattgatttgatgtttatgtattttgatgaataattaatgctagttgctagaagaaaatgggcttttctttt

SEQ ID NO: 2566 - DNA, 771 bp, Allium cepa
ccctcctcctccgtgtcgtcgtcgtgctctcaagagagcgtaggttgtaacaccacgagaggaggggggatcgccgccacttctgatctcatacacaacgatggtgatggaacgtaaaggccaacgcgtcaggctttatgttcgaggaactattttgggatacaagagatcaaaatcgaatcagtatgaaaatacttcattgatgcagatcgaaggagtgaacacaaaagaagacgtagcttattaccttgggaagagattagcgtatatttataaggcgaaggttaagaagaatggaactcactataggtgtatttggggaaaagtaactcgtcctcatggaaatagcggtgtcgtgagaactaagtttagatctaatttacctcctaaagctatgggcgctaaagttagggtttttatgtacccgagcaactactgaggtctggttaggatttggccgaaggaagtgttgcaacaaaaagataatttttggccaaattcttaagcctaactgtttatggaaatgtcaaaatttttgtttgaacaatcatatttgtttattgtcttggatttatgtgcctttgaagggaggatttacttgatttgtatgtttccatgtattgtttagagttttttattaagcaagtgctactgtttgcttgattctaattcaagcatggccttatagccaagacattagaagaaaaatgtgtaaaattggtaggaaaaaacataaaatatgttgccatcaatttgcaagttatgttttag

SEQ ID NO: 2567 - DNA, 561 bp, Allium cepa
tctgatctcatacacaacgatggtgatggaacgtaaaggccaacgcgtcaggctttatgttcgaggaactattttgggatacaagagatcaaaatcgaatcagtatgaaaatacttcattgatgcagatcgaaggagtgaacacaaaagaagacgtagcttattaccttgggaagagattagcgtatatttataaggcgaaggttaagaagaatggaactcactataggtgtatttggggaaaagtaactcgtcctcatggaaatagcggtgtcgtgagaactaagtttagatctaatttacctcctaaagctatgggcgctaaagttagggtttttatgtacccgagcaactactgaggtctggttaggatttggccgaaggaagtgttgcaacaaaaagataatttttggccaaattcttaagcctaactgtttatggaaatgtcaaaatttttgtttgaacaatcatatttgtttattgtcttggatttatgtgcctttgaagggaggatttacttgatttgtatgtttccatgtattgtttagagttttttattaag

SEQ ID NO: 2568 - DNA, 582 bp, Allium cepa
ggggaggagcgacaaggccagcgcgtcagactttacgttcgaggaacggttttgggatacaagagatcgaaatcgaatcagtatgaaaacacttcattgatgcaaattgaaggagtgaatacgaaagaagacgtggcctggtattgtggtaagcggctggcatatatttacaaggcgaaagtgaagaaaaatggaacacattttaggtgtatttggggaaaagtcactcgtcctcatggaaatagtggagttgtgagagctaagttcaggtcgaatttgcctcctaaagcaatgggagctaaggttagggtgtttatgtacccaagcagtatctgagttaactggcttgattaaagagtgctagctgtaagcagtggaaaactcgttagttccgtaggaatatcaaaattgtatctgaactgtgaacttctatgttattgttttggattttatttatctctgagttggtttttatcacatttgcatcgattttgatttatagctcatacggttatcctattatttctgagttgggtatctgctttctgttcttatgttcaaacacagtagaggttatgagtt

SEQ ID NO: 2569 - DNA, 783 bp, Citrus sinensis
attaatttaattaagaagggtagggttttagggtttctcctgctcttattttgtatcgctcgcagcctcagtctcacttgcagagcttgttgtgttgttcagtcaaaatggtaaagggacgacaaggagagcgagtcagactctatgtcagaggaaccatcctcggatacaagaggtcaaagtccaaccagtacccaaacacttcattgattcaaattgagggagtgaacaccaaggaagatgtgtcatggtactgtgggaagcgtatggcttacatttacaaggctaaagtgaagaagaatggatcacactatcgttgcatctggggcaaggtcgcaaggcctcatggaaacagtggggttgttcgtgctaaattcaagtccaatctgcctccaaagtccatgggagacagagttagggtcttcatgtaccccagcaacatctgaggtccttcggcccatagatgtcagattgaggttgttgacaactcgaaagaatctgctttttaacttgtgttataagctagatttgaattcatgtgtgttatggagctgaatcatttttgtttcattaggatagtaaatgagacattattttcgctaaaactgatgtcagaattttttgccccagctgtttctatcttactgcatatttgggtgatttacattgttgatctaaaacttcagtccgattctagcaaccaaattctgctattatttcaagtactacttgtccgtgtaccaaatttatgcaagccattagccttattgcttatttgttgac

SEQ ID NO: 2570 - DNA, 646 bp, Orobanche aegyptiaca
cagtatcctcatttcgactctctcagcccgccgaagttccgaaacagcagcagcaatggtgaagggacgacaaggcgaacgcgtcaggctctacgtccgtggaacggtcctcggatacaaaaggtcgaagtcgaaccagtatccaaacacgtcgttggtacagatcgagggagtgaacacgcaagaggaggtggggtggtaccttgggaaacgaatggcgtacgtttacaaggctaaggttaagaagaacggatctcactaccgttgcatttgggggaaagtcacgcgccctcacggcaacagtggtgtcgttcgcgccaagttcaagtctaatcttcctcccaaatccatgggtgctagagtgagggtcttcatgtacccgagcaacatttgagtggatgggctcgtgtagacttagctggagcactgcatgaaatcgagccatcaaagaccatcattggtttgatcatttgattttttcctttggatatgattttgagaaagcattttgcctatattattcagacttaacttagtttttttccagtagtattgttggtttcaaatctttaagtggcatttagtagtacttgtcttgtttgcatgattttggcttttttttatttaatgatatgttaaaagcaag

SEQ ID NO: 2571 - DNA, 809 bp, Orobanche aegyptiaca
tcatttcgactctctcagcccgccgaagttccgaaacagcagcagcaatggtgaagggacgacaaggcgaacgcgtcaggctctacgtccgtggaacggtcctcggatacaaaaggtcgaagtcgaaccagtatccaaacacgtcgttggtacagatcgagggagtgaacacgcaagaggaggtggggtggtaccttgggaaacgaatggcgtacgtttacaaggctaaggttaagaagaacggatctcactaccgttgcatttgggggaaagtcacgcgccctcacggcaacagtggtgtcgttcgcgccaagttcaagtctaatcttcctcctaaatccatgggagccagagtcagggtgttcatgtaccctagcaacatttaagtggattgaggagtataacttgaagatgggcgagctgttacggtttgaaatatctttgagtttaaacatttgtattgttaaatcagattatatcgtcattcgctttgagcttcactttgtactaagggatgaagattttgagcttcactttgttctgatttggatctgttttcattggtcttattgttgtttccgctttttgtttccaacttcgcataacaagatggttcttggatgcctaaattttaatcagtcgttgcgatgggactttataggttgcttataagaactataatgagtacgagttattatctataataattgtaaagcacattttgaaacttgggtaactttgaggaaaatacaatggctaatcttaatgtttccttcccttttttttctctatattttcgagggtgttcc

SEQ ID NO: 2572 - DNA, 573 bp, Carica papaya
gtttcctcccgagtaggcgtctgtaactagaggaagaagaagatcttcagccaccaaagcggaaatggtgaagggacgccaaggagagcgagtcagactctacgtcagaggaaccatcctcgggtacaagaggtcaaagtcaaatcagtaccccaacacttcacttatccagattgagggagtcaattccaaggaggaggttgcttggtatgcggggaagcgcatggcttacatctacaaggctaaggtgaagaagaatggaacacattaccgctgcatttggggcaaggtcgcaaggcctcatggtaacagcggggttgttcgtgccaagttcaaatcaaacttgcctcctaaatcaatgggagatagagtaagggtattcatgtacccaagcaacatatgaggtactaaagtagatgctgtacttcagaagggatctgcagtcttacttgtttctataaacttagtttttaaatattgtgtgctttggccgagtcatttttttgcttgtttaggatattggtcgactcttatcaactaatttgattaaaagcattttcatgcctgcttggt

SEQ ID NO: 2573 - DNA, 646 bp, Plantago ovata
tttctctcactcgctcagtcgtcgtctccgcctctctagctaatcgcagacagccgaagcagcagcaccatggtgaagggcagacaaggagaacgcgtcaggttgtacgtccgtggaacaatcctcggctacaagagatcgaagtcgaatcagtatccgaacacatctttggttcagattgagggagtcaacacacagaaggaggttgactggtaccgagggaagagattggcgtacatttacaaggcgaaggtgaagaagaacggatctcactaccggtgcatttggggaaaggtgtctcgtccccatggaaacagtggcgttgtccgcgccaagttcacttctaaccttcctcccaagtctatgggagctagggttagggtgttcatgtatcccagcaacatttgagttgattgggcggagcatcgttgaagccatgtgatgaagcagatcgagatcaagtctttttcgagtttagaaagtattttgactatccatcatttgggttttgcgaattctttttgttttccttgttcgcttttaagttagaagactccaatggattatgatgacatgttcttcagcttgtgtttactttttaatttataatcatatacttaaaagtccatgcattaaacgtttctcg

SEQ ID NO: 2574 - DNA, 715 bp, Plantago ovata
cagaccgccaaactcttttgttccgaccgagggactggcacttgcctgaggctcacatcttcatcgacggaggacccgccacacccagagcaagcatcaacatcaacaatggtgaagggtcgccaaggagaacgcgtcagactttacgtccgcgggacaatcctggggtacaaaaggtcgaaatcgaaccagtacccgaacacatcgttggtacagatcgagggagtgaacacgcagaaggaagttgattggtaccgtgggaagaaaatggcttacatctacaaggctaaggtgaagaagaatggatctcactaccgttgcatttggggaaaggtttctcgtccccatggtaacagtggtgttgttcgtgctaagttcacatctaatcttccacctaaatccatgggagctagagtcagggtgttcatgtatcccagcaacatttgagtgtattgcgtggagcatgtgagcaatctggtggatcaggaaaatattagtcaattgtcttagaaactcttgtatcttaatagccgttttgtcttatgatcaaattatgagctcaaggttttgttatggctttccaagtttatcttggggctgtatacttttggacatctttgcagtgcttgtctatcttttaatagctatctctctctaactccttgttatcttggattcttggggtctctaacggtgcatttgctaattataagac

SEQ ID NO: 2575 - DNA, 673 bp, Plantago ovata
agggaatccgaattgtgacctctcagagattagggtttattggtatctttcaatcgggaacatctggaagctcatttgcagcaacaatggtgaaaggacgtcaaggagaacgcgtcagactctatgtccgtggaacaatcctaggctacaaaaggtcgaaatcgaaccagtatccaaacacgtcactggtacagattgagggagtgaatacgcagaaggaagtggattggtatcgtggaaagcgattggcttacatttacaaggccaaggtgaagaagaacggttcacactatcgttgcatttgggggaaagtcagccgtccccatggtaacagtggcgtcgttcgtgctaagttcacctctaatcttccaccaaaatccatgggagctagagtcagggtgttcatgtatcccagcaacatttgaggtttggcgaagcaccttgagtccgagttctaggaaatcatagtctattgtaacgagtcgaagaacaaatttttgttgaaattaggcaatgtgcttctggtacttacacagatttaagaacccttgtcgtttatcgcatgcatggctgattatatgagtttgctcacttcttcgtgttcattcaattgatattgtgtgttcatgcatttatattctcggttatgtctgttatgccattatcttgccgg

SEQ ID NO: 2576 - DNA, 794 bp, Platanus occidentalis
caccctcgcagacgtctcggtgaaggatattctaacgaaaatggtgaaggggcgccagggagagcgagtcagactctatgtgagaggaacgattcttggctacaagaggtcgaaatcgaatcagtacccaaacacatcgttgatccagatcgagggtgtgaacacaaaagaggaggttgcatggtactgcggcaagcgtatggcctacatttataaggccaagatcaagaagaatggatcgcactaccgatgcatttggggaaaggtcacgaggccgcacggaaacagtggagtcgtacgagccaagttcaagtccaacttgccccccaaatccatgggttctagggttagagttttcatgtacccgagcaatatatgagtgactcggtatgcttagatgccaagctgaagagagttaaaacttttaaagggtttgttcttctacatttgagctgacgtttgaaggttttgtattcagaagttacactaggtagttgttttggtactgtttttgtttgttcagaacgggggatacaggagttatattaagcttgtgtctattttttgacgtgggattcttcactagtcttggtggaattaattaatcacagtaactaagttccatagatataagttgatttagtttgacattagttttggtgtttatgatttgaataaattggatttcacacattttttttcctgtaatagttaattttttttatgcgtcttgtagattactatttcagcttgtttttgtttttcaatccttgatctagatacaagaggattga

SEQ ID NO: 2577 - DNA, 648 bp, Platanus occidentalis
gccgcttgtgagagaaccagttagcgaaaatggtgaaggggcgccaaggagagcgagtcaggctctatgtaagaggaacgattctcggatacaagaggtcgaaatcgaatcagtacccaaacacttcgttgatccagatcgagggcgtgaacacaaaggaggaagtcgcttggtactgcggtaagcgtatggcatacatttacaaggccaaggtaaagaagaatgggtcgcactatagatgcatttggggaaaggttgccaggcctcacggaaacagcggagtcgttcgagccaagttcaagtctaacttgccccccaaatccatgggttctagggttagggttttcatgtaccccagcaatatatgagttcattggtacgtgtaaatgccaagctgaggattactagagaatcagcagagcaaatgggttcaaccttctgttattgagttaaaatttgaaaggttttttgtattggagagctacattagttgtcttggcactgtttttgttggtttagaatgaagaatggaacatttatgatcatgcttggatctagtttttgacgttggaatcttcactattttctttaccataatgttgcatgggtgttttaaactgatgaaatttgtgtagtaattaagtttga

SEQ ID NO: 2578 - DNA, 757 bp, Populus trichocarpa
ttacgtttccatctcgcagcttcatagtataagccacttttagcgagagaggaagagagagctcttagcctcagagtttgaaaatggtgaagggacgccaaggagagcgagtcaggctttatgtcagaggaacaatcttgggctataagaggtcgaagtccaaccaatacccaaacacatctctgatccagattgagggagtcaacaccaaggaagaagttgcatggtatgctggtaagcgcatggcatacatatacaaggccaaggtgaagagggatgggacccactatcgctgcatttggggcaaggtcacaaggcctcatggaaacagtggtgttgtcagagctaagttcaagtccaacttgcctccaaagtccatgggatgtcgtgtaagagttttcatgtatcccagcaacatttgagttcctcaggctctttacaggtagcagcgtgggtccatttgatgtcttgtagggattgtcgttttactttttataagctaagtttaaatatcgtatgagctgagaatgatggacggactttgtttctaatttcagtatccgttttccaccattctgtcgttgatgtgaatggttttgcgatcaccttttccttgatttaaacattaagatctttggtatgatgaacaaggtgtggcacattgattcgcgcaataattcttatactgtaaccgaatgtgatagggccagagggtcaattcattatatagacaaaagcataaacacgttttgcaagg

SEQ ID NO: 2579 - DNA, 1419 bp, Populus trichocarpa
gaaacagcagcaattagggttttacgtttccatctcgcagcttcatagtataagccacttttagcgagagaggaagagagagctcttagcctcagagtttgaaaatggtgaagggacgccaaggagagcgagtcaggctttatgtcagaggaacaatcttgggctataagaggtcgaagtccaaccaatacccaaacacatctctgatccagattgagggagtcaacaccaaggaagaagttgcatggtatgctggtaagcgcatggcatacatatacaaggccaaggtgaagagggatgggacccactatcgctgcatttggggcaaggtcacaaggcctcatggaaacagtggtgttgtcagagctaagttcaagtccaacttgcctccaaagtccatgggatgtcgtgtaagagttttcatgtatcccagcaacatttgagttcctcaggctctttacaggtagcagcgtgggtccattcgatgtcttgtagggattgtcgttttactttttataagctaagtttaaatatcgtatgagctgagaatgatggacggactttgtttctaatttcagtatccgttttccaccattctgtctttgatgtgaatggttttgcgatcaccttttccttgatttaaacattaagatctttggtatgatgaacaagatgtggcacattgattcgcgcaataattcttatactgtaaccgaatgtgatagggccagagggtcaattcattatatagacaaaagcataaacacgttttgcaaggaaaaaaacaggaggctgggtgaattgctgtccatgttttccttgcatgttcatggaagaaaaccgtagttaagcagaaaagaacacatgattggaggtccaaattactccattttttagctacccgctgtcccacccaactggtaacaaacgcaatcaaaataaatggaaggataactggataagtttttcattatggaagtgtgaagatttccctgcatattattatacagctggaattctgaaaaattcgtgaacatgaaactttttcctttttgtcgagaagggtgaaaatcaagatagcttgttgtgtgattagagtagaatttctggggagatatgagttgcacttgacactctgcgtttttgataacttctttgtttcctaggataaacacaccttaaaaaaccttgtcacgagcttaccggcagcagtacgtctctgtggccatgctaaaggttgtaattttcccctgaggtatagctctccaacgaagtatcctgccatgccttttctttactaaaagcatcggacctgggttacctttccaattttcagttcgctgatctgctccaaataaataccttgcctctattttagtaaggaatcaacaaatcagtagaagattgattcaaaagttc

SEQ ID NO: 2580 - DNA, 749 bp, Populus trichocarpa
agcggcagcagtagctagggtttaaggtacccgtctcggtgtcagccattctttttcgcgagagagcttggactcgcgggattgaaaatggtgaagggacgtcaaggagagcgagtcaggctttatgttcggggaacaatcttgggttataagaggtcgaagtccaaccaatatccaaacacatcactggtccaagttgagggagtcaacaccaaggaagaggttgcatggtatgctgggaagcgtatggcatacatctacaaggccaaggtgaagaagaatggatcccactatcgctgcatctggggcaaggtcaccaggcctcatggtaacagcggtgtagtgagagccaagttcaaatcaaatctgcctccaaagtcaatgggagctcgagtgcgggttttcatgtatcccagcaatatctgaggtacagtttgctttatatagtcattactggtgggtagtttaggtttagcttctcatgcctctgagtgctttctttatcgaggactgtttatggctgtagtgagaactctttctcttgtccggatcttgtgatttttaattgaattttggctcttaagatttgcgttgctttatggatggaaagtgaaggcaattgactattatatcaaagcactcttcatgctttttctgttctgctgctgggttacctcgggaattttatgaatgttgtattgcttaatcatccatcaccttcgtgcagtattttaatctgtattttttaa

SEQ ID NO: 2581 - DNA, 851 bp, Populus trichocarpa
aagcagcggcagcggcagcagtagctagggtttaaggtacccgtctcggtgtcagccattcttttttgcgagagagcttggactcgcgggattgaaaatggtgaagggacgtcaaggagagcgagtcaggctttatgttcggggaacaatcttgggttataagaggtcgaagtccaaccaatatccaaacacatcactggtccaagttgagggagtcaacaccaaggaagaggttgcatggtatgctgggaagcgtatggcatacatctacaaggccaaggtgaagaagaatggatcccactatcgctgcatctggggcaaggtcaccaggcctcatggtaacagcggtgtagtgagagccaagttcaaatccaatctgcctccaaagtcaatgggagctcgagtgcgggttttcatgtatcccagcaatatctgaggtacagtttgctttatatagtcattactggtgggtagtttaggtttagcttctcatgcctctgagtgctttctttatcgaggactgtttatggctgtagtgagaactctttctcttgtccggatcttgtgatttttaattgaattttggctcttaagatttgcgttgctttatggatggaaagtgaaggcaattgactattatatcaaagcactcttcatgctttttctgttctgctgctgggttacctcgggaattttatgaatgttgtattgcttaatcatccatcaccttcgtgcagtattttaatctgtattttttaaataatcgctttgttctttttatcttttctgcttccactggttcagctatagagctatgatcagcgtggatctattttttgacctgtgatgcg

SEQ ID NO: 2582 - DNA, 683 bp, Papaver somniferum
taaatcgattaacctaggtttttcttctctctcttcactgcctccatatctcctccgtcttagtagttgcagaggaaaggggattttcttcattttcagcaaaaaatggtgaaaggtcgtgaaggtgaacgtgtcagactctacgttagaggaaccattcttggatacaagaggtcaaagtcgaaccagtacccaaacacatcattggttcagattgaaggagtgaacaccaaagaggaagtacaatggtatgctggtaagagggtggcttacatctacaaggctaaggtcaagactaatggttctcactaccgatgcatttggggaaaagttatcaggcctcatggtaacagtggtgttgttcgtgctaaattcacctccaacttgccacctaaatccatgggaatgagagttagagtgttcatgtacccaagcaacatctaaggctaaggattgctttttgtggtggtgaagttataagcattatgatatctagatcctctctttggtacttggtttcagttttcttatttagagctctctctttttttgtagttgataaacaaattgggaattactgtaagttaagggcaaattttgtgctggtgctttcagataatctttaattgttacattttattggtagtgcaacaaaagattggtactgcgagctgttttgctta

SEQ ID NO: 2583 - DNA, 626 bp, Solanum tuberosum
tttctttagtttgcagcttcaaagttgaaaatggtgaagggacgccaaggagagcgtgtgagactttataccagaggaacggttctcggatacaagaggtcgaagtcgaatcagtatccgaatacttcattggttcagatcgagggagtgaacactaaggaggaagtagattggtacttagggaaacgtatggcttatgtatacaaggcgaaaacaaagaagaataactcacattatcgctgcatttggggaaaagtttgcaggcctcatggaaacagtggtgttgttagagctaagttcaagtccaatttgccaccaaagtccatgggagccaaggttagagttttcatgtacccaagcaacatataagcaaggtaccaagttgatgcatgcttggacgccctacatttgtctatcattagttatgaaggatttgaatctttaatagtagttggacataacttgttttgggctatgtggagttacatttttagtctctatttgtactgggaaacaccaatgagtgaaacatctgattagatgtcgtctaattttgttcttggagtttctacatacaatcatttagttctctttgctcttcaatcttgatatgtccagcaagtttc

SEQ ID NO: 2584 - DNA, 644 bp, Rosa hybrid cultivar
gtcttcgtttagggtttccgtctcacacccagtagcctccagagccgccgctgcttcattcgttcgaaaatggtgaagggtcgtcaaggagagcgcgtcagactctacgtccgtggaaccgtcctcggatacaagaggtcgaagtcgaaccagtacccaaacacttccttgattcagatcgagaacgtgaacaccaaggaggaggtggcatggtacgccgggaagcgtttggcttacatttacaaggccaaggtaaagaagaacggcagccactaccgttgcatttggggaaaggtctctaggcctcatggaaacactggtgtcgttcgcgccaagttcacctccaatcttccacccaaatccatgggatccagagtcagggttttcatgtatcccagcaacatttgagggatgaggctaatgtagatgatcgattggatttggagtgcagcagctgcttttttgcttttatgtcgtttagattcaaactttgaaagacttaatgtactgaggaacctgagttatttatctaaacgtttgttgctagacttattgttgtgttcaaattattttcattgctttttgcattttaaccatatgaatagatcacaaagtgatgtcactttgttgatgagaatgaccgg

SEQ ID NO: 2585 - DNA, 524 bp, Scabiosa columbaria
ttttagctttcttcttcaccgcaggcgttttcattcatcactttcaactccgcaaaaatggttaagggacgccaaggagagcgagtcagactctatgttagaggaacaatcctcggctacaagaggtctaagtcgaatcagtatccaaacacttcgttggttcaaatcgaaggagtgaacactaaggaagaggttacatggtaccaagggaagcgtatggcgtacatctacaaggctaaagtgaagaagaatggctctcactatcgctgcatttggggaaaggtgtcaaggccacatggtaacactggcatcgttagagctaagttcaagtccaatcttccccctaaatccatgggagctagggttagagtaatgatgtaccccagcaatatataaaatgagtttcttctcaaaggaagtgaaaaaggaaggcgtatgtttctgaagaacctcttttttttctacgactttattgtcattagaaacttgcaaatgttgatgtattttgattaaccatttgggct

SEQ ID NO: 2586 - DNA, 527 bp, Scabiosa columbaria
gtttttagctttcttcttcaccgcaggcgttttcattcatcactttgaactccgcaaaaatggttaagggacgccaaggagagcgagtcagactctatgttagaggaacaatcctcggctacaagaggtccaagtcgaatcagtatccaaacacttcgttggttcagatcgaaggagtgaacaccaaggaagaggttacatggtaccaagggaagcgtatggcgtacatctacaaggctaaagtgaagaagaatggctctcactatcgctgcatttggggaaaggtgtcaaggcctcatggtaacactggcatcgttagagctaagttcaagtccaatcttccccctaaatccatgggagctagggttagagtaatgatgtaccccagcaatatataaaatgagtttcttctcaaaggaagtgaaaaaggaaggtgtatgtttctgaagaatcttcttttttttcttacgactttattgtcattagaaacttgcaaatgttgatgtattttgattaaccatttgggc

SEQ ID NO: 2587 - DNA, 529 bp, Scabiosa columbaria
ggttttagctttcttcttcaccgcaggcgttttcatccagcactttgaactccgcaaaaatggttaagggacgccaaggagagcgagtcagactctatgttagaggaacaatcctcggctacaagaggtctaagtcgaatcagtatccaaacacttcgttggttcagatcgaaggagtgaacaccaaggaagaggttacatggtaccaagggaagcgtatggcttacatctacaaggctaaagtgaagaagaatggctctcactatcgctgcatttggggaaaggtttcaaggcctcatggtaatactggcatcgttagagctaagtttaagtccaatcttcctcctaaatccatgggagctagggttagagtaatgatgtaccccagcaatatataaaatgagtttcttctcaaaggaagtgaaaaaggaaggcgtatgtttctgaagaacctctttcttttcttacgattttattgtcattagaaacttgcaaatgttgatgtattttgattaaccatttgggctag

SEQ ID NO: 2588 - DNA, 742 bp, Sesamum indicum
gtttttccaagtcttctttgttcctgattctcagctcgccgaagctttcatacagcgacaatggtgaaagggcgccaaggcgaacgtgtcagactctacgtccgtggaacaatccttggatacaaaaggtcgaagtcgaatcagtatccaaacacgtcgttgatacagatagaaggagtgaacactcaagaggaagtggcatggtaccgcggcaagcgaatggcgtacatttacaaggccaaggttaagaagaacggctctcactaccgttgcatctggggtaaagttacacgtccccacggtaacagcggcgttgttcgtgccaagttcaagtctaatctcccccccaaatccatgggtgctagagtaagggtgttcatgtacccaagcaacatttgagtgattgggctcttgttgatcaggtttgggagcgttaagtgaaagccgaatcttcaagatttaaaactatagttttgagtttaggaattattcttattattagccaattttcctcttccttttcttttgaatctgaatatgagaaacaatctagttgaggtaacggactgtactgaggctccacaatgttgccattttacctcactgaatagggtttgaaaggttggacattgttgcgttgtgtgttgttgatctcttgtatctgccactattacttcccttggacaatatttcctggcacaattgacctgatgatatttacatatttgtcctgcatttggtg

SEQ ID NO: 2589 - DNA, 698 bp, Solanum phureja
agggttttaggcttctccattagaagggattttctttagtttgcagcttcaaagttgaaaatggtgaagggacgccaaggagagcgtgtgagactctataccagaggaacagttctcggatacaagaggtcgaagtcgaatcagtatccgaatacttcattggttcagatcgagggagtgaacactaaggaggaagtagattggtacttggggaaacgtatggcttatgtatacaaggcaaaaacaaagaagaataactcacattatcgctgtatttggggaaaagtttgcaggcctcatggaaacagtggtgttgttagagctaagttcaagtccaatttgccaccaaagtccatgggagctaaggttagagttttcatgtacccaagcaacatataagcaaggtaccaagttgatgcatgcttggacgccctacatttgtctatcattagttatgaaggatttgaatctttaatagtagttggacataacttgttttgggctatgtggagttacatttttagtctctatttgtactgggaaacaccaatgagtgaaacatctgattagatgtcgtctaattttgttcttggagtttctacatacaatcatttagttctctttgctcttcaatcttgatatgtccagcaagtttcttaatttgcctttttgcaagggaatggtttcctcggtttaat

SEQ ID NO: 2590 - DNA, 813 bp, Fragaria vesca
cggctcttgccatatataactttcaacccctctcctccactagtcttcgtattagggtttccgcctcacaccagcactagcctccagagccgccgcagcttcattcgtccgaaaatggtgaagggtcgtcaaggagagcgcgtcagactctacgtccgtggcaccgtcctcggatacaagaggtcgaagtcgaaccagtacccaaacacgtccttgattcagatcgagaacgtcaacaccaaggaggaggtggcctggtacgccgggaagcgtctggcttacatttacaaggctaaggtaaagaagaacggcagccactaccgttgcatttggggaaaggtctctaggcctcatggtaacactggtgtcgttcgcgccaagttcacctccaatcttccacccaagtccatgggatgcagagtcagggttttcatgtatcccagcaacatctgagggatgaggttaatgtagatgaccgacttgatttggagtgcagcagctgcttttttgcttttatgtcgtctagattcaaactttcaaaactatgtactgaggaacctgagttatttatctaaacgtttgttgctagacttattgtgttgttcaaatccttttcttgaagttttgcatttgaccataatcgtttgcataatcaatctgaatgaatcataaagcaaatgatgtttggttttacaatggtgttcttgatgaggtagtagtatcattcatgtcaaaaatacccatcattttcgtcagttgtagcatatatgtttacatggtatggttggttatcggtattgtctgaaaagattc

SEQ ID NO: 2591 - DNA, 631 bp, Helianthus annuus
atcttcttcatcagcagcaccggcggtcggtaagtatctgctcaaccaaaatggtgaagggtcgtcaaggagaacgcgtcagactctacaccagaggaacgattctcggttacaaaaggtcaaagtcaaaccagtatccaaacacatcattgattcaaatcgaaggagtgaacacgaaggaggaggtatgctggtaccaagggaaacgtatggcgtacgtatacaaagctaaggtgaagaagaatggatcacattatcggtgcatttgggggaaagttactagacctcatggtaacactggtgttgttcgtgctaagttcaagtctaatcttcctcccaaatctatggggtctagggttagagtgttcatgtacccaagcaacatttaagctgtagggaagaagagtatggtgattgttgctgctggcactttaattgtttttgtattagttgtgttgaccatttggtatgaaagatttttgttttttacatggaacgttactagttctttaaaatactttgtactctatctgaaagaatgcaagaccgccctttttcttgatttttgtcctataacgttatgtgttatggtcaatgtgaaatgtgaaaaaagcttgccatattttcccaa

SEQ ID NO: 2592 - DNA, 569 bp, Helianthus annuus
agggtttattgcatcttcttcttcatcagcagcaccggcggtcggtaagtatctgctcaaccaaaatggtgaagggtcgtcaaggagaacgcgtcagactctacaccagaggaacgattctcggttacaaaaggtcaaagtcaaaccagtatccaaacacatcattgatccaaatcgaaggagtgaacacgaaggaggaggtatgctggtaccaagggaaacgtatggcgtacgtatacaaagctaaggtgaagaagaatggatcacattatcggtgcatttgggggaaagttaccagacctcatggtaacactggtgttgttcgtgctaagttcaagtctaatcttcctcccaaatctatggggtctagggttagagtgttcatgtacccaagcaacatttaagggaagaagagtatggtgattgttgctgccggtactttaattgttcttgtattagttgtgttgatcatttggtatgaaagatttttgttttttacatggaacattactagttctttaaaatactttgtactccatctgaaagaatgcaagaccaccctttttctt

SEQ ID NO: 2593 - DNA, 648 bp, Helianthus annuus
atctagggtttattgcatcttcttcttcatcagcagcaccggcggtcggtaagtatctgctcaaccaaaatggtgaagggtcgtcaaggagaacgcgtcagactctacaccagaggaacgattctcggttacaaaaggtcaaagtcaaaccagtatccaaacacatcattgatccaaatcgaaggagtgaacaccaaggaggaggtatgctggtaccaagggaaacgtatggcgtacgtatacaaagctaaggtgaagaagaatggatcacattatcggtgcatttgggggaaagttaccagacctcatggtaacactggtgttgttcgtgctaagttcaagtctaatcttcctcccaaatctatggggtctagggttagagtgttcatgtacccaagcaacatttaagggaagaagagtatggtgattgttgctgccggcacttttattgtttttgtattagctgtgttgaccatttggtatgaaagatttttgttttttacatggaacattactagttctttaaaatactttgtactctatctgaaagaatgcaattccacccattttcttgaatgatggtactaaggagtgtaatatgatattgtcatttgctcttcaagtagtgtgtgtcatagtccaaaaaaa

SEQ ID NO: 2594 - DNA, 575 bp, Helianthus annuus
gatctagggtttattgcatcttcttcttcatcagcagcaccggcggtcggtaggtatctgctcaaccaaaatggtgaagggtcgtcaaggagaacgcgtcagactctacaccagaggaacgattctcggttacaaaaggtcaaagtcaaaccagtatccaaacacgtcattgatccaaatcgaaggagtgaacacgaaggaggaggtatgctggtaccaagggaaacgtatggcgtacgtatacaaagctaaggtgaagaagaatggatcacattatcggtgcatttgggggaaagttaccagacctcatggtaacactggtgttgttcgtgctaagttcaagtctaatcttcctcccaaatctatggggtctagggttagagtgttcatgtacccaagcaacatttaagctgtagggaggaagagtatggtgattgttgttgccggtactttaattgttcttgtattagttgtgttgatcatttggtatgaaagatttttgctttttacatggaacattactagttctcttaaatactttgtactctatctgaaagaatgcaagaccacccttt

SEQ ID NO: 2595 - DNA, 743 bp, Tamarix hispida
  misc_feature (511)..(511): n is a, c, g, or t
  misc_feature (570)..(570): n is a, c, g, or t
caggaattcggcacgaggcctcgtgccgaattcggcacgaggcatccacagagctccagcattccgcaacaatggtgaagggccgccaaggagaacgcgtcagactgtacgtaaggggctccattttggggtacaagaggtctaaatcgaaccagtacccgaacacttcattggttcagatcgaaggagtgaataccaaggaagaagtagcatggtaccaagggaaaaagatggcttatatctacaaggccaagattaagaagaacggctctcactacaggtgcatttggggcaaggttattcgtcctcatggtaacaccggtattgttcgtgcgaagtttaagtccaacctgcctcctaaatccatgggtgctaaagttagggtttttatgtacccaagcaacatttaagttatccatgtagattcagttttcagtcagtttagttgagaaagagacggttatcttcatctggagtttatttcatttttcaaaatttctgtattccgacntttatcggcccactatttggcactttagttttgtgtgtagaagacttctcttacatctnaaatggtttattttcccatctataagccgagtttcgtctcttttgctattccttgataaccaatggctggtaccatcatgtgaaagacattcttcgattgtctgaagtctgaactaggcagccgtacccgtactatctccgtcaacgtctatgtaatagatcaatgataagca

SEQ ID NO: 2596 - DNA, 618 bp, Eutrema parvulum
atgaatccatatattgtttgacctaatatcgaaagctagggttcttctctgtgattcgctcgccggcataaaagaggcaaagaggaagaagacacagtatcagtattcaaaatgaagggacgtcaaggagagagagttagattgtatgttcgaggaactgtcctcggttacaagaggtcgaagtcgaaccaataccccaacaattccctcgtccagattgaaggtgtgaacacaacagaggaggttgcttggtacaagggaaagcgtatggcttacatctacaaggcgaagacaaagaagaacggttctcactaccgttgcatctggggcaaagtcactaggcctcatggtaacagcggtgttgtccgtgccaagttcacttcaaacctaccaccaaagtcaatgggagctagagtcagagtgttcatgtacccaagcaacatatgaggtaggtgggtctcatttgaggaagctccattaccatttctcagaagctatagtttatcctttattcactttttgtcctagactctctgtcggttttgttcatctctagacgaagtaacattatttttcgttggataatatattttgatggaattccagaaaagaaaatat

SEQ ID NO: 2597 - DNA, 1095 bp, Nicotiana tabacum
  misc_feature (1092)..(1092): n is a, c, g, or t
ggtctagggtttaggtttctatatcacaggcatttccgcagctccaatccccttgattcgaaaatggtgaagggacgccaaggagaacgtgtcaggctatacgtcaggggaactgttcttggatacaaaaggtcgaaatcgaaccagtatccaagtacttcactgattcagattgagggagtgaacactaaggaagaggtggactggtacctcgggaagcgaatggcctacgtttacaaggcaaagacaaagaagaataactcacactatcgctgcatttggggtaaagtttgtaggccccatggaaacagtggcgttgttagagctaagttcaagtccaatttgcctcctaagtccatgggagctaaggttagggttttcatgtacccaagcaacatttaagtggggtgcttagatgtcatggatgtggattgaagtcattggttgctttgggggaggcattagtgtctcatatcaaggttttaaatgatgtagaatcttcatctttaaaagtagttagttaaactgtaatgtgctttgtggagttatttatatttgtttttataatttccgggtaataccagggattaaacatctgattagatgtggctaattttgctcatggaacctttttctgtacgactattcagctgtgtctttgctttaattatttttttcaccttctaccaacaaaaaaaaaaaaaaaaaaaaaaaaaaaacatgtcctcgaggttgcagagacagagatcttgacaacggtaagaaaggcccgtttcaggtgctgcatcagtcaacctatgactacagattgatatggaaagaggaaatagtaggcagtaagagcaagagtaaagaatttgggaaggcaaaacaaaactgataccaacgttttgccatttgtatctactgaggcataatttcgtcattcagatagaaaaaatggagaaagttatgataaaaactgtctgtttgttgtatcttcttttcgttttccttttctccttggattgaagattctgattagtgataatagaagtatgtgtaattatacatgtccttttgtggctatatttagatcctactttttatttnacc

SEQ ID NO: 2598 - DNA, 557 bp, Tripterygium wilfordii
accaggtgcaggagctacaaaccaaatcccataatggtgaagggtcgtcaaggagagcgcgtgagattgtatgttcgaggaaccgtacttggttacaaaaggtcaaagtcgaaccagtacccaaacacgtcgctgatacagatcgagggcgtgaacaccaaggaggaggttgcgtggtactgtgggaagcgcatggcctacatatacaaggccaatgtgaagaagaatggcacccattatcgctgtatttggggcaaagtatctagacctcacggtaacagtggcgtcgttcgtgctaagttcaagtctaatcttccacccaaatccatgggatctagggttagggttttcatgtatccgagcaacatatgaggttgtggggtttttagagctgtcaagatttggggatttacacaatcttttgagtttttgctattgctgtctattaagggctaagttttaagattttgaacttcattattgtaatagcaacagtttgtctttgttccatttgattataatggattgtagttgttctgagaatgcctacaatcagt

SEQ ID NO: 2599 - DNA, 581 bp, Valeriana officinalis
tgaattgagcgaaaatggtgaaaggccgccaaggagaacgagtcagactctatgtgaggggaacaattctaggttacaaaaggtcaaaatcaaaccagtacccaaacacatctctggttcagattgaaggagtgaacaccaaggaagatgtcacatggtaccaaggaaagcgaatggcttatatttacaaggctaaggtgaagaagaacggctcgcattatcgttgcatttgggggaaaattgctaggcctcatggtaacagtggtgttgttcgtgccaagttcaaatccaaccttcctcccaaatccatgggatctagggttagagttttcatgtatccaagcaacatatgagtgttgaatcaaaatgaaggtcatgctggatgaagagtgtagtggattttcctgatctatatggtagttgtttttgtttttgtcaaggatagaacaatgttgctactacaatgagtgttttgaattaaaaaaattcttttcaatttgtgttagatgttagtattcctgctgctacttgttacttttcttctactgattgatcaaatattgtttgtcatggagtttaaa

SEQ ID NO: 2600 - DNA, 895 bp, Citrullus lanatus
atttcgaaagaaaatactgaaaataacaagaataacctaacagcagaaaccctagaaggagtgctttatatcattttgccctcaaatccccattataaaagcttcctcttcttcaagcggccactttcttctttgaaccgcagctccatcctccttacttcaacctgctaatctaaggtgattattcctctaagatttcctttcctttttcctttctccatatcgtttgcacttgattaccgatcttagttcttagtttctttgtttgaaggagtcgtttttcagaaccctagactgcggcagccatggtgaagggaaggcagggagaaagagtcagactctacgtcagaggaacggtccttgggtacaagaggtcgaagtcaaaccaatatccaagaacatccctgatccaaattgaaggggtgaacactagggaagaggtggcatggtatgctggaaagcgcttggcgtacatttacaaggccaaagtgaagcaaaatggaactcactaccgatgcatttggggcaaggtttccaggcctcatggtaacagtggcattgttcgagctaagttcaagtcgaacttgcccccaaaatccatgggtgataaaattagggtatttatgtaccccagcaatatatgagttactctgtcatcagctagctagaggtcaggtttcatttctttgttgacttgggtggatcgatatttttgtttcttttcttcctactggacccagtgcttagggtgtgatgttttcgtgtaaaactttaactaaatttggaacgttcattgtggaatatttttactttcaattttgaccgtgtttcatttcttatcaaggcttctgtggcaagacatgctgagtattaatggtcacttcgcttgcattta

SEQ ID NO: 2601 - DNA, 303 bp, Cannabis sativa
attctgtggtgaattaggtccaagtcaaaccagtatccaaacacttctttggtccagattgagggagtaaacacaaaggaggatgtttcatggtactgtgggaagcgcatggcgtacatctacaaggctaaggtgaagaaggacggttcccactatcggtgcatttggggcaaggttatcaggcctcacggtaacagtggtgttgttcgtgctaagttcacttctaacctgcctcccaaatctatgggtgctagagttagagtgttcatgtaccccagcaatatataaggtaactttttaatt

SEQ ID NO: 2602 - DNA, 648 bp, Amborella trichopoda
ggggagggtttgtagttcactccccttcgtctgcaacttttggcgaaaatggtgaaggctcagggggagcgcgtaagattatatgtgagggggactatccttggatacaagaggtccaaaaaaatcagtatgagaatacttccttggtccagattgagggggttaacactaaggaggaggtagcctggtaccttgggaagcgtatggcctatatttacaaggctaaggtgaagaagaatggctcccactataggtgcatttggggaaaggtcaacaggccccatggtaacagtggtgtagttcgagccaagttcaagtcgaacttgccacctaggtctatgggagcgaaggtcagggttttcatgtacccaagcaggatttgagtgcaaggattcttttcgaggctcgatctccagagtaccagtttgggaagttagaatgttttttccagattgcttttttttttcttttaactagtgttggtactaggtgacatgactctcgattattcgcacactttcctttccccatctgcactatataaatggaacatacatgatgctttggggtattgattggattagtatggatgtttttcaatgtttatttgttcataggttgcaaattaaagtcctatgctactggaaa

SEQ ID NO: 2603 - DNA, 1157 bp, Chelidonium majus
gaataggtggtgggttcggtaaaggtggttccgttttagggttttaaagtctaggagatttatcatcccagaaggccgtctctcgacccccgtggtaaccctaaggaacaaacaaaaatggtgaagggtagagcaggtgaaagagtcagactctatgtacgaggaactgttcttggttacaagaggtcgaaatccaaccagtacccaaacacctcattgatccagatcgaaggagttaacacaaaggaggatgttgcttactactgtggtaagagaatggcttacatttacaaggctaaggtgaagaaggatgggtctcactacagatgcatttggggaaaagtttcaaggccccatggtaacagcggtgtcgtaagagccaagtttacaagcaaccttcctcccaaatccatgggtgctagggttagggtgtttatgtatccaagcaacatatgattctgagaggtaggttgaaagatcactccagttggttaagttccatgggcagttgcagattctttagaggctatctatgcgtttgttttgcgatgttcttttcttttttgtcttttttactatatggaatattatcaggagctttcgcctgatggttccaactctccagtgtcctcaaattcaagctggaaagttggtggtagacttcggtcaacagcacattctacggaaacagataatgctggaacggttgttattaaggactttgtctccagagcggttgtatcacaatttagagctcatacaagtccaatttctgcactatgttttgaccctagtgggacccttttggttacagcctctgtatatgggaacagtataaatatcttccgcattatgccttcctgcttacaaaatgaatccggcactccaagctatgactggagtaattctcatgtgcatctttataagttgtatcgtggaataactacagctgttattcaagatatccgttttagtcattttagtcagtggatagctatcatttcatccagggggacttgccatatttacgttctttcccctttcggtggtgaggctggtcttcaaacacgtagttcggttggtgatggacccaccctcataccatgtttaacttcaccttggtggtctacttcgtcttgcacaaatcagcagtcttc

SEQ ID NO: 2604 - DNA, 531 bp, Fraxinus spp
tcttctccggcaattacactcattcgccgttcccggaagaaacattcagaaatggtgaagggtcgccaaggagagcgcgtcaggctgtacgttagaggaacgatcctggggtacaagaggtcgaagtcgaaccagtacccaaacacgtccttgattcagatcgagggagtaaacagcaaggaggaggttgcgtggtaccatgggaaaaggatggcgtacatttacaaggctaaggttaagcaaaaatggaacccactacaggtgcatttggggtaaggtgattcgtccccacggaaactccggtgttgttcgtgctaagttcaaatccaaccttccccccaagtccatgggagcccgagttcgcgtcttcatgtaccctagcaacatttgaagtgttcttaagaagtaggggaactgagtttgagcaatggtggctattagaaggatctgttttgccttctttttactccctattttggtcatgtttgtttatcatcaaggatttttacagtcctggtcactgttttaatc

SEQ ID NO: 2605 - DNA, 700 bp, Allium cepa
tttcgtttcttcatttctcttttgttttccgccggcttaatccattcaccagtaccagaatacaataacaatggtgaaagaaagacaaggacaacgcgtcaggctttatgtacgtggcactgttctcggctacaaaaggtccaagtcaaaccagtacgagaatacatctttgatgcaaattgaaggagtgaataccaaggaagacgctcgctggtatgctggaaaaagagtagcttatgtttacaaggctaaggttaagaagaatggaactcattatagatgcatttgggggaagtgactcgtcctcatggcaacagtggtgttgttaggtctaagttcaggtccaacttacctcctaaagccatgggacgtaaagttcgagtttttatgtacccgagcaacatttgagcatctttgctaatcctggtcatggagaaaaagcttttatggacgtcgcagctgaatcttttttatatctatttgtcttagtagtttcaaattttgtttttgtgtggaacttgcgtttttactgttgggagaatgttgaaccatcttttcaattttaaattagacatggcttatttgtgccttaattgcgttttccttattgttgggttttttggctagtttgagttcatgaaaattctgaatacaaagcaattggtcattgctcaggcagtgcatccttttttcattcttt

SEQ ID NO: 2606 - DNA, 495 bp, Orobanche aegyptiaca
gccagtatcacttctcagctcgccgaagcttagaaactgcagcagcaatggtgaagggacgacaaggcgaacgcgtcaggctctacgtccggggaacggtcctcggatacaaaaggtcgaagtcgaaccagtatccaaacacgtcgttggtacagatcgagggagtgaacacgcaagaggaggtggggtggtaccttgggaagcgaatggcgtatgtttacaaggctaaggttaagaagaacggatctcactaccgttgcatttgggggaagtcacgcgcctcacggcaacagtggtgtcgttcgcgcaaagttcaagtctaatcttcctcccaaaatccatgggtgctagagtgagggtcttcatgtacccgagcaacatttgagtggatgggctcgtgtagacttagctggagaactgaatgaaatcgagccatcaaagaccatcattggtttgatcatttgattttttcctttggaaatgattttgagaaag

SEQ ID NO: 2607 - DNA, 484 bp, Tamarix hispida
  misc_feature (133)..(133): n is a, c, g, or t
gggggcttctagggttttaggtcgtcgtctttcggtgcagcagaatccccagcggcaacctccgactgcgaaaatggtgaagggtcgtcaaggagaacgcgtcaggctctacgttagaggatcaatcctcggnttacaagaggtcgaagtcaaatcaataccctaatacttctttagttcagatcgagggagtgaacaccaaggaagaagtggcgtggtatgctggcaagaagacggcatacatttacaaggctaagaccaagaagaatggttctcattaccgatgcatttggggaaaggtgacgagaccacatggtaacactgggattgtccgtgctaagttcaagtccaaccttcctcctaagtctatgggtgccaaagttagagtcttcatgtacccaagcaacatctaagatcttaacgtcaggtgcataattgggagttcaagtgtcctgaaggagtatctattcatagttgatccagt

SEQ ID NO: 2608 - DNA, 4487 bp, Solanum lycopersicum
agaattgagcttttgctgtttagcccttttttttgaaattttcatggcaacgacgtcgtttcatcatccacttctaccaaatgtgcacaatgatgatgaattggctattcatattcctagttctgcacatcaagttagtaatgattcatggtttcaggtaggagttgttttgagcactggtattaacagtgcctttgctctcggatatgctggcctaattatggttcctctaggttgggttggtggtgtggttggtttgattttatcatcagctatatcactctatgctagtactcttattgctaagctccatgaatatggaggaaggaggcatatcagatatagagaccttgcgggattcatgtatggacagacagcctattcacttgtctgggcatcccagtatgcaaatcttttcttgataaatactggatatgtcattttgggtggacaagcattaaaggctttctatgttctctttagggatgaccatcaaatgaaattgccacacttcattgcagtggctgggttggcgtgtgtcctttttgccattgctataccccatttgtcagctttaaggatttggctggggttttcaacattcttcagtctagtttatatctgtatagtgattgctttgtctcttaaagacggtcttgaggcacctcctagagactatagcattccaggaaccaaaaacagtaagacttgggcaacaattggtgctgctgctaaccttgtttttgcgtataacacaggaatgcttcccgagatacaggccactgtgagagaaccagttgtcaataacatgataaaagcccttaactttcagttcactttaggagttattccaatgcatgctgttacgtacattggatattgggcttatggatcaagtgcatcttcctatttgctgaacaatgttagtggcccaatttggttgaagggaatggctaacattgctgctttcttgcaatctatcatcgcgttgcatatatttgcgagtccgacatacgagttcttggataccaagtatggagttacaggaagtgcactggcttgtaaaaacttggccttcagaatcattgttagaggtggttatatagccattacagctttcttgtctgctcttttgccttttttgggagacttcatgaaccttgctggggctatcagtacatttccactcacatttatacttccaaatcacatgtacattgttgctaagagaaaaaagttgtcatttttaaagaagagttggcattggctcaatattattttctttagttgcatagcagttgctgcatttgtagctgcattgagattcatcacagttgactccacaacataccatgtatttgctgacttataattttattttttttcactatttgagtgataatttacccatctttttttttttggggggggggggtcatttatatgtaaatgttaaattattcagttttaatgaagtgtattcttgattattatttttttaaactctgagaaaggtgtacaaatatgtatacattgatatgtgaaatagcatttgactactattgagtattgtgatttctccttgtattgtgttttaagcatcatgacttgattccattgagtaattacagttaaattgacggtgcacaaagcattctgtatttatgcaatacaaataaaaacttactttgtaatgtgttcaaatattcaattcgaaaagacaagtaaaatttataaaggaatggttgatatattttggatttttacacaaataatctaatctattcactattcattttttctagttgttgcatgccttattatacatgataatatatgttttatacacattctctattaaaaaattattaatataagtggttcgatggacaaattcagaagtatttaattgcacgaattgtcctttaaataggttgatttttaattttgtctttataatacgaacttatacctatcacacataaaatctttaaaggcggaactcataacttgtgagatattatgatatgaaatatatcatatcccgtaaaaaagatatttctccggagcgataaaagtgcaaatgagttagattcctcttcttctcaatccggcccaaataagtcaagcccaatgaattaaaacaacttgggcctcaagcccatctcttattcgctaaatataaatttctctcttctccctcggcaattagggttttaggcttctccattaaagagattttcttcagtttgcagcttcaaagtcgaaaatggtgaagggacgccaaggagagcgtgtgagactctataccagaggaacagttctcggatacaagaggtcgaagtcgaatcagtatccgaatacttcattggttcagatcgagggagttaacactaaggaggaagtagattggtacttagggaaacgtatggcttatgtatacaaggcaaaaacaaagaagaataactcacattatcgctgtatttggggaaaagtttgtaggcctcatggaaacagtggtgttgttagagctaagttcaagtccaacttgccaccaaagtctatgggagctaaggttagagttttcatgtacccaagcaacatataagcaaggtaccaagtcgacgcatatgcttggatcccctacatttgtctatcattagttatgaaggatttgaatcttttaaagtagttggacataacttgttttgggctatgtggaattacatttctattctatttgtttaccatgtacttggaaacaccaatgagttgaaacatctgattagatgtctaattttgttcttggagtttctacatacaatcatttcgttctctttgctctttaaatcttcgatatatccagtttttaattttgccttttttgcagaatggtttcctcggtttaatgcctttctctaatatatttctttttcattgttgttttattatgatttacttaagttgagtaaatcctccttacacacaatcccccacgtgtcccatttgtatggaattaaattgtcttactttttggaagtttgaaaaaatttctttcttaggaaggtgtctcctttatctagtgtgggatgattagaccaacgaacaaatgaaaagatagaaagcttgaagagctaaggaatgtttgaaaagtttgaaggtttcccttttaccgagcgtcgaatgattagatcaacaaacaaataaaaagatagaaaggttaaagagctaacgaaaaggaataacgaacaaacaaataaaaagatagaaaggttgaagagctaacgaaaaggaataacgaatgttctacgaaagtagttgcacgtgattaagtaactagggcaagatataatctctagtgcttcaaatcagagcaacttcattatgcacaattagatgtgcataactcaattttaaaaagtaaaatgatttggacacgtgtcccttattcgttggtaaaaatccccggtgatcatgtgagcacaatggtgcttcaaataggttgagtgtgtacaaaaaatatccttcatcaacgcatgtatcaactcacattccacatataaattacgtattttgcatgcaaactaggatcactatacgactaatcgattaaatccaatgtttactttttccttaacgatatatagtatttcttttgttttaattaatcgatttaacgatatagtactttttttgtttcaatttgtttgttagggttttaaactaacaaaagacctgacttccttcttctcaatttggcccaaattagtcgaagcccaaaagattatattactgggctacaagcccattcctcattcggtaaataccagcagtctagggtttcagtattcttctccagtttacagctccagagtcgaaaatggtgaagggacgccaaggagagcgtgtaagactctacactagaggaacagtccttggatacaagaggtcgaagtcgaatcagtatccaaacacttcattggttcagatcgagggagtcaacactaaggaagaagtagattggtacttagggaagcgtatggcttatgtatacaaggcgaaaactaagaagaacaactcgcattatcgttgtatttggggtaaagtttgtaggcctcatggtaacagtggagttgttagagctaaattcaagtccaatctgccaccaaaatccatgggagctaaggttagagttttcatgtacccaagcaatatataaagcaaggtatttagttgatgcttacttggaggccctacgtttgtctatcgaggtcattagtggtgaaggttttgaatctttaaaatatagttgacataaattgtttcaagtttttttggtatttttgtttatcatgtactctgaaataccatggtttgaacatctgattagatgtctaattttattcttggattttcattttgtctttgctcttaaatcttatatgactttgacatgaaccatctaacttgaaaatcatttgcctggt

SEQ ID NO: 2609 - DNA, 943 bp, Triticum aestivum
cgcttttctccactcctctctcgcccccctctactgcccgaaatccagcagcgaccgccggcgcatctcaccccgggccgaggccggcgaactccgaagggaatcggagatgcagcagggcgatggcacggaggcgcaggtgacgtgggatgaccagcagaacatcaaccggttcggccgcctcaacaaccgcctccacgagctcgccgacgagatcaggctcgccaaggaagcaaacgaaaacctcgaggatgctgggaatgaactcatcttgtctgatgaagacgtggtgcgattccaaatcggggaagtgtttgcccacatgccagtggacgatgtggaagctaggctagagcagatgaaagaggacgcagctaagaagttggagaagctcgaggaagagaaggaatccatccttgcccagatggccgaactgaagaagatcctctatgggaaatttggagatgccatcaacctggaggaagattgatgtcaagaactggagctgcctttttaagtgtcgagtcatatgacacctgttcttgttcaggtgtttcattcgcctcgttgcattgtttcttgtgatgctggctagtgtaaaatgggagttttaagttctagaggattgttccccgttatgcattggcatggttgatctcggttggactcaaataggttgaggctcattgtccagcagaagccatgggtagtttatgcaaatggtcaatttggataccaatgaggggacctttacaatgttttaagctagtgagaatggtttgaacctgcatgattgtatgagattaagtcattaggctttacatgaaattttcttcagagccctgcagtatgaataacggctgaatgtggttttaacccatttggatattcctgataatgtgcatgacatgcttcatgtatggatgcctaagtttaggaaaac

SEQ ID NO: 2610 - DNA, 974 bp, Secale cereale
tcgcttttctccactcctcctcctctctcgcccccctctactgcccgaatcccagcagcgaccgccggcgcatctcaccccgggccgaggccgacgaattccgaagggaatcggagatgcagcaggggggtggcacggaggcgcaggtgacgtgggacgaccagcagaacatcaaccggttcggccgcctcaacaaccgcctccacgagctcgccgacgagatcaggctcgccaaggaagcaaatgaaaaccttgaggatgctgggaatgaactcatcttgtctgatgaagatgtggtgcgattccagattggggaagtgtttgcccacatgccagtggacgatgtggaagctaggctagagcagatgaaagaggacgcagctaagaagctggagaggctggaggaagagaaggaatccatccttgcccagatggccgaactgaagaagatcctctacgggaaatttggagatgccatcaacctggaggaagattgatgtcgagaaccggagctgcctttttaagtgtcgagtcgtatgacacctgttcttgttcaggtgctttgttcgcctcattgcattgtttctcgtgatgctggctagtgtaaaatgggagttttaagttctagaggattgttccccgttatgcattggcatggttgatctcggttggactcaaataggttcaggctgattgtcccgcagaagccacggggagtttatgcaaatggtcacttcagataccagtgaggggacctttacaatgttttaagctagtgagaagggttacaatgttttaagctagtgagaagggtttgaacctgcgtgattgtgtgagatgaagtcattaggctttacatggaattttcttcagtttcctggagtataaacaacggctgaatgtggttttaaccatttggatattcctgataacgtgcatgacatgcttcatgtatggatgcctaacgtttaaag

SEQ ID NO: 2611 - DNA, 964 bp, Triticum aestivum
gcttttctccactcctctctcgcccccctctactgcccgaaacccagcagcgaccgccggcgcatctcaccccgggccgaggccggcgaactccgaagggaatcggagatgcagcagggcgatggcacggaggcgcaggtgacgtgggatgaccagcagaacatcaaccggttcggccgcctcaacaaccgcctccacgagctcgccgacgagatcaggctcgccaaggaagcaaatgaaaacctcgaggatgctgggaatgaactcatcttgtctgatgaagatgtggtgcgattccaaatcggggaagtgtttgcccacatgccagtggacgatgtggaagctaggctagagcagatgaaagaggacgcagctaagaagctggagaagctggaggaagagaaggaatccatccttgcccagatggccgaactgaagaagatcctgaaagcgaaatttggagatgccatcaacctggaggaagattgatgtcgaggaccggaactgcctttttaagtgtcgagtcgcatgacacctgttcttgttcaggtgttttgttcgcctcattatattgtttcgtgtgatgctggctaatgtaaaatgtgagttttaagttctagaggattgttccccgttatgcatttgcatggttgatcttgggttcaggctgattgtccagcagaagccaccgggagtttccgcaaatggtcactccagataccaatgaggggacctttgcaatgttttaagctagtgagaatggtttgaacctgcatgattgtatgagatgaagtcattaggctttacatggaattttcttcagattcctgcagtgttacactagtgtcttgtttcccggcaaacaagtgaccaggtttgtgcgaagtcaaacttgtttaagtttgactaactttacaaaaaatgctaatatctacaccattaaatatatgttataatgacaaaa

SEQ ID NO: 2612 - DNA, 1141 bp, Brachypodium distachyon
tagctctggatatgctctaaggttggcctagccacgcgtcaatgaaaaaggtaaacctagccacagagtcgacatacttccgttccctctttgccgtcacacacaaatccaacggccaggaataatatctgttcatttctctctccatcgcttgcctctccaagtctccaatccctctgctgtccccaaccaaatccagcggcgactgccggcgcttctcatctcaggccgacgccgacgcaacccgaagtaaaccggagatgcagcagggcgacggtacggaggctcaggtgacatgggatgaccaacaaaacatcaaccggttcggccgcctcaacaaccgcctccacgagctcgccgacgagattaggctcgccaaggaagcaaatgaaaaccttgaagatgctgggaatgagctcattttgtctgatgaagatgtggtgcgtttccagattggagaagtatttgcccacatgccaatggatgacgtggagactaggctggagcagatgaaagaggaggcagctaagaagctggagaggctggaggaagagaaggaatccatccttgcccagatggctgaactgaagaagatactctacggcaagtttaaggatgccatcaacttggaggaggattgaaggtagagtacccgagggtctgtcttgtagtgttgaatcatctgatgcccattctacttcaggtgctttgatcttcctgctaagttgtttctcagggtgctggcttttgtaactatgagcgttcaagttctagaggatcgttccccaaatcctccattatgcattggcatggttgatggttggaccgaattaggttagctttgcttgtgcagcagaaaccgccaggaatttacacaatggattacttcagaaaccagtgaggacaacctgtattacatttgaagttactgaatggttcgaacctgcttgattgtatgagttgaagtgattaggctagacatgaattttcttccatctggtttcatcatggatttggtacaatagtattgttgacatcatttgctattctgatggatcaagttaacttatatgttaacttcactagctagctttcgctacttgagagaagtcgcttccctcacctggtcctagatgttgta

SEQ ID NO: 2613 - DNA, 824 bp, Triticum aestivum
ctttcatcgcttttctccagtcctctctcagccccctactgcccgaaatccagcagcgaccgccggcgcatctcaccccgggccgagaccgacgaatccccaaggaagccggagatgcagcagggcgatggcacggaggcgcaggtgacgtgggacgaccagcagaacatcaaccggttcggccgcctcaacaaccgcctccacgagctcgcggacgagatcaggctcgccaaggaagcaaacgaaaaccttgaagatgctgggaatgaactcatcttgtctgatgaagatgtggtgcgtttccaaattggggaagtgtttgcccacatgccagtggatgatgtggaagctaagctagagcagatgaaagaggatgcagccaagaagctggagaggctggaggaagagaaggaatccatcctcacacatatggccgagctgaaggagatcctctacgggaaatttggaaaggccatcaacctggaggaagattgacgtcgagaaccggagctgcctttttaagtgtcgcatcgtatcctgttcttgttcaggtgctttgttagcctcgttacattgtttctcatgattctggctagtgtaaaatggtagttttaagttctagaggattgttccccgttatgcattggcatggttgatctcagttggactcaaataggttcaggctgattgtccagcagaagccatggggtgtttatgcaaatggtcacttcagataccaatgaggggaccttttacaatgttttaagctagtgagaatggtttgaacctgcatgattgtatgagatgtagtcattaggctttac

SEQ ID NO: 2614 - DNA, 1651 bp, Panicum virgatum
agaaatgcactttcggagttgatggacgtatatgacacacccttctaagtttgatgaccgctgatgtactttactctagtttgttatagcctccgctatatcctcttagcctaaaaaaaatatataccgctatttatcataaaccgctatttaaaaccatgctcaaaacccttctcccccattcggctaagtgctggaggcctggagccccgaccaaatctcgcggcgactgccgactgctactccgaaccccggcggaagaccacgacctcgcttctgaaggtctgatctccggccggtgcgaccccaggcgactcgaagatgcagcagggggacggcacggaggcgcaggtgacgtgggaggaccaacagaacatcaaccgcttcggccgcctcaacaaccgcctccacgagctccaggacgagatcaagctcgccaaggaagcaaatgaaaaccttgatgatgctgggaacgagctcatcttgtcagatgaagatgtggtacgcttccagattggggaagtgtttgcccacatgccaagggacgatgttgagactaggctggagcagatgaaagaggacgcggcgaagaagctggagaggctggaggaggagaaggaatccatcctcgcccagatggccgagctgaagaagatactgtatggcaagttcaaggatgccatcaacctggaggaggattagcagcgagtacttgagctgttggcccgtagcttgtgtaacagaagacagtttagcttcggaagctttttttacccatgatgcatgaactttggtgaagtgaatgatttgattcggagcgtgtgtatgaattgaagccaagtggccgtgagcctgggacatacgcggaagcaatgatctttctgtcagttttatttcactcgtgaagatcaccaaccttttttccgagcagaaatgttgatcagaatgagtggtacctgtgatccgtgaccgagtgcgagaaaacactgaagcatgacaagtaagcaaggtaacacacgcgtacattgtatttacaagcatttttcacgagtatcctaaaagcgatttgaacgggagaaggtcgcgtcggcgcacgccggcgtcgctacaatgaatgaaaacagaaacaaaggaaaaagaaaaccttccggtgaaatttcaccggttgccaaggccggagggaaaatgcgtgtgagattccagcccaggtgcaggtccctgtccttttcctttgacctttcagcagctcccgtacgtggtggatgcttcacgcctgcaagttgcaagctacaggatccacggggcctacggacacgtactcgtttacatgcaggctggagctggaatggtgtgagagaaaaatactgttgggctggctggagctggtgactggagtggtatgagaggaaatcactgtagcgctggaagcctctataccagccgaacgcagcgaataacgcatctttaccaatcatatggatatagatatatgtatatatagagtcgtattattgccgcggccatgctttacagcgtatcagcggagccccgcacgccacaggctgtttggggatttcctcccgacaagcattccagtcttaattgtcatactaaggattttatatcccaatcataatagagcatccatcaa

SEQ ID NO: 2615 - DNA, 728 bp, Panicum virgatum
ggaccaaatctcgcggcgactgcaactcggagccccggcggaagaccacgccctcgcttctgaaggtctgatctccggccggtgcgaccacaggcgaatcgaagatgcagcagggggacggcacggaggcgcaggtgacgtgggaggaccaacagaatatcaaccgcttcggccgcctcaacaaccgcctccacgagctccaggacgagatcaagctcgccaaggaagcaaatgaaaacctagacgatgctgggaacgagctcatcttgtcagatgaagatgtggtacggttccagattggggaagtgtttgcccacatgccaagggacgacgtcgagactaggctggagcagatgaaagaggacgcggcgaagaagctggagaggctggaggaggagaaggaatccatcctcgcccagatggccgagctgaagaaaatactgtacggaaagttcaaggatgccatcaacctggaggaagattagcagaagaagataatgtacggaaagttcaaggatgccatcaaacctggaggaagattagcagcgagtacttgagctgttgcccgttcagttgtacgtcgctttttttagtgctgtttttcgctagcttgcgtaacagaagacagttgagcctgctgtatttaaaaaaaaacagaagacagttgagcttcggaagcttttttacccgtgatgcatgaactttggttgaagtgaatgatttgattc

SEQ ID NO: 2616 - DNA, 722 bp, Panicum virgatum
ggccccttcggctcaagtgctggaggcctggagccccgaccaaatctcgcggcgactgccgactgctactccgaaccccggcggaagaccacgacctcgcttctgaaggtctgatctccggccggtgcgaccccaggcgactcgaagatgcagcagggggacggcacggaggcgcaggtgacgtgggaggaccaacagaacatcaaccgcttcggccgcctcaacaaccgcctccacgagctccaggacgagatcaagctcgccaaggaagcaaatgaaaaccttgatgatgctgggaacgagctcatcttgtcagatgaagatgtggtacgcttccagattggggaagtgtttgcccacatgccaagggacgatgttgagactaggctggagcagatgaaagaggacgcggcgaagaagctggagaggctggaggaggagaaggaatccatcctcgcccagatggccgagctgaagaagatactgtatggcaagttcaaggatgccatcaacctggaggaggattagcagcgagtacttgagctgttgcccgtagcttgtgtaacagaagacagttgagcttcggaagcttttttacccatgatgcatgaactttggtgaagtgaatgatttgattcggagcgtgtgtatgaattgaagccgagtggccgtgagcctgggacatacgcggaagcaatgatctttctgtcagttttatttcg

SEQ ID NO: 2617 - DNA, 927 bp, Panicum virgatum
cggtttccgtatactttacgtacgtggctgtttccgtatgtctacatgtatgttttcctaaactgaaatacagacacgtttgataaaaaaaaaaaagtgctggagcccccgaccattcgaccaaatctcgcggcgactgcaactcggagccccggcggaagaccacgccctcgcttctgaaggtctgatctccggccggtgcgaccacaggcgaatcgaagatgcagcagggggacggcacggaggcgcaggtgacgtgggaggaccaacagaatatcaaccgcttcggccgcctcaacaaccgcctccacgagctccaggacgagatcaagctcgccaaggaagcaaatgaaaacctagacgatgctgggaacgagctcatcttgtcagatgaagatgtggtacggttccagattggggaagtgtttgcccacatgccaagggacgacgtcgagactaggctggagcagatgaaagcggacgcggcgaagaagctggagaggctggaggaggagaaggaatccatcctcgcccagatggccgagctgaagaaaatactgtacggaaagttcaaggatgccatcaacctggaggaagattagcagaagaagataatgtacggaaagttcaaggatgccatcaaacctggaggaagagtagcaggagtacttgagctgttgcccgttcagttgtacgtcgctttttttagtgctgtttttcgctagcttgcgtaacagaagacagttgagcctgctgtatttaaaaaaaaaacagaagacagttgagcttcggaagcttttttacccttgatgcatgaactttggttgaagtgaatgatttgattcagagcgtgtgtatgaattgaagcgagtggccgagagcctgggacgtacgtggaagccatgatttttctgtcagttttatttc

SEQ ID NO: 2618 - DNA, 861 bp, Zea mays
ctaaatttatgtttgttgactttattaaaaaagggattatcttcattttgtagctttgaatcgcctctcagaaccgagatcctcaaaacccttctcccccctcccggatcgagtgcttgagctccgaccaaatctcgcagcggctgcaattccgagcccgaagagcggatcaggcgaggacgacgccttcgattctgatctgcggtcggcgcgacccagagagaaccggagatgcagcagggcgacggcacggaggcgcaggtgacgtgggaggaccagcagaacatcaaccgcttcggtcgcctcaacaaccgcctccacgagctccaggacgagatcaagctcgcgaaggagacgaatgagaaccttgatgatgctgggaatgaactcatcttgtcggatgaagacgttgtacgcttccaaattggggaagtgtttgctcacatgccaagggatgacgtcgagactaggctggagcagatgaaagaggatgcggctaagaagctggagaggttagaggaggaaaaggaatccatcctggcccagatggccgagctgaagaagatactgtacgggaagttcaaggatgccatcaacctggaggaagattagcagtactggagtcgtggcgatttgaccctctttctagttcaggtgctgttttttcccttgctctccggctctcccaaacatcagtcttgtgatgctggcctggttgtgttagcagttctttcaaaacctctattacccagaagaacccagaaaatagttccattcattccgcgggtgtatatgcattgaagttaatggacctgagccgatgaatcccttttcagttcagttttcgctgggtgcatgtgg

SEQ ID NO: 2619 - DNA, 738 bp, Avena sativa
gcttctcatctcgggccgacgacgcggacgcaacccgaaggatatcggagatgcagcagggcgacggcacggaggcgcaggtgacatgggaggaccagcagaacatcaaccggttcggccgcctcaacaaccgcttccacgagctcaccgacgagatcaggcttgccaaggaagcaaatgaaaaccttgaggatgctgggaatgagcttatcctgtgtgatgaggacgtggtgcgtttccagattggagaggtgtttgcccacatgccaatggatgacgtggaagctaggctggagcagatgaaagaagacgcagctaagaagctggagaggctggaggaggagaaggaatccatcctcgcccagatggccgagctgaagaagatcctctacgggaagtttaaggatgccatcaacttggaggaggattgaagtctgagtcctggggctgtctttgagtgttgaatcatgtgacgcctgttctacttcaggtgctttgttcttgccgatacattgtttctcgtggtgcttggctaatgtaacatatgggagtttattcaactgaggttagcatgcaaaaagtttctagttttctggtgacctgtagcaggaactgagactgtattggttacgttgcctaatcgcagaaatgcttagttctcttagccaatgcttgtttgggacaacgtcttcgaatcgcgaggcctctattcaattcaagtctgaaactattctacag

SEQ ID NO: 2620 - DNA, 789 bp, Sorghum bicolor
atcactcaaaaccctttccccccctccacccttttcccctcccgggtcgagtgctcgagctccgaccaaatctcgcagcggctgcaatccccgagcccgaagcgcggatcagcggaggaggacgccagattctgatctgcggccggcgcgacccacagaaaaccggagatgcagcagggcgacggcacggaggcgcaggtgacgtgggaggaccagcagaacatcaaccgcttcggtcgcctcaacaaccgcctccacgagctccaggacgagatcaagctcgcgaaggaaacgaatgagaaccttgatgatgctgggaatgaactcatcttatctgatgaagatgttgtacgcttccaaattggggaagtgtttgctcacatgccaagggatgacgtcgagactaggctggagcagatgaaggaggatgcggctaagaagctggagaggttagaggaggagaaggaatccatcctcgcccagatggccgagctgaagaagatactgtacgggaagttcaaggatgccatcaacctggaggaagattagtagtagagtcgtgactatttggccctctttctagttcaggtgctgtttttgtttccctgccctcccacaaacatttgtcttgtgatgctggcctgcttgtgtaacagaagctcttctacccagaagaatccagaaaatagtttttattcattctgcgggtgtatatggattgattgaagttattagccctgagcttttcagttggactttcggccttgtttagttcctaaaaaattttgc

SEQ ID NO: 2621 - DNA, 837 bp, Saccharum officinarum
ccagcccgtaccaaatctcgcagcggctgcaatccctgagcccgaggcgcggatcagcggaggaccacgccctcgattctgtctgcggccggcgcgacccacagagatccagagatgcagcagggcgacggcacggaggcgcaggtgacgtgggaggaccagcagaacatcaaccgcttcggccgcctcaacaaccgcctccacgagctccaggacgagatcaagctcgcgaaggaaacgaatgagaaccttgatgatgctgggaatgaactcatcttgtcggatgaagatgttgtacgcttccaaattggcgaagtgtttgctcacatgccaagggatgacgttgagactaggctggagcagatgaaagaggatgcggctaagaagctggagaggttagaggaagagaaggaatccatcctcgcccagatggccgagctgaagaagatactgtacgggaagttcaaggatgccatcaacctggaggaagattagtagtactggagttgtgataacatggccctctctttctagttcaggtgctgtttttatttccctggcctcccacaaatgctggcccggttgtgtaagtttgagtttcagtcttgaagctctttcaccaagaacccagaatagtttcattccgcggatttatatggattgaagttaatggccctgagcccatgaatcattttttcagtttgatgttatagaagacgaatccgaaagtaagatgtggatttttttaattatttatcatgagagggggcccggtttaaaggattcaagctttattacccctggctggcaaagaatagtttttttatgggggcacct

SEQ ID NO: 2622 - DNA, 673 bp, Cenchrus ciliaris
atcagcggaagatcacgctctcgcttctgatccccggccggcgtgacccaaggcgaatcggagatgcagcagggggacggcacggaggcgcaggtgacgtgggaagaccagcagaacatcaaccgctttggccgcctcaacaaccgcctccacgagctccaggacgagatcaaactcgccaaggaaacaaatgaaaacctcgacgacgctgggaacgagctcatcttgtcagatgaagacgtggtacgcttccagattggagaagtgtttgcccacatgccaagggatgacgtggagactaggctggagcagatgaaagaggacgctgccaagaagctggagaggctggaggaggagaaggaatcgatcgtcgcccagatggccgagctgaagaagatactgtacggcaagtttaaggatgccatcaacctggaggaggattgacagcgagcacttgagctgtcacgagatgcgtcacacactgctccttccagcccaggtgtagttttgttcccttacatttagtttgtgatgctagcttgtgtaacagaagagaggttgagcttccagaagcttgtttagcgatgcatgaactgggttggagcgtgttgtttgattccaatcgtgtctatgaattgaagtgaatgggcgtgagcctctggcgtacatccca

SEQ ID NO: 2623 - DNA, 813 bp, Cynodon dactylon
gggttcaggtgcgggagcctcgatcccatctcgcaaagccccgaagccccaaaccctcgagcgcggcggatcagccggagaccacgcccgcgcgcgcctctaagctcctgccggcgcgacccagagggaaccggagatgcagcagggagacggcacggaggcgcaggtgacgtgggaggaccagcagaacatcaaccgcttcggccgcctcaacaaccgcctccacgagctcgacgacgagatcaagctcgccaaggaggcaaatgaaaaccttgatgatgccggaaatgaacttattttgtcggacgaagatgtggtacgcttccaaattggagaagtgtttgctcacatggcaagggatgatgttgagacaaggctggaggagatgaaggaggatgccgctaagaagctggagaggctagaggaggagaaggaatccattgttgcccagatggctgagctgaagaagatactgtatgggaagttcaaggatgcaatcaacttggaggaagattgacagtgagtactgggtggttgtgccgtcaattgtatggtactctttctggttgaggtgctgcttcagttcccatatcctcccatttcattagtatctgcagtcgttacaaatgatgaatgtagttgatccatgcttggacagtatcaggtttcttttgttcgtactggaaaaacctgatggatagatgaatatgtttcgttatgtgtgcattttcggagagcgctttattatgaattatggaatttgtgcatgtatgcataggatttgaatcgaatggcagtcagatcttaaagctt

SEQ ID NO: 2624 - DNA, 986 bp, Setaria italica
ttccccctcccggtctccccttcccccccttgcggctaagtgctcgagccccgaacaaatctcgcggcgattggaatccccgaacgccgagagcagatcagcggaagaccacgccctcgcttctgatctccggccggcgcgaccccaggccaatcggagatgcagcagggggacggcacggaggcgcaggtcacgtgggaggaccagcagaacatcaaccgcttcggccgcctcaacaaccgcctccacgagctccaggacgagatcaagctcgccaaggaaacaaatgaaaaccttgacgatgctgggaacgagctcatcttgtcagatgaagatgtggtgcgcttccagattggagaagtgtttgtccacatgccaagggatgacgtggagactaggctggagcagatgaaggaggatgcggccaagaagctggagaggctagaggaggagaaggaatcaatcgtcgcccagatggccgagctgaagaagatactgtacggcaagttcaaggatgccatcaacctggaggaggattgacagtgagtccttgagctgttgcgcgatagtttttcaggttctgtttttattcccccgtcctcccaccacattagtctggtgatgctagcttgtgtaacagaggagagtttgaagcttcggaagctcgtttaccccacaggatgcacgaacttggttggagtgagtggtttgattccgagcgtgtttatgaattgaagtgaatgggcgtgagcctcaggcgtacatccagtcatgatcttttcgtcagtttgatttttcactcgtgcaggtcaccaaacattttcccagcagacatgttgatcaaaatctgtgtgaatctgtgatccgtctgtgcaagaaaacactgaactttggcacgtcgtgctcctctaccgtatattttgagttagttttactgtgtaatcatgtttatcggaatgaaagcagcggcaggagatctggagatg

SEQ ID NO: 2625 - DNA, 955 bp, Zea mays
gaaaggctcgcgtatgccttccccctcctccacctttttcccccgttcgagtgctcgagctccgaccaaatctcgcagcggtagcaatccccgagcggccgagcccgaagcgggatcagtggaggacgagtggacgacaccctcgattctgacctgcggtcggcgcgacttacagagaaccggagatgcagcagggcgacagcacggaggcgcaggtgacgtgggaggaccagcagaacatcaaccgcttcggtcgcctcaacaaccgcctccacgagctccaggacgagatcaaactcgcgaaggaaacgaacgagaaccttgacgatgctgggaacgaactcatcctgtcggacgaagatgtcgtgcgcttccagatcggggaggtgtttgctcacatgccgagggacgacgtcgagactaggctggagcagatgaaagaggatgcggctaagaagctggagaggctagaggaggagaaggaatccgtcctcgcccagatggccgagctgaagaagatactgtacgggaagttcaaggacgccatcaacctggaggaagattaagagtagtactggagttgtgacgacgtggccctctctttctagttcaggtcctgtttttgttcccctgctccccccacagaagcgcttggcccgctcgtgtaatggaagcttgagtctctcagtctttcagaagctcttttcaccaagaacccagaatagttttcattctgcgggtttatacggattgaagctaatggcgctgggcccatgaatcctttttcagtttgattgtacttggtgtatgtgggtacatcgcttgccctatttcctagtacttactagcaagcctgtgactgtgagtaccggaaaacagtggagataacgggcatgtaggtcttgttttctgcctaatatgttgggaatcatttgcagcctttcaccagcttcgg

SEQ ID NO: 2626 - DNA, 814 bp, Pennisetum glaucum
ctgtatctctgaaccctatgtatgtatgtatgaccccccttgctcgagctcccgaccaaatctcgcggcgactgcaatcctggaacgccgagagcagatcagcggaaggtcacgccctcgcttctgatctccggccggctcgacccaaggcgaatcggaagatgcagcagggggacggtacggaggcgcaggtgacgtgggaggaccagcagaacatcaaccgcttcggccgcctcaacaatcgcctccacgagctccaggaggagatcaagctcgccaaggaaacaaatgaaaaccttgacgatgctgggaacgagctcatcttgtcagatgaagatgtggtacgtttccagattggagaagtgtttgcccacatgcccagggatgacgtagagactaggctggagcagatgaaagaggatgcagcaaagaagctggagaggctggaggaggagaaggaatcgatcgtcgcccagatggccgagctgaagaagatactgtacggcaagttcaaggatgccatcaacctggaggaggattgacagagtccttgagttgttgcgctatagttcaggttctgttttcatttccccatcctcccaccactttagcctggtgatgctagcttgtgtatctttgaaagcctcggaagctggtttaccccagtatgcacgaacttggttggagtaagtggtttgattccgagggtgttcacgaattgaattgaaattggcgtgagcctctggcgtacatccggtcatgatctttccttgagtttgatttttcactagtgcaggttaccaaagcttttttt

SEQ ID NO: 2627 - DNA, 866 bp, Oryza sativa
ccccccccccccctcgtcgtcttcctctgctgctgccaattgcgaaggcttttcccccgaaatccagcagcggcggcggcggcggcggcggagatcgacgaatccagcggcggcgcaccccgaagggaaccggagatgcagcagggggacggcacggaggcgcaggtgacgtgggaggaccagcagaacatcaaccgctttggccgcctcaacaaccgcctccacgagctccacgacgaaatcaagctcgccaaggaagcaaatgagaaccttgatgatgctgggaatgaactcatcctgtcagacgaagacgtggtgcggttccaaattggagaagtgtttgcccacatgccaagggatgatgtggagacaaggctggagcagatgaaagaggatgcagctaagaagttggagaggctggagcaggagaaggaatccatcgtctcccagatggctgaactgaagaagatactgtacggaaagttcaaggacgccatcaacctggaagaagattaatatcgagtaagctgccggatattgaatgatatgatgctctcttagttgagactagaggagctgtgtttgctagactaaactgtttctagtgatttaagaagacacgtttctcgtgatgcatcaacatggttaattcttatgctggattagattagcatggttttgcccagcagatacgtgaatcatgagttgcatggtttcaatttataaaaatgcagtatgggggaatttggacgaattggttatgttattactacatataagccaagttttcagttgcatcaaattgtgttattcttcagtcgagttgaattttgcaacggtgatctatgaaattgttttgtttggat

SEQ ID NO: 2628 - DNA, 782 bp, Musa acuminata
atgtactttgccgaaggagtggaagaattaattaggtcatcgtcggcggacaggttcggagccgcgtgtggttcgtcgagcgaggcatcggttccaaagatgcagaagggcgaaggatcggaggctcaagtgacctgggaagatcagcagaacatcaacaagtttgggaggttgaacaacaggttccacgagctcgaggacgagatcaaagtggccaaggaaacaaatgaaaatttggaggatgccagcaatgagctaattttatctgatgaggacattgtgaggttccaaatcggggaggtgtttgctcatgtgccacgcgaagaagttgaaaacagattggaaaagatgaaggaggatgccagcaaggaactcgaaaagctagaggaagaaaaggaatccatccttgcgcagatggctgaactgaagaagatcttgtatgggaagttcaaggactccattaatttggaggaagattagttgggactgtgatgctttttccctgttccttaaatcctttttttttttcgcgattctctactccgtattgtgtgtgcactccttgatgaattgaaacccaaaacatggtactcgagcttagagtgagctgtcagaaatttattttgatggctgcaaaaagatctctgaccttatgtgaaagatcctgacatgatccaacatctagacatctttattatgcagaagttttgcacatacaatcctgaaacatttatgtttggatatatactactgcaactgtgattgtatttgtagtatcccag

SEQ ID NO: 2629 - DNA, 732 bp, Amorphophallus konjac
gtccacctactgacgccctcaaagcagttcatttcacctgcttgtctcgcctcttttccgctcgttccctcgctcagacgggaagcagggccgagatcgatcaaaaatgcagcaggggtcgggctcggaggcggaggtgacatgggaggaccaacagaacatcaacaagttcagcaggctcaacaaccgcttccacgagctcgatgaggagatcaaggccgccaaggaaacaaatgaaaatttggaagatgccagcaacgagctgatcctttcagatgaggatgttgtaaggtttcagataggagaggtatttgcccacgtgcctagggaggacgtggaaaatagactggagacgatgaaagaagatgctagtaaagaattggagaagctagaggaagagaaggaatctgtgcttgcacaaatggcggagctgaagaagatcctttatggaaagttcaaggattctatcaatctagaagaagactaattgagcatggtggtattatgtggactcctattgagttgttatttgaagatggtttgttatgcatctaggagatttgacagtgttatttgacgtgttacaaagcaagcccctattgacccccagatcacattacatcgacctggctcgatggggtacaatttgcagtaaatatttcttagtctgtaatgattgaacacactaggcccatttatatatatatatatcttgttatcagatattatgaa

SEQ ID NO: 2630 - DNA, 763 bp, Elaeis guineensis
gctggatggagatcagatggttcctatttagaatttccgtcgttttagcatgatccccaacaggcccacggagggagaccatctatgagaataattgggcttgaaggcctcccgccgttccagggaaaccaaagctcagctgaagatccggctgctgcccgatctatagctaaagggtcacaagatgcagcagggggaagggtcggagacgcaggtgacgtgggaggatcagcagaacatcaacaagtttgggaggctgaacaatcgcttccatgagctcgaggatgagatcaaggtcgccaaggaagcaaatgaaagtttggaggatgccagcaatgaattaattttgtctgatgaggatatggtgaggttccaaataggcgaggtctttgctcacatgcctcgggaagaagttgagggcaggttggagaagatgaaggaggatgctagcaaggaactggagaggcttgaagaagaaaaggaatcagtactcgcgcagatggctgagctcaagaagatcttgtatggaaagttcaatgactccatcaacttggaggaagactgactggggctttgcactgccccttgtttatgtgttctccctctccatagtccttaacagtgtacttttaacaggtcgccacctgtttgctagaagctcattggtcggtattttcttattgtctgatgaacctctcagttctataaattgggcaccgttgaccttgttattttctatttcatgtttaaaaaaaaaattgtt

SEQ ID NO: 2631 - DNA, 773 bp, Aristolochia fimbriata
agactgaagagtgattgtcaaatccagaaagcgggctgagttaagaatatctttccagccaaaccggttcgacccacactcagcagactcgtaaagtcgtataacaattttcggcctgcacctcgagaagccagactgagctcgctgagtgccatttgaggtcgtcgccggagcacgatgcagcagggaagcggatcggaaacggaggtgacttgggaggatcagcagaacattaataaattcggaagattgaataacaggtttcacgaattagaggacgagattaaggttgcgaaggaaacaaatgataacttggaggatgcaagtaatgagctgatcctctcagacgaggatgtggttagatttcaaataggcgaggtgttcacacatatgccaagggaagacgtagaagagaggttagaaaagatgaaagaggatacaagtaagctgttggagaaactggaggaagagaaggaatcggtacttgcacagatggctgagctgaaaaagattttgtatgggaaattcaaggattcaattaatttggaagaggattgatgaagttttttatgcaacttgtgattcaggtcttccatgtcatattgtactaatcgtgtcatatcagcttggttgtggttgatataaattttgttgaatatgatcctttgcgttggagattatgaccatccttgcaaatttgtaaaatttttatcagtcagtatgtcatactgctttggttatttcaacctctattcttggcgtctttgaaacaa

SEQ ID NO: 2632 - DNA, 589 bp, Festuca arundinacea
gccgacgccgacgcaacccgaaggacatcagagatgcagcagggcgacggcacggaggcgcaggtgacatgggaggaccagcagaacatcaaccggttcggccgtctcaacaaccgcctccacgagctcgctgacgagatcaggcttgccaaggaagcaaatgagaaccttgaggacgctgggaatgaacttatcttgtgtgatgaagatgtggtgcgtttccaaattggagaggtgttcgcgcacatgccgatggatgatgtggaaaccaggctggagcagatgaaagagaacgcagctaagaagctggagaggctggaggaggagagggaatccatccttgcccagatggcttagctgaagaagatcctctacgggaagtttaaggatgccatcaacttggaggaagattgaaaaattgagtaccggagctgtcttttgagtgtggactcatatgacacctgttctagttcaggcgctttgttctctccgatacattgtttctcatggtgctggctaatgtattcatatgtgagtttattctcttgaggttaacatgcgaaaatgttgtttcttgtttggtgacctg

SEQ ID NO: 2633 - DNA, 716 bp, Zingiber officinale
caagccaatgagttgggaagtgtttttcttccgaaagatgaaagcaagtgattcacccagtgaaggaaatttgtttgtatcgttgaagaaatacactaaagttgaaataagaataattttgttttcctcgtgccgaattcggcacgagggtcgccgaggaggatcgtcttgaagatgcagcagggcgaaggatcggagacccaggtcacatgggaagatcagcagaacatcaacaagttcgggaggttgaacaaccggtaccatgagctcgaggaagagatcaaggtcgccaaggaagcaaatgaaaacttggaggatgccagcaacgagttgatcttatctgatgaagatgttttgaggttccaaataggggaggtgtttgctcacgtgccttccgaagaagttgaaagcagactggagaaaatgaaagaggacgctgctaaggagctccaaaggctggaggaagaaaaggagtctgttcttgcgcagatggctgaattgaagaaaatcttgtatgggaagttcaaggactccataaatttggaggaagattagtgggagatttagtttgatgcattttggctctctctgcctcttgtgtgcactctttgatgcgttgagttcttttatttcagctctgtgagatgatgtggaagaaaccccaattaggcatatttagaacgtattttggatcaaatttgactatatatcctgaa

SEQ ID NO: 2634 - DNA, 2386 bp, Oryza sativa
gctccattgtgtgtgtggccaaagaagagaggagaaaaagaaaaaaaaaagaaaacaagatctcatctcgatttgtttgagctctccgtccttgctaagttgatgatctctcttctagtcttcttcgtgggtaggctcgtgctgcctctgcctgctggtgcagcagatcagatcaggtctccggcgatggcgatctgaggccggaggctgcttgcttctgcttgcatggagcgggtgctcaaatccgccagggagtcgggctccctcaacctctccaatcgatccctcagggaggtacccaaggaggtgtacaacaacttggacacgggggctcaggatgagaaatggtgggagggagttgaccttcagaagctcatattggctcataacaaccttgaggtgttgcgtgaagacctcagaaatttgtcttcgctcgttgtattaaacattagtcacaacaatatttcttccctccccgcagctattggagaccttcctttgctaaaatcgttggatgtatcttctaatcaaataaacgcttttcccgaagagattggttttgcgaccgctttagtcaaggttgactgctcaaataattgccttacagatctcccagttagtcttgccagatgcctggagttgtcagaactcaatgcgtcaaacaacactatatccgtactgccagatgaacttgctggctgttccaagttattcagattgaatctagagggtaacaagctcgtgacgctatcagacaagatgtttatgtcatggacaatgcttacagagatgaatgctgcaaagaatctactgacagccatcccggatggtattggtgcactgtcaaagctaattcgtctggacctgcatcagaacaaaataaccctgattcctccttccataaaagattgctcttctctagcagagttttatatgggaaataacttgttgacatccataccagaggatattggcatgctatcgaacttgggaatacttgatctacactctaaccagctaaaggagtatcctgtcggggcttgtagactcaagctctctttccttgatctatcaaacaactcattatctggtctgcctgctgaactaggtactatgacaaccctaagaaagcttctgcttactggtaatcctatgaggacacttcggagttccttggtttctggaccaacaacagcattattaaagtatctgcgcagtcggctttcatctgatgaaggagcatcaggatctggaagcactccaacaaaagatgatcaaattgctgcagcaagaagattgtctttatcttctaaggaactggacttgagtggtcttggtgtgaccagtgtaccacctgcagcttgggagacaaatgatgtgatgaaactagatctttctaagaattcaatagaagatctgccaaacgagttgtcattatgctcgtcacttcaatctttgattttgtctaacaacaaaattaaaaggtggcctggcaccgtattctcctcccttgccagcctttctttgttaaagctagacaacaatcctttggcagagatattggctactgatcttgaggccctgtctaaacttgaagtactagatttaagtggcagtgcttcttctctacctgaaccctctgcggtttcgaaattacctcacctaaaggaactctacctaagacgaatgaaactccatggatttcctgatagtttattgggcttaaaactgctgcgaattcttgatctgagtcagaattatcttacatctgtgccagagggtatcaaagatttaacttctttgattgagcttgatctgtcggacaacaatataacaacactcccacctgagctgggtttgcttgagcctaacctgcaagtcttgaaacttgatggaaatcccctcaggagcatacggcggactctgctggagcgaggaacgaaagcaattctgaagtatctcaaagaaaagctacctgctgaataaattctggtgggaattaatgtatgctgcatgatgtttattgatcagttcggccctctcgaactgcagttaccttttcctggagtccatttatccccaaattgttttttccttgattgatgtaatttttgcttggctatcttcttggtgatcgttatcattctcctcattttatccgcggattgctgtcacactgaaagcttctcagcttgtgtataaccaaccttgtatgcagtatacagcagatcagaattcggttatgttgtagtattttgacactggaagtcccgcacgtgtgaaaaaaaatctgccgccacaagtgaaactttgtttcttgccaaagaagccgttcctaaagaataaaaaaaaatattattggatgtggagtgctggtatgttaatg

SEQ ID NO: 2635 - DNA, 957 bp, Secale cereale
ccacagcccccggagccagacccaccctgcatacctccctcctccttcatcatcatcatcatcttcttcttcttcatctcctcgcacatccatcatccatgggctccctgggaagcagcgacgacgagaagcgactggcggtggagagcgtgaacacggaggcggcatgcgcactgctggcgtcggagcagtacgggtacgtcgacgtgcgcatgtgggaggacttcgaccggggccatgtcgccggcgcgcgcaacgtgccctactacctctccgtcaacccccacggcaaggagcgcaacctggacttcgtggaccaggtcgccgcgctccactcgaaacaggaccggctgatcattggctgccgctccggggtgcggtccaggctcgccaccgccgacctcgtcgctgccgggttcacgaaggtgaagaacctggagggaggctacctctccttgctcaagagcgtcagttaccagcagcaggcagcactagccagccgtcactaattttccttttgtttgaaaggctctcaggaataagttaaatggtgatctattattgatgatgtacagagaaaatttcctaggaaaagaaggcattttgtatgtatgtaaaactatgtatgcatcttcgatttggattttgtccattcaatagtacggctgctacccgagtattgattggtcttcttcgagaatgtatggacaagcaagggaaaaaaatgttgggaggagttggttacctacggatttgtttgactgaacatataccgagtatttctactaaaaaaaaaaaaaaaaaaaaaaaaaaaaaaaaaaaaaaaaaaaaaaaaaaaaaaaaagaaaaaaaaaagaaaaaaaaagaaaaaaagaaaaagaaaagaaagaaagaagaagagagagagactatatatactactacgacgacgacgacgacgacgacgacgagagagag

SEQ ID NO: 2636 - DNA, 689 bp, Secale cereale
tcttcttctcctcgcacatccatcatccatgggctccctgggaagcagcgatgacgagaagagaccggcggtggagagcgtgaacacggaggcggcatgcgcactgctggcgtcggagcagtacgggtacgtggacgtgcgcatgtgggaggacttcgaccggggccatgtcgccggcgcgcgcaacgtgccctactacctctccgtcaacccccacggcaaggagcgcaacctggacttcgtggaccaggtcgccgcgctccactcgaaacaggaccggcttatcgttggctgccgctccggggtgcggtccaggctcgccaccgccgacctcgtcgccgccgggttcacgaaggtgaaggacctcgagggaggctacctctcgttgctcaagagcgtcagctaccagcagcaggcagcactagccagccgtcaataattttcctttgtttttaaggctctcaggaataagttaaatggtgatctagtattgatgatgtacagagaaaatttcctaggaaaagaaggcattttgtatgtatataaaactatgtttgcatcttcgatttggattttgtccattcaatagtacggctgctaccgagtattgattggtcttcttcgagaatgtatggacaagcaagggaaaaaatgttgggaggagttggttacctacggatttgtttgac

SEQ ID NO: 2637 - DNA, 989 bp, Triticum aestivum
tcggggggaccaatccagtccatagcccccggagccagacccaccctgcatacctccccttcatcatcatcaccatcttcttcttcttctcctcgcacatccatcatccatgggctccctgggaagcagcgacggagagaagcgactgccggtggagagcgtgaacacggaggcggcatgcgcactgctggcgtcggagcaatacgggtacgtggacgtgcgcatgtgggaggacttcgaccgcggccatgtcgccggcgcgcgcaacgtgccctactacctttccgtcaacccccacggcaaggagcgcaacctggacttcgtggaccaggtcgccgcgctccactcgacacatgaccggcttatcgttggctgccgctccggggtgcgatccaggctcgccaccgccgacctcgttgccgccgggttcacgaaggtgaagaacctggagggtggctacctctccttgctcaagagcgtcagttacaagcagcaggcagcactagccaaccttcactagttttccttttgtttctaaggctctcaggaataagttaattggtgatctatcgttgatgatgtacagagtaaatttccaaggaaaagaaggcattttgtacgtattaaaaccatatatgaatcttcgacttggatttggtcttcttcgagaatgtatggacaagcaagggagaaaataatggcaggcacagttggttacttagggatttggttgactaagctgagtatttctctacctgttctgtcctttcatacagctgatcaagttgaaagaaatgcatttttacactagagaaattgaggcattaactttttattttcatcgaacacaactaatacaaaatgagttaccagttgtgtgattaggtcctctttatgctgaaaatacaacaatatttgagctaaatttgtgaattaatacaaatggaatataaataagtataaaatttggtataaacaggctcacaggc

SEQ ID NO: 2638 - DNA, 1811 bp, Triticum aestivum
tcgaccattctctctctataaataagacacgtaggtaacactcatctttcaccaatccactccacagcccccggaaccagacccaccctgcatacctcccctccttcatcatcatcttcttcttcttctcctcgcacatccatcgtccatgggctccctgggaagcagcgacgtcgagaagagactggcggtggagagcgtgaacacggaggcggcatgcgcactgctggcgtcgtcggagcaatacgggtacgtggacgtgcgcatgtgggaggacttcgaccggggccatgtcgccggtgcgcgcaacgtgccctactacctctccgtcaacccccacggcaaggagcgcaacctggacttcgtggaccaggtcgccgcgctccactctaaacaggaccggctcctcgtcggctgccgctccggggtgcggtccaggctcgccaccgccgacctcgtcgccgccgggttcacgaaggtgaagaacctggagggtggctacctctccttgctcaagagcgtcagttacccgcagttggcagcagcagccagccttcactaatacagccggcataactttcctttgttttctaaggctctcaggaacaagttaattggcaatctgttattgatgatgtatagagggaatttccaaggaaaagaaggcattttgtatgtactataaaactatatatgcatcttggacttcgatttggccctaagtattgattggtcttcttcgagaatgtatggacaaggaagggaagaactgttggcaggcacagttggttacctaccgatttggttgcccaagcttatactattctaagtgtttctctaccagttctttttttcaacagcggatcaaattggaagaaatgcattttacaacacagaaattgagacagtaacttttagagaggagtgcttcgatagaacccctaagttttcctcaaaagggttattttcgtccaacactagtaatccaaaatgagttaccagttgcgtgattaggccctcttcatacgctcgaaataccacaacatttcacctaaatttgtgaattgatacaagtgggctataagtaagcatacaagtttggtataaataggatcataggtcaagttgtaccgagtcagagaaaggcgatgccactgaactttcataggtcgccgttaatgccattgtcaccaacatcatcaaggtagtaaccgacgccaatgctgccgaggttgcctgtgccaacatcatcactaccaagatccagactatctgcattgtcgtcgctgagggcccggacacaaaaaggtactccctccatttcactataaatgtctcaactgtagtacaactttgtattacatttagtgtataaagttgatacacttattttaagacgaagggagtatttgtctgtggtcttcgcaataatggagggaagagagatgaggaatgaaattgcaaagatgaggctctcgtcatggcatgaccagtcagcacttatggaccagccacaagagggtagctcctagaacatggttaaagaatagccaagggccggctatatcgagttctcatgtcatttatagaaaatttaatagcccactcatataatagttagtcataccaaagattgttgtgtcttatgctacagctggctataagtttatagcccgtttatcttctctctcctctcatcactcctccaactagatataaaattgacgtgtcatcttttatagctcgctcatgttactgtattgtacttgctcttaggcaaccagtggcaagtagcctgacccgccagctca

SEQ ID NO: 2639 - DNA, 797 bp, Triticum aestivum
caccaatccactccacagcccccggaaccagacccaccctgcatacctcccctccttcatcatcatcttcttcttcttctcctcgcacatccatcgtccatgggctccctgggaagcagcgacgtcgagaagcgactggcggtggagagcgtgaacacggaggcggcatgcgcactgctcgcaaccgagcagtacgggtacgtggacgtccgcatgtgggaggacttcgaccggggccatgtcgccggcgcgcgcaacgtgccctactacctctccgtcaacccccacggcaaggagcgcaacctggacttcgtggaccaggtcgccgcgctccactcgaaacaggaccggctcctcgtcggctgccgctccggggtgcggtccaggctcgccaccgccgacctcgtcgccgccgggttcacgaaggtgaagaacctggagggtggctacctctccttgctcaagagcgtcagttaccagcagccggcagcactagccaaccttcactaattttccttttgtttctaaggctctcaggaataagttaattggtgatctatgattgatgatgtacagagaaaatttccgaggaaaagaatgcattttgtatgtataaaagtatatatgcatcttcgacttggatttggtcttcttcgagaatgtatgcacaagcaagggaaaaaatgttggcaagcacagttggctacatacggatttgttttactaaggaagcttatactgagtacttttctacctgttatttccttccatacagctgttcaagttgaaagaaatgc

SEQ ID NO: 2640 - DNA, 608 bp, Secale cereale
tcttcttctcctcgcacatccatcatccatgggctccctgggaagcagcgatgacgagaagagaccggcggtggagagcgtgaacacggaggcggcatgcgcactgctggcgtcggagcagtacgggtacgtggacgtgcgcatgtgggaggacttcgaccggggccatgtcgccggcgcgcgcaacgtgccctactacctctccgtcaacccccacggcaaggagcgcaacctggacttcgtggaccaggtcgccgcgctccactcgaaacaggaccggctgatcgttggctgccgctccggagtgcggtccaggctcgccaccgccgacctcgtcgccgccgggttcacgaaggtgaagaacctggagggaggctacctctccttgctcaagagcgtcagttaccagcagcaggcagcagtagccaaccgtcactaattttcttttgtttttaaggctctcaggaataagttaaatggtgatctattattgatgatgtacagagaaaatttcctaggaaaagaaggcattttgtatgtatataaaactatatatgcatcttcgacttggatttgggccaaccaatagtactactgctacccgatta

SEQ ID NO: 2641 - DNA, 1385 bp, Triticum aestivum
aaaacacgcggccccgaagcacgggaaaggaaaggggagagggatcgagattccagcggcgacggcaggcagaaaaggcgttgccgaacagaagcgtcgcgttgggcgggcgagcgagcgagccaagcatccatggcggagcgcaaggaggagtcggtgatggacaagatcacggagaagttccacggggggtcctcctcctcgtcgtcgtccgacgacgaggggaggtcggggtcctcgtcgtccgtcaaggccaagatctaccgcctcttcggccgcgagaagcccgtccactccgtcctcggcggcggcaagcctgccgacctcttcctgtggaggaacaagaagatctctggcggggtgctcgccggcgccaccgccatctggctgctgtttgaggtcctggagtaccacctcctcaccctcctctgccacggcttcatcctcaccctgggcatcctcttcctctggtccaacgcctctgccttcgtcaacaagtgccctcccaacattccagaggtgaagatccctgaggacctggctgtcaatgttgcccgctcgctgcgatacgagatcaacaggggctttgctagcctgagggcgattggtcaaggccgtgacctgaagaaattcttgattgtggttgcaggcctgtggatcctctcttttcttggcagctgctgcaatttcctgaccttgttctacatagtcttcatggtgctttacaccgtgcctgttctgtacgagaagtatgaggacaagatcgatgcttttggagagaaggccatggtcgagctgaagaagtactacgccatcttcgatgagaagtgcctgtccaagattcccaagggtccgtccaaggataagaagcagcattagaacggtagagagtaccctgcgcagatttatcttcaaagttgatcactactcgtcggttttcaaggatggttgtgattccatgtccgtagttgatagtagataccactatctggtcaaaaacctctggcacggtcagtagtcgtgacgtgcaacttctacgaacttaaaaagtcatgccagcttttgctcaatatcctctttccaatgctatggttaacgtagcatcctcacttgcaagttgtgttggtgtaatatggcagtgatgtttgcgactttagtagacttgctacaatgaatgaagtggctcttttgggtgttatgtcattcctggggttcatatccacaatgaagtggctcttttgggtgttatgtcatttggggggtttatatcgtttgttggtgttgatatgcctatgcatccgggaggcttcagttgattcggctgaatgttttgtctatcatgtctgtgtgctgaagcgtctagttaaatttgttggaacacttgt

SEQ ID NO: 2642 - DNA, 1249 bp, Triticum aestivum
aggaaaggagagagggattgagattccagcggcgacggcaggcaggcaggcagaaaaggcgttgccaaacagaagcgtcgcgttggggagagagggggagcggcgggcgagcgagcgaagcatccatggcggagcacaaggaggagtcggtgatggacaagatcacggagaagttccacggcgggtcctcgtcctcctcgtcgtccgacgacgacgagaggaagtcggggtcgtcgtcgtccgtcaaggccaagatctaccgcctcttcggccgcgagaagcccgtccactccgtcctcggcggcggcaagcctgccgacctcttcctgtggaggaacaagaagatctccggtggggtgctcgcgggcgccaccgccatctggctgctgtttgaggtcctggagtaccatctcctcaccctcctctgccacggcttcatcctcaccctgggcatcctcttcctctggtccaacgcctctgccttcgtcaacaagtgccctcccaacattccagaggtgaagatccccgaggacctggctgtcaatgttgcccgctcgctgcgatacgagatcaacaggggctttgctagcctgagggcgattggtcaaggccgtgacctgaagaaattcctgattgtggttgcaggcctgtggatcctctctttccttggcagctgctgcaatttcctgaccttgttctacatagtcttcatggtgctttacaccgtgcctgttctgtacgagaagtatgaggacaagatcgatgcttttggagagaaggccatggtcgagctgaagaagtactacgccatcttcgatgagaagtgcctgtccaagattcccaagggtccgtccaaggataagaagcagcattagaacggtagagagtaccctgcgcagatttactttcaaagttgatcactactcgtcggttttcaaggatggttgtgattccatgtccgtagctgatagtagataccactatctggtcaaaaccctggcacggtcagtagtcatgacgtgcaacttctacgaacttaaaagtcatgccagcttttgctcaatatcctgtttccaattctatgttcaacgtagcatcctcacttgcaagtcgtgttggtgtaatatggcagtgatgtttgcgactttagtagacttgctataatgaatgaagtggctcttttggtgttatgtcattcctggggttcatatccacaatgaagtggcccttttgggtgttatgtcatttg

SEQ ID NO: 2643 - DNA, 1203 bp, Leymus cinereus x Leymus triticoides
  misc_feature (73)..(73): n is a, c, g, or t
gcggcgacggcagaaaaggcgtagccgaacagaagcgttggagagagagaaagaggggagagggagcggcgancgagcgaaccaggccatccatggcggagcacaaggaggagtcggtgatggacaagatcacggagaagctccacgggggctcctcctcgtcgtcttcgtcggacgacgaggggaagtccgggtcgtcgtccgtcaaggccaagatctaccgcctcttcggccgcgagaagcccgtccactccgtcctcggcggcggcaagcctgccgacctcttcctgtggaggaacaagaagatctccggtggggtgcttgcgggcgccacggccatctggctgctgtttgaggtcctggagtaccatctcctcaccctcctctgccacggcttcatcctcaccctgggcatcctcttcctctggtccaacgcctctgccttcatcaacaagtgccctcccaacattccagaggtgaagatacccgaggacctggctgtcaatgttgcccgctcgctgcgatacgagatcaacaggggctttgctagcctgagggccattggtcaaggccgtgacctgaagaaattcctgattgtggttgcaggcctgtggatcctctctgctcttggcagctgttgcaatttcctgaccttgttctacatagtcttcatggtgctttacactgtgcctgttctgtatgagaagtatgaggacaagatcgatgcttttggagagaaggccatggtcgagctgaagaagtactacgccatcttcgatgagaagtgcctgtctaagattcccaagggtccgtccaaggataagaagcagcattagaacgatagagagtaccctgcgcagatttatcttcaaagttgatcactactcgtcggttttcaaggatggttgtgattccatgtccgtagctgatagtagataccactatccggtcaaaaccctggcacgatcagtagtcgtgacgtgcaactttctacgaacgtgaagttatgcgagcttttgctctctatcgtgtttcgaagtctatgtttaatgtagcgtcatcacttgcaagctcgctggtataattatggcagtgatgtttgcgactttaggagacttgctacaatgaagtggctcttttgggtgttatgtcattcctggggtttatatctacaatgaagtggctcttttgggtaaaaaaaaa

SEQ ID NO: 2644 - DNA, 1188 bp, Pseudoroegneria spicata
gcgggagcgacggcaggcaggcagaaaaggcgttgccgaacagaagcgtcgcgttggggagagagagagagggagcggcgggcgagcgaagcaggcgaggccatcgtccatggcggagcacaaggaggagtcggtgatggacaagatcacggagaagttccacggtgggtcctcgtcctcctcctcgtccgacgacgagggcaagtccgggtcgtcgtcgtccgtcaaggccaagatctaccgcctcttcggccgcgagaagcccgtccactccgtcctcggcggcggcaagcctgccgacctcttcctgtggaggaacaagaagatctctggtggcgtgctcgcgggcgctacggccatctggctgctgtttgaggtcctggagtaccatctcctcaccctcctctgccatggcttcatcctcaccctgggcatcctcttcctctggtccaacgcctctgccttcatcaacaagtgccctcccaacattccagaggtgaagatccctgaggatctggctgtcaatgttgcccgctcgctgcgatacgagatcaacaggggctttgctagcctgagggcgattggtcaaggccgtgacctgaagaaattcctgattgtggttgcaggcctgtggattctctcagctcttggcagctgctgcaatttcctgaccttgttctacatagtcttcatggtgctttacactgtgcctgttctgtatgagaagtacgaggacaagatcgatgcttttggagagaaggccatggttgaactgaagaagtactacgccatcttcgatgagaagtgcctgtctaagattccgaagggcctgtccaaggataagaagcagcattagaacggtagagagtaccctgcgcagatttatcttcaaacttaatcaccactcgtcggttttcaaggatggttgtgattccatgtccgtagctgatagtagataccactatctggtcaaaatcctggcactcgacgtgcaacttctacgaacttgaagttatgccttttgctctatatcctgtttcgaagtctatgtttgctacgtagcatcatcagttgcaagttgtgttggtataatatgggagtgatgtttggtacattaggagatggtggctctttggatgtcatgtcattactggggtttatatcgattgttggtgtcgatatgcatca

SEQ ID NO: 2645 - DNA, 1149 bp, Secale cereale
agagggaagagcgagcggcgagagcgagagagcatccatggcggagcacaaggaggagtcggtgatggacaagatcacggagaagttccacggggggtcctcgtcctcctcctcgtcgtcggacgacgaggggaggtcgggggcgcagtcgtcgtcgtccgtcaaggtcaagatctaccgcctcttcggtcgcgagaagcccgtccactccgtcctcggcggcggcaagcctgccgacctcctcctgtggaggaacaagaagatctctggcggtgtgcttgcgggcgccacagccatctggttgctgtttgaggtcctggagtaccatctcctcaccctcctctgccacggcttcatcgtcaccctgggcatactcttcctctggtccaacgcctctgccttcatcaacaagtgccctcccaacattccagaggtgaagatccctgaggacctggctgtcaatgttgcccgctcgctgcgatacgagatcaacaggggctttgctagcctcagggccattggccaaggccgtgacctgaagaaattcctgattgtggttgcaggcctgtggatcctctctgctcttggcagctgctgcaatttcctgaccttgtcctacatagtcttcatggtgctttacaccgtgcctgttctgtacgagaagtacgaggacaagatcgatgcttttggagagaaggccatggtcgagctgaagaagtactacgccatcttcgatgagaagtgcctgtccaagattcccaagggcccgtccaaggataagaagcagcattagaacggtagagagtaccctgcgcagatttatcttcaaagttgatcactactcgtcggttttcaaggatggttgtgattccatgtcggtagctgatagtagataccactatctggtcaaaaaaccctggcacggtcagtagtcgtgacgtgcaacttgtacgaacttaaaagcttttgctcaatatcctgtttccagttctatggttaacgtagcatcctcacttgcaagttgtgttggtgtaatatggcagtgatgtttgcgactttactagacttgctacaatgaatgaagtggcgcttttggtgttatgtcgttactggggttcatatccacaatgaagttgctcttttgggtgt

SEQ ID NO: 2646 - DNA, 1299 bp, Secale cereale
acggcaggcagaaaaggcgttgccaaacagaagagggaagagcgagcggcgagagcgagagagcatccatggcggagcacaaggaggagtcggtgatggacaagatcacggagaagttccacggggggtcctcgtcctcctcctcgtcgtcggacgacgaggggaggtcgggggcgcagtcgtcgtcgtccgtcaaggccaagatctaccgcctcttcggccgcgagaagcccgtccactccgtcctcggcggcggcaagcctgccgacctcctcctgtggaggaacaagaagatctctggcggtgtgcttgcgggcgccacagccatctggttgctgtttgaggtcctggagtaccatctcctcaccctcctctgccacggcttcatcgtcaccctgggcatactcttcctctggtccaacgcctctgccttcatcaacaagtgccctcccaacattccagaggtgaagatccctgaggacctggctgtcaatgttgcccgctcgctgcgatacgagatcaacaggggctttgctagcctgagggccattggccaaggccgtgacctgaagaaattcctgattgtggttgcaggcctgtggatcctctctgctcttggcagctgctgcaatttcctgaccttgtcctacatagtcttcatggtgctttacaccgtgcctgttctgtacgagaagtatgaggacaagatcgatgcttttggagagaaggccatggtcgagctgaagaagtactacgccatctttgatgagaagtgcctgtccaagatccccaagggcccgtccaaggataagaagctgcattagaacggtagagagtaccctgcgcagatttatcttcgaagttgatcactactcgtcggttttcaaggatggttgtgattccatgtcggtagctgatagtagataccactatctggtcaaaaaaccctggcacggtcagtagtcgtgacgtgcaacttctacgaacttaaaagcttttgctcaatatcctgtttccagttctatggttaacgtagcatcctcacttgcaagttgtgttggtgtaatatggcagtgatgtttgcgtactttactgacttgctacaatgaatgaagtggctctttaaggtaaaaaaagttaaaaaaaaaaaaaaaaaaaaaaacaaaaaaaaaaaaaaaaaaaataaaaaaaaaaaaaagaaaaaaaaaataaaaataacacgtagtacgtagactacgatacgtataccgagtacgacgtacacgacgacaagaccgaaggagtagagacacgtcatca

SEQ ID NO: 2647 - DNA, 1174 bp, Secale cereale
gattccagcggcgactgcaggcagaaaaggcgttgccgaacagaagagggagagagagcggcgaccgagcgagcgagcgagcatccatggcggagcacaaggaggagtcggtgatggacaagatcacggagaagttccacggggggtcctcgtcctcctcctcgtcgtcggacgacgaggggaggtcggggacgcagtcgtcgtcgtccgtcaaggtcaagatctaccgcctcttcggtcgcgagaagcccgtccactccgtcctcggcggcggcaagcctgccgacctcctcctgtggaggaacaagaagatctctggcggtgtgcttgcgggcgccacagccatctggttgctgtttgaggtcctggagtaccatctcctcaccctcctctgccacggcttcatcgtcaccctgggcatactcttcctctggtccaacgcctctgccttcatcaacaagtgccctcccaacattccagaggtgaagatccccgaggacctggctgtcaatgttgcccgctcgctgcgatacgagatcaacaggggctttgctagcctgagggccattggccaaggccgtgacctgaagaaattcctgattgtggttgcaggcctgtggatcctctctgctcttggcagctgctgcaatttcctgaccttgtcctacatagtcttcatggtgctttacaccgtgcctgttctgtacgagaagtatgaggacaagatcgatgcttttggagagaaggccatggtcgagctgaagaagtactatgccatcttcgatgagaagtgcctgtccaagattcccaagggcccgtccaaggataagaagcagcattagaacggtagagagtaccctgcgcagatttatcttcaaagttgatcactactcgtcggttttcaaggatggttgtgattccatgtccgtagctgatagtagataccactatctggtcaaaaaaccctggcacggtcagtagtcgttacgtgcaacttctacgaacttaaaagcttttgctcaatatcctgtttccagttctatggttaacgtagcatcctcacttgcaagttgtgttggtgtaatatggcagtgatgtttgcgactttactagacttgctacaatgaatgaagtggcgctttttggtgttatagtaacaaaaaaaaaaaaaaaa

SEQ ID NO: 2648 - DNA, 1196 bp, Secale cereale
agggattccagcggcgacggcaggcagaaaaggcgttgccaaacagaagagagaaagaggggagagggagcggcgagcgagcatccatggcggagcacaaggaggagtcggtgatggacaagatcacggagaagttccacggggggtcctcgtcctcctcctcctcgtcggacgacgaggggaggtcggggacgcagtcgtcgtcgtccgtcaaggtcaagatctaccgcctcttcggtcgcgagaagcccgtccactccgtcctcggcggcggcaagcctgccgacctcctcctgtggaggaacaagaagatctctggcggtgtgcttgcgggcgccacagccatctggttgctgtttgaggtcctggagtaccatctcctcaccctcctctgccacggcttcatcgtcaccctgggcatactcttcctctggtccaacgcctctgccttcatcaacaagtgccctcccaacattccagaggtgaagatccccgaggacctggctgtcaatgttgcccgctcgctgcgatacgagatcaacaggggctttgctagcctgagggccattggccaaggccgtgacctgaagaaattcctgattgtggttgcaggcctgtggatcctctctgctcttggcagctgctgcaatttcctgaccttgtcctacatagtcttcatggtgctttacaccgtgcctgttctgtacgagaagtatgaggacaagatcgatgcttttggagagaaggccatggtcgagctgaagaagtactacgccatcttcgatgagaagtgcctgtccaagattcccaagggcccgtccaaggataagaagcagcattagaacggtagagagtaccctgcgcagatttatcttcaaagttgatcactactcgtcggttttcaaggatggttgtgattccatgtcggtagctgatagtagataccactatctggtcaaaaaaccctggcacggtcagtagtcgtgactgtgcaacttctacgaacttaaaagcttttgctcaatatcctgtttccagttctatggttaacgtagcatcctcacttgcaagttgtgttggtgtaatatggcagtgatgtttgccactttactagacttgctacaatgaatgaagtggcgtcgttttggtgttatggtctattacgtggggtttcagttataccaaaaagcgagggg

SEQ ID NO: 2649 - DNA, 1175 bp, Secale cereale
gcgagagagcatccatggcggagcacaaggaggagtcggtgatggacaagatcacggagaagttccacggggggtcctcgtcctcctcctcgtcgtcggacgacgaggggaggtcgggggcgcagtcgtcgtcgtccgtcaaggccaagatctaccgcctcttcggccgcgagaagcccgtccactccgtcctcggcggcggcaagcctgccgacctcttcctgtggaggaacaagaagatctctggcggggtgctcgcgggcgccacggccatctggctgctgtttgaggtcctggagtaccatctcctcaccctcctctgccacggcttcatcgtcaccatgggcatcctcttcctctggtccaacgcctccgccttcatcaacaagtgccctcccaacattccagaggtgaagatccccgaggacctggctgtcaatgttgcccgctcgctgcgatacgagatcaacaggggctttgctagcctgagggccattggccaaggccgtgacctgaagaaattcctgattgtggttgcaggcctgtggatcctctctgctcttggcagctgctgcaatttcctgaccttgtcctacatagtcttcatggtgctttacaccgtgcctgttctgtacgagaagtatgaggacaagatcgatgcttttggagagaaggccatggtcgagctgaagaagtactacgccatcttcgatgagaagtgcctgtccaagattcccaagggcctgtccaaggataagaagcagcattagaacggtagagagtaccctgcgcagatttatcttcaaagttgatcactactcgtcggttttcaaggatggttgtgattccatgtcggtagctgatagtagataccactatctggtcaaaaaaccctggcacggtcagtagtcgtgactgtgcaacttctacgaacttaaaagcttttgctcaatatcctgtttccagttctatggttaacgtagcatcctcacttgcaagttgtgttggtgtaatatggcagtgatgtttgccactttactagacttgctacaatgaatgaagtggcgcttttggtgttatgtcattactggggttcatatccacaatgaagtggctcttttgggtgttatgtcattcgtggggtttatatcgtttgttggtgttggtatgccaaa

SEQ ID NO: 2650 - DNA, 1171 bp, Secale cereale
ggggcgccgactgcgcgacgcagcagaaaggcgtgaccaacagagaggaagagcgagcggcgagagcgagagagcagtccagtcggacggtagcacaaggaggagtcggtagatggacaagatcacggagaattccgacgggggtccgtcgtcctcctcgtacgtcgtcggacgacgagggaggtcgggggcgcagtcgtcgtcgtccgtcaaggccaagatctaccgcctcttcggccgcgagaagcccgtccactccgtcctcggcggcggcaagcctgccgacctcttcctgtggaggaacaagaagatctctgggggggtgctcgcgggcgccacggccatctggctgctgtttgtaggtcctcggagtaccactctcctcaccctcctcctgccacggcttcatcgtcaccactgggcatcctcttcctctggtccaacgcctccgccttcatcaacaagtgccctcccaacattccagaggtgaagatccccgaggacctggctgtcaatgttgcccgctcgctgcgatacgagatcaacaggggctttgctagcctgagggccattggccaaggccgtgacctgaagaaattcctgattgtggttgcaggcctgtggatcctctctgctcttggcagctgctgcaatttcctgaccttgtcctacatagtcttcatggtgctttacaccgtgcctgttctgtacgagaagtatgaggacaagatcgatgcttttggagagaaggccatggtcgagctgaagaagtactacgccatcttcgatgagaagtgcctgtccaagattcccaagggcccgtccaaggataagaagcagcattagaacggtagagagtaccctgcgcagatttatcttcaaagttgatcactactcgtcggttttcaaggatggttgtgattccatgtcggtagctgatagtagataccactatctggtcaaaaaaccctggcacggtcagtagtcgtgactgtgcaacttctacgaacttaaaagcttttgctcaatatcctgtttccagttctatggttaacgtagcatcctcacttgcaagttgtgttggtgtaatatggcagtgatgtttgccactttactagacttgctacaatgaatgaagtggcgcttttggtgttatgtcattactggggtt

SEQ ID NO: 2651 - DNA, 1146 bp, Lolium multiflorum
agagagagaagagagcagaggacctgcctggccatggcggagcacaaggaggagtcggtgatggacaagatctccgagaagttccacgggtcctcctcctcctccgactccgacggcgagggcaagtccgccgccgccgccgtcaaggccaagatctaccgcctcttcggccgcgagaagcccgtccactccgtcctcggcggcggcaagcctgccgatctcttcctgtggaggaacaagaagatctcgggcggggtgctcgcgggcgccacctccatctggctgctgttcgaggtcctggagtaccacctcctcacactcttctgccactgcctcatcctcaccctcggcaccctcttcctctggtcaaacgcatccgcattcatcaacaaggcccctcctaacattcccgaggtgaagatcacggaggacctggctgtcaatgttgcccgctcgctgagatatgagatcaacaggggcttcgctagcttgagggcgattggtcaaggccgtgacctaaagaaattcctgattgtgattgcaggtctgtggattctctctgctcttgggagctgctgcaatttcctgaccttgttctacatagtcttcatggtgctctacactgtgccggtcctgtatgaaaagtacgaggacaagattgatgcttttggagagaaggccatggtcgaactgaagaagtactacgccatctttgacgagaagtgcctgtctaagattcccaagggtccgtcgaaagacaagaagcattagagcggtggagagagtatttgcgcagatttatcttctctgctgatcactactcgtcggttttcaaggatggttgtgattccaaatctgtagttgatagtaggtacctgtttggtcaaatcctggcacggtcagtagtcaactagtcgtgaccgtgcctgcttctacgaacttatgttatgccagcttttgctctataacctatcttgggagtggtttaaggtagcgcatcctcaattgcaacgtctgtgttcgaatgctactatcagtgggagtcatgttagtggtatgaggagactttgctaatgttgttctttggtgctagatgtgcatgtcacccctgtggttttaaatcattggttcttttcgcctcgtgcc

SEQ ID NO: 2652 - DNA, 1129 bp, Avena sativa
ggaggaagagaatacgggagagcgcgtggccatggcggagcacaaggaggagtcggtgatggacaagatctcggagaagctccacgggtcctcctcctcctcggggtccgacgacgagggcaggtcgtcctcgccgtcggccgcggccgccgtcaaggccaagatctaccgcctcttcggccgcgagaagcctgtccactccgtcctcggcggcggcaagcctgccgatctcttcctgtggaggaacaagaagatctctggtggggtgctggcgggtgccacctccatctggctgctgtttgaggtcctggagtaccatctcctcaccctcttctgccactgcctcatcctcaccctgggcaccctcttcctctggtccaacgcctctgcattcatcaacaagtcccctcctaacattcctgaggtaaagatcccagaggacctggctgtcaatgttgcccgctcgctgagatatgagatcaacaggggctttgctagcttgagggcaattggtcaaggccgtgacctgaagaaattcctgattgtgattgcaggtctgtggatcctctctgctcttgggagctgctgcaatttcctgaccttgttctacatagtcttcatggtactgtacactgtgccggttctgtacgagaagtatgaggacaagatcgatgcttttggagagaaggccatggtcgaactgaagaagtactatgccatcttcgatgagaagtgcctgtccaagattcccaagggaccgtcgaaagacaagaagcattagagccacggagagtgctctgcgcagaactcgtcttctctgttgatcactactcgtcgtttttcaaggatggttgtgattccatgtccgtagttgatagtagattacctatctggtcgaatccttgcgcgcgatcagaagtcatggcgtgcaacttctatgaacttatgtcctgccagcttttgctctatatcctgctttgaagtctgtttagcgtagcatcctcacttgcaagttgttggtgttagaatgctaccagtgggagtgatgcttgtggtactattaggagacttctataattaagtggctcgttggtgctagtctgctagatatgcatgcatgtcatccctt

SEQ ID NO: 2653 - DNA, 1139 bp, Avena sativa
gaagagagaggaagggaatacgggagagcgcgtggccatggcggagcacaaggaggagtcggtgatggacaagatctcggagaagctccacgggtcatcctcctcctcggggtccgacgacgagggcaggtcgtcgtcgccgtccgccgcggccgccgtcaaggccaagatctaccgcctcttcggccgcgagaagcccgtccactccgtcctcggcggcggcaagcctgccgatctcttcctgtggaggaacaagaagatctctggtggggtgctcgcgggtgccacctccatctggctgctgtttgaggtcctggagtaccatctcctcaccctcttctgccactgcctcatcctcaccctcggcaccctcttcctctggtccaacgcctctgcgttcatcaacaagtcccctcctaacattcctgaggtaaagatcccagaggacctggctgtcaatgttgcccgctcgctgagatatgagatcaacaggggctttgctagcttgagggcgattggtcaaggccgtgacctgaagaaattcctgattgtgattgcaggtctgtggatcctctctgctcttgggagctgctgcaatttcctgaccttgttctacatagtcttcatggtactgtacactgtgccggttctgtatgagaagtatgaggacaagattgatgcttttggagagaaggccatggtcgaactgaagaagtactacgccatcttcgatgagaagtgcctgtccaagattcccaagggaccgtcgaaagacaagaagcattagagccactgagagtgctcggcgcagaactcatcttctctgttgatcactactcgtcggttttcaaggatggttgtgattccatgtccgtagttgatagtagatacctatctggtcggatccttgcgcggtcagtagtcgtgacgtgctacttcttcgaacttgtgttatgccagcttttgctctatatcctgctttgaagtctttttagcgtagcatcctcacttgcaagttgttggtgttagaatgctatcagtgggagtgatgcttgtggtactattaggagacttctacaattaagtggctcgttggtgctagtctgctagatatgcatgcatgtcatcccttgtttgct

SEQ ID NO: 2654 - DNA, 1835 bp, Brachypodium distachyon
aagcggcaggcttccgcgagcgttggcttgcacggccgatcgtgctgggatcgacggctgaggacgcgtcacgcggcgcacaaaacacgcggcccggagcacgggaaagggaaaaagcggagaaggcgtcgccgaacagaagcattcgaacggagagaaagagagagatagtaaggagagagcagaggtaagccatggcggagcacaaggaggagtcggtgatggacaagatctcggagaagctccacggtgggtcctcgtcggggtcggacgacgagtcgtcttcggccgccgccgccgtcaaggccaagatctaccgcctcttcggccgcgagaagcccgtccactccgtcctcggcggcggcaagcctgctgatctcttcctatggaggaacaagaagatctctggtggcgtgcttgcgggcgccactgccatctggctgctgtttgaggtcatggaataccatctcctcaccctcttgtgccactgcttcatcctcaccctgggcatcctcttcctctggtccaacgcctctgcattcatcaacaaatcccctcctaacattcctgaggtgaggattccggaggaccttgctgtcaatgttgcgcgatcactgagatacgagatcaacaggggctttgctagcttgagggatattggccaaggccgtgacctaaagaaattcctgattgtgattgcaggtctgtggactctctctgctcttggaagctcctgcaattttctgaccttgttctacatagtctttatggtgctgtacaccgtgccggttctgtatgagaagtatgaggacaagattgatgcttatggagagaaggccatgatcgaactgaagaaatattatgccatcttcgacgagaaatgcctgtctaagattccaaagggtccgtcaaaagataagaagcattagaaggagtatcttgtgcaggatgtatcctctctgttgatcactaaggatggttgtgattccatgtctgtagttgatagtagacaccttatttggaccttagtgtggtcagtagtcgtgacgtgcaacttctacaaacttatgttatgccagctttttctctatatcctgttttgcgatctatcttttaacatagcattcacacttgcttgttgttggtgctggaatgtgtgaaggatgtgttggtgttggaatacataaaaaaatctggtcaaattttgacatagcatgcacacttgttagttgttggtgctgcaatgtgtgaaggatgtgtttgtgttggaatacatgaagaaaatctggtcaaattttcgttgttaatatggattcctttgttataagcgcagctaaaaccttttgcttgggtgaatgcacggatgacttgatcgatttcatgatatactgctaacgtttcaatccattcttggatatgtataccttgtgctttgattctgattaattgtgaagcagaaattacggtgcagggaaatactctgtttgctcatgtcagtaacatcctcgcttcttggtaaaaaaaaaaacattctcacttgctaatgaaaaactactgccaatagcattggagcacaacttataagcttgggttccgcccattgagcctttcatagagttgtagtcagtggtcaaaaacagtgcacaactacggtataacaaaactaattagtaaagcaaatttacaagactaatctcagtccaaatgacaactccaaaatcgtctcgacgtattatcttcagaatcactatctgtatcatcactgtcagatgatgaagatagccgaccatgagagttcaatatgtaacctgtaacctggtccaggaaggagtgca

SEQ ID NO: 2655 - DNA, 1060 bp, Secale cereale
ggggggtcctcctcgtcgtcctcgtcggacgacgaggggaagtcggggtcgcagtcgtcgtcgtccatcaaggccaagatctaccgcctcttcggccgcgagaagcccgtccactccgtcctcggcggcggcaagcctgccgacctcttcctgtggaggaacaagaagatctctggcggggtgctcgcgggcgccacggccatctggctgctgtttgaggtcctcggagtaccactctcctcaccctcctctgccacggcttcatcgtcaccatgggcatcctcttcctctggtccaacgcctccgccttcatcaacaagtgccctcccaacattccagaggtgaagatccccgaggacctggctgtcaatgttgcccgctcgctgcgatacgagatcaacaggggctttgctagcctgagggccattggccaaggccgtgacctgagaaattcctgattgtggttgcaggcctgtggatcctctctgctcttggcagctgctgcaatttcctgaccttgtcctacatagtcttcatggtgctttacaccgtgcctgttctgtacgagaagtatgaggacaagatcgatgcttttggagagaaggccatggtcgagctgaagaagtactacgccatcttcgatgagaagtgcctgtccaagattcccaagggcccgtccaaggataagaagctgcattagaacggtagagagtaccctgcgcagatttatcttcgaagttgatcactactcgtcggttttcaaggatggttgtgattccatgtcggtagctgatagtagataccactatctggtcaaaaaaccctggcacggtcagtagtcgtgacgtgcaacttctacgaacttaaaagcttttgctcaatatcctgtttccagttctatggttaacgtagcatcctcacttgcaagttgtgttggtgtaatatggcagtgatgtttgcgactttactagacttgctacaatgaatgaagtggcgcttttggtgttatgtcattactggggttcatatccacaatgaagttgctctttgggttgttatg

SEQ ID NO: 2656 - DNA, 1138 bp, Panicum virgatum
gagagagaggcgaaaagcaggcaggagcttgttgctggtgttgctcgtacgcgtccggagagcgaaggggagggtgcgagcgagcgagcgagcggtggccatggcggagcagcacaaggaggagtcggtgctggagaagatctcggacaagctccacggccgcgggggcggcggctcatcgtcgtcgtcggactcggacgacgaccgctcgtcggcgacggccgcggtgaaagccaagatctaccgcctcttcggccgcgagaagcccgtccactccgtcctcggcggcggcaagcctgccgatctgtttctatggaggaacaagaagatttctggtggtgtgcttgccggcgcaactgccatctggctgctgtttgaggtcatggactaccacctgctcaccctgttatgccactgcctcatcctcaccctggccatcctgttcctctggtcgaatgccaccactttcatcaacaagtctcctcctaacatccctgaggtgaagatcccagaggacctggcagtgaatgttgcacgttcactgagatacgagatcaacaggggctttgctaccttgagggagatcggtcagggccatgacctgaagaagtttctgattgtaattgcaggactgtggatcctttccgttcttgggacctgctgcaatttcctcaccttgttctacatagtctttatggttttgtacactgtgccggtcctgtatgagaagtatgaggataaggttgatgcttttggagagaaggccatggtcgagctgaagaagtactacgccatcttcgacgagaaatgcctatcaaagattccgaagggtccgtcaaaagacaagaagctgcattagaagagtagaatcagaggatggtctgtgcactgatttatcatctgtcaatcactacatgtcggttttgaagtatggttgtaattccatgtctccatgtaatggtaaatatttagagatgaacgcacgtgttctagtgtggtcagtagttgcgttgtgcgaaattattccaatctgaaacttcatgttttaacatcccgcctctccaagtggctggttccgttacatggccagacttagggttatgatgaaatttttatttggttatttacgtctttctgc

SEQ ID NO: 2657 - DNA, 1076 bp, Cenchrus ciliaris
  misc_feature (78)..(78): n is a, c, g, or t
  misc_feature (760)..(760): n is a, c, g, or t
  misc_feature (770)..(770): n is a, c, g, or t
  misc_feature (779)..(780): n is a, c, g, or t
  misc_feature (817)..(817): n is a, c, g, or t
  misc_feature (831)..(831): n is a, c, g, or t
  misc_feature (842)..(842): n is a, c, g, or t
  misc_feature (854)..(855): n is a, c, g, or t
  misc_feature (949)..(949): n is a, c, g, or t
  misc_feature (953)..(953): n is a, c, g, or t
  misc_feature (963)..(963): n is a, c, g, or t
  misc_feature (977)..(977): n is a, c, g, or t
  misc_feature (981)..(981): n is a, c, g, or t
  misc_feature (988)..(988): n is a, c, g, or t
  misc_feature (993)..(993): n is a, c, g, or t
  misc_feature (998)..(998): n is a, c, g, or t
gaaagcttgttgctggtgttatttgtacggcacacgcgtttggacttcggagagccagagggggaaggagaagaagcnagcgagcggtggccatggcggagcagcacaaggaggagtcggtgctggagaagctctcggacaagctccacggccgcgggtcctcgtcgtcgtcggactcggacgacgagcgctcgtcggcgacggccgccgtgaaggccaagatctaccgcctcttcggccgggagaagcccgtccactccgtcctcggcggcggcaagcccgctgatttgtttctatggaggaacaagaagatttctggtggggtgcttgcgggcgcgactgccatctggctgctgtttgaggtcatggactaccacctcctcaccctgttgtgccactgcctaatcctcacccttgccatcctgttcctctggtccaatgccaccactttcatcaacaagtcccctcctaatatccctgaggtgaagatcccagaggacctggctgtgaatgttgcgcgttcgctgagatatgagatcaacaggggctttgctaccttgagggaaatcggccaaggccatgacctgaagaagtttctgatcgtggttgcaggactgtggatcctttctgttcttgggagctgctgcaacttcctcaccttgtcctatatagtctttatggttttgtacactgtgccggttctgtatgagaagcatgaggataaggttgatgcttttggagagaaggctatggtcgagtngaagaaatantatgccatnntggacgagaaatgcctatcaaagattcccaagggccngtcaaaagacaagnagcagcattanaagagtagaatnngggaagggtccgtgcccttatttatcatttctgtcaatcaccacatgtgggttttgaaggatggttttagttccatacttccatgcctccatgngatngtaaataccnacatgtacgtgttntagngtggtcngtagntgcgntgtgataagttatgtaagcttaatgctgaaccgttttttccaatttgaaaactccatgttccaagtggttggttccta

SEQ ID NO: 2658 - DNA, 1339 bp, Setaria italica
atggacttggcccgcaagaataggcctagaagcttctgtgagagtttcttggcccacgccgccgaccccctcctctgcgctcggatgccggcgaagtcctggcacgccacgcgtcgtcacgtcgccgtgtcgccctcgcgatctccaccccgcgggcccaccatgcaggacatgggacggtgggtccaaaggtgtgggcctaagccgtggggacgcgcgcggcgcaaaagcttgttgctggtgttgttcgtacggcaaacgcgtttggactttggagagcgaggggagggggaaggagcgagcgagcgagcggtggccatggcggagcagcacaaggaggagtcggtgctggagaagctctcggacaagctccacggccgcggaggcgggtcctcgtcgtcgtcgtcggactcggacgacgagcgctcgtcggcgacgaccgccgtgaaggccaagatctaccgcctcttcggccgcgagaagcccgtccactccgtcctcggcggcggcaagcccgctgatctgtttctatggaggaacaagaggatttctggtggggtgcttgcgggcgcgactgccatctggctgctgtttgaggtcatggactaccacctcctcaccctgctgtgccactgcctcatcctcacccttgccatcctgttcctctggtccaatgccaccactttcatcaacaagtcccctcctaacatccctgaggtgaagattccagaggacctggctgtgaatgttgcgcgttcgctgagatatgagatcaacaggggctttgctaccttgaggggaatcggccaaggccatgacctgaagaagtttctgattgtggttgcaggactgtggatcctttccgttcttgggagctgctgcaatttcctcaccttgtcctatatagtctttatggttttgtacactgtgccggttctgtatgagaagcatgaggataaggttgatgcttttggagagaagaccatggtcgagttgaagaaatactacgccatctttgacgagaaatgcctatcaaagattccgaagggcccgtcaagagacaagaagcagcattagaagagtagaatcagggaagggtctgtgcgctgatttatcatctctgtcaatcactacatgtgggttttgaaggatggttttagttccatgtctccatgtgatggtaaatacctacatgttcctgttctagtgtggtcagtagttgcgatgtgctaaattatgcaagcttacgctttactgtggttcttcaatctgaaactccatgttgtcttacctgcccagacttagggctatgatgaaatggttcttcgttatttttgtc

SEQ ID NO: 2659 - DNA, 1921 bp, Panicum virgatum
ccgagtgctttcctactcaggttgcttaattgttcaaaaaagttgtgcgaccaactttttccccctcttgttccgaagtcaacagaaggaagttctcgtttccttagcctaaaagacaccaaaaatacctttgataataagaaacaagggccaaaagaatccatttgcttgactacaaaagctaacttagattggacttggcccgcaagaacaggccaagaagcccacgcctagaagcttctgcgtgcgatgtactacgagtacccttctccttggcccacgccccgacccctccgctacgcccggatgccggcgaaactcctgccacgccacgtgtcatcacgtcgccgtgtcgccctcgcgatctccacctccgcggggcccacccaggacatggggggcgtgacggcgtggagagggcgctacccccggggtccaccgattcatccaccctacgctggcttacaggtgggccgcgagccaactccgtcgccgtggagacttggctcgcggcgttacgttggcacgtaaccgcgcgaataaatgacgctagattaacgcaggacgaatcacacggcccggcgcgacggagccgacggccgagatcgcgccgcgccgcgccgcgccgcgcataaaggacgccgcccgagcacggcggtggggagagaggcgaaaagcaggcaggcaggagcttgttgctggtgttgctcgtacgcgtccggagagcgaagggaaggggagggtgcgagcgagcgagcgtcagcgagcggtggccatggcggagcagcacaaggaggagtcggtgctggagaagatctcggacaagctccacggccgcgggggcggctcctcctcatcatcgtcggactcggacgacgaccgctcgtcggcgacggccgcagtgaaggccaagatctaccgcctcttcggccgcgagaagcccgtccactccgtcctcggcggcggcaagcctgccgatctgtttctatggaggaacaagaggatttctggtggtgtgcttgccggcgcaactgccatctggctgctgtttgaggtcatggactatcacctgctcaccctgctgtgccactgcctcatcctcaccctggccatcctgttcctctggtcgaatgccaccactttcatcaacaaatctcctcctaacatccctgaggtgaagatcccagaggacctggcagtgaatgttgcgcattcactgagatacgagatcaacaggggctttgctaccttgagggagatcggtcaaggccatgacttgaaaaagtttctgattgtgattgcaggactgtggatcctttctgtccttgggagctgctgcaatttcctcaccttgttctacatagtctttatggtattgtacactgtgccagtcctgtatgagaagtatgaggataaggttgatgcttttggagagaaggccatggtcgagctaaaaaagtactacgccatcttcgacgagaaatgcctatcaaagattccaaagggtccgtcaaaaggcaagaagctgcattagaagagtagaatcagaggatggtctgtgcactgatttatcaatctgtcaatcactacatgtcggttttgaagtatggttgttgttccatgtctccatgtaatggtaaatacatagatgaacgcacgtgttctggtgtggtcagtagttaagatgtgttaaattgttcgaatctggaacttcatgttttaacgtcccttctgctccaggtggctggttccttaagtatcttacatggccagacttagggttataatgaaatggttctggttgtataagtcttcctcgagcttccatttatgcctttttggtagctttggtttgactcaattgcagtcattgtgcatttatgctgaaaacagtatgatatttactgaccggagtatccaa

SEQ ID NO: 2660 - DNA, 1117 bp, Panicum virgatum
gcaggcaggagcttgttgctggtgttgctcgtacgcgtccggagagcgaagggaaggggagggtgcgagcgagcgagcgagcgtcagcgagcggtggccatggcggagcagcacaaggaggagtcggtgctggagaagatctcggacaagctccacggccgcgggggcggctcctcctcatcatcgtcggactcggacgacgaccgctcgtcggcgacggccgcagtgaaggccaagatctaccgcctcttcggccgcgagaagcccgtccactccgtcctcggcggcggcaagcctgccgatctgtttctatggaggaacaagaggatttctggtggtgtgcttgccggcgcaactgccatctggctgctgtttgaggtcatggactaccacctgctcaccctgctgtgccactgcctcatcctcaccctggccatcctgttcctctggtcgaatgccaccactttcatcaacaaatctcctcctaacatccctgaggtgaagatcccagaggacctggcagtgaatgttgcgcattcactgagatacgagatcaacaggggctttgctaccttgagggagatcggtcaaggccatgacttgaaaaagtttctgattgtgattgcaggactgtggatcctttctgtccttgggagctgctgcaatttcctcaccttgttctacatagtctttatggtattgtacactgtgccagtcctgtatgagaagtatgaggataaggttgatgcttttggagagaaggccatggtcgagctaaaaaagtactacgccatcttcgacgagaaatgcctatcaaagattccaaagggtccgtcaaaaggcaagaagctgcattagaagagtagaatcagaggatggtctgtgcactgatttatcaatctgtcaatcactacatgtcggttttgaagtatggttgtagttccatgtctccatgtaatggtaaatacatagatgaacgcacgtgttctggtgtggtcagtagttaagatgtgttaaattgttcgaatctggaacttcatgttttaacgtccctcctgctccaggtggctggttccttaagtatcttacatggccagacttagggttataatgaaat

SEQ ID NO: 2661 - DNA, 1202 bp, Saccharum officinarum
gcgaaaagcttgtcgctggcgttgctcgtagtacgggtacggcagccgcgtgtggagcaagggccaaggagggagaggggagccagcgagcgggcaggcggtggcagccatggcggagcagcacagggaggagtcgggcgcgtcggtgatggacaagatctcggacaagctccacggccgcgggggtggctcgtcgtcgtcgtcggactcggacgacgagcgctcgtcggcgacggccgccgtgaaggccaagatctaccgcctcttcggccgcgagaagcccgtccactccgtcctcggcggcggcaagccggcggatctgtttctatggaggaacaagaggatctctggtggggtgctcgcaggcgcaactgccatctggctgctgtttgaggtcatggattaccatctccttaccctgctatgccactgcctcatcctcaccctggccatcctgttcctttggtccaatgccacgactttcatcaacaagtctcctcctaacatccctgaggtgaagatcccagaggacctggctgtgaatgttgcacgttccctgagatatgagatcaacagggggttcgctaccctgagggagatcggccaaggccatgacctgaagaaatttctgattgtgattgcaggactgtggatcctttctgttcttgggagctgctgcaatttcctcaccttgtcttacatagttttcatggtattgtacactgtgccgatcctgtatgagaagcatgaggataaggttgatgcttttggtgagaaggccatggtcgagctgaagaagtactacgccatcttcgacgagaaatgcctatcaaagattccgaagggcccattaaaagacaagaagcaacattagaagagtagaatgagataagggtctggggtgatttatcatctcttttgatcattactttgtcggttttgaaggatggatgtgattccatgtctccatgtgatggtaagtacctggacgtgttctagtgtattagttgggtcagtagcaatgtgctaaattatctaaggttacgcagaattgtgttctgaattccatgtttgacattaccctccttggaagtggtggtttcctcgttgtctgtaatatatatccagtgctatttcataactggacctaggctacgatgaattgttctcggtggttattgatataccccccgttctaaatt

SEQ ID NO: 2662 - DNA, 1121 bp, Pennisetum glaucum
gagagggagaaaacgaacagcaggcgagagacgcgaaagcttgttgctggtggtattcgcacggcacacgcgtttggacttcggagagccaggggaagaagcaagcgagcggtggccatggcggagcagcacaaggaggagtcggagctggagaagctctcggacaagctccacggccgcgggggcgggtcctcctcgtcgtcgtcggactcggacgacgagcgctcgtcggcgacggccgccgtgaaggccaagatctaccgcctcttcggccgcgagaagcccgtccactacgtcctcggcggcggcaagcctgctgatctgttcttatggaggaacaagaagatttcgggtggggttcttgcaggcgtgactgccatctggctgctgtttgaggtcatggactaccacctcctcaccctgttgtgccactgcctcatcgtcacccttgccatcctgttcctctggtccaaagccaccactttcattaacaagtcccctcctaacatccctgaggtgaagatcccagaggacctggctgtgaatgttgcgcgttcgatgagatatgagatcaacaggggctttgctaccttgagggaaatcggccaaggccatgacctgaagaagtttctgattgtggttgcaggattgtggatcctttctgttcttgggagctgctgcaatttcctcaccttgtcctatatagtgtttatggttttgtacactgtgccggttctgtatgagaaacatgaggataaggttgatgctttcggagagaaggccatggtcgagttgaagaaatactacgccatcctcgatgagaaatgcctatcaaagattcccaagggcccgtcaaaagacaagaagcagcattagaagagtagaatcagggaaggttctgtgcgcttatttatcgtctctgtcaatcactacatgtgggttttgaaggatgatgttagtctcatgcctccatgtgatggtaaataccaacatgtacgttttctagtgtggtcagtagttggctagttgcaatgtgataaattatgcaagctttacgtaagctttacgtcgaaccgtgtatcttacatgcccagacttaaggctatgatgaaattgttctt

SEQ ID NO: 2663 - DNA, 1821 bp, Triticum aestivum
ggccagacacgtatatcggcggctacgtccaggtcaacaggcagggggagactcggcgagagatcaatggaaggttatcgtggccggccatggaccaggctaccggcgctgctgctggcctgcgccgccgccgctgccgtgggcgagtgcagggtggtgcacgtgggagaggcgcaccggcggagcatgctggccaatggcctcggcgcgacgccccccatggggtggaacagctggaatcacttcgcgtgcgacggcaacggcgaggttgtcatcagggagaccgccgatgcgcttgtgtccaccgggctcgccgctgccggctacaaatacgtcaatcttgatgattgctgggcagaacccgaacgtgatgcgaagggcaatcttgcggcgaacaagaagacgttcccgcacgggataaaggcactcgcagactacgtccacagcaaggggctcaagctcggcatctactccgatgctggatacaagacatgcgccaaggctcagcctgggtccctcggccacgaggagcaggacgccaagacctttgcgtcctggggcatcgactacctcaagtacgacaactgcaacaacggcgacacgaagccgctgcagaggtaccctgacatgagcaaggctctgatgcaggccggccgacccatcttcttcaacctctgcgaatggggcgacatgcacccggcgcggtggggcgcggcgtacggcaacagctggagaaccaccaacgacatcgaggacacctgggacagcatgacgtcgatggcggaccagaacgaggtgtgggccgagtacgcgcgccccggcggctggaacgacccggacatgctggaggtgggcaacggagggatgaccaacgacgagtacatcgtgcacttcagcatctgggccatctcaaaggcgcctctgatcatcggctgcgacgtgaggcacatgtcgcaggacacctacgacatcctcgccaacaaggaggtgatcgccgtcaaccaagatcctctcggcgtccaggggaagaaagtgaggatggaggggagcagcgagatctgggctgcgccgctgacggggtacaggacggcggtgctgctgctgaaccggcacgccaaggacgaggcccagatcacggcgcactgggacgacatcggcctccccgccggcacggccgtcgacgccagggacctctggctgcacaagacgctcgacgccaagttcacggacaagatgagcttcaacgtgacgccgcacgcggccaggatgttcgtgctcacgcctctcaagtcccagatggactaaggaaaaacgacatgggttgatgcccgttccaaaattgattatacaaatacagtacatttttttcctacttctatttttccgtaatatttttttttgagccgaattttccgtaataatttgaacctggtttttagtgtgtaatgatttttttttagaacttctagtgtgtaataaggtctgggcactttcggttcatggtaaggtcaaaacttttgtgtggaaagttttacatggagccattcccgttaaatcaactctgacgaattatcatattggacggacgactggtgtccagtttgtcatgatcatccggaagacctgaaacacttgctatttgaatgcgcaccagcaaaaacgatgtggcacaaacccaagcctctattccaggcaaagattttgctctaaagtttagccacttgtgtgaaaatgatgtatggtgaataccgcatgtgacacgtgctatttgtttggtacctggtggtgtagaactgctttgtagatttaaggtttcgtttt

SEQ ID NO: 2664 - DNA, 1493 bp, Secale cereale
ggccagacacgtgtatcggcggctacgtccaggtcaacaggcggggggagactcggcgagagatcaatggagggtcgtggccggccatggaccaggctaccggcgctgctgctggcggcgctggcctgcgccgccgtgggcgagtgcagggtggtgcacgtgggagaggcgcaccggcggagcatgctggccaatggcctcggcgcgacgccgcccatggggtggaacagttggaatcacttcgcgtgcgacggcaacggagaggttgtcatcagggagaccgccgatgcgcttgtgtccacggggctcgcggctgtcggctacaaatacgtcaatcttgatgattgctgggcagaacccgaacgtgatgcaaagggcaatcttgcggcgaacaaaaagacgttcccccacgggataaaggcactcgcagactacgtccacggcaaagggctcaaactcggcatctactccgatgctggatacaagacatgcgccaaggctcaacccggatccctcggccacgaggagcaggacgccaaaacttttgcgtcctggggaatcgactacctcaagtacgacaactgcaacaacggcgacacgaagccgctgcagaggtaccctgacatgagcaaggctctgatgcaggccggccgccccatcttcttcaacctctgcgaatggggcgacatgcacccggcacggtggggcgcggcctacggcaacagctggagaaccaccaacgacatcgaggacacctgggacagcatgatgtcgatggcggaccagaacgaggtgtgggccgagtacgcgcgccccggcggctggaacgaccccgacatgctggaggtgggcaacggcgggatgaccaacgacgagtacatcgtgcacttcagcatctgggcgatctcaaaggcgcctctcatcatcggctgcgacgtgaggcacatgtcgcaggacacgtacgacatccttgccaacaaggaggtgatcgccgtcaaccaagatcctctcggcgtccaggggaagaaagtgaggatggaggggagcagcgagatctgggctgcgccgctgacggggtacaggacggcggtgctgctgctgaaccggcacgccaaggacgaggcccagatcacggcgcactgggacgacatcggcctccccgccggcacggccgtcgaggccagggacctctggctgcacaagacgctcaacaccaagttcacggacaagatgagcttcaacgtcacgccgcacgcggccaggatgttcgtgctcacgcctctcaagtcccagatggattaggagaaacgacatgggttgatgccgttccaaaattgattatacaaatacagtgcattttatcctacttctatttttccgtaataatttggatgtgatttttagggtgtaataaaaaaattgagaacttctagtgtgtaataagtacggcatagcaggcacggtgagcaatctccaaaccattcaaaaaaaaa

SEQ ID NO: 2665 - DNA, 1646 bp, Triticum aestivum
ggcagggggagactcggcgagggatcaatggagggttgtcgtgtccggccatggaccaggctaccggcgccgctgctggtggcgctggcctgcgccgccgccgctgccgtgggcgagtgcagggtggtgcacgtgggagaggcgcaccggcggagcatgctggccaatggcctcggcgcgacgccccccatggggtggaacagctggaatcacttcgggtgcgacggcaacggcgaggttgtcatcagggagaccgccgatgcgcttgtgtccaccgggctcgccgctgtcggctacaaatacgtcaaccttgatgattgctgggcagaacccgaacgtgatgcgaagggcaaccttgcggcgaacaagaagacgttaccccacgggataaaggcactcgcagactatgtccacagcaaggggctcaagctcggcatctactccgatgctggatacaagacatgcgccaaggctcaacccgggtccctcggccacgaggagcaggacgccaaaacctctgcgtcctggggcatcgactacctcaagtacgacaactgcaacaacggcgacacgaagcccctgcagaggtaccctgacatgagcaaggctctgatgcaggccggccgccccatcttcttcaacctctgcgaatggggcgacatgcacccggcgcggtggggcgcggcgtacggcaacagctggagaaccaccaacgacatcgaggacacctggaacagcatgatgtcgagggcggaccagaacgaggtgtgggccgagtacgcgcgccccggcggctggaacgaccccgacatgctggaggtgggcaacggagggatgaccaacgacgagtacatcgtgcacttcagcatctgggcgatctcaaaggcgcctctgatcatcggctgcgacgtgaggcacatgtcgcaggacacgtacgacatcctcgccaacaaggaggtgatcgccgtcaaccaagatcctctcggcatccaggggaagaaagtgaggatggaggggagcagtgagatctgggctgggcctctgacggggtacaggacggcggtgctgctgctgaaccggcacgacaaggacgaggcccagatcacggcgcactgggacgacatcggcctccccgccggcaccgcagtcgaggccagggacctctggatgcacaagacgctcgacaccaagttcacggacaagatgagcttcaacgtgacgccgcatgcggccaggatgttcatgctcacgcctctcaagtctcagatggattgaggaaaaacgacatgggttgatcccccgttccgaatatgattacagaaatatattttttcctacgcctatttcccagtaataatttggaagtgttttttagcgtgtaatattttttttgaatacagtacagacgcaagcgctcatacatacgcgcatacactcaagcctggacttgaaccttggtgggctggggatgctactgtccacctaaccatctcaaccacaggttgattcgtgaatctgagaacttttagtgtgtatataataagtaccgtgcggccggtaagcaatctccaaataattaacatttgtgtgtaataagctcgagcgtttatatcttatacttgctcaacataatcaactattctttt

SEQ ID NO: 2666 - DNA, 1774 bp, Brachypodium distachyon
gtggtagtacgagcatctgccagatctcctgtccccgtccttagaattactagctcgattctatttgtgagctgattaggattataattgtatgacgattaatcaattgccagagcaaaatataaacacacgagttgcgccaaatcgcgggcaatttgactcttccccctctgatcgtacacttagaccgaggccgcagctacgttccgattcaggacaggcagggagagcgcgagatcaatggagggcaaccgtggaggctcgccgtggcctaggctgccggcgccggcgctgatgccgatgctgctgctggtggtgctggcgagcgtcgccgccgtgggcgaggccaaggtggtgcacgtgggagaagcccaccggaggagcatgctggccaatggcctcggctccactccacccatggggtggaacagctggaatcacttcgggtgcgacggcaacggcgaggtcgtcatcagggagacagccgacgcgctcatctccaccgggctcgcagccgccggctaccgatacgtcaaccttgatgattgctgggcagaatccgaacgtgatgccaaggggaaccttgtggcgaaaaagagtacgttcccgaacgggataaaagcgctcgctgactacgtccacagcaaggggctcaaattagggatctactccgacgcaggatacaagacctgcgccaaggctcagcctggatccctcgggtacgaggagcaggacgcaaaaactttcgcgtcatggggagtggattacctcaagtacgacaactgcaacaacggcgacctgaagccgctggagaggtaccctgagatgagcaaggcgctgatgaaggccggccacccgatctacttctcgatctgcgaatggggcgacatgcacccggcgcgatgggccgcggcttacggcaacagctggagaaccaccaacgacatcgaggacacctgggacagcatgacgtcgagggcggaccagaacgaggtgtgggccgagtacgcacgccccggcggctggaacgatcctgacatgctggaagtgggcaatggagggatgaccaacgacgagtacatcgtgcacttcagcatctgggcaatctccaaggcgcctctgatcatcggctgcgacgtgaggcacatgtcgcaggacacctacgacatcctggccaacacggaagtgatcgccgtcaaccaagatcctctcggcgtacaggggaagaaagtgaggatggaggggagcaacgagatctgggctgcgccgctgtcggggtacaggacggcggtggtgctgctgaacaggcacgccaaggacgaggccgagatcacggcgcgctgggacgacatcggcctcccggccggcatggccgtcgaggccagggacctctggcaacacaagacgctggacgccaagttcacggacaagatgcccttcaacgtgacgccgcacgccgcccggatgttcctgctgacgcctctcacgtcgcagatcaactgagtactacctcatggcacgcttcccacgtcggccgaaattattttgcaactgtctgctcgaaattttccatatttttctttgggatgtgattttccaaataaaaagcgagtttttgctccagatcatacaggggtattcctgccctgtgagtctgtctcgatattcacaaaaatcagcagagggtaaatgcgtgcagcagagggtagaatgcgtgttgatagccgaattggcctatgtcataacgatattgaaacaaataatggttttccca

SEQ ID NO: 2667 - DNA, 1558 bp, Avena sativa
ctccgctgttgctgaccatacactacacgtacgtggagggcgctgctgcgttgaggacagcagccagagagagagaaaggcagacactcactcggcgagagaccaatggagggtggtcgtcgttgctcgccgtggaccaggctgccggcgctgctgctgctgctgctgctggcctgcgccgcctccgtacgcgtgggggagtgcagggtggtgcacgtgggagaggcgcaccggaggagcatgctggccaatggcctcggctccactccacccatggggtggaacagctggaatcacttcgcgtgcgacggcaacggcgaggttgtcatcaaggagaccgctgatgcgcttgtctccaccgggctcgcagctgccggctacaaatacgtcaatcttgatgattgctgggcagaacccgaacgtgatgccaagggcaatctggtggcgaacaagaagacgttcccccacgggatcaaagcgctggcagactacgtccacagcaaggggctcaaacttggcatctactctgacgcaggatacaagacttgcgccaaggcccagcctggatccctgggctacgaggagaaggacgccaaaacattcgcctcctggggcgtggactacctcaagtacgacaactgcaacaacggcgacctgaagccgctggagaggtaccctgacatgagcaaggctctgatgaagaccggacggccaatctacttgtccatctgcgaatggggtgacatgcacccggccaagtggggcgccgcgctcggcaacagctggaggaccaccgacgacatcgaggacacctgggagagtatgacgtcgagggcggaccagaacgaggtgtgggccgagtacgcgcgcccgggcggctggaacgatccggacatgctggaggtgggcaacggggggatgaccaacgacgagtacatcgtgcacttcagcatctgggctatctcaaaggcgcctctgatcatcggctgcgacgtgaggcacatgtcgcaggacacctacgacatcctcgccaacaaggaggtcatcgccgtcaaccaagatcctctgggcatccaggggaagaaagtgaggatggaggggagcaaagagacctgggctgcgccgctgtcgggatacaggatggccgtgctgctggccaaccgtcacgttagggacgaggtcgagatgacggtgcactgggacgacatcggcctccccgccggcaccaccgtccaggccagggacctctggctgcacaagacgctggacgccaagttcacggacaagatggccttcaacctcacctcgcacacggccaggatgttcgtcctcacgcctctcaactctcagatcaattgaccaatctcctggcacggcaaccattcggtcgtccacaaatttatttgtagctatatacgtacttataggaacatttcctgagcttctagttttggaaactacaatgatttttcctacagtaataaatggcgagtggatatttcttgcttatactactactattgatttacagttttgctaattcacggttgactcctat

SEQ ID NO: 2668 - DNA, 1563 bp, Pennisetum glaucum
cagggagcgacgagagtccgagtcgaaggcaacgagtgacagacaaaagtcttgatctcgtgcgcggtgaaggttttgtagtggttcgtggagggcagagtcgcagcgatggcgggtggtggccgtcgtcgcactggtccgtcgtcgccggcgaggctggcgctgctggtggtgatggtgatgcttctggcggcggcggcggcggaggccaaggtggtgcacgtggaggaggcgcaccggcggagcatgctggccaacggcctcggctcggcacctcccatggggtggaacagctggaaccacttccagtgcgacggcaacggcgaggtggtcatcagggagaccgctgacgcgctcgtgtcgaccgggctcgctgctctcggctacaaatacgtcaacatcgatgactgctgggcggagccaaaacgtgatgcaacgggcaatctggtggccaacaccaagacgttcccgcacgggatcaaggcgctcgcggattacgtccacagcaaggggctcaagctcggcatctactccgacgccgggttccagacatgcgccaaggtccagccgggctccctcggccacgaggagcaggacgccaagaccttcgcggcatggggagtggattacctcaagtacgacaactgcaacaacggcgacctcaagccgctggagaggtacccggagatgagcaaggccctgatgaaggccggccggcccatctacttctcgctgtgcgaatggggcgacatgcacccggcgcggtggggcgcggcctacggcaacagctggaggacgaccaacgacatcgccgacacctgggagagcatgatcgcaacggcggaccagaacgaggtgtgggcggagtacgcgcgccccggcggctggaacgatccagacatgctggaggtgggcaacggggggatgaagaacagcgagtacgtcgtgcacttcagcctctgggcgatctccaaggcgccgctcatcatcggctgcgacgtgaggcacatgtcgcaggagacgtacgacatcctggccaacaaggaagtgatcgccgtcaaccaagatccgctcggcgtgcaggggaagaaggtgaggatggaagggagcaacgagatctgggcggcgccgctgtcggagtaccggacggcggtggtgctgctgaaccggcacgcgaccgacgaggccaccatcaccgcgcactgggacgacatcggcctccccgccggcaccaccgtcgaggccagggacctgtggctgcacaagacgctgggcgccgcgttcacggacaagatggcgttcgacgtcgcgccgcggtcgtgcaggatgttcgtgctcaagcccaccagcaggctccagtagaagcagagcgcggcggagggcctggtctccgcggacggcgcacgctgccggccgaactgccaaagctgacgccacagcgttggtgccttggtggatatcaggcgatttgcttgtactgctacttgcattaatttttctctcatcttcataattttttattttagcattttacaaacatatacaacctaataaaaaattgca

SEQ ID NO: 2669 - DNA, 1720 bp, Setaria italica
cacaagtgttggtccacgaaggcaaggagcgacgaaagtccgagacgaaggcacgagtgacaaagtcttgatctcgtgcggagtgaaggtttttctggttcggggagggcagcgatggcgggtggtggccgtcgtactggtccgtcgccggcgaggctggcgctgatggtgctgcttctcgcggcggcggttgcggcggaggccaaggtggtgcacgtggaggagccgcaccggcggagcatgctggccaatggcctcggctcggcacctcccatggggtggaacagctggaaccacttccagtgcgacggcaacggcgaggtggtcatcagggagaccgctgacgcactcgtgtcgaccgggctcgctgctctcggctacaaatacgtcaacatcgatgactgctgggcagagccaaaacgtgatgcaatgggcaatctggtggccaataccaacacgttcccgcacgggatcaaggcgctcgcggattacgtccacagcaaggggctcaagctcgggatttactccgacgccgggttccagacctgcgccaaggtccagccgggctccctcggccatgaggagcaggacgccaaaactttcgcggcatggggagtcgattacctcaagtacgacaactgcaacaacggcgacctcaagccgctggagaggtaccctgagatgagcaaggccctgatgaaggcgggcaggcccatctacttctcgctgtgcgaatggggcgacatgcacccggcgcggtggggcgcggcctacggtaacagctggaggaccaccaacgacatcgccgacacctgggagagcatgatcgcaacggcggaccagaacgaggtgtgggcggagtacgcgcgccccggcggctggaacgacccggacatgctggaggtgggcaacggggggatgaagaacaacgagtacgtcgtgcacttcagcctgtgggcgatctccaaggcgccgctcatcatcggctgcgacctgaggcacatgccgcaggagacgtacgacatcctggccaacaaggaggtgatcgccgtcaaccaagatccgctcggcgtgcaggcgaagaaggtgaggatggaggggagcagcgagatctgggcggcgccgctgtcggactaccggacggcggtggtcctgctgaaccggcacgcgacggacgaggccacgatcaccgcgcgctgggacgacatcggcctccctgccggcaccgccgtcgaggccagggacctgtggctgcacaagacgctggacaccgcgttcacggacaagatggcgttcgacgtcgcggcgcggtcgtgcaggatgttcgtgctcaagtccaggctccggtagaagcagagcgcggcggccccggtcccgtggacggcgcacgatgccggtcggcggagatgacgtggcgttggtagatattgggcgatttgctcgtactgctacttgcataaatgcctattaaggatcagggatttaagaatgtgttccttttaggggacgatgatatacttgtagtactgtactatacatttttttttagacctagtactgtagtatacatgactttgcacactggtaccggtgggccttctttaccacggccgacgataccttgaagcaaaaagccgggctgaatccgggccgagaacgcccgatttggcggcccatgggctgttgaaacgaagttatacggcggggctgacgacaaaag

SEQ ID NO: 2670 - DNA, 1816 bp, Zea mays
aaagcgttgatccgatccacgaaggcaagagagagacaaagtagaagctaaggcgcgagtgataggagggttttggttcagagaggagcggggcaatggcgggtggtcgtggctcgtcggcggcgaggctagcgctgctactggtggtggtggtggcggcggtggcgggcggcgccgtggcggggggcaaggtggtgcacgtggaggaggcgcaccggcggagcatgctggccaatggcctcggctcggcccctcccatggggtggaacagctggaaccatttccagtgcgacggcaacggcgaggtggtcatcagggagaccgcggacgcgctcgtgtcgaccggactcgccgctctcggctacagatacgtcaacatcgatgattgctgggcagagccacaacgtgacgctaagggcaacctggtggccaacaccaagacgttcccgcacgggatcaaggcgctggcggactacgtccacggcaaggggctcaagctcgggatctactccgacgccgggttccagacctgcgccaaggcccagcccgggtccctcggacacgaggagctggacgccaagaccttcgcggcatggggggtggattacctcaagtacgacaactgcaacaacggcgacctgaagccgctggagaggtacccggagatgagcagagcactgatgaaggtggggcggccgatctacttctcgctctgcgaatggggcgacatgcacccggcgacgtggggcgcgacctacggcaacagctggaggaccaccaacgacatcgccgacacctgggacagcatgatcgccacggcggaccagaacgaggtgtggtcggagtacgcgcgccccggcggatggaacgatccggacatgctggaggtgggcaacgggggcatgaccaacagcgagtacgtcgtgcacttcagcctctgggcgatctccaaggcgcctctcatcatcggctgcgacgtcaggcacatgtcgcgggagacgtacgccatcctggccaacaaggaggtgatcgccgtcaaccaagatccgctcggcgtgcaggggaagaaggtgcggatggaggggagcagcgagatctgggccgcgccgctctccgagtaccggacggcggtgctgctcctgaaccggcacgccaaggacgaggccaccatcgccgcgcactgggacgacatcggcctccccgccggcacgcccgtcgaggccagggacctgtggctgcacgagacgttggacgccacgttcacggacaagatgagcttcgacgtcgcgccgcactcgtgcaggatgctcgtcctcaagcccaggatccagatccagtgaactacaccaccgctgccgcatgggcgcgcgtacgtgcggccctcacgacgtcaccacgcgtcgattcatttgtactgcaggctactaattgcagacacgtggaatcaaaatcaccaagaatggttcttgttccttgtatcgtattgtgctctcgactcaaccgagacactgggccctcgtgctggcctcacaacacggcccaccccagttgggaacataaatccaccatacccggcccaggcaggttgtccacaccacggactgcattgcgtgctggatcctcacaaacgcttacatggatattttttcctaatctccgtttctcgtgaggataaatctctgacagtcatcatcgacccgcttaaattataattagtacatacttcttttgttcggctgcgaagaaaatgaggggaatagaggatcgatgtgcaatcaaacagaccctaatggaggcattattcacaaagaattag

SEQ ID NO: 2671 - DNA, 1547 bp, Oryza sativa
tcgagctgatcagcagcagccagccgccggcgagctgtgccgttcttgatcaccgaggcgatggcggcggcggcggcggtgctgcttgcggtggcgtgcgccgcggcggcgatgatcgccggcggcgagtgcgggagggtggtgcacgtgggggaggagcaccggaggagcatgctcgccaatggcctcgccacggctcctcccatgggctggaacagctggaatcacttcgcctgcgacggcaacggagaagacgtcatcagggagactgctgatgcacttgtgtcaaccgggcttgcagctgctggctacaaatacgtcaacatcgatgattgctgggcagagccacaacgtgattcgaagggtaatcttgtggccaacaaaaagacattcccccacgggatcaaggcgctcgccgattatgttcacagcaaggggctcaagctaggcatttactccgatgcaggattcaagacgtgtgcgaaggttcagccggggtctctcggccacgaggagcaggacgccaagacattcgcatcgtggggagtggactacctcaagtatgataactgcaacaatggcgacctgaagccactggagaggtacccggagatgagcaaggctctgatgatggccggccggccgatctacttctcgctgtgcgaatggggcgacatgcacccggcgaagtggggcgcggcgtacggcaacagctggagaaccaccaacgacatcgcggacacctgggagagcatggtgtcgagggcggatgagaacgaggtgtgggcggactacgcgcgacctggcggctggaacgacccggacatgctggaggttggcaatggcgggatgaccaacgacgagtacatcgtccatttcagcctctgggccatctccaaggctcctctgatcatcgggtgcgacgtgaggcacatgtcgcaggagacgtacgacatcctggccaacaaggaggtcatcgccgtcaaccaagatgctctgggcatccaggggaagaaggtgaggatggagggcagcagcgaggtgtgggcggcgccgctgtcgggttacaggacggcggtgctgctgctgaaccggcacgcggcggaggcggcggcgatcaccgcgcactgggacgacgtcggcctccccgccggcaccgccgtcgaggccagggacctgtggcggcacgcgacggtggccggcgccggcggcgagttgacggagaagatcaccctcgacgtggcgccgcactcgtgcaggatgctcctgctcaagcccctcatctcgtcccgggccaactgagacgagcgagcgagcgagcgagctcgccgccggcgagcagggctctccgggcgtcctcgccgtgacattttttttttgataatggaataaatatccctgcctttgctcattagagctacagccaattattacaaggaatcacacaaacaacgagtaaagttcaaataaaattaaacacacccaacgataaaaaaaccaagccaagaaaaggagcacacatttattcaagtctatttgtgaatctc

SEQ ID NO: 2672 - DNA, 3057 bp, Sorghum bicolor
gaacgcgacacatccgtccgcatctgcgcttggaaaaaaaattgtgcaccggcaacaaagttcaacagagagcggcgcaatggcgggcggcggtggttcgtcgccggcaaggctagctctgctgctgatggcggtggcggtcgtgggtggcggcggcaaggtggtgcaggtggaggaggcgcaccggcggagcatgctggccaatggcctcggctcggcccctcccatggggtggaacagctggaaccacttccagtgcgacggcaacggcgaggtggtcatcagggagaccgctgacgcactcgtgtcgactggactcgctgctctcggctacagatacgtcaacatcgatgattgctgggcagagccaaaacgtgatgctaaggggaatctggtggccaacaccaagacgttcccgcaggggatcaaggcgctggcggattacgtccacagcaaggggctcaagctcgggatctactccgacgccgggttccagacctgcgccaaggtgcagcccgggtccctcggccacgaggagcaggacgccaagaccttcgcggcatggggagtggattacctcaagtacgacaactgcaacaacggcgacctcaagccgctggagaggtacccggagatgagcagagcactgatgaaggtggggcggccgatctacttctccctctgcgaatggggcgacatgcacccggcgaagtggggcgcggcctacggcaacagctggaggaccaccaacgacatcgccgacacttgggacagcatgatcgccacggcggaccagaacgaggtgtgggcggagtacgcgcgccccggcggctggaacgatccggacatgctggaggtgggcaacgggggcatgaccaacagcgagtacgtcgtgcacttcagcctctgggcgatctccaaggcgcctctcatcatcggctgcgacgtgaggcacatgtcgcaggagacgtacgacatcctggcgaacaaggaggtgatcgccgtcaaccaagacccgctgggcgtgccggggaagaaggttcggatggagggcagcagcgagatctgggcggcgccgctctccgagtaccggacggcggtggtgctcctgaaccggcacgccaaggaccaggccaccatcaccgcgcactgggacgacatcggcctccccgccggcacgcccgtcgaggccacggacctctggctgcacgagacggtggacgccacgttcacggacacgatgagcttcgacgtcgcgccgcactcgtgcaggatgttcgtgctcaagcccaacatccacatccggtgaactagctacaccgcgccggccggggcgcgcgcgtacgtacggctcttcatggcgacgacatcaccaccggtgataccatacctgcaggcgattcacttgcactgcaggctgattgcatacacatgggtggaatcaaaatcaatcaccaagagtgttttactgttccttttgttgttgtgcccgtgcacgcatttgtgttttctctgaatggggaaaaagatgctctcgactcaaactgagatactgggccctcatggtggcctgtcggcatgttgtagcgaaccaatggagagcaaaacgcggcccagcccagcccagcccagcccaactggaaccgaaatccaccgcaccggcccaggcaggtttgccatccaaagttccaaaccgcattgcgtgcacagcgtcggaattacgtagtactccctaataaggtcaaggaaacgaaccatgctgaagctgaactgtccactacagatacagtttcactagtctacactctacaaacgatgcctatgcatgatagtacagtatgtagtaacatcaaggaaacaactctagccggctctgccactagaaaatctaatggcaggagatataatgaatatcacttttttttgttgggtctgagatacagagatacaaaagccatcagtcattgctgatccctcatatcatcatcataccagaccaagtgcgtattgcactgcgttccgtttgcaaattaaaccagacaatggggagggggagcaccgcatttctctttctgtctcttgtgtgccagagccaactgccaaagctaacagggctgtctagtgttgtctgttggtgccttctatcatgtgtccggtagcctaagtcagctgcctaccgtgcataagctgataagcaagcaaaagcatggtataaatttcgaaggaggaggaagttgcagcatcccactggaaatttcatctccttgatttgatcacttcaacagttctgtgtagtggccatgcatgtcttcagcagtggcctaatcttgcattgcgtggataggaataggattagccaatccagtcgtctctgttgttcatctcctgtcacaggcaaattaaaagcccgtgtcagctacgttcaacgatagagactggaggatttgaagacgacccggtgatgtgtgtcccctttgcagcgttgttgtcccaagcgatcgacacagcgggatacggatcgaaggcgagcgaaatgcatggaagctagctaacgcgcagacgatcgatgagaccgcgagcgcgatggcgtcgaccgagcgctctcgatccgacacgtggcggccgtgtggtcgttcaccgtccgatcgctgccgaccacggaccaccacatccacatggatggatcatcctccatctcctgaccatgaagcacatcagcagtagtaactactgctagtagtgtttgaatgagcaagagaaaacgctggtcctattcctaccaaacggcgccgcgtcgtgacttgccaaccaccgcgatggtggaaagacaacgcagggaggcaatcaggacaagttgttgtgttggcgctccggccggccggaacatcactgatcagcgcatgctttccaatacaagcagcaggctgcagatttccggactctggtctgcttccccgttgctttgaacagccttgggcgccaccgcatttccatggcaatggcagacaaacgcaatggtggttagtgccttcaattcttccatgtatccagtagcct

SEQ ID NO: 2673 - DNA, 1326 bp, Secale cereale
tggaacgcttccggttcaggtcacctcccctctcgctcaagctggccttcgccgccgtctccctcggcgtctccttcgccgccgtctcctgctcctcctcctctcccctcccttcctcggccgcctcctcctctccgcggccgtctccccggactgtagccgccgacctcctcgccgtccttgccggcccgcgcgccgcggcgcgggtgccggcccgggaggcctcgcgcctgagctcctgcctccggttcctctccccggtaaatcctgccgccacatctacgacatatccgtggaggggatcccggaagtttctcctggaaggctgcgatgcggccgaggcggatgcgatggtgatgtggccaccggcgccggtcttggagctggcgcgcctcgccgtcgactccggaggcgaccccggggcgatccaccgcttgctcgaccccaccatgctgcctgtgcctgatatcgagggaacgaagaagagcaaatgccacctcacaagaacaccgtatggaagacgctttgctgacgaggacatcaattcatactttgcgttcctgtttgaattgatcgttgcgcgaggaccgtcagttggattaaatgtgtcactgaatcggtatgacttgttccacgggcatctctttctggcatctgggacaggaagggttgggattctgttccatgccaaagagtatccagcatttgacaagaaacggttcccttacaatttgggatattgccagagggaatctgatgtaccgtatgacgattctatgaatttacgtaatatcctttggttagctccattgccatccagtgatacgaaagcttggttagcaccaggagtgctagtcgtcctggatgcacatccagatggaattatttatcaagacatgatacgcgactatgttcagattgtacgaacaatatatgaagatgatttcggagagcttgcggtcgatgtcaactatctgaatgtcgccaacgcagctccagcggatagaattttcatttgctgacgtccatccataggatcattggttttctccgtcatttgatctcatctctgggaagggaacaccaaatgtacatttttttacggatgcactcgagatccaagaaagcagcaatgatttggtagcaagtatcctgtatagttcaggtgttcatctccaagatggcttcagatgttattgattgaaatgtacatttgattgaaatgtacagatgtagcactcgaggaagcagttaatctatcgcacctatgacatgtttgattgatggagatagtcagaaattcatttggttctgtgcaaaaaagtc

SEQ ID NO: 2674 - DNA, 1616 bp, Secale cereale
tcaggttgggagcctcggaggggatggaacgcttccggttcaggtcacctcccctctcgctcaagctggccttcgccgccgtctccctcggcgtctccttcgccgccgtctcctgctcctcctcctctccgctcccttcctcggccgcctcctcctctccgcggccgtctccccggaccgtagccgccgacctcctcgccgtcctcgccggcccgcgcgccgcggcgcgggtgccgtcccgagaggcctcgcgcctgagctcctgcctccggttcctctccccggtaaatcctgccgccacatctacgacatatccgtggaggggctcccggaaggttctcctggaagactgcgatgcggccgaggcggatgcgatggtgatgtggccgccggcgccggtcttggagctggcgcgcctcgccgtcgactccggaggcgaccccggggcgatccaccgcttgctcgaccccaccatgctgccggtgcctgatatcgaggggacgaagaagaacaaatgccacctcacaagaacaccgtatggaagacgttttgctgatgaggacatcaattcatactttgcgttcctgtttgaattgatcgttgcacgaggaccgtcagttggattaaatgtgtcactgaatcggtatgatttgttccatgggcatctctttctggcatctgggacaggaagggttgggattctgttccatgctaaagagtatccagcatttgacaaggaactgttcccttacaatttgggatattgccagagggaatctgatgtaccgtatgacgattctatgaatttacgtaatatcctttggttagctccattgccatccagtgatacgaaagcttggttagcaccaggagtgctagtcgtcctggatgcacatccagatggaattatttatcaagacatgatacgcgactatgttcagattgtacgaacaatatatgaagatgatttcggagagcttgcggtcgatgtcaactatctgaatgtcgccaacgcagctccagcggatagaattttcatttgctgacgtccattcataggatcattggttttctccgtcgtctgatctcatctctgggaagggaacaccaaatgtaccattttttacgagatgcactcgagacccaagaaagcagcagtgaattggtagcaagtatccttttacaagatgcactcgagatccaagaaagcatcagtgaataggtagcaagtatcctgtatagtttaggtgttcatctcaaagacggcttcagatgttttatttgattgaatgtacagatgtagcactcgaggaagcagttaatctatcgcacgcatgacatgtttgttcgatggagatcgtcagaaattcatttggttgtggcattcagcggaaccagtgtttatatattgtgataagtatgaaggttgtatctcaattcgggtgctatttggttgtgcctgtgtacaacagataacgagttgatatctcaagtggaaactacttgaattgcgttttgcgttttcaagaaaaacaaaaaaaaaaaaaagaaaaaaaaaagaaaaaaaaaagtaaggtagaggagacgacgacactaggaggagagggcgggggggg

SEQ ID NO: 2675 - DNA, 2857 bp, Brachypodium distachyon
actaaatctgtatagtctccaaccgaaataccagccatcagatcaagatcaaagcacaacagacggtctacaaggaagtccactgtccattgaagagaacacccagtagatgcagcagcagcaaagcagaagcaacagccgatggaacgcttccggttcaggttcaggaggtctcctctgctctcgctgaacctgaagctggccttcgccgtctccctcggcctcggcgtctccttcgccgtctcctcctcctcctcttccgccctcccttccccgccgccttctccgcaggccgtagccgccgacctcctcgccgtcctcgccggcccgcgcgccgcgtcgcgtgtgccggctggcgaggcgtcgcgcctgcggtcctgcctccggttcctctccccggccagcgcctccgctgtatccagggagtctcccccctggaggggcttccggaaggttctcctcgaaggctgcgacgacgatgcggctgaggcggatgggttggtgatgtggccgccggcgccggtcatggagctggcgcgcctggccgtcgactccggtggcaaccctggcgcgatccaccacgcgctcgaccccaccatgcttccggtgccagatattgagggatcgaagaagaacaaatgtcatctcacaagaacaccatatggaaggcgttttgctaaccaggaaatcaattcatacttagcctttttgtttgagttgattgccacacgaggaccatctgttggattaaatgtatcactgaatcggtatgatttgttccatgggcatcttttcctggcatctgggacaggaaggcttggaattttgttccatgctaaggaatatccagcatttgacaaggaactattcccttacaatttgggttattgccaggcaggatctgatgtaccatatgacgattctatgaatttacgtaatatcctttggttagcaccattgccatccagcgagacgaaagcttggttagcaccaggagttttagttatcctggatgcacatcctgatggaattatttatcaggatatgatacgcgactatgttcaaatcgtacgaacaatatacgaagatgattttggagagcttgcagttgatgtcaattacctgaatgttgccaacgcagctcccgctgatagaatttttatttgctgacgcgacagccctccatttggatttttcacgcattgtgatttcctccctgggaaacaaacaccagaagaccagacgtatccatctaagtaccctctgtatattccacgtgttcatttaggagaccgtttcagatgtttctcttattggatgtacttgaggaagcagtttttcataccgtcataaattcatttggttgtagcaccttgtgtatttaaccggtttcacttacacgatggtgtttgttttggcttgagtactggatgtgagggctatgctgcaacatcaccggtttgccgtgacattttaccaatattttaaattgctgaggatcgatcagataaaaataaggtggccagaaatagaattaggtaacaatgaaaccaagaggggaacttcgattcaaggatttgcatgctctgagctcatgttttacagcagattacaaatacgggaagaaatgtattgcactgagctattacactgttagtgagttttccggagataagcatggattgcagaaaatattgttcccacagtgcacgccaaaaaaaaattactcgcatcagagccaacacaaacaaggtgactcgacaccttaaccagaaatgcataacagcttcacacgagcaacacagcattgatgcagccatcattctccgggttgtttgtaacctgagcatatttaccccaaacaacttttccagcaggggttacaagaccgagttcgctaacgttcacctcaatgattgtcccccttgtcataacaccaagagaagtgtacatttgaccatttggatttttcttcacagaaattatgtcgagattgaacgtgcatttcaactcagggtgggtaacatgagctttggtaaaacgcagaccagtgggccgaatgaacctttcatacttcggtggcttcctcgtaaaaccaggacccacaaaggtagccttagttaccattctcttccactgcttcgctgcataaagaaaaattatatcagccaaattattcaactcaaaggaatactttgcatggtctctgcaattgccatttgtttagtgaacttttatgagaacaacttcagacaaaaaatagaagttggtgacttcagttgccttgcagcacatagcacttccaggaaagctcatcccaacaaaaatgcacaactgacaaagaattacatgcatatgcaatgccaagtatgaatgcaggacaaacacaaattccaaatggtaacctagcttccagatttatcgataaatcttattatgacttacttttccgcttgccagttcgtagaactttgaacatctcatcttcagccacacctctgacctgaaagaagaaaaattgtgacaatgtttagtcaagtaggaaaccaccgattttgaagcaagaagacaacaacagtttgaatggagaattacctttggcaaaggaacatcccatttgccagccttttccttcctcttttgctttattgtgttgctgaggacctacatttcacgataaatcaacaagcagcaccacaaaaaggttcatgtgtcacaacagatggttcgaactaactactttaccttggcccgctgcgtctgatcacgatccagcagatatggagggagagccccttcttcaacatcatcatcaaccttctgccgggaagttgactcgtcatgcattttcaggctg

SEQ ID NO: 2676 - DNA, 884 bp, Secale cereale
tggggctgggcctgggcaaaagaaacagcaaacgataacgaagcctgcagagagcacggacatggcggcgaggagcgagaacgagtcggacggcgacgtgggcaccaaccccgccgaggggggctcgtccctgtccctgccgcctctagctgccggtccagccgtatgcgtcctccggtccgccggggacttcgccggcggcgccttcgtcggatctatctttggatatggacaaggtcttctatctaagaagggcttgaagggctcactcggcaatgcagggtcttctgccaaaagttttgcggttctttctggcgtccagagtttggttttgtgcttgttgaggaaactgcgtgggaaagatgatatcatcaactccggcattgctgggtgttgcacaggtcttgctttgagttttccaggtacaccacaagcgctgcttcagaactgcgccacgtttgcagcgttctcgtgcatcatggaggggctcaacaagcagcagaccgcgatggcgcacaccctcggcggcaatgccctgacctttgcgcacaacaatggcgggggcgtcctccctcctttcactcttcccccaatcctcgatgcatccgatgctttcgcttcatgctgccaggccttggtcgtcaagcctaagaagcactagacagcatcattaggagggagggagggagagagtgagatgtgctcaggaaacctagctagctcctagcgtaatgtaaattttgcttttggataatgtcgaaaacctagattgtttgctttttggccgggttgtttttggtgctgcgatgcgtttcgtggcgtgcgcttgctttgttgatggtatgtcaaggatagatttttttgacctggaagataagatgtcg

SEQ ID NO: 2677 - DNA, 1014 bp, Triticum aestivum
ttaccagaggctggagtcccgtcctatactccaaccctgggcctgggcaaacgaaacaggaagcgataacgaaactcgcagagaggacggacatggcggcgaggagcgagaacgagtcggacggcgacgtgggcaccaaccccgccgaggggggctcgtccctgtccctgccgcctctagctgccggtccagccgtatgcgtcctccggtccgccggggacttcgccggcggcgccttcgtcggatctatctttggatatggacaaggtttgctatctaagaagggcttgaagggctcactcggcaatgcagggtcttctgccaaaagttttgcagttctttctggcgtccagagtttggttttgtgcttgttgaggaagctgcgtgggaaagatgatatcatcaattccggcattgctggttgttgcacaggtcttgctttgagttttccaggtacaccacaagcgctgcttcagaactgcgccaccttcgcagcattctcatgcatcatggaggggctcaacaagcagcagaccgcgatggcgcacaccctcactgggaacgccttgacctttgcgcacgacaatggcgcgggcgtcctcccccccttcactctccccccaatcctcgacgcttccgatgctttcgcctcatgctgccaggccttggtcgccaagcctaagaagcactagacagcagcattaggagggagagagtgagatatgctcaggaaacctagctagctcctagcgttatgtaaattttgcttttggataatgtcgaaaatctagattgtttgctttttcagccgggtgttttttgtcgccgcgtttcgtggcgtgggcttgctttgttgatgatatgtcaaggatagattttgtttaccgggaagataagatgtcgtggaaaattttgcttgatggctgtatctgctttgttaaaatggttgaagcgttgctactctccaacagtgagagccgcgtggtatttattcataagagatggtgaccgttt

SEQ ID NO: 2678 - DNA, 2021 bp, Avena sativa
tatagtccatcaagacgaattttcaaggtttttatcagccaggccaacaaaatcttatccatgacagcatcaagcacgcgccacgccacaaaacgcccccaccaacaagaaaacacccggccacaaagcaaaacaatctagatcatcttcgacattatccgaaagcaaaatttacaatacgctaggaaaataccggagctagctaggttttcctgagcatatctcttcttgtcccactcctaatcatgtttcctagtgcctaggctttaccagggccttgcagcatgaagctagagcgtctgaagcatcgaggatcggtggcagtgtgaaaggagggaggaccccgcctttgttgtcaccatgcgcggcaaaggccagagcgttcccgccgagagtgtgcgccattgcagtctgctgcttgttgagcccctccatgatgcatgagaacgctgcaaaggtggcgcagttctggagcagcgcttgaggcgtacctggaaagctcaaagcaagaccggtgcaacaaccagcaatgccagaattgataatgtcatctttcccacgcagccttctcaacaagcacaaaaccaaactctggacgccagaaagaactgcgaaacttttggcagaagaccctgcattgccaagtgagcccttcaaacccttcttagttagcaaaccttgtccatatccaaagatagatccgacgaaagcgccgccggcgaagtcaccggcggaacgcgtgacgcatacgactggggcggcagctagaaacggcggagacgcggacgcgcctccctccccgggattggtgccctcgtcgccgtccgactcgttctcgctcctcgccgccatctctgctcccctctcgagttttcgttatcgtctccgtttccatttgtccggcgagcagcagagcaccggtttttggagggaggcagaggcggtcgcgatgatgaccatggatctgatggggaggtacgggagggcggacgagcaggtggccatccaggaggcggccgcggcggggctgcgcgggatggagcacctcatcctgcagctctcccggacaggcacaggcacgagcgagagctcgctggctggggcctcggagccggccgcgcagggacagcagcagcagcagcaggtggactgccgggagatcaccgatatgaccgtgtccaagttcaagaaggtgatttctatcctcaaccaccgcaccggccacgccaggttccggcgcgggcctgtggtggcgcagtcccagggcccctccgtgtccgagccggcgccggtgaggacggcgtcttcgtcgaggcccatgacgctggacttctccaagtccgcgtccgggttcgggagtaaggaccaggccgccgcgtacagcgtgtcggccgcgagctcgtcgttcctgtcgtcggtgacgggtgacgggagcgtgtccaacggacgcggcggcggcgggtcctcgctgatgctcccgccgccgccttcggccagctgcgggaagcctccgctggcggccggggcagctgccgggccgaagcggaagtgccacgaccacgcgcactccgagaacgtcgccggcgcctccggtggccgctgccactgctccaagcgcaggaaatcccgtgtgaagcggatgacccgcgttccggcgatcagctcgaaggcggcggagatccccgcggacgacttctcgtggcgcaagtacgggcagaagcccatcaagggctccccctacccacgaggctactacaagtgcagcacggtgcgcggttgcccggcgcggaagcacgtggagcgcgacccgagcgacccgtccatgctcatcgtgacctacgagggcgaccaccgccacgcccccggcgaccaggaaccagcggcggcgctcaccccgctcccggagctgcacaagctctgactgaagcttctacccaccgctactacacagacctgttaattaattaattaaaacttagcctgtcatgctgttccctttgtcgccgtatagtagtagctag

SEQ ID NO: 2679 - DNA, 1288 bp, Brachypodium distachyon
agactcggtactttggtagtcccgtcctctccactccaactccaacccgaccggacaggcgaaaacgcaatacgataacgcaactgcaagaggagatggcggcgaggagcgagaacgactcggacggcgacgagggcaccaacccaaccggcgccgggggaggcttctctccaccacctctagctgccgccccagtcgtatgcgttctccggtccgccggagactttgccggcggcgctttcgtcggatctatcttcggatatggacagggtttgataactaagaagggcttcaagggctcgttcagcaatgcagggtcttctgccaaaagttttgcagttctttctggcgtccagagtttggttttgtgcttgttgagaaagcttcgtggaaaagatgatattgtcaattctggcattgctggctgttgcaccggccttgctttgagttttccaggaacacctcaagcgctgcttcagaactgtgccacctttgcagcattctcatgcatcatggaggggcttaacaagcagcaggcaatggcacagacactcgatgggaatgcgctgaactttacgcttggcaaaggcggtgttctcccccctttcacccttccaccaattctcgatgcatcagacgcgttggcttcatgctgccaggccttggtaaagcgcaagaactagacagcagcaccgggagagagatgatgaggaaacctagctccagtatggcagtatttcctagcgtttgtaaattttgactttggatgcgtccaaaacctagttgatttgctttgtggccagctttttcttgctgcactctgtgtggcatgagcttgcttaattatgtcatggatagattttgttgacgtggcagataaaagccatgaaaaaaatcatttactttctccgtccaacaaaggatgtctcaactttgactaaatttgaatgcatctatacattaagtcatgtctagatacatccaaattttgacaaacttgagacatcttttgttggacggaggaagtacatggtttagctgttgtgcactttgcatgtgttattctgttcgcatctaaggtatggttttgttagcagttctggatttctgcactttgcgtgtgtatcattctggttcttctttacgggctataatataagtgtagagctgccccatatttaccagattcttgtactgctgtgatgattgtgatctgctcgtgtggttccctgtctgcgacgataaaaaaaacgcagaacttctttcgcaggccctgggactccaaacc

SEQ ID NO: 2680 - DNA, 704 bp, Triticum aestivum
tcctcctcctccgccgccgcctcctcgctccggcgaccagtcctctgactcctgacagcttgcggccagcagtgccgtatgaggttcgcggggtggtacctgaagatcgccgtcggcggcgcggccataggcgccgccatggagcttttcatgatccacaccggcttctatgagaaggtaacggtactggagtcagaaaaacgagcttgggaaagcagtccagaagcacaagctatgagagaagccttgaatccatggcacaagcgtgatgagcaggagaaaaaataggcaatgataggctcatcggtcctcctttcaagtaattgcattcccacccttccattgtatcgtaaccccttgaacaaggtaatagggatgtggcgtttttgtagttgttcgaacctgtctctctggggttgctggacgatagcttccagcaatgttctaaaagagttatgctcatatcatatccacaagtcttcttgctaacaaggattcttttactgtttccacgcatatgcgtccattttgaatgccattcacactcagtatctgctatgtttagcaatgtaacaaagaattttagacttgtagaggtcaaaccaatctatatcttccattcaaggactgtcttttctgtgagttgatgctaaattttgtgatcaaagatatctggggtacccctgctgctccattaattcaaa

SEQ ID NO: 2681 - DNA, 698 bp, Secale cereale
tcaggccggttttgttgggcctttggagcttgggccgtaacaacccgctacctctccttcgccctcgcctcggtccgtcagctcgtgccacgatcctcctcctccgccgccgccgcctccttgctccggcgaccgctcctctgactcctgacagaagcttgcggtcagcagtgccgtatgaggttcgcggggtggtacctgaagatcgccgtcggcggcgcggccataggcgccgccatggagcttttcatgatcaacaccggcttctatgagaaggtaacggtactggagtcggaaaaacgagcttgggaaagcagtccagaagcacaagctatgagagaagccttgaatccgtggcacaagcgtgatgagcaggagaaaaaataggcaatgataggctcatcggtcctccttccaagtaattgcattcccacccttccattgtatcgtaaccccttgaacaaggtaatagggatgtgccgtttttgtagttgttgaaacctgtctctctggggttgctggatgataacttcaagcctaaaagagttatgcccatatcatatccatatgtcttcttgctaacaaggattcttttactgtttccacgcatatgcgtccattttgaatgtcattcaaactcagtatctgctatgtttagcaatgtaacaaagaattttaggcttgcagaggtcaaacca

SEQ ID NO: 2682 - DNA, 579 bp, Secale cereale
ctccggcgaccgctactctgaatcctgacagaagcgtgcagtcagcagtgacgtatgaggttcgcggggtggtacctgaagatcgccatcggcggcgcggccataggcgccgccatggagcttttcatgatccacaccggcttctatgagaaggtaacggtactggagtcagaaaaacgagcttgggaaagcagtccagaagcacaagctatgagagaagccttgaatccgtggcacaagcgtgatgagcaggagaaaaaataggcaatgataggctcatcggtcctcctttcaagtaattgcattcccacccttccattgtatcgtaacccctcgaacaaggtaatagggatgtgccgttttgtagttgttcgaacctgtctctctggggttgctggatgataacttccagcaatgttctaaaagagttatgcccatatcatatccatatgtcttcttgctaacaaggattcttttactgtttccacgcatatgcgtccattttgaatgtcattcaaactcagtatctgctatgtttagcaatgtaacaaagaattttaggcttgcagaggtcaaacc

SEQ ID NO: 2683 - DNA, 759 bp, Brachypodium distachyon
gggggcttggccgcttgggccggaacaagaacaacccactccatcctcttcgccctcctcggccggtcggacagctcgcgccacgatccacctcctcctccgccgccgccgccgacgcctcccctcgctccggcgaccgctgcttctgactccttacaggtagtcttacagcagggcggtggtatgaggttcgcgggatggtacctgaagatcgccgccggcggtgcggccataggcgcctccatggagctcttcatgatccacacgggcttctatgaaaaggtaacggtactggagtcggagaaaagagcctgggaaagcagtccagaggcccaagctatgagagaagccttgaatccatggcacaagcgtgacgaacaagagaaaagataggcactgatagactcatccttccactgtcaagtaattgcaacccccatctttcagttgtatcgtagttcctcgaatgaggttatatgtgaatgtggaatttttttgcagttattgaaacattttagcgtatctccctgaaattgttgtggatgctagctttcagcaatgttctgaaagagtatgcccatatccgaaataagtgtcctttttgctttgattgtttttgtgtttcgacatatgtgtgtgcatattggacgtcactcgctacctgctctgttatggaaatataacaacgaaattatacgcatgaagaggtcaaacctgtctatttctttcgttatttgtgactggtcttccatgtgttcg

SEQ ID NO: 2684 - DNA, 791 bp, Panicum virgatum
ccaggcccccattttgttggaaccgtccattattgggcttcaaccttcaacggacacgattcgtcgtctgtggcctgtgggcgtcgagccgtcgacccgcctgtttgctcgccgccgccgcctctcctcgcctcgcggtcacctcagctcgctccggtcaccccttccctcgagtcgaggattcactgggggtggatcatatcatgaggttcgcgggctggtacctgaagattgcggcggtcggggcctccataggcgctgccatggagctcttcatgatccacaccggcttctatgagaaggtaactgtcttggagtcagaaaaacgagcttgggaaagcagtccagaggcccaagctatgagagaagccctgaatccgtggcgcaagcatgatgagcaacagaagaaatagtcatgcgttatgtgtcctgtcaagtatttgcatcctccatttgtagactccttgaataaggtaaaatgtgtgtaaattgtttctgttcggtgaataatttgtcctagatctctgaaatttctggatgcctggatatggtaccttccagcgaagttagagggctgtaggcagctacgataaactttttccaaggtagcaaaatttttttgagggaacaactgagctaagctgtacacgttcagactggattccacttgttatattttgttttaatagtgtatcagtgaagttaaaggtttagaaaagggtgaaagtttgttttttggtatgataattgaatgctctgtgaattgctcactgaagtatatttccttttag

SEQ ID NO: 2685 - DNA, 752 bp, Panicum virgatum
attgggcttgagcggacacgattcgtcgtccgtgccctgtgggcgtcgagccgtcgacccgccacctgtctgctcgccgccaccgtcgccgccgccggcacctcagctcgctccggtcaccccttccctcgaggattcactgggggtggatcatagcatgaggttcgctggctggtacctgaagatcgcggcggtcggggcctccataggcgccgccatggagctcttcatgatccacaccggcttctatgagaaggtaactgtcttggagtcagaaaaacgagcttgggaaagcagtccagaggcccaagctatgagagaagccctgaatccgtggcgcaagcatgatgagcaacagaagaaatagtcacacgttatgtgtcctgtcaagtgtttgcatcctccatttgtagaccccttgaataaggtaaaatgtgtgtaaatgatttgcatttggtgaataatttgtcctagatctctgaaatttctggatgcctggatatgataccttccagcaaagtttaaggggctgtaggcagttacgataaacttattccaaggagcaaaaaaagtttgagggaacaactgagctaagctgtactgtacatgttcagactggattgcacttgttatattttttttaatagtgtatcagtgaagttataggtttagaaaaaggtgaaagtttgtttcttggtatgataattgaatgctctgtgaattgctcactgaagtatatttccttttagtta

SEQ ID NO: 2686 - DNA, 670 bp, Setaria italica
cacgattcgacagcctcctcttccttgcgtcgacccgcctgtccgctcgccgccgccgccgccgccgcggccgcctcgccttgccgtcacctcagctcgctccggccaccccttccctcgaggattcactgggggtggatcatatcatgaggttcgcgggatggtacctgaagatcgcggcggtcggggcctccataggcgccgccatggagctcttcatgatccacacaggcttctatgagaaagtaactgtcttggagtcggaaaaaagagcttgggaaagcagtccagaggcccaagctatgagagaagccctgaatccgtggcgcaaacatgatgaacaacagaagaaatagtcatgagttatgtgtcctgtcaagtgtttgcatcctccatttgtagaccccttgaataagaggtggaaaatattgctgcaagagtctgacagggactgcctggaacggctaaacaaccaagtggcgacctgggtgaaaggattcctagtagaggaacgcaatcaagacctgatggaggacttcatttgagctgcttttaccttctatgatagactctgatggtgtaatctcttagcatatgtctgtggttattcagcttagtatgttgctaggcttttctgaagttctctcttgtaagctggtatccagcaaaa

SEQ ID NO: 2687 - DNA, 683 bp, Panicum virgatum
  misc_feature (402)..(403): n is a, c, g, or t
  misc_feature (407)..(409): n is a, c, g, or t
  misc_feature (412)..(412): n is a, c, g, or t
gggcgtcgagccgtcgaccgcctgtctgctcgccgccgccgcctcgcggtcacctcagctcgctccggtcaccccttccctcgagtcgaggattcactgggggtggatcatatcatgaggttcgcgggctggtacctgaagattgcggcggtcggggcctccataggcgctgccatggagctcttcatgatccacaccggcttctatgagaaggtaactgtcttggagtcagaaaaacgagcttgggaaagcagtccagaggcccaagctatgagagaagccctgaatccgtggcgcaagcatgatgagcaacagaagaaatagtcatgcgttatgtgtcctgtcaagtatttgcatcctccatttgtagactccttgaataaggtaaaatgtgtgtaaatnntttnnnttnggtgaataatttgtcctagatctctgaaatttctggatgcctggatatgataccttccagcaaagtttaaggggctgtaggcagttacgataaacttattccaaggagcaaaaaaagtttgagggaacaactgagctaagctgtactgtacatgttcagactggattgcacttgtatattttttttaatagtgtatcagtgaagttataggtttagaaaaaggtgaaagtttgtttcttggtatgataattgaatgctctgtgaattgccc

SEQ ID NO: 2688 - DNA, 5319 bp, Oryza sativa
tggccaacgaaggcggtgtcgacgagagccgtgatggggttggcggcgagggcgagcacagcaggcaaggcgatggtgaggatgtccataccaatctcatcaaccatgaaccatccgcgcccgcgcacctcctcctcttcgccatccggcgaagtctccttctcggctacaacttccgtgacaccgggcttcccgcggcaccgcgtgggcctccaccgaggaggaggagcagcactacggcagtgacgacgggagaagggaaaggatatacggttgagagctggagaaggggttaggacaagcgcggcggcggcgacagacgtcatcggcggcgaggtcgccgccatgccgcccgggtgtgtggtgcgagcagtgatattttctgtgttgggtctgggtcgggctgggccggcgctgggccttctctcacaaaaaaaaaaactccaggggatgatctggaccgtcggtttatctgtgtattacgccaatatgcgtgcctcctcttcgcgttctctctctctctcccccgtctgacctcggctccatctgccgccgccgccgcctccgcgcggtggatctctctctctctccggccaagctacctttgacggaggaaagttacagcgcgggccgaggagggaggccgacgacctgtacacagggcagagtccacaccggaaggtcatagagccatagagctagcaagagctgagtggggtgcgagagtaaaaaaatatctgtgcattcgattgcatcacggacatacgggaaaggatatgaggttcctggggtggtacctcaagatcgcggtaggcggcgccgccataggtgccagcatggagctcttcatgatccacaccggcttctatgagaaggtaactgtgttggaatcagaaaaaagagcttgggagaacagcccagaggctcaagccatgagagaagctctgaatccatggaggaagcatgatgaacaagagaaatgatagtcctaggctcatggccaccctcaattgtagcccttcatgaggtaatttcgatactaagcatttttgcagttggtcaaacagtaattgtacctctctcaaactgctggatggtaggtggtagcttctacaaatgctttagaagaatatacccgtatgtcttgatatatattttttggttcaacacgcatatacagatggcatgccatctttatgtgatgcactgatgattcatactagataacaaggaaattataggcttggacaggttgaacaggcccttttttttgtgtgtgtgtattactactatcccttttcattggtttgctgctactggagtatgggtttttgtgattaaagatagctgaggttgcccagctgtgttcctaactaaattccatgtccactgtgccattgaaccagctaattttcttagttcttattgaggtaataacctagcgtgttaggcagaggcatccaatttcacaactgcatcatacacgaagtgctaaatgaaaaaaaaaataccttgagaaacgttcttgattttactatttatgttagaaacaattgttcaaaattaattccgtggcatcttggatgtcaacaactcaacatcaatgccctgtaaatggaactgctatcctaatctgcttctttctctgcgattctctctgatgattttatttacatgcatgttatctactaacctagttcacctagaactcaatcaaaacttgtacaaagtagccatggtttcatagcagtaaggaacagatcaaggagttctgtcaagtcgaaacttcgctaaggtgtttacaacttgctgaccaccagcagcactgtaagctgttcttgttctcaagaataggattatgcttgacaccaaccccaggaatgtgatacaaccccacacaaagaatgtggttgagtagcactttggccccatgcaaaccaccatagtgtcaaccatgccattgcggttgtctattactgacatctttaggccatttgcatcatacactagggcagcaatctgaccgtagagaagtgatccaagagggatgttggtgatgaggatgttatggttcatgccaatgctgtttggtccaaagagctcagaggtcactgacactgctgcagcaaagatgaagcctgagcttagaccaattagtgctgttcctgctaccagagtgtttacatcatgcaatttccacattaggaagaacgccattggcatgggaaccaacgcagctgcaagccaccctgtccgagcaaacgaaaccttcctgcatgcaaattcaatatatatagttagtttatgggccagctggtgagaattaggatgcattcaagtatatagaacaagacagagggacctgcgaaggaagtctggaagtgcagagagaaggcgaccaaagaaggaacaggaggagtagacggcaagaagcatggtgagctgagattcccggtgaaatgattgtgcaatctgccccaagttgttgctgtacactagcccaacagtggcaccacagaagtaggctatgtagtatagccagaagtcgacgcactggataagcttctttgcactatgctcctcacaaagaaccaacatgcgtcccttctccagtactgttcccaagcaacaatcctgcattgggtgttccactgttttctgcatcatggcattggactctgtgctgtggtcactattgagcaaaagtggttttcttgaatcttcgtggttgagttgaacagtaggttcagggtcatgtgtgtccacatgagaacaactggaggaggcagggatgatgagagggagggcgaggaggaccatggcacctgtaaggaccacccatgcagtggagttggttgtgttgaaagagccgaagatcactagatatatgccagtgatgaacgcgaggaggtagagaccaagaaagatacgtttgtcatgcttgggcacaacgtggaggtggccgtcatgtgggtggcagaggagtattgctggcagtgcaacaagagatacgacgagagggacaatggcattgagaaggaggtagacagatggggaaaagggggagagggcattggcaaagagggtgtagaatgcagcacttagcccattgaagcttatggagagggagagggccagtgggcgattgctcgaggagaaactgcgaatgcagagcacaaagcatactgtgttgaaccagcagatactgcaacctgctaccaggcagatcaagaacacctgcattgtaatacatgatccaaattagtcaatcagttggttagctcagttttactggctgcaaacagttaaaaagcatttgtccgtacatcgctggtttaatactgttgatgaaagttaaaggaaaacatgcctaacagtaagttattatgcaccaacgatcagttcatacatcctggtttaatgtatgcaagatgtgaagtatactaatatgtaatgcattgtacaacaaagtgataaatccagatttgctgcttcgagtagtgtttggaagagagtgttatgtactgttgcggaaaaactgtaatggcatgatcttcggtaataattctgtgatctaattggtatttgtgtttatcaggatgttatgcttcctcatctgtaaaaaggatgtcatacttcctactgatattgaaggatctgcccaaggaaaggaagaatatgtgaagcatgagcaggttgaggatgctgttctgagtactgaaaaatgcaatgcaacaggcgtgtgtgaagttgttgttgtcatcacattcatggctgacgctctagcaatgcttttctttgtcaggaattttgttctaggctgatgatgtggcttctgttttagagggagtgccttcgatttggcggttgcgaggacgttcctttgttaaaggcctcatgccgttggtttcagaaaaggaaaactgcagccggtctgagaagtgagaataggtaattaacttgctgaccttgtctaggtatgctgttttagtttcagaggacaaaccaggacggctaattatgtctttgagctatgcagtctaacaagatttattactgtaattcaaaatatattatggtggcagaggattggttataggctctaaaatcaggaatacgttcagactatttgattactgtaactgataaaaaggatgtgctgcttctttcttgctactgtttatgatggagaagttgaaggaaggaggctatacttggcagttggcatcaacacctaccactctaccagtcagaaagaaaccaaaagaaggggatacagtgtagcgatggtccttttgtaagaagaattatgtgggggaagaatggtagcttgttcatctgctagtcaaagctgaattgaagctgaaactgatagttgggcaggaaggcattaattcaagatgatgccaataatgcaggactcactggcatgggtattttgatagcgagttttattaactgtaattcaggacacagagctacctggatgtttagagtaacagaatggattttagttttacatagtgccgtagcgttagtttgttcgtgagtttttcatgagtgaagcgtgaacttaccgatggagttttagctatttatacttttctggaccattttaagctgagacttgagaaccatttgtttgtttcttcttcgatcgtgtgtgggatttttatttttggctcttcatcttttgaaataggcgcaagcagctaacatttatgaaaattaaaagggagatgagaaagaatcaattaaataaacacttttgatcgtggttgatgatggcatatgcgggtgttgttggttaggagttgtttgttattccctccatcccaaaatatacgttgagttgattgaagtaatcaattaatccagatacatgtttaaggcagaaactaacttattgctgcagatacacagtatataagattgactatgtataacatgggcaatattataatacacagtaggagtatattggtaaatggtaatcgattgcagcagacgattccaaaaaattgtaagccaaggaaaaacgagaggtgggcgcggcgacggagagatatggatgcattgagtctctcagatatcgatttaatatacatataattcagtagcagttgaatgggacgttagaattgcgtccgtaaatgtgatatatgattgcaacttatttgtggccactcagatcagtagcttcattactactactactagtactatcgatctcgaatctccaaaccctgctggccggccttggcctctatacatccacgtactactacgatcaatcagcatagttggctaagatctcca

SEQ ID NO: 2689 - DNA, 611 bp, Festuca arundinacea
  misc_feature (538)..(538): n is a, c, g, or t
ggcacgagggccgcctcctcgctccggcgaccgctgcttctgacaccgcttgcagccagcggcgcggcatgaggttcgcggggtggtacctgaagatcgccgccggcggcgcggccataggtgcctgcatggagctgttcatgatccacaccggcttctatgagcaggttacgatgctggagtcggaaaaaagagcttgggaaagcagtccagaagcacaagctatgagagaagccttgaatccgtggcacaagcgtgatgaaaagcctgatgaaaaagagaaatgatagccacaagctatcattggtcctcctttcaagtaattgcactcccatccttcagctgtattgtagtcccttgaacgaggcaatgtggaatgcagcattttttgcagttgtcgaaacatgtacccttcacctctgggattgctggttggcagcttccagctattttctaaaagagtatgcccatattggatccatgtgtcacaaggattctttttctgcttcgacacatatgtgtccactttggtcttagncatataacaaagaactatagactcagagtggtcataccgacctttcattctttgagcgactactgtctgttct

SEQ ID NO: 2690 - DNA, 5180 bp, Oryza sativa
taccgacatggccaacgaaggcggtgtcgatgagcgccgtgatggggtcggcggcgagggcgagcacagcaggcaaggcgatggtgaggatttccataccaatctcatcaaccatgaaccacccgcgcccgagcatctcctctcctccatccttcctctcggggttggcctcccgccgccaggtctcctcctcgtcgtcgtgtaccacgtcctccaccgccggcttcccgcggcaccgcgcgggcctccaccgaggagcagcagtactagggcagtgacggtgggcgaagggaaaggagagacggttgagcgttggagtgggggttaggacaagcgcggcggcggcgacagacctcatcggcggcgaggtcgccgtcatgccgcgcgagcgtgtgactgtggactgtggtgtggtctccgtccaagcagtgatatttttgggttgggtttgggttgggttgggtcgagttggagtgggccttcttatcttgaggaaaggcccactccaaacctttgccttccctttcttctcctcctgcttccccgtctcacctcctcctcgtcggccgccgcctccgccgcatccgcctccgcctccgccttattgctcacttcgctccggcgacggaaaggccggccggcagcttggttgcgacaatcgaattgagtgcaagagaatacaaaaaattcgcgtctcgtcccggccttagtgaagagggcatgaggttcctgggctggtacctcaagatcgcggccggcggcgcggccataggcgctgccatggagctgttcatgatccacaccggcttctatgagaaggtgactgtgttggagtcagagaaaagagcttgggaaaccagcccagaggctcaagccatgagagaagccctgaatccatggaggaagcatgatgaccaagagaaaagatagccctagactcattgccacccttcaattgtaagcccttcatgaggtaatttgttggatgtactagtacttcctccgtttcatgttagcattgcctacattcatatatatgttaatgaatatagacatatatgtgtgcttagatttattaacatctatatgaatgtgggcaatgctagaaagtcctgtaacctgaaacggaggtagtagcatttttgcagtatttgtacctctctcgaacttctggatggtaggtggtagcttctacaaatactttagaagaatacacccgtatgtcttgatatatattttttttggttcaacacacatacacagatggcatgccatctttatgtgatgcactgatgtttcatactagataacaaggaaattataggcttggagaggttgaacagttctatttttaatgtgttactactatcctttttcatttgtttgctgctactggactatgggtttttgtgattaaagatagctgacgttgcccggctccggctgtgttcctaactaaatttcatgttccactgtgccattgaaccagctaattttcgtagttcttattgaggtaataacctagcatgttaggcagaggcatccaattccacaactgcatcatacgcaaagtgctaaatgaaaaaaaaaaccttgagaaatgttcttgattttactatttatgttagaaacaattgttcaaaactaatttcgtggcatcttggatgtcagcaactcaacatcaatgccctgtaaatggaactgctaccctaatctgcttctttctctacaattctctctgatgattttatttacatgcatgttatctactaaccgagttcacttagaactcaatcaaaacttgtacaaagtagacatggtttcatagcagtaaagaacatatcaaggagttctgtcaactcgaaacttggctgtggtgtttataacttgctgaccattagcagcactgtaagctgttcttgttctcaagaataggattatgcttgacaccaaccctaggaatgtgatacaaccccacacgaagaatgtggttgagtagcactttggccccatgcaaaccaccatagtgtcaatcatgccattgtggttgtctattactgacatctttaggccatttgcatcatacactagggcagcaatctgaccatagagaagtgatccaagagggatgttggtgatgaggatgttatggttcatgccaatgctgtttggtccaaagagctcagaggtcactgacactgctgcagcaaagatgaagcctgagcttaggccaattagcgctgttcctgctaccagagtgtttacatcatgcaatttccacattaggaagaacgccattggcatgggaaccaacgcagctgcaagccaccctgtccgagcaaatgaaaccttcctgcatgcaaattcattatatagttagtttatggaccagctagtgagaattaagatgcatgcaagtatatagaacaagacatagggacctgtgaaggaagtctggaagtgcagagagaaggcggccaaagaaggaacaggaggagtagacggcaagaagcatggtgagctgagattcccggtgaaatgattgtgcaatttgccccaagttgttgctgtacactagcccaacagtggcaccacagaagtaggctatgtagtatagccagaagtcgacgcactggataagcttctttgcactatgctcctcacaaagaaccaacatgtgtcccttctccagtattgtccccaagcaacaatcctgcatcggctgttccactgttttctggatcatggcattggactctgtgctgtggttattattgagcaaaagtggtttttttgaatcgtcatggttgagttgagcagtaggttcagggtcatgtgtgtccacatgagaacaactggaggaggcagggatgatgagagggagggcgaggaggaccatggcacctgtaaggaccacccatgcagtggagttggttgtgttgaaagagccgaagatcactagatatatgccagtgatgaacgcgaggaggtagagaccaagaaagatatgtttgtcatgcttgggcacaacgtggaggtggccgtcatgtgggtggcagaggagtattgctggcagtgcaacaagagatacaacgagagggacaattgcattgagaaggaggtatacagatggggaaaagggggagagggcattggcaaagagggtgtagaatgcagcacttagcccattgaaacttatggagagggagagggccagtgggcgattgctcgaggagaaactgcgaatgcagagcacaaagcatactgtgttgaaccagcagatactgcaacctgctaccaggcagatcaagaacacctgcatagtaatacatgatccaaattagtccatcagttggttagctcagttttactggccacaaacagttaaaaagcatgtccatacatcgctggtttaatactgttgatgagagttaaaggacaacatgcctaccagtaagttattatgtaccaacgatcaggtcatacatcctggtttaatgtatgcaagacatgaagtatactaatatgtaatgcatacaacaaagtgataaatccagatttggtgcttcgagtagcgtttagaagagagtgttatgtacggttacggaaaaactgtaatggcatgatcttcggtaataattctgtgatctaattggtatttgtatttatcaggatgttatgcttcctcatctgtaaaaaggatgtcgtacttcctactgacatcaaaagatctgcccaaggaaaggaagaatatgtgaagcatgagcaggttgaggatgctgttctgagtactgaaaaatgcaatgcaacaggcatgtgtgatgttgtagttgtgatcacatttatggctgacgcgctagcaatgcttttctttgtcaggacttttgttctaggctgatgatgtggcttctgttttagagggagtgccttcagtttggcggttgaagaccttgctttgttaaaggcctcatgtccgtttggtttcagaaaaggaaaactgcagccggtctgataataggtaacttgctgaccttgtctaggcatgctgttttagtttcagaggagtaaccaggacggctaattatgtctttgagctatgcagtgtaacaactcttattatgcaattcaaagtatgttatggtagcagaggattggttatggactcctaaaatcaggaatacgttcatactatttggttactgtaactgataaaaaggatgtgctgcttctttcttgctactgtttatgatggagaagttgaaggaaggaggtgacttggcaagttgcatcaacacctaccagtcagaaagaaaccaaaagaaggggatacagtgtagtgatggtccttctgtaagaagaattctttggggggagaatggtagcttgttcatctgctagtcaaagttggattgaagctgaaactgatagttgggcaggaaggcattaattcatgatgatgccaataatgcaggattcactggcatgggtattttgatagcgagttttattaactgtaattcaggacacagagctacctggatgtttagagtaacagaatggattttagttttacatagtgccgtagcgttagtttgttcgtgagtttttcatgagtgaagcgtgaacttaccgatggagttttagctatttatacttttctggaccattttaagctgagacttgagaaccatttgtttgtttcttcttcgatcgtgtgtgggatttttatttttggctcttcatcttttgaaataggcgcaagcagctaacatttatgaaaattaaaagggagatgagaaagaatcaattaaataaacacttttgatcgtggttgatgatggcatatgcgggtgttgttggttaggagttgtttgttattccctccatcccaaaatatacgttgagttgattgaagtaatcaattaatccagatacatgtttaaggcagaaactaacttattgctgcagatacacagtatataagattgactatgtataacatgggcaatattataatacacagtaggagtatattggtaaatggtaatcgattgcagcagacgattccaaaaaattgtaagccaaggaaaaacgagaggtgggcgcggcgacggagagatatggatgcattgagtctctcagatatcgatttaatatacatataattcagtagcagttga

SEQ ID NO: 2691 - DNA, 443 bp, Setaria italica
ggggcggatcataccatgaggttcgcgggctggtacctgaagatcgcggcggtcggggcctccataggcgccgccatggagctcttcatgatccaaaccggcttctatgagaaggtaactgtcttggagtcagaaaaacgagcttgggaaagcagtccagaggcccaagctatgagagaagccctgaatccgtggcgcaagcatgatgaacaacagaagaaatagtcatgaggttatgtgtcctgtcaagtgtttgcatcctccatctgtagaccccttgaataaggtaaaatgcgtgtaaattttttgcatttggtgaacaatttgtcctagatctctgaaatttctggatgcctggatatggtaccttccagcaaagtttaaagtgctgtaggcagctacgataaactttttccaagggagcaaaaaaattttgagggaac

SEQ ID NO: 2692 - DNA, 879 bp, Sorghum bicolor
gcggtgtgatgtgggctgccacaatagctctagtaggaaatccttgcaactgtagcggacgtggtgtgggctgaccgccgccggccccccatttgcatccttgcggcgctggcccgccgccagaacacgtctcgcccgcggccgatcctctccatccgctcgccgcgccgccacccggagaggcccagcgtcctcgcgagccgcgaccagctgcggcgcggcgtccgtcctctgcagccccggtgtccccgcggccgtcgctgctgtcctacttcgccactcgccactccccaccttggccggcgacgagcacaaccaggtgtatatgcatgtcctttactgattcagagggtggtgcatgcatgaagttcgcgggctggtacctgaagatcgcggcggtcggggcctccattggcgccgccatggagctcttcatgatccacacgggcttctatgataaggttgttgtcctggagtcagaaaaacgagcttgggaaagcagtccagaggcccaagctatgagggaagccctaaacccatggcgcaagcatgacgaacagcagaagaaatagtcatgagttatgcgtcctgtcaagtgattgtaccctccattcttaggcccttgaacgaggtaatatgaatgtgagtcttatgcatttggtgaataattgtactacttttttggaaattgctgaatgcctggatggatggtaccttccaggaaaggttgaagggatataggtaacagagttttttttttttttttttttgagggaacaaactatacactttcagactggattgcacttgttatgtgttgttttaacagtataacagcgaaattgtaggcatagaaagaggtgaaagttgtatgtctat

SEQ ID NO: 2693 - DNA, 621 bp, Zea mays
ggctttcactgggccatggccctgtcgctcgacaacctcatcaaagccgccgccgccgtcggctcagctcgctccggccgcctctgcctccctgcctctgaggatttgcttggggagggacatatgagattcgcgggttggtacctgaagatcgcggcggtaggggcctccattggcgccgccatggagctcttcatgatccacacgggcttctatgagaaggtaactgtcttggagtcagaaaaacgagcttgggaaagcagtccagaggcccaagctatgagagaagccctcaatccatggcacaagcatgatgaacaagaacaacaaaagaaatagtcaagatttatgtgtcctgtcgagtgtctgtgtcccccatccgtagacccatgaatgaggtactgttagtgtcaatcttctgtatttagtgaacaatctacatttttttatatacttctctaaaagggctggatgcctggatggtaccttccgcaagacgctgaagggctatgtgaaacagctataaactgtttttttcacgggaggaaaaaatcgagggaaaaattgtacactatcagactagtttcgcttgttttttatgatatattaacattaaacagc

SEQ ID NO: 2694 - DNA, 3310 bp, Zea mays
caaccgagggctcggatgttagattcattgtgcacatacactctctgggtcatcaacgggcggcttcatcgaggcgtagaggtcgtgctcgacatagctgtcgtagacgacgagaggaggatgcgtggactccaccacctccacctgcggctgtgggtccttcaactcgatggtgctggacaccgtcgcggtagacgtctgtgacctctgtgacgaccgacttcccaccacggcgaccgcatcgtgggagactcctccaccgagacggagtagagcgacggcggtggcagcggcaggaggtcaaggatatacgtctgtaaaccgcggacggggctcgggcgtgcgcagcggctgcaggtctcgccagcgtcggcgtcggcgaggtcgccgccatgggcgcgcggccgtgtggtcacagtcacagtggtcggagtgtgattggttggaaatcgaacgcgatgcgggccttccttttgggctcggtgggccgtgagtcccattttgtttgggcggcaaaggaaacaaaattgatcctactcatcatattcgtttggcttcaacggtcaggatttggcttccactccatgggcctttcgctcgacaagctcatcaaagccgccgccgccgccgccgtcgcctcagctcgctccggctgcctctgcctcccctgcctctgaggatttgcttggggagagacttattatgagattcgcgggttggtacctgaagatcgcggcggtaggggcctccattggcgccgccatggagctcttcatgatccacacgggcttctacgagaaggtaactgtcttggagtcagaaaaacgagcttgggaaagcagtccagaggcccaagcaatgagagaagctctcaatccatggcgcaagcatgatgaacaagaacaacagaagtagtcaagatttatgtgtcttgtcgagtgtctgtgcccccccatccgtagacccatgaatgaggtactattagtgtcaatcttctgcatttggtgaacaatctacatttttttatgtacttccctaaaagtgctggatgcctagacggtaccctccagaaggcgctgaagggctatgtgaaacggttacaggttgtgtgtttttttccgctggagcaaaaataataatctaaggggaaaatttgtaaaataagactgatttcttgtatgatatattaacattaaaacagcaaattatgggtataggaatgggtggaagttgtattcttttctctacaataattgaatgctctgtggattgctcacttaaagctttttcagctatggctcacctgagtagtacgccccaggcgttcttgtaaaatttagaaactggctgtgtgattttgtggtgcttgaacaacttatgacacccctatttgaagcattagtgcctccttggcacagactgaaggagaagttttcacatttaattttaggcagaaagctgaaatgctagtcagattcaatcctgaagtcctgcatgctgtaatcattataagtgttacataaaaaacagtaattatggagcatttggcacacaactccattccactggcaacaacagtctaactctaaactgatttcatgctatcctgggtaaacggagtgttcgttctgtactttaacatttcagctataaagctgttaattactgttccatcttggtctcgtcctgtcaagtatttgcattcacatcctccagctgtaaccctcagatgaagtaatatgaatgggatcctttttgtacaagctactcattttcacatattttttgtaacccgtttcagctagaactatcaactaaccaaaattttatacaagctagcggtgattacaacagtaagtttctctgtcaactactttaactggaaacttggtgaaggtgcttacaacttgaccgactagcagcagtggcataagctggctttgttcttatgaatagaactatgcttgatgctaaccccagaaatgtgatgcaagcccacacgacgaaggtggttgagtagcacttcacccctatgcacacagtcatggtgtcaacaatgccagtgcggttatccactactgtcatcttttggccatttgcatcgtataccatggcagcaatctgcccatagaggagtgagccaagcgggatattggtgataaggatgttgtgattcaccccaacgctatttggtccaaagagctccgaggtcactgacactgctgcagcaaagatgaaccctgagcttaggccaattagcgctgttcctgctaccagggtgcttccatcttgtttgttccacataaggaaaaaggccattggcatggggaccaatgcagcagcaagccaccctgtgcgagcaagtgacaccttcctgtggacaaattttagttaggaagcatgagatatgatgatatatatgtatgcatataaagcaaaacagatacctgtgaaggaggtcaggtagtgcagagagaagacggccgaagaaggagcaggatgagtagacggcaaggagcatggtgagctgtgactgctggtgcaatgactgagcaatctgacccaagttgttgctgtataccaggccaacagtggctccacagaagtaggctgtgtagtagagccagaagtccacacaccgaatgagcttctttgcactgtgttcttcaccgagcgtcgccaggcggcccttgacctgcacctggttctcctttggcttttgcatcatggcattggactccatctgactgatgaggagtggcttatgtgggtcatcatatgcagggtcagggccatctgagcaactggagcaggcagggatgatgagaggaagggcgaggaggaccatggcacctgtgaggatgacccacgcagtagagctggttgcggtgaaagatccaaagaccaccagatatatgccggtgatgaatgcgaggatgtagaggccgaggaagacgcggccgtcatgcccgggcgcactttggatgtggccctcatttttgtggcagaggaggatcgctgggagtgcaaggacagagacggcgagagggaggattgcattgaggaggaggtagacagctggggagaaaggggagagcgcgttggcaaagagagtgtagaaggcagcgctgagcccgttgaagcttatggagagggagagggctagggagcggctgctcgcagagaagctgcggatgcagagaacaaagcagactgtgttgaaccagcagatgctgcaccctgctatcaagcagaacaagaacacctgcagggggggcaacatgtgaatcagaggagtttggtcagacaa

SEQ ID NO: 2695 - DNA, 639 bp, Sorghum bicolor
cacactgcccccactcgtcttcaccagaaacccgccgccgccggtttggtccccgtcgtccccgtccccgtccccatctccggccaccactagcttccgacccgtaccaacgcccttcgcccctacctcaacattgctagcaggaaactctcccagaccgagggacgaatccagagggtgcatgcatgaggttcgcgggctggtacctgaagattgcggcggttggggcctccattggcgccgccatggagctcttcatgatccacacgggcttctatgataaggttgttgtcttggagtcagaaaaacgagcttgggaaagcagtccagaggcccaagctatgagggaagccctgaacccatggcgcaagcatgatgagcaacagaagaaatagtcatgagttatgtgtcctgtcaagtaattgtatcctccatttgtaggcccttgaacgaggtaatatgaatgcgagtcttttgctggtgaataatttgtactacattttggaaattgctggatgcctagatggatggtaccttccaggaaaggtttaagggacataggtaacagagttatttcttttttcaagggaacaaactatacactttcagactggattgcacttgttatgtgtttgttgg

SEQ ID NO: 2696 - DNA, 630 bp, Panicum virgatum
cgacttcaaatccgccgcgacgccgcccgcctcgccggtcgcttggcctcagcgcgctcgggccgcctctgcgtccgacgattcacggcgagggtgtcatattatgaggttcgccgggtggtacctgaagatcgcggcggtcggggcctcgattggcgccgccatggagctcttcatgatccacaccggcttctatgagaaggttactgtcttggagtcagagaaacgagcctgggaaagcagtgcagaggcccaagctatgagagacgccctgaatccatggggcaagcatgatgaacaacagaagaaatagtcatgagttgtgtgtcctgtcaagtgtttgcatcctccatttgtagacccttggatgaggtaatatgactctgaatttttctgcattcagtgaatgatttgtcctacatctatgaaattgctggatagctggatggtagattctgggaaagtttaaaagagctataggcaactgtgccaaggaagccaattttgttttcaatgaaacatatgctaaactgtacaattccatactggatttcacttgctatttgttattttaactgtataacagcgacattatgggttagaaagggtgacagttgtctgtttctttgt

SEQ ID NO: 2697 - DNA, 691 bp, Zea mays
cctgctcatcgatcttattcatttggcctcaacgatcaggattagtttggcttccactccttgagccttctgctcaaagcaaccaccgctggctcagctcactccggtggcctccggccgcctctgcctccgaggattcgcttggggggagacgtattatgaggttcgcggggtggtacctgaagattgcggcggtggggcctccattggcgctgccatggagctcttcatgatccacacgggcttttatgagaaggtaactgtcctggggtcagaaaaacgagcttgggaaagcagtctagaggcccaagctatgagagaagctctcaatccatggcaaaagcatgatgaacaagaacaacagaagaaatagtcaagagttatgtgtcttaagtgtctgcgttcccatccgtatacccttgaatcagcttccagaacacgttgaagggctatcgaagacagttataaactgcttttttcatgggatgcaaaaaaaagaggggacattgtacactatcacactgggtttcacttgtttttatgatattttaacattagaacatcagattttgggtatagaaatgggtgaaagttgtctgcttctctgtacaataattgaatgctctatggattgctcatgtaatccttttcagttatgatatttttttaaacatcatttgttggaacaaaa

SEQ ID NO: 2698 - DNA, 328 bp, Saccharum officinarum
ccactagcgaccaaccccttgcagtttttaagaggaaactctccctgaccgagggacgaatccagagggtgcatgcatgaggttcgcgggctggtacctgaagatcgcggcggtcggggcctccattggcgccgccatggagctcttcatgatccacacgggcttctatgataaggttgttgtcttggagtcagaaaaacgagcttgggaaagcagtccagaggcccaagctatgagggaagccctgaacccatggcgcaagcatgacgaagaacagaagaaacagtcataagttatgtgtcctgtcaagtgactgtatcctccattt

SEQ ID NO: 2699 - DNA, 229 bp, Pennisetum glaucum
caccccttccctcgaggatttactgggggcggatcgtatcatgaggttcgcgggttggtacctgaagatcgcggcggtcggggcctccataggcgccgccatggagctcttcatgatccacaccggcttctatgagaaggtaaccgtcttggagtcagaaaaaagagcttgggaaagcagtccagaggcccaagctatgagagaggccctgaatccgtggcgcaagcat

SEQ ID NO: 2700 - DNA, 1618 bp, Triticum aestivum
ccggtagaaagaaacccattgagacgcccaaaccctaccgcgcctcgcagctcccgcctcccggacgccgacacccagcagccgccgccggcgcctccgcccgacgccgacgagggcttattcgccaccgattctcttcgtgttcttcctcgtggacgcttcgttgctgatttgttctcggcatgggcaaatccaaagacaagaaggcttcgcgggaagccaaggttgataagaagctggcgcttgggcttggagtgaagaggaagcagctgaagaagaagaaggatagagttttagatgctgccgttgagagcgagggcgctgccggacatgctatcgcggaagatataggaagcaagaagattgtattggtgaagcaaaagaagaaaattaagcatgccaaagtaacaagctgttgtaccaaggctcataatttggtgactctcaatgaggatgaggcaacacctaagctgaagaagaagaagagcaaaaaacagctaaaggaaagcaaaagtcctgttgaggtacaaagtccattggacagtaatgatgctggaacacttaagctgaagaagaagaaaaggaaggtgaaggaagggaagagctctgttgagcccaatgatgcagatgatatcctgcatgaaaatctcgatgaagaaactctaaacgctgatgtcaaccaacttccagcagagagtgaagttatggatattggggaaccagaaaaggcaaagaaacgaaagaaaaataagacagctgatgtcaaacaagttgcagaagagagtgaagttatggacattggggaaccagaaaaggcaaagaaacgaaagaaaaataagacaaagaaagtaaagcaatctggggaagtcaacaggacagatatgcaggtatcagttagagaggacaatttggaggtgcatgaagttgataccgcaaatgttgatgagattgcatcagtcgatgaagactgttccagaggaatgaaaaaatggatcttggagtacagacagaagcggccaggcttgaaagtcttgcagcaaaatatagatgtgtttataactgcacatgaggaacaacaagagcgggagaagaaggaaagagaggcagcagctgcagaagatgggtggacagtggtgatgcatcataagggtcggaagaagactacagatgctgaaactggaacagcggttggctctgtatctctggctgcaatgcaagagaaaatggctcagaagaaacccaaggaagttggtcggaacttctacagacatcagaaacgagaagctcaaatgagtgagctggcgatgctgcagagcaagttcgagcaggacaagaagaggatacagcagctgcgggctcaaaggaaattcaagccttacggattttgaagggggctcctccatggagaggcagtgttcgttccacatcactcgagaccagccgtcgctggagtgctggcttggttgctatgttgaacgtgcactgcattcctttttttgacagaaaatgttgcatcgttggacaaatgtaccatgcttcttgactgggaacggtgccagtcgtgtacaatggcttgaacatttgcagcaagtgtattattggttatctggcccatttt

SEQ ID NO: 2701 - DNA, 1669 bp, Triticum aestivum
ttcgtcgcgatttggtctcccggcggcgacgagagcacggcgacgcagcaaagccagcctcactggttgccggcactggaccggcgcggattgatttcttctttccttggatattcagagcaccacagagttgcagatgtcaccccagggtactaatgaagtgcaaagtaaccaactaaacacaatggccactgatgcacctgcaggagatcccggttctgtggcagtcgctaacaatgataatagaaaagtctcccgtgaagacattgaacttgtccaaaatttgatagagcgctgtctgcagctgtacatgaccaaaggagaggttgttaggacactttctactcgtgctagaatagaacctggcttcactactttagtatggcagaaacttgaagaagagaactctgaattctttcgggcttactatataagattgaaattgaaaagacagattgtcttgttcaaccatttattgcagcaccagtataacttgatgaaatatccagcacctccgaatgttccgctggctcccatgcaaaatggaatgcatcctttgccagttaacaatctaccgatggggtatccagtacttcagcaacctctgatgcctgctcccggccagcctcacattgatccgatggtttgtggtctatccagtggtcatgtagtgaatgggatccctgcaccaggtggttatcatccaatgcgcatgaactctggaaatgacatggttgtggacaacggtgcacctgaagttgcacatgctggtgctatgtcatctgatatggctgtgagtccctcatcagcagcatcaagccatgctcctttcactccatctgagataccagggatggccatggatacatcagtcctggattcagcatttggatctgagatagggaacacaggacctctgcaattaggggcagatgggtcgtcaagggaatccatccgatccttggggcagctctggaatttcagcctctctgatcttacagcagatttgacaagtttaggagacttggaggctcttgagaattatgcgggtacccctttcctgccctcagactcggatctcttacttgattccccagaccatgatgacataggtaaccatgatgacatagttgagtactttgcggacgccatcaacgggtctcaatcggacgaagagaagccatagaagaacagactcagaatagtcccattgagatttagtcctggctagagtgtcatctcatgtagtgtaatctcgcagcccgtgcataccggcgcaatatcagactgggtgttcgcccagaggtgcggtaattgcgcgtcactaaggaattttgtagtggccaatgctagttcttcggaataatcagcctcaggcagccttcaccggataaagttgctgtctacaagtctgaaaagtttagaaaaaaaaattgtgtcgaacctcaggaacaaatcaaaccctttgtaattgctgaacaagtggacagttcatctggtattgcgccatttcgtgtcttccaggttgcatgtacagccaattcaaggtctcctgtacgggcctgtttctattttttctttctctctgagagtacgccgatggcgtgccatgtatgtgttcgagaatgcatcaaattaaagagttcactagaggcttttctcaggccaa

SEQ ID NO: 2702 - DNA, 1671 bp, Triticum aestivum
ttccaacgttcatccttcccgtcgccttctctcctcacagatttctccccccaaattcgcccccttcccagccccattttccagcagccggtgctccttcgttcgtcgcgatttgttctgccggcggcgacgagagcacggcggcgcagcaagccacagcctcactggttgctggcactggaccggcgcggattgatttcttctttccttggataagcattgatcctggatttagctatttcttatgtgataagtagataagctgcaatgaaggattctcaggatattcagagcaccacagagttgcagatgtcaccccagggtactaatgaagtgcaaagtaaccaactaaacacaatggccactgatgcacctgcaggagatcccggttctgtggcagttgctaacaatgataatagaaaagtctcccgtgaagacattgaacttgtccaaaatttgatagagcgctgtctgcagctgtacatgaccaaaggagaggttgttaggacactttctactcgtgctagaatagaacctggcttcactactttagtatggcagaaacttgaagaagagaactctgaattctttcgcgcttactatataagattgaaattgaaaagacagattgtcttgttcaaccatttattgcagcaccagtataatttgatgaaatatccagcacctccgaatgttccgctggctcccatgcaaaatggaatgcatcctatgccagttaacaatctaccgatggggtatccagtacttcagcaacctctgatgcctgctcccggccagcctcacattgatccgatggtttgtggtctatccagtggtcatgtagtgaatgggatccctgccccaggtggttatcatccaatgcgcatgaactctggaaatgacatggttgtggacaacggtgcacctgaagctgcacatgctggtgctatgtcatctgatatggctgtgagtccctcatcagcagcatcaagccatgctcctttcactccatctgagataccagggatggccatggatacatcagtcctggattcagcgtttggatcggagatagggaacacaggacctctgcaattaggggcagatgggtcgtcaagggattccatccgatccttggggcagctctggaatttcagcctctctgatcttacagcagatttgacaagtttaggagacttggaggctcttgagaattacgcgggtacccctttcctgccctcggactcggatctcttacttgattccccagaccatgatgacataggcaaccatgatgacatagttgagtacttcgcggacgccatcaacgggtctcagtcggacgaagagaagccatagagaacagactcaaatagtcccattgagattagacctggctagagtgtctatctcatttagtgtaatcttggagccgcgcataccgcggtaatatcagactgggtgttcgtccagagatgcggtaattgcgcgtcactaaagaattttgtagtggtcaatgctagttctttggaataatcagccttcaccgccgggtaaatttgctgtctacatggctgaaaagcttaggaaaaaaaaactgtgtcaaacctcaggaacaaccctctgtaattgctgaacaagtggacagacagttcatctggtgttggaaca

SEQ ID NO: 2703 - DNA, 1813 bp, Secale cereale
tttctccccctaaatttgcccccttctcagccccatttcccagccggtgctccttcgttcgtcccgatttgttctcccggcggcgacgacagcacggcggcaccagcaagccagcgtcactggttgctggcactggaccggcgtggattgatttcttctttcctcggataaatattgatcctggatttagctatttcttatgtgataagcagataagctgcaatgaaggattctcaggatattcagagcaccacagagttgcagatgtcaccccagggtactaatgaagtgcaaagtaaccaactaaacacaatggccactgatgcacctgcaggagatcccggtactgtggcagtcgctaacaatgataatagaaaagtctcccgtgaagacattgaacttgtccaaaatttaatagagcgctgtctgcagctgtacatgaccaaaggagaggttgttaggacactttctactcgtgctagaatagaacctggcttcactactttagtatggcagaaacttgaagaagagaactctgaattctttcgggcttactatataagattgaaattgaaaagacagattgtcttgttcaaccatttattgcagcaccagtataatttgatgaaatatccagcacctccgaatgttccgctggctcccatgcaaaatggaatgcatcctatgccagttaacaatctaccgatggggtatccagtacttcagcaacctctgatgcctgctcccggccagcctcatattgatccgatggtttgtggtctatccagtggtcatgtagtgaatgggatccctgcaccaggtggttatcatccaatgcgcatgaactctggaaatgacatggttgtggacaacggtgcacctgaagctgcacatgctggtgctatgtcatctgatatggctgtgagtccctcatcagcagcatcaagccatgctcctttcactccatctgagataccagggatggccatggatacatcagtcctggattcagcatttggatctgagatagggaacacaggacctctgcaattaggggcagatgggtcgtcaagggattccatccgatccttggggcagctctggaatttcagcctctctgatcttacagcagatttgacaagtttaggagacttggaggctcttgagaattacgcgggcacccctttcctgccctcggactcggatctcttacttgattccccggaccatgatgacataggtaaccatgacgacatagttgagtacttcgccgacgccatcaacgggtctcaatcagacgaagagaagccatagagaacagactcaaagtagtcccattgagatttagacctggctagagtgtcatatcatttagtgtaatctcgcagcccgtgcataccattgccgccgcaatatcatcagactgggtgttggcccaaagatgcggtaattgcgggtcactgaagaattttgtagtggtcaatgctagttctttggaataatcagccttcaccgccgggtaaagttgctgtctacaaggctgaaaagcttagaaggaaaaaaaaataactgtgtcaaacctcaggaacaaccctttgtaattgctgaacaagtggacagacagttcatctggtgttgagatatttctgtaactaaaaaaaaaaaaaaaaaaagaaaaaaaaaaaaagaaaaaaaaaaaagaaaaaaaaagaaagagagagacgagagacagagagagaggaggggacgtagacagatagagtgagtcagtagctggaggactgagctagctagcggtgaggctggtcgatcg

SEQ ID NO: 2704 - DNA, 1832 bp, Hordeum vulgare
taatagcaccaataattgactgatactgttttcagtattagcatccattttgttttgtctttagcaggtgattgatttatgttacttatgcaaatttcctacaggatattcagagcacgacagagctgcagatgtcaccccaaggtaccaatgaagtgcaaagtaaccaactaaacacaatggccactgatgctcctgcaggagatcctggttctttggcagttgctattaatgataatagaaaagtttcccgtgaagacattgaacttgtccagaatttgatagagcgctgtctgcagttatacatgaccaaaggagaggttgttaggacgctttctactcgagcgagaatagaacctggcttcactactttagtatggcagaaactcgaagaagagaaccctgaattctttcgggcttactatataagattgaaactgaaaagacagattatcttgttcaaccatttgttgcagcatcagtgtaatttgatgaaatatccagcacatcctaatgttccactagctccaatgcaaaacgggatgcatcctatgccagttaacaatctaccgatggggtatccagtacttcaacaacctctgatgcctgctcccggccaacctcacattgatcctatggtttgtggtctatccagcggtcatgtggtgaatgggatccctgcaccaggtggctatcaaccaattcgcatgaactccggaaatgacatggttgtggacaacggtgcacctgaagttgcacatactggtgccatgtcatccgagatggctgtgagtccctcatcagcagcatcaaccaaccatgctcctttcactccgtcggagataccagggatggccatggatacatcaatgctagattcagcatttggttctgacatagggaacacagaacctctgcaattaggtccagatggttcgtcaagggattccatccgatccttggggcagctctggaatttcagcctctctgatcttacagctgatttgacaagtttaggagatttggaggctcttgagaactatgaaggtacccctttcctgccctcggactcggacctcttacttgattccccagaccataatgatgacatagttgagtactttgccgacgccatcaacgggagtcaatcagatgaagagaagtcatagagaagatgacagactcaaatagtctcattcagtttgggacctggccagagcatcatctcatgtagtgtaatcctgtagctgcgcagactgccgcaaatcagactgggcattcatccagaggtgggatgattggcgaattttgtagcgttcaatgctaattatttggaataatcagttagggcagccttcaccggataatgttgctgtctacaaggttgaaaagtttaggaaattgtgtcaaacctcaggaacaacccctttgtaattgctgaagaagtggacagttcatctggtattgcaccattccttgtctccctgtgcctgtttcttttctctttttcctgagactacgtaatgtcgcaatgtgtcaaagtatttacaaggtgtggacaatggagtattttgcatgtgaaattgtgaatacagtaaatggggaaacaatggcctacgtatggtaacacatggtaacagtcttgtgctgtgggccaggataacgtcggtcagcgggaccgtattaactgtcaccctgtctggtgcattttttgtgagccgtggcccgtaaagtttgatggcagatgggtaaatgcgcctttcttgatgtaatgcaattgatgtaaaacctacttttgattattgcttgagaactgcatagctgtactttac

SEQ ID NO: 2705 - DNA, 1873 bp, Triticum aestivum
ctctcggccaattcgatagcacacctttgtaatactggtgtctcctatataaaccgaccaaaatcgtggatttgccccgtttccaacgttcatccttccttcccgtcgccttctctcctcacagatttctcccccaaaattcgtccccttctcagccccattttccaccccgtgttccttcgttcgtcgcgatttgttctcccggcggcgacgaaagcacggcgacgcagcaagccagcctcactggttactggcactggaccggcgcggattgatttcttctttcctcggataagcattgatcctggatttagctatttcttatgtgataagcagataagctgcaatgaaggattctcaggatattcagagcaccacagagttgcagatgtccccccagggtactaatgaagtgcaaagtaaccaactaaacacaatggccactgatgcacctgcaggagatcccggttctgtggcagtcgctaacaatgataatagaaaagtctcccgtgaagacattgaacttgtccaaaatttgatagagcgctgtctgcagctgtacatgaccaaaggagaggttgttaggacactttctactcgtgctagaatagaacctggcttcactactttagtatggcagaaacttgaagaagagaactctgaattctttcgggcttactatataagattgaaattgaaaagacagattgtcttgttcaaccatttattgcagcaccagtataatttgatgaaatatccagcacctccgaatgttccgctggctcccatgcaaaatggaatgcatcctatgccagttaacaatctaccgatggggtatccagtacttcagcaacctctgatgcctgctcctggccagcctcacattgatccgatggtttgtggtctatccagcggccatgtagtgaatgggatccctgcaccaggtggttatcatccaatgcgcatgaactctggaaatgacatggttgtggacaatggtgcaccggaagctgcacatgctggtgctatgtcatctgatatggctgtgagtccctcatcagcagcatcaagccatgctcctttcactccatctgagataccagggatggccatggatacatcagtcctggattcagcatttggatctgagatagggaacacaggacctctgcaattaggggcagatgggtcgtcaagggattccatccgatccttggggcagctctggaatttcagcctctctgatcttacagcagatttgacaagtttaggagacttggaggctcttgagaattacgcgggtacccctttcctgccctcggactcggatctcttacttgattccccagaccatgatgacatagttgagtacttcgccgacgccatcaacgggtcccaatcggacgaagagaagccatagagaacagactcaaaatagtcccgttgagatttagacctggccagagtgcctatctcatgtagtgtaatcttggagccgcgcataccgcggtaatatcagactgtgggtattcgcccagagatgcggtaattgcgcgtcactaaagaattttgtagtggtcaatgctagtcctttggaataatcagccttcaccggataaagttgctgtctacaagtctggaaaagtttagaaaaaaaattgtgctgaacctcaggaacaaaacaaccctttgtaattgctgaacgagtggacagttcatctggtattgcgccatttcgtgtcttccaggttgcatgtacagccaattcaaggtctcctgtacgggcctgtttctattttttctttctctctgagagtacgccgatggcgtgccatgtatgtgttcgagaatgcatcaaattaaagagttcact

SEQ ID NO: 2706 - DNA, 1725 bp, Triticum aestivum
cgagtctctcagccaattcgatagcacaacccacacctttgtaatactggtgtctcctatataaaccgaccaaaatcgtggatttgccccgtttccaacgttcatccttcccgtcgccttctctcctcacagatttctccccccaaattcgcccccttcccagccccattttccagcagccggtgctccttcgttcgtcgcgatttgttctgccggcggcgacgagagcacggcggcgcagcaagccacagcctcactggttgctggcactggaccggcgcggattgatttcttctttccttggatattcagagcaccacagagttgcagatgtcaccccagggtactaatgaagtgcaaagtaaccaactaaacacaatggccactgatgctcctgcaggagatcctggttctttgacagtcgctagtaatgataatagaaaagtctcccgtgaagacattgaacttgtccaaaatttgatagagcgctgtctgcagctgtacatgaccaaaggagaggttgttaggacactttctactcgtgctagaatagaacctggcttcactactttagtatggcagaaacttgaagaagagaaccctgaattctttcgggcttactatataagattgaaactgaaaagacagattatcttgttcaaccatttgttgcagcaccagtgtaatttgatgaaatatccagcacatccgaatgttccactggctccaatgcaaaatgggatgcatcctatgccagttaacaatctaccgatggggtatccagtacttcagcaacctctgatgcctgctcccggccagcctcgcattgatccgatggtttgtggtctatccagcggtcatgtggtgaatgggatccctgcaccaggtggctatcaaccaattcgcatgaactccggaaacgacatggttgttgacaacggtgcacctgaagttgcacataatggtgccatgtcatctgagatggctgtgagtccctcatcggcagcatcaagcaaccatgctcctttcactccgtcggaaataccagggatggccatggatacatcgatgctagattcagcatttggatctgacatagggaacacagaacctctgcaattagggccagatgggtcgtcaagggattccatccgatccttggggcagctctggaatttcagcctctctgatcttacagctgatttgacaagtttaggagatttggaggctcttgagaactacgaaggtacccctttcctgccctcggactcggacctcttacttgattccccagaccataatgatgacatagttgagtacttcgccgacgccatcaacgggactcaatcagatgaagagaagtcatagagaagatgaaagactcaggtagtctcattcagagtgggacctggccagagtgtcatctcatgtagtgtaatcttgtagctgcgcgcaaatcagactgggaattcacccagaggtgcggtgattggcgcgcgcccctgaagaattttgtagcgttcgatgctaattatttggaataattggttcgggcagccttaaccgggtaaagttgctgtctacaaggctgaaaagtttagaaaattgtgtcaaacctcaggaacaacccctttgtaattgctgaagaagtgggcagttcatctggtattgcaccattccttgtctcccagtgcatgttttctttccatgagtacacaatgcatc

SEQ ID NO: 2707 - DNA, 1680 bp, Secale cereale
aacgttcatccttcctcccgtcgccttctctcctcacaggtttctccccctaaatttgcccccttctcagccccatttcccagccggtgctccttcgttcgtcccgatttgttctcccggcggcgacgacagcacggcggcaccagcaagccagcgtcactggttgctggcactggaccggcgtggattgatttcttctttcctcggataaacattgatcctggatttagctatttcttatgtgataagcagataagctgcaatgaaggattctcaggatattcagagcaccacagagttgcagatgtcaccccagggtactaatgaagtgcaaagtaaccaactaaacacaatggccactgatgcacctgcaggagatcccggttctgtggcagtcgctaacaatgataatagaaaagtctcccgtgaagacattgaacttgttcaaaatttgatagagcgctgtctgcagctgtacatgaccaaaggagaggttgttaggacactttctactcgtgctagaatagaacctggcttcactactttagtatggcagaaacttgaagaagagaactctgaattctttcgggcttactatataagattgaaattgaaaagacagattgtcttgttcaaccatttattgcagcaccagtataatttgatgaaatatccagcacctccgaatgttccgctggctcccatgcaaaatggaatgcatcctatgccggttaacaatctaccgatggggtatccagtacttcagcaacctctgatgcctgctcccggccagcctcacattgatccgatggtttgtggtctatccagtggtcatgtagtgaatgggatccctgcaccaggtggttatcatccaatgcgcatgaactctggaaatgacatggttgtggacaacggtgcacctgaagctgcacatgctggtgctatgtcatctgatatggctgtgagtccctcatcagcagcatcaagccatgctcctttcactccatctgagataccagggatggccatggatacatcagtcctggattcagcatttggatctgagatagggaacacaggacctctgcaattaggggcagatgggtcgtcaagggattccatccgatccttggggcagctctggaatttcagcctctctgatcttacagcagatttgacaagtttaggagacttggaggctcttgagaattacgcgggcacccctttctgccctcggactcggatctcttacttgacttccccggaccatgatgacataggtaaccatgacgacatagttgagtacttcgccgacgccatcaacgggtctcaatcagacgaagagaagccatagagaacagactcaaagtagtcccattgagatttagacctggctagagtgtcatctcatttagtgtaatctcgcagcccgtgcataccattaccgccgcaatatcatcagactgggtgttggcccagagatgcggtaattgcgcgtcactgaagaattttgtagtggtcaatgctagttctttggaataatcagccttcaccgccgggtaaagttgctgtctacaaggctgaaaagcttagaagaaaaaaaataacaactgtgtcaaacctcaggaacaaccctttgtaattgctgaacaagtggacagacagttcatctggtgttga

SEQ ID NO: 2708 - DNA, 1564 bp, Secale cereale
cggtaggttaccttactagtcttgtcggtccgtcctttaatcccgcccctcctctcgcctctcgggggacgcgcgccgccgctgccgccgccatcgccgttcactttcttctttgcccccaggacatcctgctgctgtctccaccccgtcccagtctctcgccattgggctccttccttcctttgaggatattcagagcacaacagagctgcagatgtcaccccaaggtaccaatgaagtgcaaagtaaccaactaaacacaatggccactgatgctcctacagcatatcctggttctttggcagtcgctagtaatgataatagaaaagtctcccgcgaagacattgaacttgtccagaatttgatagagcgctgtctgcagctatacatgaccaaaggagaggttgttaggaccctttctactcgcgcgagaatagaacctggcttcactactttagtatggcagaaactcgatgaagagaaccctgaattctttcgggcttactatataagattgaaactgaaaagacagattatcttgttcaaccatttgttgcagcaccagtgtaatttgatgaaatatccagcacatccgaatgttccactggcaccaatgcaaaatgggatgcatcctatgccagttaacaatctaccgatggggtatccagtacttcagcaacctctgatgcctactcctggccagcctcacattgatccgatggtttgtggtctatcaagcggtcatgtggtgaatgggatccctgcaccaggtggctatcaaccaattcgcatgaactccggaaatgacatggttgtggacaccggtgcacctgaagttgcacatactggtgccatgtcatccgagatggctgtgagtccctcatcagcagcatcaagcaaccatgctcctttcactccatcggagataccagggatggccatggatacatcgatgctagattcagcgtttggatctgaaatagggaacggtggacctctgcaattagggccagatgggtcgtcaagggattccatccgatccttggggcagctctggaatttcagcctctctgatcttacagctgatttgacaagtttaggagatttggaggctcttgagaactacgcaggtacccctttcctgccctcggactcggacctcttacttgactccccagaccatgatgatgacatagttgagtacttcgccgacgccatcaacgggagtcaatcagacgaagagaagtcatagagaagatgatagactcaaaagtctgattcagactgggacctggccagagtgtcatctcatgtagtgtaatcctgtagctgcgcagaccgtggcaaatcagactgggcattcacccagaggtgcggtgattggcgcgcgtcactgaagaattttgtagtgttcaatgctaactattttgaataatcagtccgggttggcttcaccgggtaaagttgctctctacaaggctgaaaagtttaggaaattgtgtcaaacctcaggaacaacccctttgtaattgctgaagaagtggacagttcatctggtactgca

SEQ ID NO: 2709 - DNA, 1554 bp, Triticum aestivum
aggatattcagagcacaacagagctgcagatgtcaccccaaggtaccaatgaagtgcaaagtaaccaactaaacacaatggccactgatgctcctgcaggagatcctggttctttgacagtcgctagtaatgataatagaaaagtctcccgtgaagacattgaacttgtccagaatttgatagagcgctgtctgcagctatacatgaccaaaggagaggttgttaggacgctttctactcgcgcgagaatagaacctggcttcactactttagtatggcagaaactcgaagaagagaaccctgaattctttcgggcttactatataagattgaaactgaaaagacagattatcttgttcaaccatttgttgcagcatcagtgtaatttgatgaaatatccagcacatccgaatgttccactggctccaatgcaaaatgggatgcatcctatgccagttaacaatctaccaatggggtatccggtacttcagcaacctctgatgcctgctcctggccagcctcacattgatccgatggtttgtggtctatccggcggtcatgtggtgaatgggatccctgcaccaggtggctatcaaccaattcgcatgaactccggaaatgacatggttgttgacaacggtgcacctgaagttgcacatggtgccatgtcatccgagatggctgtgagtccctcatcggcagcatcaagcaaccatgctcctttcactccgtcggagataccagggatggccatggatacatcgatgctagattcagcatttggatctgacatagggaacacagaacctctgcaattagggccagatgggtcgtcaagggattccatccgatccttggggcagctctggaatttcagcctctctgatcttacagctgatttgacaagtttaggagatttggaggctcttgagaactacgaaggtacccctttcctgccctcggactcggacctcttacttgattccccagaccataatgatgacatagttgagtacttcgccgacgccatcaatgggactcagtcagacgaagagaagtcatagagaagatgacagactcaaatagtctcattcagactgggacctggccagagtgtcatctcatgtagtgtaatcttgtagctgcgcgcaaatcagactgggcattcacccagaggtgcggtgattggcgcgcgctactgaagaattttgaagcgtttgatgctaattatttggaataatcggttcaggcagccttcactggataaagttgttgcccacaaggctgaaaagtttagaaaattgtgtcaaacctcaggaaacaacccctttgtaattgctgaagaagtggacagttcatcgtgtattgcaccattcattgtctccccgtgcctgttccatttttccttttcctggagggtacgcagtgcatcaaattaaagagtttacaaggtgtagacatggagtttcttcgcccgagcactgctgctccttctatcctgaccagtgaatgcagtatggggatctgttccatttttgttttgcatcctttttt

SEQ ID NO: 2710 - DNA, 1227 bp, Avena sativa
aaccaactaagcacaatggccactgatgctcctgtaggagattctggttctttgtcagtcgctagtaatgataatagaaaagtctcccgcgaagacattgaacttgtccagaatttgatagagcgctgtctgcagctgtacatgaccaaaggagaggttgttaggacactttctactcgcgcgagaatagaacctggcttcactactttagtatggcaaaaacttgaagaagagaactctgaattctttagggcttactatataagattgaaattgaaaaggcaaattatcttgttcaaccatttattgcaacaccagtacaatttgatgaaatatcctgcacctccgaatgttccaatggctccaatgcaaaatggaatgcatcctatgccagttaacaatttaccaatggggtatccagtacttcagcaacctctgatgcctgctcccggccagcctcaccttgatccaatggtttatggtatgtccagtggtcatgcagtgaacgggatacctgcaccaggtggctatcatccgattcggatgaactctggaaatgacatgcttgtggacaacagtgcacctgaagctgcacatgctggtgctatgtcgtctgagatggctatgagtccctcatcagcagcatccagcaaccatgttcctttcactccatctgagataccagggatggccatggatacatcagtcctagattcagcatttggatctgacatagggaacacaggacctctgcaattaggggcagatggttcatcaagggactccatccgatccttagggcagctctggaattttagcctttctgatcttacagctgatttaacaagtttgggagacttggaggctcttgagaactacgcgggcaccccgttcctgccctcggactcagacctcttacttgattccccagaccatgatgacatagttgagtacttcgcggacgccatcaacgggtctcagtcagacgaagagaagtgatagacgacagggttaaatagtcccattcagattcagacctggccgaggtttcattgtcatctagtgtactctttcagctatacataccgtggaaattctggttgagcgcaattcgcccacaggtgcggttatattggcgcgcgccactgaagaattttgtagtggtcaaatcctaattctttggaaataatcagttcggtagcattcaccggatgaagctgctggcta

SEQ ID NO: 2711 - DNA, 2120 bp, Brachypodium distachyon
cacacggctcggcgagggcagcccaaccgatttgcatcctctggccggatctacaaactgaagacaaattggacaaaatgtggagagacaaattctttttccgggaacgggaagacaaattccttttccggttagataaattccgagacttcgtttttcacttgagccggagctcatctatgtgacttctctctctctctgtctctctctcttcatcttttccttcctgcgccgcagcccttcctccttctggccatctcgctgccgaccgccccagccgcctcgctacgtcgctcgtcttcctcctcgcgcgaccgccgccaccgccggttggtctctccttcgattctctcgctcccgaccgtttctcctcccatcaccccacgaacggattccgccctttagctcccgttccatctccttaatcttccccaattcgtaactgaggcaagaaccaaggtagggcggccgccctactttgccctactgggtcctccgcctaggatgacctgcgatggtttaatgttaagcattgatattggatttagctatttcttatgtcataagctggaatgaaggattctcaggatattcagagcacgacagagttgcagatgtcaccacaaggtactaatgaagtgcaaagtaaccaagcaaacacagtgggcactgatgctcctgtaggggattctggttctttgtcagtcgctagtaatgataatagaaaagtctcccgcgaagacattgaacttgtccagaatttgatagagcgatgtcttcagctatacatgaccaaaggagaggttgttaggacactatctactcgtgcaagaatagaacctggcttcactactttagtatggcagaaacttgaagaagagaactctgaattcttccgggcctactatataagattgaaattgaaaaaacagatcatcttgttcaaccatttgttgcagcaccaatacaatttgatgaaatatccagcacctccgaatccattggttccaatgcaaaatggaatacattctatgccagtcaacaatttaccgatggggtatccagtactacagcaacctctgatgcctgctcccggccagcctcacatagatgcaatggtttgtggtctctccagtggtcatgtagtgaatgggatacctgcaccaggtggctatcatccaattcgcatgaattctggaaatgacatggttgtggacaacggtgcacctgaagctgcacatcctggtgctatgtcctctgagatggccgtgagtccctcatcagcagcatcaagcaaccatgctcctttcactccatctgatataccagggatggccatggatacatcagccctagattcagcatttggatctgacgtggggaacacaggacctctgcaattagggccagatggttcgtcaagggactccatccgatccttggggcagctctggaatttcagcctttctgatcttacagcagatttgacaagtttgggagacttggaggctcttgagaactacgctggcacccctttcctcccttcagactcagaccttttacttgattccccagaccatgatgacatagttgagtacttcgccgacgccatcaatgggactcagtcggatgaagataagtcatagagaacagagttaaatagtctcattcagattcagacatggccggggcgtcatctcatgtagagtgtactcttgcagcccagcaaatctaactgtgtatgtgccctagagaattttgtggtggttaatcctaactctctggaataagcattcagggtagccttcatcaccaggtaaagtcgccggctacaagaggatgaaaagcttacaaatttgtgtcaaacctcgtgaacattccttcgtaatagctaaagaactggacagctacttcaccttgtctcgtgccttgtcatgtcttccaggccatcctgtacagccgatttaaggtttcagaagtttggcttgtcattttggcagccaggccggtgttctactttggttttccgttgaaatgcgaagttttttaatcatgtcagcgtaatgtagaattgtcttgactgaagatctggaagtacatgaaatgtgattggggaattc

SEQ ID NO: 2712 - DNA, 1388 bp, Saccharum officinarum
ccccttaaccacctgctttatcttctcccgttcaccccgcgtgcgcgctctccctccctccctccttccctctcgctagtggcgacgactgggcgactgcctccgccgcattttgctaggcgccccacggcccttcgccggcgacgagcacccaccagaaaaagtgttgctcctacgactagttctttttatgtataacctccaatgaaggattctcaggatattcagagcacgacagggttgcagtcatcagcacaaggtactaatgaagtgcaaagtcagcaaccaaacccaatggccactgatgctcctgcaggaaatttgggttccttatctgtagctagtaatgacaataagaaggtgtctcgcgaagatattgaacttgttcagaatttgatagagcgttgtctacagctatacatgaacaaaggagaagttgttagaactctttctactcgtgctagaatagaacctggcttcactactttagtatggcagaaacttgaagaagagaactcagagttctttagggcttactatatacggctgaaattgaaaaggcagatcatcttgttcaatcatttattgcaacaccagtacaatttgatgaaatatccagcacctccaaatattccattggctccaatacaaaatggaattcaccatatgccagttagcaatttaccaatggggtatccagtacttcagcagcctatcatgcctgctcccggccagcctcacatggatccaatggcctgtggtctgtccagtggtcatgtggttaatggaatacctgcaggtggttatcatccaatgcgcatgaactccggaaatgacatggttgtggacaatggagcgcctgaagcaccacatgctggtgctaccggtagtgctatgtcatctgagatggttgtgagtccctcatcagcggcttcaagcaaccatgctccttttacgccatcagagataccaggcatgaccatggatgtatcagccctagactcggcatttggatctgatgtggggaatcctggatgtctgcaattaggacctgatggctcatcaagagactctaatagatccttcgggcagctctggaatttcagcctctctgatctaactgcagatttgacgagtttgggagcagatttggacgtgctggagaactacactggcacccctttctgccttcagattcggacattttgcttgattcccagaccatgatgatatagtcgaatattttgctgacgccatcaacgggtctcagtcagacgaagagaaaccatagcgaagctatagtttcgtagacgcccctcatgcattcaggttcaggcagggctgtcatctcatctcatgtagtgtaagcttgctgctgctctcatgta

SEQ ID NO: 2713 - DNA, 2043 bp, Oryza sativa
cttatatttacagagagtaataaaactctgaaaggcttaaacaaattcactttcttcctcctttttggggggtgtttctggtgtgcgccgcgcgcagcagcagcagcagcgtgcacagcagcagagcgcgcgcgcgcggccggccggcgagcgagcgcggcggcggcggcggcggcgacggcctccctcctctcctcccctccccgcccccgcgcggcctggacaagctctctttctctgtctctgtctctgtttctgtctatctgtctgtctgtctgtctcctttcgcctcgcatccttcccggctcgaatcgaattgaaggataaacattgatcttggaatagctgtttttatgtcatatgttgcaatgaaggattctcaggatattcagagcccaaccgagttgcagtcatcagcacaaggtactaatgaagtgcaaagtaaccagccgaatccaatggccactgatggtcctggaggagactctggttcattgtctatcgctagtaatgataatagaaaggtctcccgtgaagatattgaacttgtgcagaatttgatagagcgctgtctacagctatacatgaacaaaggagaggttgttaggacgctttctactcgtgcaagaatagaacctggtttcactactttagtatggcagaaacttgaagaagagaactctgaattctttcgtgcttactatatacggttgaaattgaaaaggcagattatcttgttcaaccatttactgcagcaccaatacaatttgatgaaatatccagcacctccaaatgttccattggctcctatgcaaaacggaatgcatcctatgccagttaataatttgcctatgggatatccggtacttcagcaacctatgatgcctgctcctggccagcctcacattgactcaatggcctgtggtctatccagcgggcatgtagtgaatgggatccctgcagctggtggttatcatccaattcgcatgaactctggaaatgacatggttgtggacaacggtgcacctgaaactgctcatgttggcgctacctgcagtgctatgtcatctgaaatggctgtgagtccctcatcggcagcatcaagcaaccatgctcctttcactccatctgagataccagggataaccatggatacatcagctctagattcaacatttgtatccgatgttgagaacacaggacaactgcagttaggaccagatggctcgtcaagggactccatcagatctttaggacagctctggaatttcagcctttctgacctaacagcagatttaacaagtttgggagacttggaagcacttgagaactacgcaggtactcctttcctggcctcagactccgacattttacttgattccccagaccagaatgacatagttgagtactttgctgatgccatcaacgggccttcacaatcagacgaagagaagtaacagaagagagtttcagactaaaggcctggccggccgtgcccatctcatgtagtgtaaccttgcagagaaattgtgacagaattctaactgtagatgcgcatggtggtgcggcaatcggcatgtactgttgtcgctgctgaagaattttgtagggggtcaatcctaattctttccaataaacagtagggcagattaagcagctggctacaaggatcaaaagtttacagatgttaaacctcatgaactctctctgtaattgctaaagaagtgaactgttcatgtggacctgcacattttccatgtctcctctagccggaaaagtttgttttcctctcgagacttcgagaggatgtccccttgtttttacgtgttctagttaattttttttttaaaaaaaaaaagtaagaaatgtcaatatgtgttgtatgagctttataataaaaaaaggctagcttaaattcgccctatataaattaaaaaaacaagactgaaaagcgggcattattaataatcatattttctatttttttttttcttaacttatatagatcgaatttaaattcgcgtgtttgtggacctatgtgta

SEQ ID NO: 2714 - DNA, 1562 bp, Setaria italica
catttacccacttaaggactttttctacaggatattcagagcacgacagagttgcagtcatcaaaacaaggtactaatgaagtgcagagtcagcaaccaaatccaatggccactgatgctcctgcaggagattctggttccctgtcagtagctagtaatgacaataagaaggtctctcgtgaagacattgaacttgtacagaatttgatagagcgctgtctacagctatacatgaacaaaggagaagttgttagaactctttctactcgcgcaagaatagaacctggcttcactaccttagtatggcagaaactcgaagaagagaactctgagttctttagggcttactatatacggttgaaattgaaaaggcagatcatcttgttcaatcatttattgcaacaccagtacaatttaatgaaatatcccgcacctccaagtgttccattggctccaatacaaaatgggattcatcatatgccagttagcaatctaccaatggggtatccagtacttcaacagcctatgatgcctgctccaggccagcctcacatagatccaatggcctgtggtctgtccagtggtcatgtagtgaatggaatccctgcgccaggtggttatcatccaattcgcatgaactctggaaatgacatggctgtggacaatggtgtggcggaagcaccacatgctggtgttactggcagtgctatgtcatctgagatggctgtgagtccctcatcagtggcttcaagcaaccatgctccttttacaccatcggagataccagggatgaacatggatgtatcagccctagattcgacatttggatctgatgtaggaaatgccggacctctgcaattaggaccagatgggtcgtcaagagactccatcaaatccttagggcagctctggaatttcagcctttccgatctaacagcagatttgacaagcttgggagatttggaagcgctggagaactacgccggtacccctttcctgcctttggattctgacatcttacttgattcccctgatcaggatgacatagttgagtattttgctgacgccatcaacggatctcaatcagatgaagagaaaccataacgaagctagtttcatatcaatagccccgttcaggttcaggaaggactgcttgccatctctcatgtagtgtaagtttgctgcgatgccgcggcaaatctaactgtgtatcctccccccacaggtggggtatctgccactagataattttgtagtggttattaaaatcctaattctttcgaataaacagttggttggtgtagccttagtcagataaaagtcgctggctgcgaatggtgggatggaaagtttacagtttgtgactgtcaaaccttacctcaggaactcttcttatttgctacagaagtaaacagtacccttccattgcctcttgggttgtgtttcacttgctacagaagaaatctggcttcgtggtttggaagatttttcagcactttacacggggttccagccgaaaccttacatgttttatgtaaaattctatggggcaagatgctgaa

SEQ ID NO: 2715 - DNA, 1156 bp, Setaria italica
aaggcactaatgaagtgcaaagtcagcaaccaaatccaatggccactgattctcctgcaggagattctggttctttgtcagtagctagtaatgacaataaggtgtctcgtgaagacattgaacttgtccagaatttgatagagcgctgtctacagatgtacatgaacaaaggagaagttgttaggactctttctactcgtgcaagaatagaacctggcttcactactctagtatggcagaaactcgaagaagagaactctgagttctttagggcttactatacaaggttgaaattgaaaaggcagatcatcttgttcaatcatttattgcaacaccaatacaatttaatgaaatattcatcacctccaaatgttccattggctccaatacaaaatgggactcaccacgtgccagttagcaatttaccaatggggtatccagtactgcaacagcctattatgcctgctccaggccaacctcacatggatccaatggcctgtggtctctccagtgatcatgtagtgaatggaatccctgcaccaggtggttatcatccaattcgcatggactccggaaatgacatggttgtggacaatggtgtgcctgaaacaccgcatgctggtgctaccggcagtgctatgtcatctgagatggctgtgagtccctcatcagtggcgtcaagcaaccatgctccttttacgccatcggagataccagggatgagcatggatgtatcaaccctagattcgacgtttggatctgatgtagggaatcctggactgctgcaattaggacctgatggctcgtcaagagactccatcagatccttcgggcagctctggaatttcagcctttctgatctaacaacagatttgacgagcttgggagatttggaagcacttgagaactacgctggtacccctttcctgccttcggactctgacatattacttgattccccagatcaggatgacatagttgagtattttaccgatgccatcaacggatctcaatcagatgaagagaaaccatagtgaaactagttcaatagccctgttcaggttcagaaaggactgccatctctcatgtagtagtgtaaatttgctggggtgccgcggcaaatctgtgtgtaacaccccccccccaccccacccac

SEQ ID NO: 2716 - DNA, 2406 bp, Panicum virgatum
ctcccttataataagcacctctgccacacaaccaaacggtgcagcaggggctcacgccagtcgccactgtatctctctcgttgagccgccaatccgttcgtcgtgcaggagacggaggcgcagccgcgcaggggagcatcgcaggtctcctgtcagtttcccagtggttccttcgctgttcgtgtcgcccctgccgccttccagtctcctcgtcgccggaaggcgggcgctcccggcgcacaccgacgcgtcccccctctgcgttctcttctcccgttcacccctgccttttcgtcttctattcaccccgagcaccagcgccgccctccgccaggtgcccagatcgagcacccaccaggctcataggactaggtctttttatgttacaaagctgcaatgaaggatgctcaggatattcagagcacgacagagttgcagtcatcagcacaaggtactaatgaagtgcagagtcaacaaccaaatgcaatggccactgatgctcctgcaggagattctggttccttgtcagtaagaagtaatgacaataagaaggtctcccgtgaagacattgaacttgtacagaatttgatagaacgctgtctacagctatacatgaacaaaggagaggttgttaggactctatctactcgtgcaagaatagaacctggcttcactaccttagtatggcagaaactcgaagaagagaactctgagttctttagggcttactatatacggttgaaattgaaaagacagatcatcttgttcaatcatttattgcaacaccagtacaatttaatgaaatatccagtacctacaaatgttccattggctccaatgcaaaacgggattcatcatatgccagttagcaatttaccaatggggtatccagtacttcagcagcctataatgcctgctccaggccagcctcacatagaccctatggcctgtggtatgtccagtggtcatatagtgaacggaatccctgcgccaggtggttatcatccaattcgcatgaactctggaaatgacatggttgtggacaatggtgtaactgaagcaccacatgctggcgctagtggcagtgctatgtcgtctgagatggctgtgagtccctcatcagcagcgtcaagcaaccatgctccttttacaccatcagagataccagggatgaccatggatgtatcagccctagattcaacgtttggatctgatgtaggaaatgctggacctctgcaattaggaccagatggctcgtcaagagactccatcagatccttagggcagatctggaatttcagcctttctgatctaacagctgatttgacgagtttgggagatttggaagcacttgagaactacaccggtacccctttcctgcattcggattctgacatattactcgattccccagatcaggacgacatagttgagtattttgctgatgccatcaacggatctcaatcagatgaagaaaaaccttagtgatgctcttgtttcatatcttagccccgttcaggttcaggaaggactccaatctctcgtgtagtgtaagtttgctgcggtgctgcggcgaatctaactgtgtatcctcccacacaggtggggtgattctgtaattggcctttgccgctagagtttttttatagtagtggttaaaatactaattctttggaataaacagttggtcggtgtagcctttggccagataaaatttacggttggtggtgaaaaatttatggttcgtgactgtcaaaccttacctccaggaacaactctttgtgcctgctactacagaagtgagtgagcagttggtagggttaaactattttccttggctcttggattatattgctcgcttgcacggtcgatgatccggtgcagaaccgtggcttgcttctggtttggaagacgtttgatcagtgctttacacggggtttgagctgaaatttgggggcttgttttatgtttttttgtttcgagaatgtggggcttgttttatgtaaacattgtaaggcaagatgctgagcgttcagcatatgttagtgaatattatgctgcggtcatctggccggacttgtggttggagaactcgagaggtgtgctgcaactgcaagcccgcaatgatgtgtatttccaggccgcagtgccaacggcgtggcgccttggttctcagatactctctgctttggcgaattcaggagaaacaactttttgttttgttttcatttgtcgcatgagagccgagaagatttggtccgttccactagaatgttgtttagaaattttaaggcatactccctccgtcctgaaatgtagggtattttagaattcaaattttgtactcaaatgtaagacattttagattgagaatggatcaaaccatcttaaatatacatcgttttt

SEQ ID NO: 2717 - DNA, 1561 bp, Pennisetum glaucum
cgcgcacgcggcgagccggcgacgactgggcgagcgccgccgccggcctactgcgccaggtggccaggtcttcgtcgggctcttcaccggcgacgagcacacacacacacacacacacaccaggctcttaggacaatatctttttatgttataagctgcaatgaaggattctcaggatattcagagcacgacagagttgcactcatcaaaacaaggtactaatgaagtgcagagtcagcaaccaaatccaatggccactgatgctcctgcaggagattctggttccctgtcagtagctagtaatgacaataagaaggtctctcgtgaagacattgaacttgtacagaatttgatagagcgctgtctacagctatacatgaacaaaggagaagttgttagaactctttctactcgtgcaagaatagaacctggcttcactaccttagtatggcagaaacttgaagaagagaactctgagttctttagggcttactatatacggttgaaattgaaaaagcagatcatcttgttcaatcatttattgcaacaccagtacaatttaatgaaatatcccgcacctccaagtgttccattggctccgatgcaaaatgggatccatcatatgccagttagcaatctaccaatggggtatccagtaattcaacagcctatgatgcatgctccaggccagcctcatatagatccaatggcctgtggtctgtccagtggtcatgtagtgaatggaatccctgcaccaggtggttatcatccaattcgcatgaactctggaaatgacatggctgtggacaatggtgtgagtgaagcaccacatgctggtgctgctggcagtgctatgtcatctgagatggctgtgagtccctcatcagcggcgtcaagcaaccatgctccttttactccatcggagataccagggatgaacatggatgtatcagccctagattcggcatttggatctgatgtaggaaatgctggatctctgcaattaggaccagatggctcgtcaagagactccattaaatccttaggacagctctggaatttcagcctttccgatctaacagcagatttgacaagcttgggagatttggaagcgctggagaactacgccggtacccctttcctgcctttggattctgacatcttacttgattcccccgatcaggacgacatagttgagtattttgctgacgccatcaacggatcaccatcagatgaagagaaaccataacgaagctagtttcgtatcgtagccctgtcgttcaggttgaggaaaggaccgcctgccatccctcatgtagtgtaagtttgctgcgacgccgcggcggcaaaatctaactgtgtatcctcctcccccgaccggtgggggtgtctgttactagagaattttgtagtggttattaaattcctaattctttagaataaacagctggttggtgtagccttagtcagatataaaagtagctggctgtgcgaatggttactgtcaaacgttacctcaggaactcttgtttatttgcaacagaagtaagcgaaagtaccc

SEQ ID NO: 2718 - DNA, 3117 bp, Panicum virgatum
ggccataactagacgccctcccgctcgaggctccgctcctcagggcgtcaggttcatctgctccctctgtttctcttctccaacctttcccttctctccgagagaaactctctcctgatctccccccttgctcgagatcttccttccctggcggcgacgactgggcgagcggcggcccagccctttgccggcaacgagcgcatcctccaggtatgccgctccggccccttctctttccttgtgctgtgcgagacggagcaccccaaacccagttacaatatattgagctacctactaacttggatttcgtttgcaagaacaagaagaattatcgggtatacatgtgtacacccatgtcctatgctgggtccgcccctgaacccaagcataaccattgttatatttttcttatcaggctcacagaacacggtctttttatgttataaagctgcaatgaaggatgctcaggatattcagagcacgacagagttgcagtcatcagcacaaggtattaatgaagtgcagagtcaacaaccaaatgcaatggccactgatgctcctgcaggagattctggttccttgtcagtagcaagtaatgacaataagaaggtctctcgtgaagacattgaacttgtacagaatttgatagaacgatgtctacagctatacatgaacaaaggagaggttgttaggactctatctactcgtgcaagaatagaacctggcttcactaccttagtatggcagaaactcgaagaagagaactctgagttctttagggcttactatatacggttgaaattgaaaaggcagatcatcttgttcaatcatttattgcaacaccagtacaatttaatgaaatatccagtaccttcaagtgttccattggctccaatgcaaaatgggattcatcatatgccagttggcaatttaccaatggggtatccagtacttcagcagcctataatgcctgctccaggccagcctcacatagacccaatggcctgtggtatgtccagtggtcatgtagtgaatggaatccctgccccaggtggttatcatccaattcgcatgaactctggaaatgacatggttgtggacaatggtgtaactgaagcaccacatgctggcgctactggcagtgctatgtcatctgagatggctgtgagtccctcatcagcggcgtcaagcaaccatgctccttttacgccatcagagataccagggatgaccatggatgtatcagccctagattcaacgtttggatctgatgtaggaaatgccggacctctgcaattaggaccagatggctcgtcaagagactccatcagatccttagggcagatctggaatttcagcctttctgatctaacagcagatttgatgagcttgggagatttggaagctcttgagaactacaccggtacccctttcctgcattcagattctgacatattacttgattccccagatcaggacgacatagttgagtattttgctgatgccatcaacggatctcaatcagatgaagagaaaccacagtgatgctcttttttcatatcgtagccccgttcaggttcaggaaggactccaatctctcatgtagtgtaactttgctgcgatgctgcggcgaacctaactgtgtatccccttctccccacacacaggtggggtaattccgtaattggcctttgccgctagagaatatttttagtagtggttaaaatcctaattctttggaataaacagttggttggtgtagcctttggctggataaaagtcgctggctgtgaatggtgggtgaaatgttcgttgaaaaaaaaaattacggttggtgactgtcaaaccaccaggaacaactctctttgcctgctactacagaagcgagtgagcagttggtacgggttaaactcttttccttgggtcttggattatcttgggcttgcacggtcgatgacccggtgcagaaccgtggcttctggtttggaagacgtttcatcagtgctgtacacggggtttgagctgaaatttgggggacttttttttatgtaaaaactgtaaggcaagatgctgatagtttagcatatgttagtgaatatatggtgcggtgatctggccggaattgtggctggagaactcgagaggtgtgctgcaagcatgcaaggggcacaagtctgggatcatctgcaaggttctcctctccctgatgtgtatttccaggccgcagtgctagcggcgtgtcgccttggttctctgatactctttgctttagcctattcagggacaagtttttgtgctttttttttgttcatttgtggcatgagaggcgagaagatttggtgcagcgcaagggagttgctaggcctttgcgcttggcgtttgtggttcctgaaacaaacagagggaggaggagcagacggcatcggcgagcagaaatcatgggggctctctcgtgcttggtcgcagcagcagcagggtcattgggtcaacaggccgccggattcaccgcggatcggccgcggctccgggcggcgctgagctcccgcacaagtcagggggcttgtctgtctgggaaaccatggccttcctgcttccggctccgggcactgcacccggaatcgaaaaattcagagtcactcacgtgcgtgtccgtcacttgagcgagcatttggtctttgttgccacttgtgctgtaaggtagcacagcgaccaggtggtcacatgccgaggcggagctgcgcggcggccatgagactctgactcttcacctggcgactggcgtgttgtctgcagcgcgagttaccgggagcgggagcccgtaaatacggcggcggctctgctctacagctctagtgctctgtctctcggcctcagcaagatcgaagattcaagcagcaatccgcgatcgccaggacggaatcgctgcaggtgtagttacatccattccgtgccatcgctttccttccttccttggctagcctctctgggctctctcggccatggccaggggacgacgaggaggaggatcgcgcggcgcagccggcagaatgtccgttctcggcctcgccctgctcgtgctcgccgccgcggcgcagatggcgtgcgcggctgccgccg

SEQ ID NO: 2719 - DNA, 1808 bp, Zea mays
caagtcccaaccaaaagacacacggatgccagctctctagctaccttgtgcccaaagtgccaaacggccccttaagtcttaaccacctgctttatcatctcccgtacgcgctctccctcggtctctccctccctccctccctctcgctcgtggccacgactgggcgactgcctccgccgcatttcgctaggcgccacacggcccttggccggcgacgagcacccacagaaaaaagtgttgctcctacgactagttctttttatgtgtaaccttcaatgaaggattctcaggatattcagagcacgacagagttgcagtcaccagtgcaaggtactaatgaagtgcaaagtcagcaaccaaactcaatggccgctgatgctcctgctggaaattcgggttccttgtctgtagctagtaatgacaataagaaggtgtctcgcgaagatattgaacttgttcagaatttgatagagcgttgtctacagctctacatgaacaaaggagaagttgttagaactctttctactcgtgctagaatagaacctggcttcactactttagtatggcagaaacttgaagaagaaaactccgagttctttagggcttactatatacggttgaagttgaaaaggcagatcatcttgttcaatcatttattgcaacaccagtacaatttgatgaaatatccagcacctccgaatattccattggctccaatacaaaatggaattcatcatatgccagttagcaatttaccaatggggtatccagtacttcagcagcctatcatgcctgctcccggccagcctcacatggatccaatggcctgcggtctgtccagtggtcatgtggttaatggaatacctgcaccaggtggttatcatcccatgcgcatgaactccggaaatgacatggttttggacaatggagcgcctgaagcaccacatgctggtgctaccggtagtgctatgtcatctgagatggctgtgagtccctcgtcggcggcttcaagcaaccatgctccttttacgccgtcagatataccaggcatgaccatggatgtatcggccctagactcggcatttgggtgtgatgtggggaatcctgaatctctgcaattgggaccagatgggtcgtcaagagactctattagatccttagggcagctctggaatttcagcctctctgatctaacagcggatttgacgagtttgggagcagatctggacgtgctggagaactacactggcacccctttcctgccatcggattcggacattttgcttgattccccagaccaagatgatatagtcgagtattttgctgacgccatcaacgggtctccgtcagacgaagagaaaccgtagtttttccggggttgcatggcatgcattcaggttcatcatcaggcagggctgtcatctcatctcatgtagtgtaaagcagccaatctaactgtgtattcggctcgcgcgcggtgatccggtaatcgggcctctgccactaaaaagaattttgtagcggttaattgaaatcctaattctttggaataagtagctgggactggaatgtccagagagtagcggtcgttgttggcttagggattgctgctggtggatgcaaacctcacagctagctggtgactctgaaaccacaggaactccttttctttttctttttacttgtatctgtatttgctgctacataagtaaacagaagtggggtgtacctagttttctggttctcgagtgtcttgaaacagtgggcgcgggttttcagctgaaagatcatgatattgtgttgttggc

SEQ ID NO: 2720 - DNA, 2151 bp, Sorghum bicolor
gtcccttggacaccccaaccattccaatttccatcccaaagtcccaaccaaaagagacggatgccagctctctagctagtagctaccctgtgcccaaagtgccaaacggcgccttaaccacctgctttatcttctcccgttcacctcgcgtgcgcgctctccctcccttcctctctctctctcgctcgtggcgacgactgggcgactgactgcccccgccgcatttcgctaggtgccccacggcccttcgccggcgacgagcacccaccagaaaagggttgttcctacgactagttctttttatgtataacctccaatgaaggattctcaggatattcagagcacgacagagttgcagtcatcagcacaaggtactaatgaagtgcaaagtcagcaaccaaaccctatggccactgatgctcctgcaggaaattcgggttccttatctgtagctagtaatgacaataagaaggtgtctcgcgaagatattgaacttgttcagaatttgatagagcgttgtctacagctatacatgaacaaaggagaagttgttagaactctttctactcgtgctagaatagaacctggcttcactactttagtatggcagaaacttgaagaagagaactctgagttctttagggcttactatatacggctgaaattgaaaaggcagatcatcttgttcaatcatttattgcaacaccagtacaatttgatgaaatatccagcacctccaaatatacccttggctccaatacaaaatggaattcatcatatgccagttagcaatttaccaatggggtatccagtacttcagcagcctatcatgcctgctcctggccagcctcacatggatccaatggcctgtggtctgtccagtggtcatgtggttaatggaatacctgcaggtggttatcatccaatgcgcatgaactccggaaatgacatggttgtggacaatggagcacctgaagcaccacatgctgctgctaccggtagtgctatgtcatctgagatggctgtgagtccctcatcagcggcttcaagcaaccatgctccttttacgccatcagagataccaggcatgaccatggatgtatcagccctagactcggcatttggatctgatgtggggaatcctggatctctgcaattaggaccagatggctcatcaagagactctattagatccttagggcagctctggaatttcagcctctctgatctaacagcagatttgacgagtttgggagcagatttggacgtgttggagaactacactggcacccctttcctgccttcagattcagacattttgcttgattccccagaccaagatgatatagtcgaatattttgctgacgccatcaacgggtctccgtcagatgaagagaaatcatagctaagctatagtttcgtagacgcccccatccccatgcattcaggttcaggcagggctgtcgagcctggtatctcatgtagcgtagcttgctgctctcatgtagtgtaagcctgctgcaacgccgcggcaaatctaactgtgtatttggctcgcgtgccccctgtgcggtgttgatccagtaattgggcctctgccactaaagaattttgtagtggttaattaaaatcctctaattctttggaataagtagttgggatggccagatagtagtgttgctggctaggtatgcttctggatgcaaagctcacagctggtgactctgaaaccacaggaactctttttttgtattttctgcataagtaaacagttggtacgggttcactcccttgtgttgcctctcacagttgtacgtcgcacaggaatggtctagcgtagaaagtttagcttctggtttggacagggttttcagtatcttaaaacaatgtctgagctgaatttgaactttgctggtgttgcaaccgttggcaaaatgagtatggagtggtacttcaaagatttggtgtttgtgctctctagctgccgggctctcttggcgactgatggttggatgagctagccgccgtggttttttcttttttggtgtactttgggattttgtttcaggtaggttggaacatgaacacaacacatatcagttggaaggttttaagttgacacatgtggcgactggcgagtataagcctgtg

SEQ ID NO: 2721 - DNA, 1557 bp, Panicum virgatum
ggatttcgtttgcaagaacaagaagaattatcgggtatacatgtgtacacccatgtcctatgctgggtccgccccctgaacccaagcataaccattgttatatttttcttatcaggctcacagaacacggtctttttatgttataaagctgcaatgaaggatgctcaggatattcagagcacgacagagttgcagtcatcagcacaaggtattaatgaagtgcagagtcaacaaccaaatgcaatggccactgatgctcctgcaggagattctggttccttgtcagtaacaagtaatgacaataagaaggtctctcgtgaagacattgaacttgtacagaatttgatagaacgctgtctacagctatacatgaacaaaggagaggttgttaggactctatctactcgtgcaagaatagaacctggcttcactaccttagtatggcagaaactcgaagaagagaactctgagttctttagggcttactatatacggttgaaattgaaaaggcagatcatcttgttcaatcatttattgcaacaccagtacaatttaatgaaatatccagtaccttcaagtgttccattggctccaatgcaaaatgggattcatcatatgccagttggcaatttaccaatggggtatccagtacttcagcagcctataatgcctgctccaggccagcctcacatagacccaatggcctgtggtatgtccagtggtcatgtagtgaatggaatccctgccccaggtggttatcatccaattcgcatgaactctggaaatgacatggttgtggacaatggtgtaactgaagcaccacatgctggcgctactggcagtgctatgtcatctgagatggctgtgagtccctcatcagcggcgtcaagcaaccatgctccttttacgccatcagagataccagggatgaccatggatgtatcagccctagattcaacgtttggatctgatgtaggaaatgccggacctctgcaattaggaccagatggctcgtcaagagactccatcagatccttagggcagatctggaatttcagcctttctgatctaacagcagatttgatgagcttgggagatttggaagctcttgagaactacaccggtacccctttcctgcattcagattctgacatattacttgattccccagatcaggacgacatagttgagtattttgctgatgccatcaacggatctcaatcagatgaagagaaaccacagtgatgctcttttttcatatcgtagccccgttcaggttcaggaaggactccaatctctcatgtagtgtaactttgctgcgatgctgcggcgaacctaactgtgtatccccttctccccacacacaggtggggtaattccgtaattggcctttgccgctagagaatatttttagtagtggttaaaatcctaattctttggaataaacagttggttggtgtagcctttggctggataaaagtcgctggctgtgaatggtgggtgaaatgttcgttgaaaaaaaaaattacggttggtgactgtcaaaccaccaggaac

SEQ ID NO: 2722 - DNA, 1573 bp, Zea mays
cccgtgctcgcgcgcgcgcgcgctctctctctctctctctctcccctccctgtctccctccccctctcggagtctcggtcgtggcgacgacgactgggcaggccgacgagcacccaccaggaaaagtattgctcctagcctcctacagctagttctttttatgattaagctccaatgaaggattctcaggatattcagagcacaacagagttgcagtcatcagcacagggtactaatgaagtgcaaagtcagcaaccaaacccgatgaccactgatgctcctgcaggaaattcgggttccttgtctatagctagtaatgacagtaagaaggtgtctcgcgaagacattgaacttgttcagaatttaatagagcgttgtcttcagctatacatgaacaaaggagaagttgttagaactctttctactcgtgctagaatagaacctggcttcactactttagtatggcagaaactcgaagaagagaactccgagttctttagggcttactatatccggttgaaattgaaacggcaaatcatcttgttcaatcatttattgcaacaccagtacaatttgatgaaatatccagcacctccaaatgttccattggctccaatacaaaatggaattcatcatatgccagttagcaatttaccaatggggtatccagtacttccgcagcctatcatgccggctcccggccagcctcacatggacccaatggcctgtggtctgtccaatggtcatgtggtcaatggaatacctgcaccaggtggttatcatccgatgcgcatgaactctggaaatgacatggttgtggacaacggagcgcccgaagcaccacatgctggtgctaccggcagcgtcatgtcatccgagatggccgtgagcccctcatcagcggcttcaagcaaccatgctccatttatgccgccggagatcccaggcatggccatggacgtgccaggcctagactcgacattcggatctgacgtagggaatggacctctgcaattaggaccagatggctcgtcgagagactccattagatccttggggcagctctggaacttcagcctctctgatctaacggcggatttgacgagtttgggagatttggacgtgctggagaactacaccggcacccctttcctgccttcggactcggacattctgctcgactccccggaccaagatgacatagtcgaatattttgctgacgccatcaacgggtctcagtcagacgaggagaggtcatagcgaagctagctcaaggtttttcaggcagggcgcagggatgtgtcttctcatggcctgctgcgagagatgctgcggctaatgtaatgtaactgtgccttgggcccgcgcccctgtgtgctgcggcaagtgtagctggtttaattagactttttttttaatttgtagctggttaattagaatcctaattctttggaataaaaaagtagtagctggagttatcggtaagaatcgctggatgtaatgcaaagctcgctctcacagtcacagctgggtgaccacaggaggacctcctttttgtttgttgtatatttgc

SEQ ID NO: 2723 - DNA, 4409 bp, Triticum aestivum
ggcaggaatatggcgggcaagtccaagggtgcgaggaacaaggccaaggcgcaggccgccagccaggaggccgtctcggtggagccggtcgctgatgtggcggaggaggccaagccccagaacggggaagtgaccgaggcccctgctgccgaggtcgcccctgctgctgaggttgctgcggcggacgtggagaaggaggagggggatgtggccgaggccgcacaggctgcagagaagccagctgaaggagagcttcatctataccctgtttctgttaagacgcaatcaggtgaaaagctggagctgcagctaagccctggagattctgtcattgatgtcaaacaattcctcttggacgctcctgaaacttgcttctacacatgctatgatttgatattgcatactaaagatggttcaacacaccagttagaggactacaatgaaatttctgagattgcagatataactgctggtggctgttcgttggagatggttgctgcaacatatgatgagaggtctattaggtcgcatctccgccgtgtccgggaattgctctctctttctagtcttcatgtctcactatcgacatccctagctctgcagcaggagtctgcacaggcgaaaaatgcagatgcaggaaaaactgctcaccaggagcttgatggtttgaatttcatggaggatactactgtagctcttactaatttgctggcatctgcaccagcagaaatcaaatgtgtggacagcatagttttttcatcattcaatcctccaccgagttataggaggttacatggggatctcatctatattgatgttgtgacattagaaggaagcaaacactgcatcacggggagctccaaatctttttatgtgaacgctagcaatggaagtgttttggattcaagacctttgaaacaatctcacgaagccagcactttagttggcctgctacaaaaaattagcgccaagtttaagaaaggctttcgcgaaatattggaccgcaaagcatcggcccatccttttgagaatgttcaggccttgcttccagtgacttcttggttgggagctcaccccgtgccagaacatagaagagatgcagccagggctgaggattctgttgtgctgtcatatggtaccgagttgattgggatgcagagagactggaatgaggaactgcagtcatgccgagagtttcctcatgccaatcctcaagaaagaatattgcgaggcagagcactctataaagtgacatgtgattttgttgatgctgctgtaaaaggagcagtcggtgtcatcaatagatgtatacctccaatcaatccaactgatccagaatgtttccatatgtatgtccacaacaacattttcttcagttttgcggttgactctgactatgagcaaatctcaaaggaccaaaagccagattgccaaaatggttctagcaggagtacgccagtcccctccccaggtttgggtgccaaggcagattctggagtagcaccagattcaaaaactgaagaggcaaacagtgttttggaaggacctacagaggcacaaatagcagacagtgagcaggcgacctatgcttctgctaataatgacttgaaaggaacgaaatcttaccaagaagctgatatttcggggctttataatcttgccatggcaataattgattacagaggtcacagggttgtagctcagagtatcatacctggtattcttcaaggagacaagtctgactcccttctgtatggttctgttgataatggcaagaagatatcttggaacgagtcattccatgcaaaggtagttgaggctgcaaagcgactccatgtgaaggagcatgtggttttggatggttctggcaatcctgtaaaattagctgctacagttgaatgcaagggaatcgttggtagtgatgacaggcattatattttggatctgatgagagtgactcctcgagattctaactacattggactgcagcaccgtttctgtgtgttgagacctgagcttgtagcctcatttgtcgaggctgaatccataaagaaatcccctacgcagaaagttccggatgttcccacagaattgaatgggcaagaatctgatgacattgccagtggttctgatgctacggctgcttctgtggaggaacatgacaagtctgatgaaacccctgtttctacacctgctgaaagtaatgactcgactgctgaaattcttttcaatccaaatgtatttacggagtacaagcttgctggcagtcctgaggagattgaagcagatgaagctttggttaaaaaggttggttcgtatctgttagatacggtgatcccaaagtttgttcaggatctttgctctcttgatgtctcccctatggacggtcaaactttaactgatgtgctgcatagcaatgggataaatgttaggtatctaggcaaagttgcaggcttgatcaagcatttgccacatctgtgggacttattttcggctgagataattgttaggtctgcgaagcatgttgtcaaggacatactgaggcaaagcccggaccataatattgcacctgctgttgctcatttcttgaattgtttctttggcaaagttttggctgcttcaacaaaaggtagtactggcagcccgcagtcgaaaacccagaagaaatcaagtcaatcagcttcttcaaaaaagggtcaatctgcattttcccagctaacatctgacggagtttggtctgacattaaggagttcgcgaaacataaataccagtttgaagcgccggatgatgtgagggttggggctaaaagagttgcagttctccgcaatctttgccaaaaggtgggaataacaattgctgctcgcaaatacgatctgcattctactactccattccaaccttcagatatcttgaatctccaaccagttgttaagcactcagttcctacctgtactgatgcaaggaagcttatggaagctgggaaaatccggatggctgagggaactctaaatgaggcgtatgcactattttctgaagctttttctctacttcaacagatcaatggtcccatgcacaaggatgctgcgaactgttgccggtaccttgctatggttttgtaccatgccggcgacacagcaggagcaattgtgcagcaacatagagagcttatcataaatgagcgatgccttggtctagaccatcctgatacagcccacagctacggtaacatggctttgttctatcatgggctcaatcaaaccgaacttgcgctgcgacacatgtcccgtacactgctgttgctgagtttagcatctggtcctgatcatccggatgttgcagcaactcttataaatgtggcgatgatgtaccaggatgcgagcaatatgagtactgctcttaggtatcttcaagaagcacttaagaagaacgagcgccttttaggtccaggtcatattcaaacagcagtttgctatcatgctctcgccattgcattcagctgtatgggtgcatacaagctttcagttcagcatgaaaccaagacacatgatatactggtcaaacagttaggtagtgatgattcacgaacaaaagattcagaaaattggttgaatacatttaaggggcgagaacagcaggttattgcgcagaagcaaaaaggccagggaactgtcccctctgctaacgctgttgaattcttgaaggctcatcctggattgttccaagcaatgaaggcagctgcgatccaatctggtggcgatggaccagcaaatgtcaacagagtaagaggaggtgacgagcgcgctgccaaggcggccgcagaagcccgaaaaacggctgttgccaggggtgttaatctccgcaacgggcctgctgcgagcgtttctgacatcaatcaaattctcaacctcatcaactctgctgcttccgcgtctgctgcttcttctggcaatgctcaggcaactgaatctgaagtgccgcagtccaacggtcctgccctgaatggcgcaaaggaggccaaggatacaagccgtccgtcggccaaggctgacggtcaagccccagtaggattaggtgcgtcattggagctgaagaagcagaagtccaagcagaaggcatagaaaggactctgcaatggctgttttctccttcttacaattttggacctctagggtgatcattttttggcccataggattgtcacgtccacatagtggcagagtaattttatttatggtggggtggggttcgtagaatgagtgcaataataataatagcgacgaggatggggtgaagacaaattcttgtggcgatacttctgattgatgagataaaaagccttccatatctaatttctgtaaactggctatgccaatttgtttggcacacagaaattaacaagctgaaggtt

SEQ ID NO: 2724 - DNA, 4597 bp, Triticum aestivum
ggcaggaatatggcgggcaagtccaagggtgcgaggaacaaggccaaggcgcaggccgccagccaggaggccgtctcggtggagccggtcgctgatgtggtggaggaggccaagcccgagaacggggaagtgactgaggcccctgctgccgaggtcgcccctgctgctgaggtcgctgccgcggacgtggagaaggaggagggggatgtggccgaggccgcacaggctgcagagaagccagctgaaggagagcttcatctataccctgtttctgttaagacgcaatcaggtgaaaagctggagctgcagctaagccctggagattctgtcattgatgtcaaacaattcctcttggacgctcctgaaacttgcttctacacgtgctatgatttgatattgcatactaaagatggttcaacacaccagttagaggactacaatgaaatttctgagattgcagatataactgctggtggctgttcgttggagatggttgctgcaacatatgatgagaggtctattaggtcgcatctccgccgtgtccgggaattgctctctctttctagtcttcatgtctcactatcgacatccctagctctgcagcaggagtctgcacaggcgaaaaatgcagatgcaggaaaaactgctcaccaggagcttgatggtttgaatttcatggaggatactactgtagctcttactaatttgctggcatctgcaccagcagaaatcaaatgtgtggacagcatagttttttcatcattcaatcctccaccaagttataggaggttacatggggatctcatctatattgatgttgtgacattagaaggaagcaaacactgcatcacggggagctccaaatctttttatgtgaacgctagcaatggaagtgttttggattcaagacctttgaaacaatctcacgaagccagcactttagttggcctgctacaaaaaattagcgccaagtttaagaaaggctttcgcgaaatattggaccgcaaagcatcggcccatccttttgagaatgttcaggccttgcttccagtgacttcttggttgggagctcaccccgtgccagaacatagaagagatgcagccagggctgaggattctgttgtgctgtcatatggtaccgagttgattgggatgcagagagactggaatgaggaactgcagtcatgccgagagtttcctcatgccaatcctcaagaaagaatattgcgaggcagagcactctataaagtgacatgtgattttgttgatgctgctgtaaaaggagcagtcggtgtcatcaatagatgtatacctccaatcaatccaactgatccagaatgtttccatatgtatgtccacaacaacattttcttcagttttgcggttgactctgactatgagcaaatctcaaaggaccaaaagccagattgccaaaatggttctggcagaagtacgccagtcccctccccagctttgggtgccaaggcagattctggcgtagcaccagattcaaaaactgaagagtcaaacagtgttttggaaggacctacagaggcacaaatagcagacagtgagcaggcgacctatgcttctgctaataatgacttgaaaggaacgaaatcctaccaagaagctgatatttcggggctttacaatcttgccatggcaataattgattacagaggtcacagggttgtagctcagagtatcatacctggtattcttcaaggagacaagtctgactcccttctgtatggttctgttgataatggcaagaagatatcttggaacgagtcattccatgcaaaggtagttgaggctgcaaagcgactccatgtgaaggagcatgtggttttggatggttctggcaatcctgtaaaattagctgctacagttgaatgcaagggaatcgttggtagtgatgacaggcattatattttggatctgatgagagtgactccacgagattctaactacattggactgcagcaccgtttctgtgtgttgagacctgagcttgtagcctcatttgtcgaggctgaatccataaagaaatcccctacgcagaaagttccggatgttcccacagaatcaaatgggcaagaagaatctgatgacattgccagtgcttctgatgctacggctgtttctgcggaggaacatgacaagtctgatgaaagccctgcttctacacctgccgaaagtaacgactcgactgctgaaattcttttcaatccaaatgtatttacggagtacaagcttgctggcagtcctgaggagattgaagccgatgaagctttggttaaaaaggttggttcgtatctgctagatacggtgatcccgaagtttgttcaggatctttgctctcttgatgtctcccctatggatggtcaaactttaactgatgtgctgcatagcaatgggataaatgttaggtatctgggcaaagttgcaggcatgatcaagcatttgccacatttgtgggacttattttcggctgagataattgttaggtctgcaaagcatgttgtcaaggacatactgaggcaaagcccggaccataatattgcacctgctgttgctcatttcttgaattgttttttggcaaagttttggctgcttcaacaaaaggtagtactggcagcccgcagtctaaaacccagaagaaatcaagtcaatcagtttcttcaaaaaagggtcaatctgcacattcccagctaacttctgacggggtttggtctgacattaaggagttcgcgaatcataaataccagtttgaagcgccggatgatgtgagggttggggctaaaagagttgcagttctccgcaatctttgccaaaaggtcggaataacaattgctgctcgcaaatacgatctgcattctactactccattccaaccttcagatatcttgaatctccaaccagttgttaagcactcagttcctacctgtactgatgcaaggaagcttatggaagctgggaaaatccggatggctgagggaactctaaatgaggcgtatgcactattttctgaagctttttctctacttcaacagatcaatggtcccatgcacaaggatgctgcgaactgttgccggtaccttgctatggttttgtaccatgccggcgacacagcaggagcaattgtgcagcaacatagagagcttatcataaatgagcgatgccttggtctagaccatcctgatacagcccacagctatggtaacatggctttgttctatcatgggctcaatcaaaccgaacttgcgctgcgacacatgtcccggacactgctgttgctgagtttagcatctggtcctgatcatccagatgttgcagctactcttataaatgtggcgatgatgtaccaggatgcgagcaatatgagtactgctcttaggtatcttcaagaagcacttaagaagaatgagcgccttttaggcccaggtcatattcaaacagcagtttgctatcatgctctcgccattgcattcagctgtatgagtgcatacaagctctcagttcagcatgaaaccaagacacatgatatactggtcaaacagttagggagtgatgattcacgaacaaaagattcagaaaattggttgaacacatttaaggggcgagaacagcaggttattgcgcagaagcaaaaaggccagacaactgccccctctgctaacgctgttgaattcttgaaggctcatcctggattgttccaagcaatgaaggcagctgcgatccaatctggtggtgatggaccagcaaatgtcaacagagtaaggggaggcgatgagcgcgctgccaaggcggccgcagaagcccgaaaaacggccattgccaggggtgttaatctgcgcaacgggcctgctgcgagtgtttctgacatcaatcaaattctcaacctcatcaactctgctgcttccgcgtctgctgcttcttccggcaatgctcagtcaaccgaatctgaagtgccgcagtccaacggtcctgccatgaatggcgcaaaggaggccaaggatacaagtcggccgtccgccaaggctgacggtcaagctccagtaggattaggtgcgtcgttggagctgaagaagcagaagtccaagcagaaggcatagacgcgtcgttggagctgaagaagcagaagtccaagcagaaggcatagacaggaatctgcaatggttgttttctccttgcaattttggacctctagggtgatcattttttggcccataggattgtcacgtccacatagtggcagagtaattttatttatggtggggtgggggttcgtagaatgagtgcaataataataagaggatggggtgaagacaaattcttgtgaagataaaaagccttccatatctaatttctgtaaactggctacaccaatttgtttggcacacagaaattaacaagctgaaggttttattgagccatagcaaagcttaatatctttgctttttcttattctttttttttacttctgtgccttagaaaatgcatccaattactcaatcagtcccttcaggtcatttgtagccactatgtacgtgcatgccaacaaaagacgcccttaagcaagctacgttag

SEQ ID NO: 2725 - DNA, 4508 bp, Secale cereale
ccgcctccgcgccgcctctcctctcccctcccctggtggtgccgaggcttccgcggcgccgcgggcggcaggcaaaggaatatggcggggaagtccaagggcgcgagaaacaaggccaaggcgcaggccgccagccaggaggccgtctcggtggagccggcggtgccggttcctgatgtggtggaggaggccaagccggagaacggggaagtgattgaggcccctgctgccgaggtcgctgcggcggacgtggagaaggaggagggagatgcggccgaggccgcacaagctgcagaaaagccagctgaaggagagcttcatctctaccctgtttctgttaagacgcaatcaggtgaaaagctggagctgcagctaagccctggagattctgtcattgacgtcaaacaattcctcttggatgctcctgaaacttgcttctacacatgctatgatttgatattgcatactaaagatggttcaacacaccagttagaggactacaatgaaatttctgagatagcagatataactgctggtggctgttcgttggagatggttgctgcaacatatgatgagaggtctatcaggtcgcatctccgccgtgtccgggaattgctctctctttctagtcttcatgtctcactatcgacatccctagctctgcagcaggagtccgcacaggcaaaaaatgcagatgcaggaaaaactgctcaccaggagcttgatggtttgaatttcatggaggatactactgtagctctcactaatttgctggcatctgcaccagcagaaatcaaatgtgtggacagcatagttttttcatcattcaatcctccgccgagttataggaggttacatggggatctcatctatattgatgttgtgacattagaaggaagcaagcactgcatcacagggagctccaaatctttttatgtgaatgctagcaatggaagtgttttggattcaagacctttaaaacaatctcacgaagccagcactttagttggcctgctacaaaaaattagcgccaagtttaagaaaggctttcgcgaaatattggaccgcaaagcatcggcccatccttttgagaacgttcaggccttgctcccagtgacttcttggttgggatctcaccccgtgccagaacatagaagggacgcagccagggctgaggattctgttgtgctgtcatatggtacagagttgattgggatgcagagagactggaatgaggaattgcagtcatgccgagagtttcctcatgccaatcctcaagaaaggatactgcgaggcagagcactctataaagtgacatgcgattttgttgatgctgctgtcaaaggagcagttggtgtcatcaatagatgtatacctccaatcaatccaactgatccagaatgttttcatatgtatgtccacaacaacattttcttcagttttgctgttgactctgactatgagcaaatctcaaaggaccaaaagccagattgccaaaatggttctggcagaagtacgccagtcccctccccaggtttgggtgccaaggcagattctggcgtagaacccgattcaaaaattgaagagccgaacagtgttttggaaggacctacagaggcacaaatagcagacagtgagcaggcgacctatgcttctgctaacaatgacttaaaaggaacgaaatcttaccaagaagctgatatttctgggctttacaatcttgccatggcaataattgattacagaggtcacagggttgtagctcagagtatcatacctggtattcttcaaggtgacaagtctgactcccttctgtatggttctgttgataatggcaagaagatatcttggaatgagtcgttccatgcaaaggtagttgaggctgcaaagcgtctccatgtgaaggagcatgaggttttggatggttctggcaatcctgtaaaattagctgctacagttgaatgcaagggaattgttggtagtgatgacaggcattatattttggatctgatgagagtgacacctcgagattctaactacattggactgcagcaccgtttctgtgtgttgagacctgagcttgtagcctcatttgttgaggctgaatccataaagaaatcccccacgcagaaagttccggatgttcccacagaatcgaatgggcaagaatctgatgaccttgccagtgcttctgatgctacggctgcttctgtggatgaacatgacaagtctgatgaaagccctgcttctacacctgctgaaagtaacgactcaactgctgaaattcttttcaacccaaatgtatttacggagtacaagcttgctggcagtcctgaggagattgaagcagatgaagctttggttaaaaaggttggttcgtatctgctagatacggtgatcccaaagtttgttcaggatctttgctctcttgatgtctcccctatggacggtcaaactttaactgatgtgctgcatagcaatgggataaatgttaggtatctgggcaaagttgcaggcatgatcaagcatttgccacatttgtgggacttattttcggctgagataattgttaggtctgcaaagcatgttgtcaaggacatactgaggcaaagcccggaccataatattgcacctgctgttgctcatttcttgaattgtttttttggcaaagttttggctgcttcaacaaaaggtagtactggcagcccgcagtcgaaaacccagaagggccagaaatcaagtcaatcagcttcttcaagaaagggtcaatctgcatattctcagctaacatctgatggagtttggtctgacattaaggagttcgcaaaacataaataccagtttgaagcgccggatgatgcgagggttggggctaaaagagttgcagttctccgcaatctttgccaaaaggtgggaataacgattgccgctcgcaaatacgatctgcattctactactccattccaaccttcagatatcttgaatctccaaccagttgttaagcactcagttcctacctgtactgacgcaaggaagcttatggaagctgggaaaatccggatggctgagggaactctaaatgaggcgtacgcactattttctgaagctttttcgctacttcaacagatcaatggtcccatgcacaaggatgctgcgaactgttgccggtaccttgctatggttttgtaccatgccggcgacacagcaggagccattgtccagcaacatagagagcttatcataaatgagcgatgccttggtctagaccatcctgatacagcccacagctacggtaacatggctttgttctatcatgggctcaatcaaactgaacttgcgctgcgacacatgtcccgtacactgctgttgctgagtttagcatctggtcctgatcatccggatgttgcagcaactcttataaatgtggcgatgatgtaccaggatgcgagcaatatgagtactgcacttaggtatcttcaagaagcacttaagaagaatgagcgccttttaggcccaggtcatattcaaacagcagtttgctatcatgctctcgccattgcattcagctgtatgggtgcatacaagctttcagttcagcatgaaacgaagacacatgatatactggtaaaacagttagggagcgaggattcacgaacaaaagattcagaaaattggttgaatacatttaaggggcgagaacagcaggttattgcgcagaagcaaaagggccagggaactgccgccccctccactaacgctgttgaattcttgaaggctcatcctggattgttccaagcaatgaaggcagctgcgatccaatctggtggtgatggaccagcaactgtcagcagaggaagaggaagcgatgaacgcgctgctaaggctgccgcagaagcccggaaaacggctgttgccaggggtgttaatctgcgcaacgggcctactgcgagcgtttctgacatcaatcaaattcttaacctcatcaacactgctgcttctgcgtctgcagcttcttccggcaatgctcaggcaaccgaatctgaagctccacagtccaacggtcctgccttgaatggtgcaaaggaggccaaggatacaagtcggccatccgccaaggccgacggtcaagccccagtaggattaggtgcatcattggagctgaagaagcagaagtcgaagcagaaggcatagaaagaactttgcaatggctgttttctccttgcaattttggacctctagggtgattattttttggcccatagggattgtcacgtccacatagtggcagagtaattttatttatggtggggtggggttcgtagaatgagtgcaataataaataatagcaacgaggatggggtgaagacaaattcttgtggcgatactgctgattgatgagataaaaagcctatcatatccagctcatccttttgagccctaatttctgtaaactggctacaccaatttgtttgccacgcagaagttaacaagttgaaggttttattgag

SEQ ID NO: 2726 - DNA, 4659 bp, Triticum aestivum
ggcggtgccgagccttccgcggcgccgcgggcggcaggcaggcaggaatatggcgggcaagtccaagggtgcgaggaacaaggccaaggcgcaggccgcaagccaggaggccgtctcggtggacccggtcgctgatgtggtggaggaggccaagcccgagaacggggaagtgaccgaggcccctgctgctgaggtcgcccctgctgctgagaccgctgcggtggtcgtggagaaggaggagggggatgcggccgaggccgcacaggctgcagagaagccagctgaaggagagcttcatctataccctgtttctgttaagacgcaatcaggtgaaaagctggagctgcagctaagccctggagattctgtcattgatgtcaaacaattcctcttggacgctcctgaaacttgcttctacacgtgctatgatttgatattgcatactaaagatggttcaacacaccagttagaggactacaatgaaatttctgagattgcagatataactgctggtggctgttcgttggagatggttgctgcaacatatgatgagaggtctattaggtcgcatctccgccgtgtccgggaattgctctctctttctagtcttcatgtctcactatcgacatccctagctctgcagcaggagtctgcacaggcaaaaaatgcagatgcaggaaaaactgctcaccaggagcttgatggtttgaatttcatggaggatactactgtagctcttactaatttgctggcatctgcaccggcagaaatcaaatgtgtggacagcatagttttttcatcattcaatcctccaccgagttataggaggttacatggggatctcatctatattgatgttgtgacattagaaggaagcaaacactgcatcacagggagctccaaatctttttatgtgaatgctagcaatggaagtgttctggattcaagacctttaaaacaatctcacgaagccagcactttagttggcctgctacaaaaaattagcgccaagtttaagaaaggctttcgcgaaatattggaccgcaaagcatcggcccatccttttgagaatgttcaggccttgcttccagtgacttcttggttgggagctcaccccgtgccagaacatagaagagatgcagccagggctgaggattctgttgtgctgtcatatggtaccgagttgattgggatgcagagagactggaatgaggaattgcagtcatgccgagagtttcctcatgccaatcctcaagaaaggatattgcgaggcagagcactctataaagtgacatgcgattttgttgatgctgctgtaaaaggagcagtcggtgtcatcaatagatgtatacctccaatcaatccaactgatccggaatgttttcatatgtatgtccacaacaatattttcttcagttttgctgttgactctgactatgagcaaatctcaaaggaccaaaagccagattgccaaaatggttctagcaggagtacgccagtcccctccccaggtttgggtgccaaggcagattctggtgtagcaccagattcaaaaactgaagaggcaaacagtgttttggaaggacctacagaggcacaaatagcagacagtgagcaggcgacctatgcttctgctaataatgacttgaaaggaacgaaatcttaccaagaagctgatatttcggggctttataatcttgccatggcaataattgattacagaggtcacagggttgtagctcagagtatcatacctggtattcttcaaggagacaagtctgactcccttctgtatggttctgttgataatggcaagaagatatcttggaacgagtcattccatgcaaaggtagttgaggctgcaaagcgactccatgtgaaggagcatgtggttttggatggttctggcaatcctgtaaaattagctgctacagttgaatgcaagggaattgttggtagtgatgacaggcattatattttggatctgatgagagtgactcctcgagattctaactacattggactgcagcaccgtttttgtgtgttgagacccgaacttgtagcctcatttgttgaggctgaatctataaagaaatcccctacggagaaagttccggatgttcccacagaatcaaatgggcaagaagaatctgatgacattgccagtggttctgatgctacggctgcttctgtggaggaacatgacaagtctgatgaaagccctgcttctacacctgccgaaagtaacgactcgactgctgaaattcttttcaatccaaatgtatttacggagtacaagcttgctggcagtcctgaggagattgaagcagatgaagctttggttaaaaaggttggttcgtatctgctagatacggtgatcccaaagtttgttcaggatctttgctctcttgatgtctcccctatggacggtcaaactttaactgatgtgctgcatagcaatgggataaatgttaggtatctgggcaaagttgcaggcatgatcaagcatttgccacatttgtgggacttattttcggctgagataattgttaggtctgcaaagcatgttgtcaaggacatactgaggcaaagcccggaccataatattgcacctgctgttgctcatttcttgaattgtttttttggcaaagttttggctgcttcatcaaaaggtagtactggcagcccgcagtcgaaaacccagaagaaatcaagtgaatcagcttcttcaaaaaagggtcaatctgcattttcccagctaacatctgacggagtttggtctgacattaaggagttcgcgaaacataaataccagtttgaagcgccggatgatgtgagggttgggactaaaagagttgcagttctccgcaatctttgccaaaaggtgggaataacaattgctgctcgcaaatacgatctgcattctactactccattccaaccttcagatatcttgaatctccaaccagttgttaagcactcagttcctacctgtactgatgcaaggaagcttatggaagctgggaaaatccggatggctgagggaactctaaatgaggcgtatgcactattttctgaagctttttctctacttcaacagatcaatggtcccatgcacaaggatgctgcgaactgttgccggtaccttgctatggttttgtaccatgccggcgacacagcaggagcaattgtgcagcaacatagggagcttatcataaatgagcgatgccttggtctagaccatcctgatacagcccacagctacggtaacatggctttgttctatcatgggctcaatcaaaccgaacttgcgctgcgacacatgtcccgtacactgctgttgctgagtttagcatctggtcctgatcatccggatgttgcagcaactcttataaatgtggcgatgatgtaccaggatgcgagcaatatgagtactgctcttaggtatcttcaagaagcacttaagaagaacgagcgccttttaggcccaggtcatattcaaacagcagtttgctatcatgctctcgccattgcattcagctgtatgggtgcatacaagctttcagttcagcatgaaaccaagacacatgatatactggtcaaacagttggggagtgatgattcacgaacaaaagattcagaaaattggttgaatacatttaaggggcgagaacagcaggttattgcgcagaagcaaaaaggccagggaactgtcccctctgctaacgctgtggaattcttgaaggctcatcctggattattccaagcaatgaaggcagctgcgatccaatctggtggtgacggaccagcaaatgtcaacagaggaagaggaggcgacgagcgcgctgccaaggcggctgcagaagcccgaaaaacggccgttgccaggggtgttaatctgcgcaacgggcctgctgcgagcgtttctgacatcaatcaaattctcaacctcatcaactctgctgcttccgcgtctgctgcttcttccggcaatgctcaggcaaccgaatctgaagtgccgcagtccaacggtcctgccctgaatggcgcaaaggagtccaaggatacaagtcggccgtctgccaaggctgacggtcaagccccagtaggattaggtgcgtcattggagctgaagaagcagaagtccaagcagaaggcatagaaaggactctgcaatggctgttttctccttacaattttggacctctagggtgatcattttttggcccataggattgtcacgtccacataatggcagagtaattttatttatggtgggatggggttcgtagaatgagtgcaataataataatagcaacgaggatggggtgaagacaaattcttgtggcgatactgctgattgatgagataaaaagccttccatatctaatttctgtaaactggctacaccaatttgtttggcacacagaaattaacaagctgaaggttttattgagccatagcaaagcttaatatctttgctttttcttattctttttttttacttctgtgccttagaaaatgcatccaattactcaatcagtcccttcaggtcatttgtagccactatgtacgtgcatgccaacaaaagacgcccttaagcaagctacgttagtaccacattcctttgatacaaaatgccatgtgtaagagaaaagc

SEQ ID NO: 2727 - DNA, 4314 bp, Triticum aestivum
tgtggtggaggaggccaagccccagaacggggaagtgactgaggcccctgctgccgaggtcgcccctgctgctgaggtcgctgccgcggacgtggagaaggaggaggggaatgcggccgaggccgcacaggctgcagagaagccagctgaaggagagcttcatctataccctgtttctgttaagacgcaatcaggtgaaaagctggagctgcagctaagccctggagattccgtcattgatgtcaaacaattcctcttggacgctcctgaaacttgcttctacacatgctatgatttgatattgcatacgaaagatggttcaacacaccagttagaggactacaatgaaatttctgagattgcagatataactgctggtggctgttcgttggagatggttgctgcaacatatgatgagaggtctattaggtcgcatctccgccgtgtccgggaattgctctctctttctagtcttcatgtctcactatcgacatccctagctctgcagcaggagtctgcacaggccaaaaatgcagatgcaggaaaaactgctcaccaggagcttgatggtttgaatttcatggaggatactactgtagctcttactaatttgctggcatctgcaccggcagaaatcaaatgtgtggacagcatagttttttcatcattcaatcctccaccgagttataggaggttacatggggatctcatctatattgatgttgtgacattagaaggaagcaaacactgcatcacagggagctccaaatctttttatgtgaatgctagcaatggaagtgttctggattcaagacctttaaaacaatctcacgaagccagcactttagttggcctgctacaaaaattagcgccaagtttaagaaaggctttcgtgaaatattggaccgcaaagcatcggcccatccttttgagaacgttcaggccttgctcccagtgacttcttggttgggagctcaccccgtgccagaacatagaagagatgcagccagggctgaggattctgttgtgctgtcatatggtaccgagttgattgggatgcagagagactggaatgaggaactgcagtcatgccgagagtttcctcatgccaatcctcaagaaagaatattgcgaggcagagcactctataaagtgacatgtgattttgttgatgctgctgtaaaaggagcagtcggtgtcatcaatagatgtatacctccaatcaatccaactgatccagaatgtttccatatgtatgtccacaacaacattttcttcagttttgcggttgactctgactatgagcaaatctcaaaggaccaaaagccagattgccaaaatggttctagcaggagtacgccagtcccctccccaggtttgggtgccaaggcagattctggagtagcaccagattcaaaaactgaagaggcaaacagtgttttggaaggacctacagaggcacaaatagcagacagtgagcaggcgacctatgcttctgctaataatgacttgaaaggaacgaaatcttaccaagaagctgatatttcggggctttataatcttgccatggcaataattgattacagaggtcacagggttgtagctcagagtatcatacctggtattcttcaaggagacaagtctgactcccttctgtatggttctgttgataatggcaagaagatatcttggaacgagtcattccatgcaaaggtagttgaggctgcaaagcgtctccatgtgaaggagcatgtggttttggatggttctggcaatcctgtaaaattagctgctacagttgaatgcaagggaatcgttggtagtgatgacaggcattatattttggatctgatgagagtgactcctcgagattctaactacattggactgcagcaccgtttctgtgtgttgagacctgagcttgtagcctcatttgtcgaggctgaatccataaagaaatcccctacgcagaaagttccggatgttcccacagaattgaatgggcaagaatctgatgacattgccagtggttctgatgctacggctgcttctgtggaggaacatgacaagtctgatgaaacccctgtttctacacctgctgaaagtaatgactcgactgctgaaattcttttcaatccaaatgtatttacggagtacaagcttgctggcagtcctgaggagattgaagcagatgaagctttggttaaaaaggttggttcgtatctgttagatacggtgatcccaaagtttgttcaggatctttgctctcttgatgtctcccctatggacggtcaaactttaactgatgtgctgcatagcaatgggataaatgttaggtatctaggcaaagttgcaggcttgatcaagcatttgccacatctgtgggacttattttcggctgagataattgttaggtctgcgaagcatgttgtcaaggacatactgaggcaaagcccggaccataatattgcacctgctgttgctcatttcttgaattgtttctttggcaaagttttggctgcttcaacaaaaggtagtactggcagcccgcagtcgaaaacccagaagaaatcaagtcaatcagcttcttcaaaaaagggtcaatctgcattttcccagctaacatctgacggagtttggtctgacattaaggagttcgcgaaacataaataccagtttgaagcgccggatgatgtgagggttggggctaaaagagttgcagttctccgcaatctttgccaaaaggtgggaataacaattgctgctcgcaaatacgatctgcattctactactccattccaaccttcagatatcttgaatctccaaccagtcgttaagcactcagttcctacctgtactgatgcaaggaagcttatggaagctgggaaaatccggatggctgagggaactctaaatgaggcgtatgcactattttctgaagctttttctctacttcaacagatcaatggtcccatgcacaaggatgctgcgaactgttgccggtaccttgctatggttttgtaccatgccggcgacacagcaggagcaattgtgcagcaacatagagagcttatcataaatgagcgatgccttggtctagaccatcctgatacagcccacagctacggtaacatggctttgttctatcatgggctcaatcaaaccgaacttgcgctgcgacacatgtcccgtacactgctgttgctgagtttagcatctggtcctgatcatccggatgttgcagcaactcttataaatgtggcgatgatgtaccaggatgcgagcaatatgagtactgctcttaggtatcttcaagaagcacttaagaagaacgagcgccttttaggtccaggtcatattcaaacagcagtttgctatcatgctctcgccattgcattcagctgtatgggtgcatacaagctttcagttcagcatgaaaccaagacacatgatatactggtcaaacagttaggtagtgatgattcacgaacaaaagattcagaaaattggttgaatacatttaaggggcgagaacagcaggttattgcgcagaagcaaaaaggccagggaactgtcccctctgctaacgctgttgaattcttgaaggctcatcctggattgttccaagcaatgaaggcagctgcgatccaatctggtggcgatggaccagcaaatgtcaacagagtaagaggaggtgacgagcgcgctgccaaggcggccgcagaagcccgaaaaacggctgttgccaggggtgttaatctccgcaacgggcctgctgcgagcgtttctgacatcaatcaaattctcaacctcatcaactctgctgcttccgcgtctgctgcttcttctggcaatgctcaggcaactgaatctgaagtgccgcagtccaacggtcctgccctgaatggcgcaaaggaggccaaggatacaagccgtccgtcggccaaggctgacggtcaagccccagtaggattaggtgcgtcattggagctgaagaagcagaagtccaagcagaaggcatagaaaggactctgcaatggctgttttctccttcttacaattttggacctctagggtgatcattttttggcccataggattgtcacgtccacatagtggcagagtaattttatttatggtggggtggggttcgtagaatgagtgcaataataataatagcgacgaggatggggtgaagacaaattcttgtggcgatacttctgattgatgagataaaaagccttccatatctaatttctgtaaactggctatgccaatttgtttggcacacagaaattaacaaagctgaaggtt

SEQ ID NO: 2728 - DNA, 4703 bp, Brachypodium distachyon
atgcggtttagtggggagaatcattttgtttttgtgtgttatgggctgcggcggggttttgactgatgagatttggtgttgttgcttttggcttgggcaggaatatggcggggaagtcgaagggtgggaggaacaaggcgaaggcgcaggccgccagccaggccgttccggtggagccggtagtgcctgttactgatggagttcaggaggacaagcctgagaacggggttgtgagtgaagcccctgctgcggaggtcggtgcggtggatgttgaaaaggaggagggagatgcagcttcggtcgcacagcctgcagagaagcccgctgaaggagagcttcatctctaccctgtttctgttaagacacaatctggtgaaaagctagagctacagctaagcccgggagattctgttattgatgtcaaacaattcctcttggatgcacctgaaacttgcttctacacgtgctacgatttgatattgcatacaaaagatggttcagcacaccagttagaggactacaatgaaatttctgagattgcagatataactgctggtggctgttcgttggagatggttgctgcaacatatgatgagaggtctattaggtctcatctccgccgtgtcagggaattgctctctctttctagtcttcatgtctcactatcaacatctctagctctgcagcaagagtctacccaggggaaaaatgcagcagatgcaggaaaaactgctaaccaggagcttgatggtttaaattacatggaggacacaactgttgctcttactaatttgttggcatctgcaccagcggaaatcaaatgcgtggacagcatagttttttcgtcgttcaatcctccaccaagttataggaggttacatggagatctcatctatattgatgttgtgacactagaaggaaacgcatactgcatcacagggagttccaaatctttttatgtgaatgctagcagtgaaaatatattggattcaagaccgttgaaacaatctcatgaggccagcactttagttggtctgctacaaaaagttagcgccaagtttaagaaaggttttcgtgaaatattggaccgcaaagcatcagcccatccttttgagaatgttcaggccttgctcccagtgacttcttggttgggagcttaccctgtgtcagagcataaaagggatgcagcaagggctgaggattctgtcgtgttatcatatggtactgaattgatcggcatgcagagagactggaatgaggaattgcagtcctgccgagagttccctcatggaaatcctcaagaaaggatattacgtggtagagcactctataaagtaacatgtgattttgttgatgctgcggtaaaaggagcagttggtgtcattaatagatgtatacctccaatcaatccaactgatccagaatgttttcatatgtatgtccacaacaatattttctttagttttgctgtcgactctgactatgagcaaatttcgaaggaccacaagctggactgtcaaaatggttccagtagaagtacgcttgtgacctccccagatttgggtgctaaggcagataggaaacatacagactccagtgtagcaccgaattcaaaaactgaagagcctaatggtgttttggacaataatcctgatgcatccgcagaagcacaaatagcagacagtgagcaggcgacctatgcttccgctaataatgacttaaagggaaccaaatcttaccaagaagctgatgttcctggtctttacaaccttgccatggcaataattgattacagaggtcacagggttgtagctcagagtatcatacctggtatacttcaaggagacaagtccgactcccttctgtatggttctgtcgataatggcaagaagatatcttggaacgaggcattccatgctaaggtagttgaggctgcaaagcggctccatgtgaaggagcatgttgttttggatggttctggcaatcctgtaaaattggctgctacagttgaatgcaagggaattgttggtagtgacgacaggcattatattttggatctgatgagagtgactccgcgagattctaatttcattggactgcagcaccgcttctgtgtgttgaggcctgaacttgtagcctcatttgttgaggctgaatccataaagcaacccccggcagagaaagttccagatgtccctgcagagtctaatgggcaagatgctacggctactatcgtggagggacatgacaagtctgatgaaagttctgctcctagacctgctgaaaatactgactcagctgctgaaattcttttcaatccaaatgtatttacggagtacaagcttgctggcagtccagaggagattgcagcagacgaagctttggtcaaaaaagttggttcatatctgctagagacggtgatcccaaagtttgttcaggacctttgctctcttgatgtctcccctatggatggtcaaactttaaccgatgtgcttcatagcaatgggataaatgttagatatttgggcaaagttgcaggtatgatcaagcaattgccgcatttatgggacttgttttcagctgagataattgttaggtctgcaaaacatgttgtcaaggatatactgaggcaaagcccggaccataatattggacctgctgttgcgcatttcttaaattgttttatcggcaaagttttggctgcttcgacaaaaggtagtgctgcccagtcgaaatcccagaagggtcatgaaactcaaaaatcgaccaagggtcagaaatctggccattcagcatcttcaagaaagggtcaatcagcatattcccacctaacatctgatggaatttggtctgacattaaggagtttgcaaaacataaatatcagtttgaagtgccagatgatgcgagggttggggctaaaagagttgcagttctccgtaatctttgccaaaaggtgggaataacaatcgctgctcgtaaatatgatctgaatgctgcagctccattccaaccttcagatatcttgaatctccaaccagttgtcaagcactctgttcctacctgtacggacgcaaggaagcttatggaagcagggaaaatccgaatggctgagggaacactgaacgaggcgtatgcactatttaatgaagctttttcgctacttcaacagataaatggtcccatgcacaaggatgctgcaaactgttgccggtaccttgctatggttttataccatgcgggcgatacagcgggagcaattgtgcagcaacatagagaacttgtcataaatgagcgatgccttggtctagatcatcctgatacagcccacagctacggcaacatggctttgttctatcatgggctcaatcaaactgaacttgcattgcggcacatgtcccgtacactgcttttgctaagtttagcatcaggtcctgatcatccggatgttgcagcaactcttataaatgtggcgatgatgtatcaggatgcaagcaatatgagtactgctcttaggtatcttcaagaagcacttaagaagaatgagcgccttttaggcccaggccatattcaaacagcagtatgctatcatgctcttgccattgcattcagttgtatgggtgcatacaagctttcgattcagcatgaaacgaagacccatgatatactggtaaaacaattagggaatgatgattcacgaacaaaagattcagaaaattggctgaatacatttaagggtcgggaacagcaggttaatgcccagaagcaaaaaggcaggggaactaatccatctgatagcgctattgattttataaaggcgcatcctggattgtaccaagcaatgaaggcaatccaatctggcgatggatcagcaaatatcaacaaatcacataatgctgcagtagttggagaaggtcttcctagaggaagaggagtcgatgagcgaggtgccaaagcaactgcagaagcccggaaaaaggctgctgccaggggtgttactttgcgtaatgtgcctcctgcaaacagtgtgtctgaactaaatcaaattctcagccttatcaactcggctgctacatctgccactacaaacactcaaacaactgaatctgaagggaagcagtctaatggtcctgcccttaatggcacaaaggagaccaaggaaacaaatgggccacccgccaaggcagacggtcacactcctgtaggattgggtgcgtcattggagttgaagaagcagaaatccaagcagaaagcatagtaaaagaatttggaatggttgttctctcctacaattttgaacttctagggtgattttttttaccaataggttgtcacgtccactgtggcaagagtaattttaatttattttgggtgggttcttagcacgagttcaataataataacgaaagtggagcgaagacaattcttgtgtcggttagactgctgatgagataaatgatcaagcctttaactgtaatatccagaccgatatgttaattcataatttctgtacacaggctatatacatagttgccaagagattaacacttcaaacgcttcattgtcaatcaattgcaccgtagcacgatgcaggtcttattttattttccctaagatacagttttgctcagaaatttctggttctaagggtgcccaggaagtcttcactcatgtgtggtacagctataattatttttttggacaa

SEQ ID NO: 2729 - DNA, 2846 bp, Triticum aestivum
cgagtacgcggggaccttccgagagcttctcctcctcaaatcccgccctccctcgctcaccagtgctgctccctctgctacctacgcttttcttcaacttttagccgcccttggcccccgtagcttcctccatggatccgtgctaaatgcagagcgagctcgagagctcgtagcgtttctcccggtccggtctgctgcaaagcgtaatctgggtctctgagtacgctctccgactccttggtgtttccgaggaaatggaggagagcttcgtgcccctccgaggcatcaagaacgacgtccgcgggcggctcacctgctacaagcaggactggacgggaggcttcagcgccggtatcaggatcctggcgccgaccacctacatcttcttcgcgtccgcgatacccgtgatatcgttcggggagcaattggagaggagcaccgatggggtcctcacggcagtgcagacattggcatccaccgccctgtgtggcataatccactccattgtgggagggcagcccctgctgatcctgggcgtggcagagccgaccgtcataatgtataccttcatgttcagcttcgccaaggacagggccgacctcggtcccaacctcttcctcgcctgggccggttgggtctgtgtgtggactgccctcttgctgttcttgctggcggtactgggcgcgtgctccatcataaaccggttcacccgcatcgccggtgagctgttcgggctcctcatcgcaatgctcttcatgcagcaagctatcaagggacttgttgacgagttccgcattcctgagagggagaacataaaagcactacagtttgttccatcatggaggtttgccaacggaatgttcgccatcgtgttgtcatttggccttttgctcaccgcgctgcggagcaggaaagcgcgatcctggcgctatggagcaggttggctgcgtggcttcatcgccgactacggtgttccactgatggtgctggtgtggacaggagtttcctacataccacatgacagtgtgccgaaagggatcccgcggcgcctcttcagccctaatccatggtcccctggtgcatatgacaactggacagtcatcaaggatatgccccaagtgccagtcatgtacatcattggtgccttcatgcctgcaacaatgattgctgtcctgtactacttcgaccacagcgtggcatcccagcttgctcagcaggcggagtttaatttgaggaagcctccatctttccactatgatttgcttctcctaggcttcctgacgttgatgtgtggcctgattggtatccctccatccaatggcgtcattccacagtcgccgatgcatacaaagagcttggctactctaaagcatcagatactccgtaaccgactagtggccacggcacggcaaagcatgcgccagaacgcgagcttgagccaactgtacaacaacatgcaggatgcttatcatcagattcagacaccgctgatccaccaacaacagaccgtcaaaggcttaaacgagctcaaggactccactgtccagttagcatcaagcatgggtaacttcgatgcaccggttgatgagacaatctttgacatagaaaaagagattgatgatctgctgcctatggaggtcaaggagcaaaggttgagcaactttctacaggctgtgatggttgggggctgcgtggccgccatgcccttactgaagaagatccctacagcagttctgtgggggtattttgcgttcatggcgattgagagcttgcctggtaaccagttctgggaacgaattttgctgctcttcactgctcccagcagaagatacaaggtgctggaagagtaccatacaacatttgtcgagactgtgccattcaagacgatagccatgttcacactcttccagaccacatatctgcttgtttgctttgggatcacatggatcccaatagctggggttctcttccccctcatgatcatgctcctggttccagtcaggcagtacatcctcccaaagctcttcaaaggtgcacatctcaatgacctggacgcagcggagtatgaggagtcaccggctataccgttcaaccttgctgcgcaagatattgatgtggcactgggacgcacccaaagcgcagagatccttgacgacatggtcacaagaagccgcggtgagatcaagcgcctgaatagtccgaagatcaccagttcaggtggcactcctgtcacggaactgaaaggcatccgcagcccttgtatgtctgagaaggcctacagccctcgcgtcaacgagctgaggcatgaacgcagccctctaggggggcgagacagtccacggatgggtgaggcccggccatccaagctgggtgaaggctcaacaccaaagtgaagcaataatgctgcatcgctcatagctactggaagtaaattatatcgataatttaagcatcagtgctagtatgagatgtctacttatgcacggtatgatgccactatatgatggccagtgatgaagtatgaggcccctatatgatgcctactgatgaagtatgaaaataggctaatgtgtatctatctgtagcctcctgatctaagggagcaccgtatgtgtaatctctgaatgagtagaagactattatagcatcaactttgaaacttttttcagtctcacttttctatattactgcaaactgttcatattattctttgatttttgcaccaaattggtgagtgatgagcatcatttcttgcttgtcaccttttcttgagcttaagttgtagcgtgtactgttaccagttgaatatgatacttaactgggcctacttccttcctgagtactgc

SEQ ID NO: 2730 - DNA, 2669 bp, Triticum aestivum
cctctgccacctacgctcttcttgagcttgtagccttggccccttagcttcctccagggatccgcgctaaatgcagagcgagctcgccagctcgtagcgtttctcccggtccggtctgctgcaagatgtaatctgggtctcatttcacaccttgtggccatctgaatacgctctccgattccttcgtgtttctcagggcaggtgaatcccttgtcgggttccgaggaaatggaggagagcttcgtgcccctccgaggcatcaagaacgacgtccgcgggcgcctcgcctgctacaagcaggactggaccggaggcttcagtgccggtatcaggatcctggcgccgaccacctacatcttcttcgcctccgcgatacccgtgatatcgttcggggagcaattggagaggagcaccgatggggtcctcacagcagtgcagacattggcatccaccgccctgtgtggcataatccactccattgtgggagggcagcccctgctgatcctgggcgtggccgagcccacggtcatcatgtacacattcatgttcagctttgccaaggacagggccgacctcggtcccaacctcttcctcgcctgggccggttgggtctgcgtgtggactgccctcttgctgttcttgctggcggtactgggcgcgtgctccatcataaaccggttcacccgcatagccggcgagctgttcgggctgctcatcgccatgctcttcatgcagcaggctatcaagggacttgttgacgagttcggcgttcctgagagggagaacataaaagcactacagtttgttccatcatggaggtttgccaacggaatgtttgctatcgtgttgtcatttggccttcttctcaccgcgctgcggagcaggaaagcgcgatcctggcgctatggggcaggttggctgcgtggcttcatcgccgactacggcgttccactgatggtgctggtgtggacaggagtttcttacataccacatgacagtgtgccgaaagggatcccgcggcgccttttcagccctaatccatggtcccctggtgcatatgacaactggacagtcatcaaggatatgctccaagtgccagtcatgtacatcattggtgccttcatgcctgcaacaatgattgctgtcctgtattacttcgaccacagcgtggcatcccagctcgctcagcaggcggaatttaatttgaggaagcctccatctttccactatgatttgcttctcctaggcttcctgacactgatgtgtggcctaattggtatccctccatccaatggcgtcattccacagtcgccgatgcatacaaagagcttggctactctaaagcatcagatactccgtaatcgactagtggccacggcacggcaaagcatgcgccagaacgcgagcttgagccaactgtacaacaacatgcaggatgcttatcatcagattcagacaccgctgatccaccaacaacagtccgtcaaaggcttaaacgagctcaaggactccactgtccagttagcatcaagcatgggtaacttcgatgcaccggttgatgagacaatctttgacatagaaaaggagattgatgatctgctgcctatggaggtcaaggagcaaaggttgagcaactttctacaggctgtgatggttgggggctgcgtggccgccatgccgttactgaagaagatccctacagcagtgctgtgggggtattttgcgttcatggcgattgagagcttgcctggtaaccagttctgggaacgaattttgctgctcttcactgctcccagcagaagatacaaggtgctggaggagtaccatacaacatttgtcgagaccgtgccattcaagacgatagccatgttcacactcttccagaccacatatctgcttgtttgctttgggatcacatggatcccaatagctggggttctcttccccctcatgatcatgctcctggttccagtcaggcagtatatcctcccaaagctcttcaaaggtgcacatctcaatgacctggacgcagcggagtatgaggagtcaccggctataccattcaaccttgctgcgcaagatattgatgtggcactgggacgcacccaaagcgcagagatccttgacgacatggtcaccagaagccgcggtgagatcaaacgcctgaatagtccgaagatcaccagctcaggtggcactcctgtcacggaactgaaaggcatccgcagtccttgtatctctgagaaggcctacagccctcgcgtcgccgagctgaggcatgaacgcagccctctagggggacgagacagtccacggacgggtgaggcccgaccatccaagctgggtgaaggctcaacaccaaaatgaagcaataatgctgcatcgctcatataagctatggagctactggaagtaaattatatcgataatttaagcatcagtgctaatataagatgtctacttatgcacggtatgatgccactatatgatggccagtgatgaagtatgaggcccctatatgatgcctactgatgaagtatgaaaataggctaatgtgtatctatctgtagcctcctgtgtgtaatctctgaatgagtagaagatattatagcgtctactttgaaacttttttgagtctcacttttctacataactgcaaattgttcata

SEQ ID NO: 2731 - DNA, 2873 bp, Triticum aestivum
gtcgataatctccctttgtgccaggaaattggtttagtaccaccagacagtgttgcttgctgactctccactgccccgcctgtctatatagccgagccgtcctctatctcacagctccagtaccttccgagagcttctcctcctcaaatcccgccctccctccctcgctcgctcgctcaccagtgctgctccctctgccacctacgctcttcttgagcttgtagccttggccccctagcttcctccagggatccgcgctaaatgcagagcgagctcgccaactcgtagcgtttctcccggtccggtctgctgcaagatgtaatctgggtctcatttcacaccttgtggccatctcaatacgctctccgattccttcgtgtttctcagggcaggtgaatcccttcccccgaggaaatggaggagagcttcgtgcccctccgaggcatcaagaacgacgtccgcgggcgcctcgcctgctacaagcaggactggaccggaggcttcagtgccggtatcaggatcctagcgccgaccacctacatattcttcgcgtccgcgatacccgtgatatccttcggggagcaattggagaggagcactgatggggtcctcaccgcggtgcagacattggcatccaccgccctgtgtggcataatccactccattgtgggagggcagcccctgctgatcctgggcgtggcagagccgacggtaataatgtacacattcatgttcagcttcgccaaggacagggccgacctcggtcccaacctcttcctcgcctgggccggttgggtctgtgtgtggactgccctcttgctgttcttgctggcggtactgggcgcgtgctccatcataaaccggttcacccgcatcgccggcgagctgttcgggctcctcatcgcgatgctttttatgcagcaagctatcaagggacttgttgacgagttccgcattcctgagagggagaacataaaagcactacagtatattccatcatggaggtttgccaacggaatgttcgctatcgtgttgtcatttggccttttgctcaccgcgctgcgaagcaggaaagcgcgatcctggcgctatggagcaggttggctgcgtggcttcatcgccgactacggcgttccactgatggtgctggtgtggacaggagtttcttacataccacatgacagtgtgccgaaagggatcccgcggcgcctcttcagccctaatccatggtcccctggtgcatatgacaactggacagtcatcaaggatatggcccaagtgccagtcatgtacatcattggtgccttcatgcctgcaacaatgattgctgtcctgtactacttcgaccacagcgtggcatcccagcttgctcagcaggcagagttcaatttgaggaagcctccatctttccactatgatttgcttctcctaggcttcctgacattgatgtgtggcctaattggtatccctccatccaatggtgtcattccacagtcgccgatgcatacaaagagcttggctactctaaagcatcagatactccgtaaccgactagtggccacggcacggcaaagcatgcgccagaacgcgagcttgagccaactgtacaacaacatgcaggatgcttatcatcagattcagacaccgctgatccaccaacaacagtccgtcaaaggcttaaacgagctgaaggactccactgtccagttagcatcaagcatgggtaacttcgatgcaccggttgatgagacaatctttgacatagaaaaagagattgatgatctgctgcctatggaggtcaaggagcaaaggttgagcaactttctacaggctgtgatggttgggggctgcgtggcagccatgcccttactgaagaagatccctacagcagtgctgtgggggtattttgcgttcatggcgattgagagcttgcctggtaatcagttctgggaaagaatattgctgctcttcactgctcccagcagaagatacaaggtgctggaagagtaccatacaacatttgtcgagaccgtgccattcaagacgatagccatgttcacactcttccagaccacatatctgcttgtttgctttgggatcacatggatcccaatagctggggttctcttccccctcatgatcatgctcctggttccagtcaggcagtatatcctcccaaagctcttcaaaggtgcacatctcaatgacctggacgcagcggagtatgaggagtcaccggctataccgttcaaccttgctgcgcaagatattgatgtggcactgggacgcacccaaagcgcagagatccttgacgacatggtcaccagaagccgcggtgagatcaagcgcctgaatagtccgaagatcaccagctcaggtggcactcctgtcacggaactgaaaggcatccgcagtccttgtatttctgagaaggcctacagccctcgcgtcaccgagctgaggcatgaacgcagccctctaggggggcgagacagtccacggacgggtgaggcccggacatccaagctgggtgaaggctcaacaccaaagtgaagcaataatgctgcatcgctcatagctactggaagtaaattatatcgataatttaagcatcagtgctagtataagatgtctacttatgcacggtatgatgccactatatgatggccagtgttgaagtacgaggcccctatatgatgcctactgatgaagtatgaaaataggctaatgtgtatctatctgtagcctcctgatctaagggagcaccgtatgtgtaatctctgaatgagtagaagactattatagcgtcaactttgaaacttttttctgtctcacttttctacattaccgcaaattgttcatattattctttg

SEQ ID NO: 2732 - DNA, 2662 bp, Secale cereale
ccctccctcgctcgctcaccagtgctgccccctctgctctcctcgaccttgtagccttggtcccttaccttcctccacggatccgcgctaaatgcagagcgagctcgcaagctcgtagcgtttctccgggtccggtctgctgctagatgtagtctgggtgccatctcacgccctgtggccatctgaatacactctccgactccttcgtgtttctgagggcgagtgaatcccttcccgggttcccaggaaatggaggagagcttcgtgcccctccgaggcatcaagaacgacatccgcgggcggctcgcctgctacaagcaggactggacgggaggcttcagtgccggtatcaggatcctggcgccgaccacctacatattcttcgcgtccgcgatacccgtgatatcgttcggagagcaattggagaggagcaccgatggggtcctcacagcagtgcagacattggcatccacagccctgtgtggcataatccactccattgtgggagggcagcccctgctgatcctcggcgtggccgagccgacggtgataatgtacacgttcatgttcagctttgccaaggacaggcccgacctcggtcccaacctcttcctcgcctgggccggttgggtctgcgtctggaccgccctcttgctgttcttgctggcggtactgggcgcgtgctccatcataaaccggttcacccgcatcgccggcgagctgttcgggctcctcatcgcaatgctcttcatgcagcaagctatcaagggacttgttgacgagttccgcattcctgagagggagaacataaaagcgctacagtttgttccatcatggaggtttgccaacggaatgttcgccatcgtcttgtcatttggccttttactcaccgcgctgcggagcaggaaagcacgatcctggcgctatggggcaggttggctgcgtggcttcatcgccgactacggcgttccactgatggtgctggtgtggacaggagtttcttacataccacatgacagtgtgccgaaagggatcccgcggcgcctcttcagccctaatccatggtcccctggtgcatatgacaactggacagtcatcaaggatatgctccaagtgccacccatgtacatcatcggtgccttcatgcctgcaacaatgattgctgtcctttattacttcgaccacagcgtcgcgtcccagcttgctcagcaggcggagttcaatttgaggaagcctccatctttccactatgatttgcttctcctaggcttcctgacattgatgtgtggcctaattggtatccctccatccaatggcgtcattccacagtcgccgatgcatacaaagagcttggctactctaaagcatcagatactccgtaaccgactagtggccacggcacggcagagcatgcgccagaacgcgagcttgagccaactgtacaacaacatgcaggatgcttatcatcagattcagacaccgctgatccaccaacaacagtccatgaaaggcttaaacgagctgaaggactccactgtccagttagcatcaagcatgggtaacttcgatgcaccggttgatgagacaatctttgacatagaaaaagagattgatgatctactgcctatggaggtcaaggagcaaaggttgagcaactttctacaggctgtgatggttgggggctgcgtagcggccatgcccttgctcaagaggatccctacagcggtcctctgggggtatttcgccttcatggcgatcgagagcttgcctggtaaccagttctgggaaaggatattgctgctcttcactgctcccagcagaagatacaaggtgctggaagagtaccatacaacatttgtcgagaccgtgccattcaagacgatagccatgttcacactcttccagaccacatatctgcttgtttgctttgggatcacatggatcccaatagctggggttctgttccccctcatgatcatgttcctggttccagtcaggcagtatatcctcccaaagctcttcaaaggtgcacatctcaatgacctggacgcagcagagtatgaggaatcacctgctataccgttcaaccttgctgcgcaagatattgatgtggcactgggacgcacccaaggcgcagagatccttgacgacatggtcaccagaagtcgtggtgagatcaagcgcctgaatagtccgaagatcaccagctcaggtggcactcctgtcacggaactgaaaggcatccgcagtccttgtatttctgagaaggcctacagccctcgcgtcaccgagctgaggcatgaacgcagccctctagggggccgagacagtccacggacgggtgaggcccggccatccaagctgggtgaaggctcaacaccaaagtgaagcaatgatgctgcgttgttcatataagctatggagctactggaaataaattatctcgataatttgagcatcgatgctaatataagatgtctactgatgcgcggtacgatgccactatatgatggctagtgatgaagtatgaagcccctatatgatgcctactgatgaagtatgaaaataggctaatgtgtatctatctgtagcctcctgatctaagggagcatcgtatgtgtaatctctgaatgagtagaagaatattatagcgtctactttg

SEQ ID NO: 2733 - DNA, 2721 bp, Triticum aestivum
ctgccacctacgctcttcttgagcttgtagccttggccccttagcttcctccagggatccgcgctaaatgcagagcgagctcgccagctcgtagcgtttctcccgggcaggtgaatcccttgtcgggttccgaggaaatggaggagagcttcgtgcccctccgaggcatcaagaacgacgtccgcgggcgcctcgcctgctacaagcaggactggaccggaggcttcagtgccggtatcaggatcctggcgccgaccacctacatcttcttcgcctccgcgatacccgtgatatcgttcggggagcaattggagaggagcaccgatggggtcctcacagcagtgcagacattggcatccaccgccctgtgtggcataatccactccattgtgggagggcagcccctgctgatcctgggcgtggccgagcccacggtcatcatgtacacattcatgttcagctttgccaaggacagggccgacctcggtcccaacctcttcctcgcctgggccggttgggtcgtgcgtgtggactgccctcttgctgttcttgctggcggtactgggcgcgtgctccatcataaaccggttcacccgcatagccggcgagctgttcgggctgctcatcgccatgctcttcatgcagcaggctatcaagggacttgttgacgagttcggcgttcctgagagggagaacataaaagcactacagtttgttccatcatggaggtttgccaacggaatgtttgctatcgtgttgtcatttggccttcttctcaccgcgctgcggagcaggaaagcgcgatcctggcgctatggggcaggttggctgcgtggcttcatcgccgactacggcgttccactgatggtgctggtgtggacaggagtttcttacataccacatgacagtgtgccgaaagggatcccgcggcgccttttcagccctaatccatggtcccctggtgcatatgacaactggacagtcatcaaggatatgctccaagtgccagtcatgtacatcattggtgccttcatgcctgcaacaatgattgctgtcctgtattacttcgaccacagcgtggcatcccagctcgctcagcaggcggaattaatttgaggaagcctccatctttccactatgatttgcttctcctaggcttcctgacactgatgtgtggcctaattggtatccctccatccaatggcgtcattccacagtcgccgatgcatacaaagagcttggctactctaaagcatcagatactccgtaaccgactagtggccacggcacggcaaagcatgcgccagaacgcgagcttgagccaactgtacaacaacatgcaggatgcttatcatcagattcagacaccgctgatccaccaacaacagaccgtcaaaggcttaaacgagctcaaggactccactgtccagttagcatcaagcatgggtaacttcgatgcaccggttgatgagacaatctttgacatagaaaaagagattgatgatctgctgcctatggaggtcaaggagcaaaggttgagcaactttctacaggctgtgatggttgggggctgcgtggccgccatgcccttactgaagaagatccctacagcagttctgtgggggtattttgcgttcatggcgattgagagcttgcctggtaaccagttctgggaacgaattttgctgctcttcactgctcccagcagaagatacaaggtgctggaagagtaccatacaacatttgtcgagactgtgccattcaagacgatagccatgttcacactcttccagaccacatatctgcttgtttgctttgggatcacatggatcccaatagctggggttctcttccccctcatgatcatgctcctggttccagtcaggcagtacatcctcccaaagctcttcaaaggtgcacatctcaatgacctggacgcagcggagtatgaggagtcaccggctataccgttcaaccttgctgcgcaagatattgatgtggctctgggacgcacccaaagcgcagagatccttgacgacatggtcacaagaagccgcggtgagatcaagcgcctgaatagtccgaagatcaccagttcaggtggcactcctgtcacggaactgaaaggcatccgcagcccttgtatgtctgagaaggcctacagccctcgcgtcaacgagctgaggcatgaacgcagccctctaggggggcgagacagtccacggatgggtgaggcccggccatccaagctgggtgaaggctcaacaccaaagtgaagcaataatgctgcatcgctcatagctactggaagtaaattatatcgataatttaagcatcagtgctagtatgagatgtctacttatgcacggtatgatgccactatatgatggccaatgatgaagtatgaggcccctatatgatgcctactgatgaagtatgaaaataggctaatgtgtatctatctgtagcctcctgatctaagggagcaccgtatgtgtaatctctgaatgagtagaagactattatagcatcaactttgaaacttttttctgtctcacttttctacattaccgcaaattgttcatattattctttgatttttgcaccaaattggtgagtgatgagcatcatttctgcttgcacctttcttgagcttaagttgagcgtgtactgttaccagttgaatatgatacttaactgggccttattcccttactaaag

SEQ ID NO: 2734 - DNA, 3127 bp, Setaria italica
ccctcttgtgcttttgatttccttgtgcccagggtcaccaaagccttctccttccctagtcagttcttgagcaatgcattttttagatttttttttgctttaaactttttttttctacaaagaattcttttaggatttgacagtgatgcccctctcctctgccactggctatatatctgccctctatcccgctccattggtctgaagcacttacctctcctaccctctgcaactctctcggacttgccgtttcactcggccctgctccctatgctctctatgctcgtcttcccttcatagcctcggcccttcgtcttcctccatggatccgcgctaaatgcattgcgagtctgcaatcctgtagcatttcttcctgttccatctgccgcaagatgtaagcagggtctcacttgacactccgagtggccattcagaatataccctcagatcttcttgtctgagtaaaagtgacgccctttttggtccgggcaatggaggagagcttcgtgcccctgcggggcatcaagaacgacctccaggggaggctcgcctgctacaagcaggattggaccggagggttccgtgccggtatcaggatcctggcgccgaccacctacatattcttcgcgtccgcgataccggtgatatcgttcggtgagcaattggagaggaacactgatggagttctcacagcagttcagacgttggcatccactgccctgtgtggcataatccactccattgtgggagggcaacctctgctgatcctcggtgtcgccgaaccgacagtgctcatgtacacattcatgttcaacttcgccaaggacaggcctgacctcggccgaaatctgttccttgcctggaccggttgggtctgcgtatggactgccattctgctgttcttgctggcgatactaggtgcatgctcgatcatcaaccggttcacccgcatcgctggcgagctgtttgggcttctgattgctatgctcttcatgcagcaggctatcaaggggcttgttgatgagttccgcattcctgagagagagaaccgaaaggcacttgagtttgttccatcgtggtgcttcgccaatgggatgtttgcaatcgtcttgtcatttggccttttgcttaccgctctgcggagcaggaaggcgcgatcatggcgctatggagcaggttggctgcgtggcttcattgctgactacggtgttccattgatggtactagtatggactggagtttcttacataccatacggaagtgtaccaaaaggaattccacgacgccttttcagccctaacccatggtcccctggtgcatatgacaattggactgttgtcaaggatatgacacatgttccgcttctatatatcattggtgccttcataccagcaacgatgattgctgttctctactactttgatcatagtgttgcatctcagcttgctcagcagaaagagttcaatttgaggaagcctccatccttccactatgatctgcttctcttaggctttctgaccttactgtgtggccttatcggtatccctccatcaaatggtgtcattccacagtcacccatgcatacaaagagcttggctactctcaagcatcagctgcttcgtaaccggctagtagccactgcacggaagagcatgagtcagaacgctagcttgagccaactgtatggcagcatgcaggatgcttatcagcagatgcagacaccgcttgtttatcagcaacagtctgtcagaagaggcttaaatgagctcaaagactcgacagtccagctagcttcaagcatgggtaacattgacgcaccagttgatgagaccatttttgacatagagaaagagattgatgatctgctgcccatggaggtcaaggagcagcgcttgagcaacttgctacaggctgccatggtggggggttgtgtcgctgctatgccactactcaagaagatcccaacatctgtcctctggggctattttgccttcatggccattgagagcttgcctggtaaccagttctgggaaaggatcttgctgctgttcactgctcccagcagaagatacaaggtgctagaagagtaccacaccacgttcgtcgagactgtgccattcaagacgatagccatgttcacactgttccagacagcatacctgctggtctgctttggaatcacatggatcccgatagccggggttcttttcccccttatgatcatgctgctggttccagtcaggcagtacatccttcccaagctcttcaaaggtgcacatctaactgacctggatgcagcagagtatgaggaatcaccagcaataccattcagccttgctgcgcaagatatcgatgttgcattgggacgtgcccagagtgcagagatcctagacgacatgttcacaagaagccggggcgagatcaagcgcctgaacagcccaaagatcactagctccggtggcacacctgtggcagaactgaaaaacatccgcagcccgtccatatctgaaaaagcatacagccctcgcctcactgagctcaggcatgagcgcagccctctgggagggagaagcagccctaggacgccatccaagttgggtgaaggctcaacaccgaagtgaataaagcaatgatgcattgcttatataagttatgccgctactggaagtcagctatattagtgatttcggtattagtagccatttaaagaaagagtggtttcagtgttagtatccttatatgaagatgtcctctgatgaagtatgatatgaatatctctagcctctcttctctttgtcgtgttctcctgatttacggagtaccgtatctgtaatcctgaactagaggaatattagagtaactacttggaaaatactgggtttcactagcagattatcattctttcattacttacattcattaatatgtatatggaaatggtaaaaaattatgcatttttttctgcttccattttcattgagctcaagcatacctgtggaatacttgaatgtcgagtacacataacactcctttacagaggatggtgctcaagcatgtgttgtatactagttggaacatggaactttttaggccctaccccctttctgaatttgcacatattctgtta

SEQ ID NO: 2735 - DNA, 2923 bp, Oryza sativa
ggctagtctttttaagaggtcactagactgatgacagtgaagctgcctcttctccactccactgcctatatatctgctgccctctatctaagtccattgccctctgagtctctgaaatcctgaagcttcttcttcttcttccttcctcctcttgctctcttgctcttcctatgctagcactctccatgctcttcttgcccttgtagcattggctccttggtttccatccatggatccacgctaaatgcattgcgaggctgcaaattggtagcattcccttccccgttgcatctgctgcaactatgtaagcaggagtgtctgatttgacacgcctgaatacagcttctcagatcttcagttttgttgtttgtctgagaaaaggagagagagagaggcctcttttgggtccaagaagagaaaaatggaggagagcttcgtgcccctccgtggcatcaagaacgacctccatgggaggctccagtgctacaagcaggattggaccggaggattccgcgccggtatcaggatccttgcgccgaccacctacatattcttcgcttcggccataccggtgatatcgttcggagagcaattggagaggaacactgatggtgttctgacagcagttcagacattggcatccactgcactttgtggcataatccactcctttcttggagggcagcctctgctgatcctcggtgtggccgagccgacggtgctcatgtacacattcatgttcaactttgccaaggacaggcctgatcttggaaggaggctgttcctcgcatggaccggttgggtttgtgtctggacagcaattttgctgttcttgctggcgatactaggcgcgtgctcgatcatcaaccggttcacccgcatcgcgggtgagctgtttgggctcctgattgcaatgctcttcatgcagcaggctatcaaggggcttgttgacgagttccgcatccctgagagggagaacagaaaggcattagagtttgtttcatcatggaggttcgccaacggaatgtttgctatcgtcttgtcgtttggccttttgctcactgcactgcggagcaggaaggctcgatcatggcgctatggaacaggttggctccgtggcttcatcgccgactatggtgtcccactgatggtgctagtatggacaggagtttcctacattccatatggtagtgttccaaaaggaattccacggcgccttttcagccccaacccatggtcccctggtgcatatgataattggacagtcatcagggacatgccaaatgtgccactcctctacattattggtgccttcataccagcaacgatgatagccgtcctgtactacttcgatcacagtgttgcttctcagcttgctcagcagaaggagttcaatttgaggaagcccccatctttccattatgatttgcttctcctgggtttcctgacattattgtgtggccttattggtatccctccggcgaatggtgtcattccacagtctccaatgcatacgaagagtttggctactctcaaacatcaactactccgtaaccgactagtagccacagcccgacaaagcatgagccagaatgcgagcttgagccagctgtatggcagcatgcaggaagcttaccagcagatgcagacaccactgatttaccagcaaccgtcagtcaagggattgaatgagctcaaggactcaacagtccaaatggcttcaagcatgggcaacatcgatgcgccagttgatgagacagtctttgacatcgagaaagaaatcgatgacctgctgcctatcgaggtcaaggagcagaggttgagcaacttgctccaggccacaatggttgggggttgtgttgctgctatgccattgctcaagaagatcccgacttctgtcctctggggctacttcgccttcatggccattgagagcttgcctggtaaccagttctgggagaggatcttgctgctcttcactgctcccagcagaagatacaaggtgttagaagagtaccacaccacgtttgtcgagaccgtgccattcaagacgatagccatgttcacactcttccagacaatgtatctactcgtctgcttcgggatcacatggatcccgattgctggggttcttttccccctcatgatcatgctgctggttccagtcaggcagtacatcctcccaaagctcttcaaaggtgcacatctgactgatctggatgcagcagagtatgaggagtcaccagctataccgttcattgccgcgcaagatattgatgttgcattggcgcgcacccagagtgcagaaatccttgatgacattgtcactagaagccgtggtgaaatcaagcgcctgaacagtcctaagatcaccagctccggtggcacaccagtggcagaacttaaaggaatccgcagcccttgtatctctgagagggcatacagcccttgtatcaccgagttgaggcatgaccgcagccctctaggaggaagaggcagcccaaggaccggtgagacccgatcgtccaagttgggcgaaggatcaacaccaaagtgaagcaagaatgatgcactgctcatatgagctatgcaactacctgaaatcagctatactaatgatttctgtataactatggcgtacggttatatgatgtcttatgatcaagtatcaagtatgagtctatgagaatgtttatgtatatctctagcctagtatatcaccccttcctctttttttggtgtatttcctgatttggagcaccatatgtgtaatctctgaactaccagaatattagagtgactacttggtaaccttttgagtttcatttgctaaattcctgtcagaacttgtggatgattcatactgaaaactatttgtattcattaattctttaaaagaaacaggattatagttggcatcctt

SEQ ID NO: 2736 - DNA, 3489 bp, Panicum virgatum
ctctgccactgtctatatatctgccctctatcccgctccattgctctgaggcgcccttccctttcctacctctgaaactctctctctcgggcttgccatttcactcagcgctgctccctcctatgctctctatgctcgtcttcccttcatagcctcggcccttcgtcttcctccatggatccgcgctaaatgcattgcgagtctgcaatcttgtagcattccttcctgttccatctgccgcaagatgtaagcaggctcacacttgacacaccgagtggccattcagatcttctgtttgagaaaaagcaacgccctttttggtccgagaaatggaggagagcttcgtgcccctgcggggcatcaagaacgacctccatgggaggctcgcctgctacaagcaggactggaccggagggttccgcaccggtatcaggatcctggcgccaaccacctacatattctttgcgtccgcgataccggtgatatcgtttggagagcaattggagaggaatactgatggagttctcacagcagttcagacgttagcatccactgccctgtgtggcataatccactccatcgtgggagggcaacctctgctgatccttggcgtcgccgagccgacagtgctcatgtacacattcatgttcaacttcgccaaggacaggcctgacctcggccgaaatctgttccttgcctggaccggttgggtctgcgtatggactgccattctgctgttcttgctggcgatactaggcgcatgctcaatcatcaaccgattcacccgcatcgcaggcgagctgtttgggcttctgattgctatgctcttcatgcagcaggctatcaaggggcttgtagatgagttccgcattcctgaaagggaaaaccgaaaggcactagagtttgttccatcatggcgctttgcaaatgggatgtttgcaatcgtcttgtcatttggccttttgctcactgccctgaggagcaggaaggcgcgatcatggcgctatggagcaggttggctgcgtggcttcattgccgactatggtgttccactgatggtgctagtatggactggagtttcttacataccttacggaagtgtgccaaaaggaattccacgacgccttttcagccctaatccatggtcccctggtgcttatgacaattggactgttatcaaggatatggcacatgttccgctcctctatatcatcggtgccttcataccagcaacaatgattgctgttctctactacttcgatcatagtgttgcatctcagctcgctcagcagaaagagttcaatttgaggaagcctccatccttccactacgatttgcttctcttaggcttcctgaccttactgtgtggccttattggtatccctccatcaaatggtgtcattccacagtcacccatgcatacaaagagcttggctactctcaagcatcagctgcttcgtaaccggctagtagccactgcacggaagagcatgagtcagaatgctagcttgagccaactgtatagcagcatgcaggatgcttatcagcagatgcagacaccacttgtttatcagcaaccgtctgtcagaagaggcttaaatgagctcaaggactcaacagttcagctagcttcaagcatgggtaacattgacgcaccagttgatgagacagtttttgacatagagaaagaaattgatgatttgtgcccatcgaagtcaaggagcagcgcttgagcaacttgctacaggcagccatggtgggggcttgtgtcgctgcaatgccgctactcaagaagatcccaacatctgtcctctggggctattttgccttcatggccattgagagcttgcctggtaaccagttctgggagaggatcttgctgctcttcactgctcccagcagaagatacaaggtgctagaagagtaccacaccacgttcgtcgagactgtgccattcaagacgatagccatgttcacactgttccagacaacatacctgctggtctgctttggaatcacatggatcccgatagccggtgttcttttccccctcatgatcatgctcctggttccagtcaggcagtacatcctccccaagctcttcaaaggtgcacatctaactgacctggatgcagcagaatatgaggaatcacctgctataccattcagccttgctgcacaagatatcgatgttgcattgggacgcgcccaaagtgcagagatcctagacgacatggtcacaagaagccggggcgagatcaaacgtctgaacagcccgaagatcactagctcaggtggtacacctgtggcagaactgaaaaacatccgcagcccatccatttctgaaaaggcatacagccctcggctcactgagctcaggcatgagcgcagccctctgggagggagaaacagccctaggacgccatccaagttgggcgaaggctcaacaccgaagtgaataaatcaacgatgcattgcttagataagctaagcagctactggaagtcagctatatgagtgatttcagtattaggtgttaaaagaaagagtgttttcagtgttagtatccttatatgagatgtcctctgatgaagtatgatatgaatatctctagcttctctcttctctttctcatgttctcctgatttgagtaccatatctgtaatatctgaactagaggaatattagagtaactacttggaaatactgagttccactagcagattatcattctttattgcttatattcattaatatgtatatggaattggtgaaattatgccttttttcttgcattttcattgaactcaaccatgtatgtggaacgctactcataatactctttacagaggatgccgctgaagcatgagcgttttataattagttggagcatggaactttataccccttctgaatttgcacatattttgtgcagaagttttcttgcttcacccacccacccaccccaccaccaaatttgacagtatgatacgagactatgctacaatagctcaagctacattgtagcgagttggtagaagcaaatttggcttgaatatgcaatgatgatgtggttttgagattactttggctttcaaaatacacactgaacatagtggtttatacagaatgccaggttctcgtgtagtccctgtgctgatgtgaatcgcttgaaattcagtaaaactttttatcttgttaggcactatcacaagctgactacacgagattcaggaaaggggactacacgagagatgatataatgtacaccaagtccatagaactttttatcatagagaacttggtcgaaagacacgcatgcgaaaaacaagataaggtcagaaatgactgattcggacagaaagatgattgcatagggagataccaacagcctgaacctaccgctctatttgtagagcatgccatgctggttccagcagcaatttgttaggcactatcacaagctatatgacatggtatgattacaga

SEQ ID NO: 2737 - DNA, 2824 bp, Panicum virgatum
tccctttcctacctctgaaactctctctctctctcgggcttgccatttcactcagcgctgctccctcctatgctctctatgctcgtcttcccttcatagcctcggcccttcgtcttcctccatggatccgcgctaaatgcattgcgagtctgcaatcttgtagcattccttcctgttccatctgccgcaagatgtaagcaggctcacacttgacacaccgagtggccattcagatcttctgtttgagaaaaagcaacgccctttttggtccgagaaatggaggagagcttcgtgcccctgcggggcatcaagaacgacctccatgggaggctcgcctgctacaagcaggactggaccggagggttccgcaccggtatcaggatcctggcgccaaccacctacatattctttgcgtccgcgataccggtgatatcgtttggagagcaattggagaggaatactgatggagttctcacagcagttcagacgttagcatccactgccctgtgtggcataatccactccatcgtgggagggcaacctctgctgatccttggcgtcgccgagccgacagtgctcatgtacacattcatgttcaacttcgccaaggacaggcctgacctcggccgaaatctgttccttgcctggaccggttgggtctgcgtatggactgccattctgctgttcttgctggcgatactaggcgcatgctcaatcatcaaccgattcacccgcatcgcagcgagctgtttgggcttctgattgctatgctcttcatgcagcaggctatcaaggggcttgtagatgagttccgcattcctgaaagggaaaaccgaaaggcactagagtttgttccatcatggcgctttgcaaatgggatgtttgcaatcgtcttgtcatttggccttttgctcactgccctgaggagcaggaaggcgcgatcatggcgctatggagcaggttggctgcgtggcttcattgccgactatggtgttccactgatggtgctagtatggactggagtttcttacataccttacggaagtgtgccaaaaggaattccacgacgccttttcagccctaatccatggtcccctggtgcttatgacaattggactgttatcaaggatatggcacatgttccgctcctctatatcatcggtgccttcataccagcaacaatgattgctgttctctactacttcgatcatagtgttgcatctcagctcgctcagcagaaagagttcaatttgaggaagcctccatccttccactacgatttgcttctcttaggcttcctgaccttactgtgtggccttattggtatccctccatcaaatggtgtcattccacagtcacccatgcatacaaagagcttggctactctcaagcatcagctgcttcgtaaccggctagtagccactgcacggaagagcatgagtcagaatgctagcttgagccaactgtatagcagcatgcaggatgcttatcagcagatgcagacaccacttgtttatcagcaaccgtctgtcagaagaggcttaaatgagctcaaggactcaacagttcagctagcttcaagcatgggtaacattgacgcaccagttgatgagacagtttttgacatagagaaagaaattgatgatttgctgcccatcgaagtcaaggagcagcgcttgagcaacttgctacaggcagccatggtgggggcttgtgtcgctgcaatgccgctactcaagaagatcccaacatctgtcctctggggctattttgccttcatggccattgagagcttgcctggtaaccagttctgggagaggatcttgctgctcttcactgctcccagcagaagatacaaggtgctagaagagtaccacaccacgttcgtcgagactgtgccattcaagacgatagccatgttcacactgttccagacaacatacctgctggtctgctttggaatcacatggatcccgatagccggtgttcttttccccctcatgatcatgctcctggttccagtcaggcagtacatcctccccaagctcttcaaaggtgcacatctaactgacctggatgcagcagaatatgaggaatcacctgctataccattcagccttgctgcacaagatatcgatgttgcattgggacgcgcccaaagtgcagagatcctagacgacatggtcacaagaagccggggcgagatcaaacgtctgaacagcccgaagatcactagctcaggtggtacacctgtggcagaactgaaaaacatccgcagcccatccatttctgaaaaggcatacagccctcggctcactgagctcaggcatgagcgcagccctctgggagggagaaacagccctaggacgccatccaagttgggcgaaggctcaacaccgaagtgaataaatcaacgatgcattgcttagataagctaagcagctactggaagtcagctatatgagtgatttcagtattaggtgttaaaagaaagagtgttttcagtgttagtatccttatatgagatgtcctctgatgaagtatgatatgaatatctctagcttctctcttctctttctcatgttctcctgatttgagtaccatatctgtaatatctgaactagaggaatattagagtaactacttggaaatactgagttccactagcagattatcattctttattgcttatattcattaatatgtatatggaattggtgaaattatgccttttttcttgcattttcattgaactcaaccatgtatgtggaacgctactcataatactctttacagaggatccgctgaagcatgagcgttttat

SEQ ID NO: 2738 - DNA, 2949 bp, Panicum virgatum
tttcgggctttatctgaaactctctcgggcttgccatttcactcagcgctggtccctccctatgctctctatgctcgtcttcccttcatagccctcggcccttcgtcttcctccatggatccgcgctaaatgcattgcgagtctgcaatcttgtagcattccttcctgttccatctgccgcaagatgtaagcagggtctcacttgacacaccgagtggccattcagaatatactctcagatcttctgtctgagaaaaagcaacgccctttttggtccgggaaatggaggagagcttcgtgcccctgcggggcatcaagaacgacctccatgggaggctcgcctgctacaagcaggactggactggagggttccgcgccggtatcaggatcctggcgccgaccacctacatattctttgcgtccgcgataccggtgatatcatttggagagcaattggagaggaacactgatggagttctcacagcagttcagacgttggcatccactgccctgtgtggcataatccactccattgtgggagggcagcctctgctgatccttggcgtcgccgagccgacagtgctcatgtacacattcatgttcaactttgccaaggacaggcctgacctcggccgaaatctgttccttgcctggaccggttgggtctgcgtatggactgccattctgctgttcttgctggcaatactaggcgcgtgctcgatcatcaaccgattcacccgcatcgcaggcgagctgtttgggcttctgattgctatgctcttcatgcagcaggctatcaaggggcttgttgatgagttccgcattcctgaaagggaaaaccgaaaggcactggagtttgttccatcatggcgctttgccaacgggatgtttgcaatcgtcttgtcatttggccttttgcttactgccctgcggagcaggaaggcgagatcatggcgctatggagcaggttggctgcgtggcttcatcgccgactatggtgttccactgatggtgctagtatggactggagtttcttacataccttacggaagtgtaccaaaaggaattccacgacgccttttcagccccaatccatggtcccctggtgcatatgacaattggactgttatcaaggatatggcacatgttccgctcctctatatcatcggcgccttcataccagcaacaatgattgctgttctctactacttcgatcatagtgttgcatctcagcttgctcagcagaaagagttcaatctgaggaagcctccatccttccactacgatttgcttctcttaggcttcctgactttactgtgtggccttattggtatccctccagcaaatggtgtcattccacagtcacccatgcatacaaagagcctggctactctcaagcatcagctgcttcgtaaccggctagtagccactgcacggaagagcatgggtcagaatgctagcttgagccaactgtatggcagcatgcaggatgcttatcagcagatgcagacaccacttgtttatcagcaaccgtctgtcagaagaggcttaaatgagctcaaggactcaacagttcagctagcttcaagcatgggtaacattgacgcaccagttgatgagacagtttttgacatagcgaaagaaattgatgatttgctgcctatcgaagtcaaggagcagcgcttgagcaacttgctacaggcagccatggtgggggcttgtgtcgctgcaatgccgctactcaagaagatcccaacatctgtcctctggggctattttgccttcatggccattgagagcttgcctggtaaccagttctgggagaggatcttgctgctcttcactgctcccagcagaagatacaaggtgctagaagagtaccacaccacgttcgtcgagactgtgccattcaagacgatagccatgttcacactgttccagacaacatacctgctggtctgctttggaatcacatggatcccaatagccggtgttcttttccccctcatgatcatgctcctggttccagtcaggcagtacatcctccccaagcttttcaaaggtgcacatctaactgacctggatgcagcagaatatgaggaatcacctgctataccattcagccttgctgcgcaagatatcgatgttgcattgggacgcgcccaaagtgcagagatcctagacgacatggtcacaagaagccggggcgagatcaagcgtctgaacagccctaagatcactagctcaggtggcacacctgtggcagaactgaaaaacatccgcagcccttccatttctgaaaaggcatacagccctcggctcactgagctcaggcatgagcgcagccctctgggagggagaaacagccctaggatgccatccaagttgggcgaagggtcaacaccaaagtgaataaatcaatgatgcattgcttagataagctaagcaaccactggaagtcatctatatgagtgatttcggtattataggtgttaaaagaaagagtgttttcagtgttagtatccttatatgagatgtcctctgatgaagtatgatatgaatatctctaggctctctttcttcttctctttctcatgttctcttgatttaaggagtactgtacctgtaatctctgaactagaggaatgttagagtaactacttggaaatactgagttccactagcagattatcattctttattgcttatattcattaatatgtatatggaatttgtggaaattatgccttttttctgcttgcattatcattgaactcaagcatgtatgtggaacactactcataatactctttacacagaggatggcgctgaagcatgagcactgtatagttagttggaacgtggaactttatatttcatactacccttctgaatttgcacatattttatgcagaagttttcttgctttacacccccgccccccttcta

SEQ ID NO: 2739 - DNA, 2852 bp, Pennisetum glaucum
gtattccctttgtagcctcggcccttctccttcctccatggatccgcgctaaatgcattgcgagtccgcaatcctgtagcatttcttcctgttccatctgccgcaagatgtaagcagggtctcacttgacacctcgagtggccattcagaatatcccctcagatcttcttgtctgagaaaaaaagcgacgccctttttcggtccgggcaatggaggagagcttcgtgcccctgcggggcatcaagaacgacctccatgggaggctagcctgctacaagcaggattggaccggagggttccgtgctggtatcaggatcctggcgccgaccacctacatattcttcgcgtccgcgataccggtgatatcgttcggagagcaattggagaggaacactgatggagttctcacagcagttcagacgttggcatccactgccctgtgtggcataatccactccattgtgggagggcagcctctgctgatcctcggtgtagctgaacccacagtgctcatgtacacattcatgttcaacttcgccaaagacaggcctgacctcggccgaaatatgttccttgcctggaccggttgggtctgtgtatggactgccattctgctgttcttgctggcgatactaggcgcatgctcgatcatcaatcggttcacccgcatcgccggtgagctgtttgggcttctgattgctatgctcttcatgcagcaggctatcaaggggctcgttgatgagttccgcattcctgagagagaaaaccgaaaggcactggagtttattccatcatggcgcttcgccaacgggatgtttgcaattgtcttgtcttttggccttttgctcactgctctgcggagcaggaaggcacgatcatggcgctatggagcaggttggctgcgtggcttcattgccgactacggtgttccactgatggtgctagtatggaccggagtttcttacataccatacgaaagcgtgccaaaaggaattccacgacgccttttcagccctaacccgtggtcccctggtgcatatgacaattggactgttatcaaggatatggcacacgttccgctcctctatatcattggtgccttcataccagcaacgatgattgctgttctctactacttcgatcatagtgttgcatctcagcttgctcagcagaaagagttcaatttgaggaagcctccatccttccactacgatctgcttctcttaggcttcctgaccttactgtgtggtcttattggtatccctccatcaaatggtgtcattccacagtcaccgatgcatacaaagagcttggctactctcaagcatcagcttcttcgtaatcggctagtagccactgcacggaagagcatgagtcagaatgctagcttgagccaactgtatggcagcatgcaggatgcttatcagcagatgcagacaccacttgtttatcagcagcagtctgtcagaagaggcttaaatgagctcaaggactcaacagtccagctagcttcgagcatgggtaacattgatgcaccagttgatgagacagtctttgacatagagaaagaaattgatgatctgctgcccatcgaggtcaaggagcagcgcttgagcaacttgctacaggctgccatggtggggggttgtgtcgctgctatgccgctactcaagaagatccccacatctgttctctggggctattttgccttcatggccattgagagcttgcctggtaaccagttctgggagaggatcttgctgctcttcactgctcccagcagaagatacaaggtgctagaagagtaccacaccacgttcgtcgagactgtgccattcaagacgatagccatgttcacactgttccagacagcatacctgctggtctgctttggaatcacatggatcccaatagctggggttcttttccccctcatgatcatgcttcttgtaccagtcaggcagtacatcctccccaagctcttcaaaggtgcacatctaactgacctggatgcagcggaatatgaggaatcaccagcaataccattcagccttgctgcgcaagatatcgatgttgcaatgggacgtgcccagagtgcagaaatcctagacgacatggtcacaagaagccggggtgagatcaagcgcctgaacagcccgaagatcactagctcaggtggcacacctgtggcagaactgaaaaacatccgcagcccatccatttctgaaaaggcatacagccctcggctcgctgagctcaggcatgagcgcagccctctgggagggagaagcagcccgaggacgccatccaagttgggtgaaggctcaacaccgaaatgaataaagcaatgatgcattgcttatataagctacaccactactggaagtcagctatgagtgattcggtattaatagccgtttaaagaaagagtggtttcagagttagtatccttatatgaagatgtcatctgatgaagtatgatatgaatatctctagcctcttccttctctttctcgtgttctccagatttacgaagtgccatatctgtaatcctgaactagaggaatattagattaactacttggaaaatacttgggtttcactatcattctttcattacttacattcatcaatatgtatatggaaatgttaaaaattaagcatttttactgcctccattttcattgagctcaaccatgcctgtggaaacttgagtacacacaacactcctttaccgaggatggtgttcaagcatgtgttgtatacaaattgggacatggaactttttagaccctacccttccgaatcatacattctgtgtacattttgaagcaaggtaatcttgaaccaca

SEQ ID NO: 2740 - DNA, 3102 bp, Sorghum bicolor
cacaccccactgggaacccctcttgtgctttagctttccgtgtgctcagctcagcgttcagcaattcagcaaccctcccctggacagtttttgagcaatgcatttttttttcaggataactttttactttaaacttttttctaccttctttggtgaattgacagtggcgcccctcctctgccactgcctatatatccaccctctatcccgctccattgctctgtagcttcttgcagtctttgcctccgtttccctccgctgctgctctctctgagccttggccttcgcatgctctctatgctcctcttccgttcatagccccggccttcgtcttcctccatggatccgcgctaaatgcattgcgagattccagactggtagcatttcttcctgttccatctgccgcaagatgtaagcaggctctcacttgacattcagaatataccctcagatcttcttgtctgagaaaagcgacgccctttttggtccgagcaatggaggagagcttcgtgcccctgcggggcatcaaggacgacctccacgggaggctcgcctgctacaagcaggattggaccggagggttccgtgccggtatcaggatcctggcgccgaccacctacatattcttcgcgtccgcgataccggtgatatcgttcggggagcaattggagaggaacactgatggagtgctcacagcagtgcagacgttggcatccactgccgtgtgcggcataatccactccattgtgggagggcagcccctgctgatcctgggagttgccgaacccacggtgctcatgtacacattcatgttcaacttcgccaaggacaggcccgacctcggacggaatctgttcttggcctggaccggttgggtttgtgtgtggactgccatcctactgttcttgctggccatactaggcgcatgctccatcatcaaccggttcacccgcatcgctggcgagctgtttgggcttctgattgctatgctcttcatgcagcaggctatcaagggacttgtcgacgagttccgcattcctgagagggaaaaccgaaaggcactggagtttgtcccatcatggcggtttgccaatggaatgtttgcaattgtgctgtcgtttggccttttactcactgctctgaggagcaggaaggcacggtcatggcgctacggaacaggttggctgcgcggcttcatcgctgactatggtgttccactgatggtgctagtttggactggagtgtcttacataccttatggaaatgtaccaaaaggaattccacgacgccttttcagccctaatccatggtcccctggtgcatatgacaattggacagtcatcaaggatatgacacaagttccactcctctatatccttggtgccttcataccagcaacgatgattgctgttctctactacttcgatcatagtgttgcatctcagcttgcgcagcagaaagagttcaatttgaggaaacctccatccttccactacgatttgcttctcttaggcttcctgacattaatgtgtggccttattggtatccctccatcaaatggtgtcattccacaatcacccatgcatacgaagagtttggctactctcaagcaccagctgcttcgtaaccggctagtagccaccgcacgaaagagcatgagccagaatgcgagcttgagccaactgtatggcagcatgcaggatgcttatcagcagatgcagacaccactggtttatcagcagcagtctgtcagaagaggcttaaatgagctcaaggactcaacagtccagctagcttcgagtatgggtaacattgatgcaccagttgatgagacagtctttgacatagagaaagaaattgatgatctgctgcccatcgaggtcaaggagcagcgcttgagcaacttgctacaggcttccatggtggggggttgtgttgctgctatgccgctactcaagaagatccctacatctgtcctctggggctattttgccttcatggccattgagagcttgcctggtaaccaattttgggagaggatcttgttgctcttcactgctcccagcagaagatacaaggtgcttgaagagtaccacaccacgttcgtcgagacagtgccattcaagacaatagccatgttcacattgttccagacaatgtaccttttggtctgctttggaatcacatggattccaatagctggagttcttttccccctcatgatcatgctcctggttccagtcaggcagtacatcctccccaagctcttcaaaggtgcacatctaactgacctagatgcagctgaatacgaggaatcaccggctataccattcagccttgctgcgcaagacattgatgtcgcattgggacgcacccagagtgcagaaatcctagacgacatggtcacgagaagccggggtgagatcaaacgcctcaacagcccgaagatcaccagctcaggtggcacacctgtggcagaactgaaaggcatccgcagcccatccatttctgagaaagcatacagccctcgtctcaccgagctccggcatgagcgcagccctctgggagggagaaacagccctaggacgccatccaagttgggtgaaggctcaacaccgaagtgaataaagcaatgattcatagtgcttaagcttgcaactactggccatcagttatatgagtgattttaaagtggtttcagtgctagtgtccttgtatgaagatgtcctctgatgagattactatttatgtgtatctctagcctctttttcttcttttttgtgttctcctgattaaaggagtgctatacatgtaatctctgaactagcagaatattagagtaactacttgaaaaaccctgtcactagcatattatcattcattcattgtttataatattcattaatatgtacatgaaattggtggaaattatgtgcatgcattccattgaaaagcatgtatctggattctggagcactctagttgtcacaacattctattgatgatggtgctgaagctgaagcatggaactttagaccctgcttcccttcccaattgcacatattttgttagttattacaacaagtgttcttgctttttttt

SEQ ID NO: 2741 - DNA, 2729 bp, Saccharum officinarum
agcagtcttgcctctgtttccctccgctgctctctctaagccttggcctccgcatgctctctatgctccccttccgttcatagcctcggccttcgtctcatggatccgcgctaaatgcattgcgaggttccaaattggtagcatttcttcctgctccatctgccgcaagatgtaagcaggctctcacttgacactccgagtggcggccattcagaatatacccctcagatcttcttgtctgagaaaagcgacgcccttttggtcccagcaatggaggagagcttcgtgcccctgcggggcatcaagaacgacctccacgggaggctcgcctgctacaagcaggattggaccggagggttccgtgccggtatcaggatcctggcgccgaccacctacatattcttcgcgtccgcgataccggtgatatcgttcggggagcaattggagaggaacactgatggagtcctcacagcagtgcagacgttggcatccactgccgtgtgcggcataatccactccattgtgggagggcagcccctgctgatcctgggagttgccgaacccactgtgctcatgtacacattcatgttcaattttgccaaggacaggcccgacctcggacggaatctgttcttggcctggaccggttgggtttgtgtgtggactgccatcctactgttcttgctggccatactaggcgcatgctccatcatcaaccggttcacccgcatcgcaggcgagctgtttgggcttctgattgctatgctcttcatgcagcaggctatcaagggacttgtcgacgagttccgcattcctgagagggaaaaccaaaaggcactagagttcgttccatcatggcggtttgccaatggaatgtttgcaattgtgttgtcgtttggccttttactcactgccctgaggagcaggaaggcacggtcatggcgctatggaacaggttggctgcgtggcttcatcgctgactatggtgttccactgatggtgctagtttggactggagtgtcttacataccttatggaaatgtaccaaaaggaattccacgacgccttttcagccctaatccatggtcccccggtgcatatgacaattggacagtcatcaaggatatgacacaagttccactcctctatatcattggtgccttcataccagcaacgatgattgctgttctctactacttcgatcatagtgttgcatctcagcttgctcagcagaaagagttcaatttgaggaaacctccatccttccactacgatttgcttctcttaggcttcctgacgttaatgtgtggccttattggtatccctccatcaaatggtgtcattccacaatcacccatgcatacaaagagtttggctactctcaagcaccagctgcttcgtaaccgtctagtagccactgcacgaaagagcatgagccagaatgcgagcttgagccaactgtatggcagtatgcaggatgtttatcagcagatgcagacaccactagtttatcagcaacagtctgtcagaagaggcttaaatgagctcaaggactcaacagtccagctagcttcgagtatgggtaacattgatgcaccagttgatgagacagtctttgacatagagaaagaaattgatgatctgctgcccatcgaggtcaaggagcagcgcttgagcaacttgctacaggcttccatggtggggggttgtgtcgctgctatgccgctactgaagaaaatccctacatctgtcctctggggctattttgccttcatggccattgaaagcttgcctggtaaccagttttgggagaggatcttgctgctcttcactgctcccagcagaagatacaaggtgcttgaagagtaccacaccacattcgtcgagacagtgccattcaagacgatagccatgttcacattgttccagacagtgtacctgttggtctgctttggaatcacatggattccaatagctggagttcttttccccctcatgatcatgctcctggttccagtaaggcagtacatcctccccaagctcttcaaaggtgcacatctaactgacctagatgcagctgaatacgaggaatcaccagctataccattcagccttgctgcgcaagacatcgatgtcgcattgggacgcacccagagtgcagaaatcctagatgacatgatcacgagaagccggggtgagatcaaacgcctcaacagcccgaagattaccagctcaggtggcacacctgtggcagaactgaaaggcatccgcagcccatccatttctgaaaaagcatacagccctcgtctcaccgagctccggcatgagcgcagccctctgggagggagaagcagccctaggacgccatccaagttgggtgaaggttcaactccaaagtgaataaagcaatgacgcattgcttaagctctgcaactactggccatcagttatatgagtgattttaaagtggtttcagtgttagtgtccttatatgaagatgtcatctgatgagattactatttatgtgtatctctagcctctttttcttctttttttgtgttctcctgattaaaggagtgctatacctgtaatctctgaactagcagaatattagagtaactacttgaaaaatcctgtcactggcacattatcatctttcattggttataatcattaatatatgtacatgaaattggtggaaattatgcacatgcatttccattgaactc

SEQ ID NO: 2742 - DNA, 2989 bp, Zea mays
cttgtgcctttttgctttccgtgtgctcagctcactcagcatccagcaagcctcccctggacagttcttgagcaatgcatatttttcagggtaacttttttgctttaaacgtttttttttttgtaccaagatttcttttgtgaattggcagcggtgcccctcctccgccactgcctatatatgtgccctcaaacccgctccattgctctgtagctcttccctctgctgctctctctgagcctggcccttgccctcctctccctccgggaaccagccctgctctctatgctcctcttccattcatagcctcggccttcgtcttcctccatggatccgcgctaaatgcattgcgaggttccaaactggtagcacttctccctgctccatctgccgcaagatgtaagcacggcctcacgccctcacttgacactccgactggccatccagaatataccttcagatcttcctgtctgcgaaaagcgacgcccttttggcccgggcaatggaggagagcttcgtgcccttgcggggcatcaaggacgacctccacgggaggctcgcctgctacaagcaggactggaccggagggttccgtgccggtatcaggatcctggcgcctaccacttacatattcttcgcgtccgcgataccggtgatatcgttcggggagcaattggagaggaacactgatggagtcctcacagcagtgcagacgttggcgtccactgccctgtgcggcataatccactccattgtaggagggcagcccctgctgatcctgggagttgccgaaccgacggtactcatgtacacattcatgttcaactttgccaaggacaggcccgacctcggacggaatctgttcctggcctggaccggttgggtttgtgtgtggactgctatcctgctcttcttgctggccatactaggcgcgtgctccatcatcaaccggttcacccgcatcgctggcgagctgttcgggcttctgattgctatgctcttcatgcagcaggctatcaagggacttgtcgacgagttccgcgttcctgagagggaaaacacaaaggcactagagtttgttccatcatggcggttcgccaatgggatgttcgcaattgtcttgtcgtttggccttttactcactgccctcaggagcaggaaggcacgatcatggcgctatgggacaggttggctgcgtggcttcatcgctgactatggtgttccactgatggtgctagtgtggactggagtgtcttacataccttatggaaatgtaccaaaaggaattccgcggcgcctttttagccctaatccatggtcccctggcgcatacgacaattggacagtcgtcaaggacatgacacaggttccactcctctatatccttggtgcattcataccagcaacgatgatcgctgttctctactacttcgatcacagcgttgcgtctcagcttgctcagcagaaagagttcaacttgaggaagcctccatccttccactacgatttgcttctcttaggtttcctgacgttaatgtgtggccttattggtatccctccatcaaatggtgtcattccacaatcacccatgcatacgaagagtttggctactctcaagcaccagatccttcgtaaccggctagtagccaccgcacggaagggcatgagccagaatgcaagcctgagccaactgtatggcagcatgcaggatgcttatcagcagatgcagacaccactggtttatcagcaacagtctgtcagaagaggcttaaatgagctcaaggactcaacagtccagctagcttcgagtatgggtaacattgatgcaccagttgatgagacagtctttgacatagagaaagaaattgatgatctgctgcccatcgaggtcaaggagcagcgtttgagcaaccttctacaggcttcgatggtggtgggctgtgtcgctgctatgcccctgctcaagaagatccctacgtctgtcctctggggctattttgccttcatggccattgagagcttgcctggtaaccagttttgggagaggatcttgctcctcttcactgctcccagcagaagatacaaggtgcttgaagagtaccacacgacgttcgtcgagacagtgccattcaagacaatagccatgttcacagtgttccagacagcttacctgttggtctgctttggaatcacatggattccaatagccggagttcttttccctctcatgatcatgctcctggttccagtcaggcagtacatcctccctaagctcttcaaaggtgcacatctaactgacctggatgcagctgaatacgaggaatcaccagctataccattcagccttgctgcgcaagacatcgatgtcgcattgggacgcagccagagtgcagaaatcctagacgacatggtcacgagaagccggggtgagatcaaacgcctgaacagcccgaagatcaccagctcaggtggcacgcctgtggcagaactgaaaggcatccgcagcccatccatttctgaaaaagcatacagccctcgtctcactgagctccagcatgagcgcagccctctgggagggagaagcaggcctaggacgccatccaagttgggtgaaggctcggcaccaaagtgaataaagcaatgatgcattgcttaagctatgcaactactgggttactggccatcaattatataagtgattttaaagtggtttcagtgttagtatccaagatgtcctctgatgagattactactattcatgtgtatctctagcctctttttctttctttctcttcttttgtgttctcctgattaaaggagtgctatacctgtaatctctgaactagcagaaatattagagtaactactcgaaaaatcctgtcgctaacatattatcattcttcgattgttttaatatgtacatgaaattggtgggaaattatgcgcatgcatttccattgaactcaagcatgcatccggattctggaat

SEQ ID NO: 2743 - DNA, 2979 bp, Zea mays
tctttgtgaattgacagtggtgtgcccctcccctgccacttcctatatatctgccctctatcgcaactccgttgctctgtagcggttacctccctttcgctctactgctctctctctctctctggaccttgccgttctctccctcgtcggcaatcagcccgcttcctgtgctctctatgctccccttccgttcgtagcctcggccttcgtctccctccatggacccgcgctaaatgcatcgcgagattccaaaccggtagcgtttcttcctgctccatccgccgcaagatgtaagcaagggcctcacttcacacccggagtgggagaccatccagaatacatcctcagatcttcttgtgtctgagaaaaaagcgacgcccttcaatggaggagagcttcgtgcccttgcggggcatcaagaacgacctccacgggaggctcgcctgctacaagcaggactgggccggagggttccgtgccggtatcaggatcctggcgccgacgacctacatattcttcgcgtccgcgataccggtcatatcgttcggggagcaattggagaggaacactgatggagtcctcacggcagtgcagacgttggcatccactgcgctgtgcggcgtaatccactccatcgtgggagggcagccgctgctgatcctgggagtcgccgaaccgacggtgctcatgtacacattcatgttcagcttcgccaaggacaggcccgacctcgggcggagtctgttcctggcctggaccggttgggtttgcgtgtggactgccatcctactcttcttgctggccatactaggcgcgtgctccatcatcaaccggttcacccgcgtcgctggcgagctgtttgggcttctgatcgctatgctcttcatgcagcaggctatcaagggacttatcgatgagttccgcattcctgagagggaagaccgaaaggcgctagagtttgttccatcatggcggtttgccaacggaatgtttgcaattgtgttgtcgtttggccttttactcactgccctgaggagcaggaaggcacggtcatggcgctatggagcaggttggctgcgtggcttcatcgctgactatggtgttccactgatggtgctagtttggactggagtgtcttacataccatatggaaatgtaccaaaagcaattccgcgacgccttttcagtcctaatccatggtcccctggtgcatacgataactggacagtcatcaaggatatgacacaagttccactcctctacatcattggtgccttcataccagcaacaatgattgctgttctctactacttcgatcatagcgttgcatctcagcttgctcagcagaaagagttcaatttgaggaaacctccatccttccactatgatttgcttctcttaggcttcctgacgttaatgtgtggccttattggtatccctccatcaaatggtgtcattccacaatcacccatgcacacgaagagtttggctactctcaagcatcagctgcttcgtaaccggctagtagccactgcacgaaagagcatgagccagaatgcgagcttgagccaactgtatggcagcatgcaggatgcttatcagcagatgcagacaccactggtttatcagcaacagtctgtcagaagaggcttaaatgagctcaaggactcaacagtccagctagcttcgagtatgggtaacattgatgcaccagttgatgagacagtctttgacatagagaaagaaattgatgatctgcttcccattgaggtcaaggagcagcgcttgagcaacttgctacaggcttccatggtgggtggttgtgtcgctgctatgccactactcaagaagatccctacatctgtcctctggggctattttgccttcatggccattgagagcttgcctggtaaccagttttgggaaaggatcttgctgctcttcactgctcccagcagaagatacaaggtgcttgaagagtaccacaccacgttcgtcgagacagtgccattcaagacgatagccatgttcacaatgttccagacagcgtacctgttggtctgctttggaatcacatggattccaatagctggagttcttttccccctcatgatcatgctcctggttccagtcaggcagtacatcctccccaagctcttcaaaggtgcgcatctaactgacctagatgcagctgaatatgaggaatcgccggctataccattcagccttgctgcgcaagacatcgatgttgcattcggaaacacccagagtgcagaaatcctagacaacatggtcacaagaagccggggtgagatcaaacgcatcaacagcccgaagatcaccagctcaggtggcacgcctgtggcagaactgaaaggcatccgcagcccatccatttctgaaaaagcatacagccctcgtgtcattgagctctggcatgagcgcagccctaggacgccgtccatgctgggtgaaggctcaacaccaaagtgaatgaaagcaacgatacattgcttaagctattcaaccactggtcatcagttatatgagtggttttaaagtggtttcagtgttagtatccttatatgaagatgtcctctgatgagattactacttatgtgtatctccagtctctcttttttttgttctcctgattaaaggagtgatatacctgtaatctctgaactagcagaatattagagtggctacttgaaaaatcatgtcactagcatattatcattctttaattgtctataatcattgatactatattactatgtacatgaaattggtggaaattatgcacatgcatttccattgaacccaagcatgtatctggattctggaatactcaaatgctcacaatattccattgacggcggtggtgaagcatggaactttatagaccctgcttcccttctgaatttgcacacattttgcatttttgctagttgtaacaagttctcttgcttcttttta

SEQ ID NO: 2744 - DNA, 3716 bp, Musa acuminata
ccacctccacccctcccacacctccattctctccggtatgtactcctggcttttttgcacattaccatccctagttttctctgtatgcagtcttctcgccagcatttgagctcattttgaagttataatattggaagaagcttttaggcattgatagtgatgttcacactctgcttccattgaccacattgctcactactatttgctcatttcacttcttagccctctcctcccttatttatttgaactcctctcaggcattctcagtatccctctgctgcatatttggacggtagtcgcctactgcaatccgaaagggtcgcctcctctctgtgcccttagtattgccgctgctgggcgttgttaactgaggtcgtttgcttctgcaactgattcagtgtgtcatggtttggaatctgaaacccaccctctcagatttgtgagtttggttcatgttgttctttcactataagaagaggcattgttcattcttcagttgagactttgagttctttgctccttccttatgtagccgatctgttttcccgactctggaagcacctgtatgatgtaaatctctcttggccaagcttcccgagacatttttcacatcaaaccctggaattttcgcatcagatctttgaaccaccttagtattattatgtagatcctgtgtcaggagagaaaaaggactgtggtgatcgtttgctgctgaaaccatgtaaatttagccctcttatatttttgttggttcacatctgccacctggtgggaggtttcgttacctgtttcctttcctctttgttcgaaaatcacttaagaaagatcattctttcatccgagtcaaaataagcatggaggaaacttttgtgccttttcgtgggatcaagaatgaccttcaaggaagattgaagtgttacaagcaagactggactggtggtttccgggcaggcatcaggattctggctccaactacttatatattcttcgcatctgcaatcccagttatttcatttggagagcaattggaaagaagtactgatggtgttctgacagcagtgcagactttagcatcgactgcactgtgtggaattgtacactcaatcatcggaggtcaacctttgctgattcttggagttgcagaacccacagtacttatgtacacgttcatgtttaactttgccaaggatagggcagatttgggtcgaaacttgtttctggcatggagtggatgggtgtgtgtctggacttccttcttgctatttttactggcaatcttaggtgcatgttctatcatcaatcgatttactcgtttagctggagagcttttcggtttgctgatagccatgctctttatgcaacaggctattaaggggcttgttgatgagttccgcatacccgaaagagagaacccaaaggcgctagaattcattccatcttggagatttgctaatggaatgtttgctctggttctgtcatttggccttctattcaccgcactaagaagtaggaaggcacgatcgtggcgctatggaactggttggttaagaggccttattgcagattatggggtgcccctcatggtccttgtctggacaggagtatcttatatgcctactagtagtgttccaaaaggaatccctagacgcctttttagcccaaacccttggtcacctggagcatacgagaattggacagtgatcaaggagatgctcaatgtgccctttctctacattcttggagctttcataccagctacaatgatagcagtcctatattattttgatcacagtgtagcatctcaactttctcaacagaaggagtttaatttaagaaagccagcatcatttcattatgatctactgctattgggcttcttgactttattatgtggtcttattggaattcctccatctaatggagtcatcccgcagtcgccaatgcacacaaagagtctggccactctcaaacatcaacttcttcgaagtcgactggtagccactgcacgccaaagtatgagccaaaattcaagcttgagccaactgtatggtaacatgcaagacgcttatcggcaaatgcagacccctttaatttaccaagagtcatctgctcgaggattgatggagctaaaagactcgactgtccaacttgcttcaagtatgggaaattttgatgcaccagttgatgagacggtatttgatatcgaaaaggaaattgatgatcttctaccagttgaggttaaagagcagcgtctaagcaatttgcttcaggctatgatggttggagggtgcgttggagcgttgccattcctcaggaaaatcccaacatctgttctatggggatattttgctttcatggccatagaaagcttaccaggaaaccagttctgggaaaggattctcctgcttttcactgcaccaagtagaagattcaaagtgcttgaagagcaacatgcaaccttcgtcgagaccgtgcctttcaagacaatcactttctttactctcttccagacaatttacttgcttgtctgctttggaataacatggattcctatagctggtgtcctttttccactaatgatcatgcttttagtacccgtaagacaatactttctcccaaagctcttcaaaggagcacaccttactgatctagatgcagcagagtatgaagaatcaccacccttagcatataacctggcagcggagatcgacattgccaagggatgctcctttgcagagagtggggaggtcctggatgacatagtcaccagaagccgaggtgagattaaacatatgaatagccccaaactaactagttcaagcggaaccccaacaaacgacataaggggtaaaaccagtccctggttgtcagacaaagcctacagtcctagattgaatgaactgaggcaggatcatagtcctcggcttgggggacgagggccaatcagtccgagaactggagaggttggaccatccaaactcagagaaggtgctcgggattccccatcaaagtagttctgagcaggttatatcagtttcctaacatgttcagatagataataaccgtgccaaagataaaatctgtttctattttatgttcatttctttgtggcagttgttgtagcctcagaacttttaagatcctcctacatgtctacttaagatgaaagcctattaccatccatccattttttctttttcttttttttcgcttggtttgtttgtatttcttgacatttgagtatgatattattgaaatctacattggccgggaaacttgaacctgtatatttatggtgttcagttccttatttgaggtgcagacatgcagaaagcccatgcctatagtgtaaatgctaaattctgatatgatcagcagtatttgaactcggattctgcctgtgatttaatcactgcctgtaatcaaccacatgaatgcaacattgacgatcgctccaaggtgtgtattatggtatcaaccatacgaaggggagacgacaaccaggtaatttgatgtgtccatgagaggattggagtagctgcaacatgaagtgttgatttattattattattatttcattataaagagttggtgtcttttacactcattcaagattctcttgctgatttcacatgtttggttgtgagaaagcagtcaaaaggggtgcatgtttcaagggaagtgctcgctacttttgttttgttcacatgcagagc

SEQ ID NO: 2745 - DNA, 2817 bp, Quercus alba
gattttcatttggaagatcaatgaaggctcagatgaggatgacagacctcaaatcacaggaaaaattgttctttctattcagatagagggagcaggggagtcagtccacccacgactgtgttggcatcctcacaaacagattggcatgagcactgtcctttgttaaggcattcaagaaggtgctctcagtggtcctagtaaagaaggagctatggaagagacatttgtgccgtttcgcggaatcaagaatgatcttaatgggaggctgatgtgttacaagcaagattggactggtggattcaaggcaggcttcaggattttggcccccactacatatatattctttgcttcagcaatcccagttatttcttttggagaacagttggatagaagtacagatggagttctaacagcagttcaaacattagcttctacagcactgtgtggaattatacactcaatcattggaggtcaacctttgctgattctcggagtcgcagagccaaccgtgattatgtatacatttatgttcaagtttgctaaagataggcctgatttgggatcaaagctctttttagcatggactggatgggtatgtgtgtggactgccatattgctgttcctactggctgtcttaggggcttgctccattattaataggtttactcgtatagctggggaactgtttggccttcttattgcaatgctcttcatgcaagaagctataaaaggacttgttgaagaatttcgtatacctgaaagagaaaatccaaattcaattgagtttcagccttcatggagattttcaaatggcatgtttgctttagttttgtcatttgctcttctgcttaccgctttaagaagcagaaaagcaaggtcttggcggtatgggtctggatcgctcagaggcttcatagcagattatggtgtgccattgatggttgtagtttggacagctatttcctatctaccagctggaagtgttccaaaaggaatcccaagacgactcttcagtccaaatccatggtcaccaggtgcatatgagaattggactgtcattaaggacatgctaaatgtgccggtcctctatataattggggctttcattcctgcaacaatgattgcagtgctctactactttgaccacagtgtggcttctcaactcgcccagcagaaagagttcaatttgagaaaacccccttctttccattatgatttacttcttttggggttcatggtcatattgtgtggtctcattgggatccctccatcaaatggagttattcctcaatctccaatgcatactaaaagtttggctacgcttaaacaccagttacttcgtaatcgacttgtagcaacagcacgcaagtgtatgagaaataatgcaagcttgggacaagtgtatggaagcatgcaagaagcctatcaacagatgcagactcctttaatttaccaggaaccttcagctaggggattaaaggaattgaaagactccacaattcaaatagcttcaagcacggggaatataaatgccccggttgatgagagcacgtttgatgttgagaaagagattgatgatttactgcctgttgaggtgaaagaacagcggctcagtaacctgcttcaagctatgatggtaggaggatgtgttgcagccatgcctttccttaagaagatcccaacctcagtactctggggctattttgccttcatggccattgaaagcttacccggtaaccagttttgggaaagaatcttattgctcttcacagctccaagtagaagatacaaagtactggaggagtaccatgccacttttgtggaaactgtacctttcaagaccattgcaatttttacaatcttccagactgcttatctgcttgtttgttttgggatcacatgggttccaattgctggggttctgttccctttaatgattatgcttttggttcctgtgagacaatacattttgcccaagtttttcaaagcagcacaccttcaagatttagatgctgcagagtatgaagaggcgccagctttatcattcaacctagcaatagatggggaaatgggacggacagcttcatttggagatgatggagagattctagatgggatagtaacacgtagtcggggcgagattagacggatgtgcagtctcaagttaacaagctgcacagcaacaccttccaaagaatttagaagcctacagagcccacggctgtcagatagtgtacacagccctcgcataagtgaactgagaggggaacagagtcctcggcttggtggaagagggccatttagtccaaggactggagagccgagaccatctaatttagggaaaggcagttagaactcagatatgaacttgcaacaattggctgtgtttatattgtcaggtatctaaaaagaagcaagttcttgtagtgatgatctaatgaacatgaaaagagcttgcaatgactatccctctgccttcaacatgttatgcatttataaaatttattaaaggggagggatttgtaaccacaagttttatgaatgacaatactaaattttatatgtttatttccaattactgacactatagcaagagattgtacaggcattatttatattttaccccatgccccgttttagcttttactcttgtaagtttttgagccatgcagtaagcatggtatagaagatgcaaaagatcagtcatactataatgaaagtcttctagcctttatagttggaaccagttcaccatctgtatacatgctatttttatgacgaataaaaatacctttgtccattccactttttgtcttc

SEQ ID NO: 2746 - DNA, 3037 bp, Amorphophallus konjac
gtaggacccccagcgcaggtaccacgaggtcagcatctcttaggccattggcacgtactgccatgccggtgccagtactggctggttgtgctctctcttataattgtatacatgtgttttgaagttgggttccccccatcagctggcaactgatccttgccgggactggaatatttgatcctcgatcgggtatcctgggtttcattaattgggatcttttcgaagaagaataaaaagctcagctagccatgttttgataacccatccgtattttggtctcctgtggccactcttaattttcagatttgggcaattaattgggtgttgggtttatgtagcttccagtcactagctagctagctccccaaagttccaaaaataatgtagtccaagtcgttgccccattcgatcctctcaatgagacggtgtcggacgagtcccgacccaacagggaagctttgagtagtgcgcgcggcctccccgatcgacctgtgattatatattctgctacctctttgttttcgaagtctctgagcgcggttgtcgaccactggcaccagcatggacgagacatttgtccccttccgcggaatcaagaatgatcttgatgcaaggttgaaatgttacaagcaagactggaccgggggattcaaagctggcatcaggattctggctcccacaacatatatattttttgcgtcggcaatccctgtcatatcatttggagaacaactggagagaaacaccgatgggatcctaactgctgttcagacgttagcgtccacggcgctttgtgggatcatacattccctaataggtggtcagcctttgctgattcttggagtagcggaaccaacagtgctcatgtatacattcatgtttaattttgccaaggatagacctgatttgggtccaaaagtctttctggcatggaccggatgggtgtgtgtgtggacggcagtcttattgtgctcgctggccattttgggggcctgttccattataaaccggttcactcgaatagcgggcgaactgtttggtttgttgattgcaatgctcttcatgcagcaggctattaaaggccttgtagatgaatttcaggtacccaaaagggaaaacccaaagttaccagagttcgttttctcatggaggttttcgaatgggatgtttgcactagttctatcatttggccttctgctcaccgccctaaagagtaggaaagcaaggtcatggagatatgggaccggttggctacgtggcttcattgcagactatggagtgccattgatggtcctcatctggacaggggtctcatatataccagccggtagcattcctcatggaatcccacgacgccttttcagtccaaatccatggtcccctggtgcatacgaaaattggacagtcgtcaaggagatggtgaaagtgcctgttctctacatacttggtgctttcattccagccaccatgattgctgtcctctattattttgaccacagtgtagcatcccagcttgcccaacagaaggagttcaatttgagaaagccaccgtcctttcactatgatttacttcttctgggttttctgaccttattgtgtggtcttatcgggattcccccagcaaatggtgtcatccctcagtctccaatgcatacaaagagccttgctactcttaagcatcagctcctacggaatcgtcttgttgcaacagcaaagcaaagcatgcaaaagaattctagtttgggacaactatatgggaatatgcaagaagcttatcaacagatgcagacccctcttacttatcagcagcagtccgtccaaggtttaagggaactgaaggattcaacgatccagttggcctcaagcatgggaagcatagatgcaccggtggatgagacagttttcgacattgagaatgaaatcgatgatcttttaccagtggaggtaaaagaacagcgtctgagcaacctgttgcaggctctgatggttggaggctgtgtggcagctatgccatttcttagaaagatcccaacgtctgttctctggggttactttgccttcatggctattgaaagcttacccggtaaccagttctgggaaagaattctacttctcttcaccgctccgagcagaagatacaaggtgctggaggagtaccatgcgacatttgtggagactgtgcctttcagaaccattgttaccttcactcttttccaaacagcgtatctactggtgtgttttggaatcacgtggattcctatagccggcgtattgttccctctgatgatcatgcttctagttccagcaaggcaatatgtcatgcccaaactcttcaagggggttcaccttacagatttagatgcggcagagtatgaggaatcaccagctttggcatacaatatagcatcagtagagatagacacagctctgaggggaggatctttcgcagaaactagtggagaaatcttagatggcatgatcacccgcagtcgtggcgaggtcaagcatgttaacagtcctaagttgacgagttcaactgcaactcctgtcggtgatggaggaaggggcattcacagtcctcggttttcggcttttagtcccagggtgaatgagctcaggcaggagctgagccctcgtgccggtggcaaagggccactctccccaaggacttcagaggcaaagccatctaacttgggtgatggctccagggattcagctcacaagtagatgtctttaatatatccaaggttctacgtacgtacgtacacagttactgcatgtgtactctacatactcttttcttctattatatatgtaatgtagatatgtcggggatatatgatctatatttttggtttggttcactatatatatataaatatgttcactatatatatataaatatatatatatgtatatatatatatgttcttgtaatctgcaacgaactgtataattatatcctcatgtaatattcctggcattccttggaagtgaatgtataagacaagcttcaactagtgttcctttcagatcg

SEQ ID NO: 2747 - DNA, 2604 bp, Amborella trichopoda
aaccatggaggaatcttttgtgcctttcagaggcataaagaatgatctttcaggaagactcaagtgttacaagcaagactggactggcggtttcagtgcaggcttcaggattctagctcccacgacatatatatttttcgcttctgcgattcctgtcatatcctttggagagcagctagagagaagcacagatgggactttaactgctgttcaaaccttggcttccactgcagtctgtggaatcatacactccatcataggaggtcagccattgctgatccttggggtggctgagcccactgttattatgtacactttcatgttcaacttcgcaaaagatagagctgatttgggtcccaagctgtttttagcatgggctggatgggtatgtgtatggactgcattcttgttgttcatgttggccatattggggggctgctccataattaataggtttacaagagtggctggtgaattgtttggtctattgatagctatgctcttcatgcaacaagctataactggggttgttgaggagtttcgtatccccagaagggaaaatcctcgacttactgaatttgtgccctcttggcgatttgccaatggaatgttcggtttggtcctcacctttggccttcttctcactgcattaaggagtcggaaggcacgttcttggagatacggcacgggatggctaagaagtttcattgctgattatggggtgccattgatggttcttgtgtggactgctgtttcttacataccttctggtgatgtcccaaaggggattccaagaaggcttgttagcccaaatccctggtctcctggagcatattcaaactggactgtcatcaagcaaatgctggatgttccggttctttatatcttgggagctttcattccagccaccatgattgccgttctttattattttgatcacagtgtcgcatctcagcttgctcagcagaaggagttcaatctgagaaaaccaccttcattccattatgacttgcttctcctgggttttctgaccataatatgtggtcttgtgggcatccccccatcaaatggtgttatcccacaatctccaatgcacacaaaaagtttggccactctcaagcatcagcttctacgcaatcggcttgtagccactgcacgcaattgtatcagtaagaattcaagcttgggacagctctatggaaacatgcaagaagcttatcaacagatgcagactccattgatctatcaagagcagtctactcggggcctgagggaattgaaggaatcaacgatccaattggcatcaagcatggggaatattgatgctccagttgacgagtcaatatttgatgtagagaaggaaattgatgatcttttgcctgttgaagtaaaagaacagcgtctcagtaacctactccaagctttcatggttggaggctgtgttgctgctatgccattcatcaaaatgattcccacatctgttctttggggttattttgctttcatggccattgaaagcttacctggtaaccagttttgggaaaggattctacttctcttcactgctccaagcagaagatacaaagtgcttgaggaataccatgctacctttgtggaaactgtgcctttcaaggcaattgccttctttacaatattccagttaacatacctgctggtttgttttgggatgacatggattcctattgctggcgttttgttccctctgatgattatgcttttagtccctgttcgccaataccttctccccaagttcttcaaaggaccgcaccttcaagatttagatgctgccgaatatgaagaggcaccagcattaccattcaatgttttagctttacaggaaggagaatctagtgggcttggggggatgaggggcactccagatgatggtgagatcctagatgatattatcactcgcagtcgaggagagataagaaggacttgtagttcaaaaatcacaagctcaacagccacccctgtgactgatcacagagggccattcagcccacgcttctcagagaaggaattcagccctcgtgtgagtgaactgcgccacgaaagtagccctcgggtgggtggaagacgggcattcagcccaaaaactgaagctaagccctctaatttaggccagagtgctaggaattccccctcttaacttgaagcagatgatggcttgtatttttttgtgcttgtacattagcttggaatggcgttgggagcctgttatgttgatattaagaggaatgcaaatgtgttgtattgtatctagctctctctctctctctttatatatatatatatatatatatatatgaggcaatgatccaatataacggttgtatcatagtataatgcaataacacttctagcaaaccatgtttgtggtatttgtatgacttcaaattttgcacaaatactctcttcatctcaataatcaatctctcaaaacaaaaaaagttcaatttgaaccttatatatggtcaaaatgagtctcctccaaaaatgaatctagaccattcattttgtgaatttcaagatcttaccttttataaactcaaaatcaaatttgtctttttaacattgttc

SEQ ID NO: 2748 - DNA, 2328 bp, Aquilegia formosa
ataaaaccatggaagagacttttgtaccttttgaaggaataaagaatgatctcaaagccaggttgaagtgttacaagcaagattggactggaggtttcagtgcaggcctcaggattctggctccaactacgtatatatttttcgcctctgcgataccagttatttcgtttggagaacaattggagagagatactgatggggtcttgactgcagttcaaacattagcatctactgcactttgcggaatcatacactccatcattggtggtcagcctttgttgattcttggagttgcagaacctactgtactgatgtacacattcatgtttaaatttgctaaagataaacctgaattgggtgcaaagctcttcttggcatggagtggatgggtctgtgtatggactgcaatattgctattctttctggcaatcttaggggcttgctctattatcaataggtttactcgtgttgcgggtgaactgtttggtatgcttattgcaatgctcttcatgcagcaagctatcaaaggacttgtggatgagtttcgtgctccgcaaagggaaaatctcaagcaaacagagtttctgcctccatggagattcgcaaatggaatgtttgctttagttctatcatttggtcttctcctgacaggattaaagagccgaaaagcacggtcatggcgatatggatctggcatgattcgaggcctcatagcagactatggtgtgcctttgatggttctaatctggacaggtgtttcttacataccatcccacagtgttccacatggaatccctagacgcctctttagtccaaatccatggtcgcctggtgcctatgacaattggacggttatcaaggacatgctggaggttcccatactgtatataattggagcttttattccggccacaatgattgcagttctttattattttgatcatagtgtagcatctcaacttgctcagcaaaaagagtttaatttgagaaagccaccttcattccattacgatttacttcttctaggatttttgaccttattgtgtggtcttcttggcatccctccatcaaatggtgtcatcccacaatcaccaatgcatacaaagagtctggctactcttaagcatcaattgcttcgcagtcggcttgtggccacagcacgcagaagtatgggtaaaaatgcaagcttgggacagctatatggtaatatgcaagaaagttatcagcagatgcagactccattgatctaccaggatgcctcagctcgaggacttaaagacttaaaagactcgacaattcaactggcttccagcatgggaaatattgatgccccagttgatgagacggtatttgatattgagaaggaaattgatgatctgctgcctgttgaggtcaaggagcagagacttagcaatttgcttcagtctaccatggtgggatgctgtgttgcagccatgcccttacttaaaatgatcccaacatcagtgctctggggttacttcgcttttatggccattgaaagcttacccgggaaccaattttgggaaaggatcctattactttttaccgctcccagccgaagatacaaagtgcttgaggagtaccatgctacttttgtagaaactgtacctttcaaaacaatagcaacatttacaatttttcagacagcttacttactaacatgttttgggattacttgggttcccttagccggggttctcttcccattactcatcatgttattagttccggttagacaataccttctgcccaagtttttcaaaggggcacaccttcaagatttagatgcagcagagtatgaggaagctccagctttaccattcaacctcgcatgtgggggagaaacaggtccttttgcagaaagtggagaaattatggatgagatagttactcggagccgaggggagattcgccgtgtatgcagtcccaaggttacaagctccacttcaaccccactgaaagattccaaaagctttcagagcccaaggcacatggacaaagcatttagcccccgtgtaagtgaactgcgaggggagcaaagtcctcaacttggtggaagaggtcccctaagtccaaggactggagaagccaggccatctcaattgggaaagggtactccagactccacttcaaagtgatgaatcatttggatagtaagtggctttgttggaatagctggtggtttctttatgtttaatgttgtgtgctaccattttgtatgacttcctccattgtaatcttctctatccaaggagcttgtaatcatgaaatatagaaataaacactaatgaatattgttatgttgag

SEQ ID NO: 2749 - DNA, 2692 bp, Secale cereale
ggggcgaaatcgacgccacagcgggagggaaaaagcttccggggttggcagggattccgcctcttatacgccccgcccgcctcgccagattcctcacagcttccctgcctgcgaggtcccgtgcccgaccggagatcctgaattccggaggccgtcgtcgggagtaagattcggcggccatgtcgggcgccgtgctggtcgccatagcggcgtccatcgggaacctgctgcaggggtgggataatgcgaccattgcaggtgccgtcctgtacataaagaaggaattcagcctggagacgcagcccttgatcgagggcctcatcgtggccatgtcgctcatcggggcgacggttatcaccacgttctccggggcggtggctgatgctgttggcaggcggcccctgctgatcgcctcgtctgtcctctactttgtcagtggcctggtgatgctctgggcgcccaacgtgtacgtgttgctcttggccaggctcatcgacgggtttggtatcggtttggctgtcacccttgtccctctgtacatttcggagaccgccccgactgacatccgaggactgctgaacacactgcctcagttcagtggatcaggagggatgttcctttcttactgcatggtgtttaccatgtccctcatgccgcagcctgactggagaatcatgcttggggttttgtcaatcccctcacttatgtactttgcattgactgtcttctatttgcccgagtcgcccagatggcttgtgagcaaaggaagaatggccgaggccaagcgagtgttgcagagactgcggggaagggaagatgtctcaggagaaatggcccttcttgttgaaggattgggtgttgggaaagacacacattttgaggaatacataattggacctgatgatgagcttgctgatgacgggctggctccagatcaagacaaattgaagctgtacggagctgaagaaggggtatcttggattgcccgtcctgttaggggcggtggccaaagtgcacttggaagcgccttgggtctcatgtctcgtcatgggagtatggttagtcagggtaaatctctcgtggacccacttgtcactctcttcggaagtgtccatgagaagatgcctgaggtaatggggagcatgcgcagtacattgtttcctaactttggcagcatgtttagcgtagcggaacagcagcaggctaaagctgattgggatgctgagagtcatagggatgatgaagattatgcatcggatcatggtgcagatgacattgaggataacctcaatagcccgcttatttctcgtcaagcgacaagcgtggagggtaaggagattgctgcacctcatggaagcataatgggtggtgtgggaagaactagtagcatgcagggaggggatgcagtaagcagcatgggcattggtggggggtggcagttagcttggaagtggactgagagagagggtgcagatgggcaaaaagaaggcggcttccagcgtatttacttgcatgaggagggtgtgtcaggtgatcggaggggctctatattgtctatgccaggaggtgatattcctcctggtggtgagtatatccaggcagctgctctagtgagccaacctgctctttactcgaaggacctgatagagcagcagcttgctggtcctgccatggtacatccatctgaggcagttgccaagggtacaaagtgggcagaactatttgaacctggagtgaagcatgcactgttcgttggcataggattacagatcctgcagcagtttgcgggtatcaatggagtcctctactacacacctcagatacttgagcaagcaggtgtcggggttcttctatcaaacattggactaagctcttcctctgcatctattcttattagtgccttgacaaccttgctgatgcttcccagcattggcatcgccatgagactcatggatatgtcaggaagaaggtttcttctcctttcgacaatccctgtcctgatagtagcactagctgtcttggttttggtgaatgttctggatgtcggaacaatggtgcacgccgcgctctcaacgatcagcgtcatcgtctatttctgcttcttcgtcatggggtttgggcctatcccaaatattctctgtgcggagattttccccacctctgtccgtggcatctgcatagccatctgcgcgctaaccttctggatcggcgacatcatcgtgacatacactctccccgtgatgctcaacgccatcggtcttgctggagtcttcggaatatatgctgtcgtttgcatactggcctttgtattcgtctacatgaaggtccctgagacaaagggcatgcccctggaggtcatcaccgagttcttctctgtcggcgcaaagcagggcaaggaagccacggactagttgctctgatccggtgatccgcgtcgctggtggtaattttgtggtgtcataactactgctgcactgtttaacctgcgatgctttggtgaagaaacttcaaagagagcagatacggaagactttacatcgtgaggctgaatcgtgccgtcgtaggccggcttttggaagtaggatatgtacttagatcatctgctctttttgctttggaacttcctatttgtgctattcagaatttattgcctatgtaactagtgctgttatcacaatttatgtcgtttatg

SEQ ID NO: 2750 - DNA, 2898 bp, Triticum aestivum
actcacgcacactcctcatctcgcccggggcgaaatcgacgccacagcgggagggaaaagcttccggggttggcagggattccgcctcttatacgcctgcccgcctcgccagattcctcacagcttccctgccccgagcggagatcctgaattccggaggccgtcgtcgggggtaagattcggcggccatgtcgggcgccgtgctggtcgccatagcggcgtccatcgggaacctgctgcaggggtgggataatgcgaccattgcaggtgccgtcctgtacataaagaaggagttcagcttggagacccagcccttgatcgagggcctcatcgtggccatgtcgctcatcggggcgacggttatcaccacgttctcgggggcggtggctgatgctgttggcaggcggcccctgctgatcgcctcgtctgtcctctactttgtcagtggcctggtgatgctctgggcgcccaacgtctatgtgttgctcttggccaggctcatcgacgggttcggtatcggtttggctgtcacccttgtccctctttacatttcggagaccgccccgactgacattagagggctgctgaacacgctgccgcagttcagtggttcaggagggatgttcctttcttactgcatggtgttcaccatgtcgctcatgccacagcctgactggagaatcatgcttggggttttgtcgatcccgtcgcttatgtactttgcattgactgtcttctatttgcccgagtcgccgagatggcttgtgagcaaaggaagaatggctgaggccaagcgagtgttgcaaggactgcggggaagggaagatgtctcaggagaaatggcccttcttgttgaaggattgggtgttgggaaagacacacattttgaggaatacataattgggcctgatgatgagcttgctgatgacgggctggctccagatgaagagaagttgaagctgtacggagctgaagaaggggtatcttggatcgcccgtcctgttaggggcggcggccaaagtgcacttggaagcgccttgggtctcatgtctcgtcatgggagtatggttagtcagggtaaatctctcgtggacccacttgtcactctcttcggaagtgtccatgagaagatgcctgaggtaatggggagcatgcgcagcacattgtttcctaactttggcagcatgtttagcgtggcagaacagcagcaggctaaagctgactgggatgctgagagtcatagggatgatgaagattatgcatcggatcatggtgctgatgacattgaggatagcctcaatagcccgcttatttctcgtcaagcgacaagcgtggagggtaaggagattgctgcacctcatggaagcataatgggtggtgtgggaagaagtagcagcatgcagggaggggaggcagtaagcagcatgggcattggtggggggtggcagttagcttggaagtggactgagagagaaggtgcagatgggcaaaaggaaggcggcttccagcgtatttacttgcatgaggagggcgtgtcaggtgatcggaggggctctatattgtctatgccaggaggtgatattcctcctggtggtgagtatatccaggcagccgctctagtgagccaacctgctctttattcgaaggacctgatagagcagcagcttgctggtcctgccatggtacatccatctgaggcagttgccaagggtacaaaatgggcagaactatttgaacctggagtgaagcatgcactgttcgttggcataggattacagatcctgcagcagtttgcgggtatcaatggagtcctctactacacacctcagatacttgagcaagcaggtgtcggggttcttctatcaaacattggactaagctcttcctctgcatctattcttattagtgccttgacaaccttgctgatgcttcccagcattggcatcgccatgagactcatggatatgtcaggaagaaggtttcttctcctttcgacaatccctgtcttgatagtagcactagctgtcttggttttggtgaatgttctggatgttggaaccatggtgcacgccgcgctctcaacgatcagcgtcatcgtctatttctgcttcttcgtcatggggtttgggcctatcccaaatattctctgcgcggagattttccccacctccgtccgtggcatctgcatagccatctgcgcgctaaccttctggatcggcgacatcatcgtgacctacactctccccgtgatgctcaacgccatcggtctcgctggagtcttcggcatatatgccgtcgtttgcatactggcctttgtattcgtctacatgaaggtccctgagacaaagggcatgcccctggaggtcatcaccgagttcttctctgtcggggcaaagcagggcaaggaagccacggactagttgctctgatctggtgatccgcgtcgctggtggtaattttgtggtgtcataactactactacactggttaacctgcgatgctttggtgaagaaacttcaaagagagcagatacggaagactttacatcgtgaggctgaatcgtgtcgtcgtaggccggcttttggaagtaggatatgtacttagatcatctgttcttttcgctttggaactttctatttgtgttattcagaatttcttgcccatgtaactagtgctgttatcacaatttatgtcgtttatgtttttgtcttgctcggtcgattcagtttatcctttttgttgccactagttctcagttgccagtcacttcagcagtttagttgtgctattagtactatttttgaggataagtagtgtttctgggtgtatgggaaatatgcacacaaccattttatgttactccttggtttcataatgtagtggatatagatttttgta

SEQ ID NO: 2751 - DNA, 2697 bp, Triticum aestivum
ctcctcatctcgcccggggcgaaatcgacgccacagcgggagggaaaaagcttccggggttggcagggattccgcctcttatacgcctgcccgcctcgccagattcctcacagcttccctgccccgagcggagatcctgaactccggaggccgtcgtcgggggtaagattcggcggccatgtcgggcgccgtgctggtcgccatagcggcgtccatcgggaacctgctgcaggggtgggataatgcgaccattgcaggtgccgtcctgtacataaagaaggagttcagcttggagacccagcccttgatcgagggcctcatcgtggccatgtcgctcatcggggcgacggttatcaccacgttctccggggcggtggctgatgctgttggtaggcggcccctgctgatcgcctcgtctgtcctctactttgtcagtggcctggtgatgctctgggcgcccaacgtctatgtgttgctcttggccaggctcatcgacgggttcggtatcggtttggctgtcacccttgtccctctttacatttcggagaccgccccgactgacattagagggctgctgaacacgctgccgcagttcagtgggtcaggagggatgttcctttcttactgcatggtgttcaccatgtcgctcatgccgcagcctgactggagaatcatgcttggggttttgtcgatcccgtcgcttatgtactttgcattgactgtcttctatttgcccgagtcgccgagatggcttgtgagcaaaggaagaatggccgaggccaagcgagtgttgcaaggactgcggggaagggaagatgtctcaggagaaatggcccttcttgttgaaggattgggtgttgggaaagacacacattttgaggaatacataattgggcctgatgatgagcttgctgatgacggtctggctccagatgaagagaagttgaagctgtacggagctgaagaaggggtatcttggatcgcccgtcctgttaggggcggcggccaaagtgcacttggaagcgccttgggtctcatgtctcgtcatgggagtatggttagtcagggtaaatctctcgtggacccacttgtcactctcttcggaagtgtccatgagaagatgcctgaggtaatggggagcatgcgcagcacattgtttcctaactttggcagcatgtttagcgtggcggaacagcagcaggctaaagctgactgggatgctgagagtcatagggatgatgaagattatgcatcggatcacggtgctgatgacattgaggatagcctcaatagcccgcttatttctcgtcaagcgacaagcgtggagggtaaggagattgctgcacctcatggaagcataatgggtggtgtgggaagaagcagcagcatgcagggaggggaggcagtaagcagcatgggcattggtggggggtggcagttagcttggaagtggactgagagagaaggtgcagatgggcaaaaggaaggtggcttccagcgtatttacttgcatgaggagggcgtgtctggtgatcggaggggctctatattgtctatgccaggaggtgatattcctcctggtggtgagtatatccaggcagccgctctagtgagccaacctgccctttattcgaaggacctgatagagcagcagcttgctggtcctgccatggtacatccatctgaggcagttgccaagggtacaaagtgggcagaactatttgaacctggagtgaagcatgcactgttcgttggcataggattacagatcctgcagcagtttgcgggtatcaatggagtcctctactacacacctcagatacttgagcaagcaggtgtcggggttcttctatcaaacattggactaagctcttcctcagcatctattcttattagtgccttgacaaccttgctgatgcttcccagcattggcatcgccatgagactcatggatatgtcaggaagaaggtttcttctcctttcaacaatccctgtcttgatagtagcgctagctgtcttggttttagtgaatgttctggatgtcggaaccatggtgcacgctgcgctctcaacgatcagcgtcatcgtctatttctgcttcttcgtcatggggtttgggcctatcccaaatattctctgcgcggagattttccccacctctgtccgtggcatctgcatagccatctgcgcgctaaccttctggatcggcgacatcatcgtgacatacactctccccgtgatgctcaatgccattggtctcgctggagtcttcggcatatatgccatcgtttgtgtactagcctttgtattcgtctacatgaaggtccctgagacaaagggcatgcccctggaggtcatcaccgagttcttctctgtcggggcaaagcagggcaaggaagccacggactagttgctctgatccggtgatccgcgtcgctggtggtaattttgtggtgtcataactactactacactggttaacctgcgatgctttggtgaagaaacttcaaagagagcagatacggaagactttacatcgtgaggctgaattgtgtcgtcgtaggccggcttttggaagtaggatatgtacttagatcatctgctcttttcgctttggaactttctatttgtgttattcagaatttcttgcccatgtaactagtgctgttatcacaatttatgtcgattatgtgtttg

SEQ ID NO: 2752 - DNA, 2875 bp, Triticum aestivum
gggttggcagggattccgcctcttatacgcctgcccgcctcgccagattcctcacagcttccctgcgaggtcccgtgcccgagcggagatcctcaactccggaggccgtcgtcgggggtaagattcggcggccatgtcgggcgccgtgctggtcgccatagcggcgtccatcgggaacctgctgcaggggtgggataatgcgaccattgcaggtgccgtcctgtacataaagaaggagttcagcttggagacccagcccttgatcgagggcctcatcgtggccatgtcgctcatcggggcgacggttatcaccacgttctcgggggcggtggctgatgctgttggcaggcggcccctgctgatcgcctcgtctgtcctctactttgtcagtggcctggtgatgctctgggcgcccaacgtctatgtgttgctcttggccaggctcatcgacgggttcggtatcggtttggctgtcacccttgtccctctttacatttcggagaccgccccgactgacattagagggctgctgaacacgctgccgcagttcagtggttcaggagggatgttcctttcttactgcatggtgttcaccatgtcgctcatgccacagcctgactggagaatcatgcttggggttttgtcgatcccgtcgcttatgtactttgcattgactgtcttctatttgcccgagtcgccgagatggcttgtgagcaaaggaagaatggccgaggccaagcgagtgttgcaaggactgcggggaagggaagatgtctcaggagaaatggcccttcttgttgaaggattgggtgttgggaaagacacacattttgaggaatacataattgggcctgatgatgagcttgctgatgacgggctggctccagatgaagagaagttgaagctgtacggagctgaagaaggggtatcttggatcgcccgtcctgttaggggcggtggccaaagtgcacttggaagcgccttgggtctcatgtctcgtcatgggagtatggttagtcagggtaaatctctcgtggacccacttgtcactctcttcggaagtgtccatgagaagatgcctgaggtaatggggagcatgcgcagcacattgtttcctaactttggcagcatgtttagcgtggcggaacagcagcaggctaaagctgactgggatgctgagagtcatagggatgatgaagattatgcatcggatcatggtgctgatgacattgaggatagcctcaatagcccgcttatttctcgtcaagcgacaagcgtggagggtaaggagattgctgcacctcatggaagcataatgggtggtgtgggaagaagtagcagcatgcagggaggggaggcagtaagcagcatgggcattggtggggggtggcagttagcttggaagtggactgagagagaaggtgcagatgggcaaaaggaaggcggcttccagcgtatttacttgcatgaggagggcgtgtcaggtgatcggaggggctctatattgtctatgccaggaggtgatattcctcctggtggtgagtatatccaggcagccgctctagtgagccaacctgctctttattcgaaggacctgatagagcagcagcttgctggtcctgccatggtacatccatctgaggcagttgccaagggtacaaagtgggcagaactatttgaacctggagtgaagcatgcactgttcgttggcataggattacagatcctgcagcagtttgcgggtatcaatggagtcctctactacacacctcagatacttgagcaagcaggtgtcggggttcttctatcaaacattggactaagctcttcctctgcatctattcttattagtgccttgacaaccttgctgatgcttcccagcattggcatcgccatgagactcatggatatgtcaggaagaaggtttcttctcctttcgacaatccctgtcttgatagtagcactagctgtcttggttttggtgaatgttctggatgttggaaccatggtgcacgccgcgctctcaacgatcagcgtcatcgtctatttctgcttcttcgtcatggggtttgggcctatcccaaatattctctgcgcggagattttccccacctctgtccgtggcatctgcatagccatctgcgcgctaaccttctggatcggcgacatcatcgtgacatacactctccccgtgatgctcaacgccatcggtctcgctggagtcttcggcatatatgccatcgtttgtgtactagcctttgtattcgtctacatgaaggtccctgagacaaagggcatgcccctggaggtcatcaccgagttcttctctgtcggggcaaagcagggcaaggaagccacggactagttgctctgatccggtgatccgcgtcgctggtggtaattttgtggtgtcataactactactacactggttaacctgcgatgctttggtgaagaaacttcaaagagagcagatacggaagactttacatcgtgaggctgaatcgtgtcgtcgtaggccggcttttggaagtaggatatgtacttagatcatctgttcttttcgctttggaactttctatttgtgttattcagaatttcttgcccatgtaactagtgctgttatcacaatttatgttgtttatgttttttccttgctcggtcggttcagtttttcctctttgttgccactagttctcagttgccagtcacttcagcagtttagttgtgctattagtactatttttgaggataagtagtgtttctgggtgtgtgggaaatatgcacacaaccattttatgttactccttggtttcataatgtagtggatatagatttttgtaaaagtcataccttataaactttggctaagttt

SEQ ID NO: 2753 - DNA, 3076 bp, Brachypodium distachyon
gtccacagagtctcccccacccccacgcactcgcacacacccctcatctcgctccccccgtttcctcgtggtcctccgggcgtagtcgacaccgcagcgctcgcgccgcgggagggagagcgtcggaagttggtacggatacccctcctcttatatacccaccctgctcgccagattcctccccgcgaggtcctgccccagatcggagatcctgaatcttggtggccgaggtcagggcggtagattcggtggccatgtcgggcgccgtgcttgtcgccatagcggcgtccatcggcaacctgctgcagggctgggataatgcaaccattgcaggtgctgtcctgtacataaagaaggaattcagcctggagagccagcccctgatcgagggcctcatcgtggctatgtcgctcatcggggcgacagtaatcacgacattctccggggcggtggctgatgctgttggtaggcgacccctgctgatcgcttcggctgtcctctactttgtcagtgggctggtgatgctctgggcgccgagcgtgtatgtgttactcttggcgaggctcatcgatgggtttggtatcggtttggctgtcacccttgtccctttgtacatttcggagaccgcgccaacggacatcagaggactgctgaacacgctgccgcagtttagtgggtcaggagggatgttcctttcttattgcatggtgtttacgatgtccctcatgccacagcctgattggaggatcatgcttggggttttgtcgatcccgtcacttatatactttgcactgaccgtcttctatttgcctgaatcgccaagatggcttgtgagcaaaggaagaatggctgaggccaaacgagtgttgcaaagactgcggggaagggaagacgtctcaggggaaatggcccttctcgtcgaaggattgggtgttggaaaagatacatatattgaggaatacataattggcccagacgatgagcttgctgacgaagggctggctccagatccagagaagatcaaactgtatggccctgaagaaggactatcttgggtcgcccgtcctgttaggggcggcagtgcacttggaagtgcgttgggtctcatgtctcgccatgggagtatggttagccagggtaaatctcttgtggaccctcttgtgactctttttggaagtgtccatgagaagatgcctgaggtaatgggtagcatgcggagcacgctgtttcctaactttggcagcatgtttagcgtggcggaacagcagcaggctaaagctgactgggaagccgagagtcatagagatgatgaagactatgcatcggaccatggtggagatgacattgaggatagcctccaaagcccgcttatttctcgtcaagccacaagcgtggaaggtaaggagattgctgcacctcatggcagtataatgggtgctgtgggaagaagtagtagtatgcagggaggggacgcagtaagcagcatggggattggtgggggatggcagttggcttggaagtggactgagagagaaggcgcagatgggcaaaaagaaggtggctttcaacgtatctacttgcatgaagagggcgtgccaagtgatcgtaggggctctatattgtcaatgccaggaggtgatgttcctcctggtggtgagttcattcaggcagccgctctagtgagccaacctgctctttactcaaaggacctgatggagcaacagctggctggtcctgccatggtacatccatctgaggcagctgctaagggtccaaagtgggcagacctatttgaacctggtgtgaagcatgcactctttgttggcataggattacagatcctgcagcagtttgccggtatcaatggagttctctactacacccctcagattctcgagcaggcaggtgtcggtattcttctatcaaaccttggattaagctcttcgtctgcatctattcttatcagtgccttgacaaccttgctgatgcttccaagtattggtattgccatgaggctcatggatatgtcaggaagaaggtttcttctcctcacgacaatccctatcttgattgtagcattggctatcttggttctggtaaacattctggatgtcggaaccatggtgcatgccgcactatcaactatcagtgtcatagtttatttctgcttcttcgtcatggggtttgggcctatcccgaacatcctttgtgcagaaattttccccacctctgtccgtggcatctgcatagccatctgcgccctaactttctggattggtgacattatcgtaacgtacactcttcctgtgatgcttaacgccatcggacttgctggagttttcggaatatatgctgtcgtttgcatactagcctttgtatttgtctacatgaaggttccagagacaaagggcatgcccctggaggtcattaccgagttcttctctgtcggggcaaagcagggtaaggaagccagggattagttgctctgatctcgtgatccgcatcactgatgataattttgtgctttcgaacctacaccatggttaacctgcgatgctctgtcaaagaaactcttgagagagcatggacgttgggcctaaagagatgatatgaaaactgtggctgaatcctgtcgtagaccggctttcggaactagaatatgtatttagatcatctgttctttccgctttgtgaatttctgttcgtgttgttggctgttgggaattttcttgcctctgtaactagtgttttgtcacaatttatgttactgtttttttggtccttctcagtctaatctctcgctcttggctgtgagctgtgaactagccggttcttcagcaccgtggttatgtttctggctacatctgacagtggattcctttcttctgaaacccagaaaatcaggcctgttttttttctggtaaagaagtatgcatatgcctatttggagtgctcttttatttattagtcggcgagaaatactggactattttataaaaaaaacagtttcagaaccaatgaggtgttcataattcttttgcgttatggtatcactgggcacagaagacagagctga

SEQ ID NO: 2754 - DNA, 2812 bp, Avena sativa
ctcctcatctccctccgcccccgggcgaaatcgacaccacagcgctcgcgccgtgggagggaaaagcttccgaaattggcagcgattcccctctcttatacaccccaccccccgcccgcctcgccagctcgccagattccgtgcccgatcggagatccaatctcggtagcggaggtcggtggtaagattcgccggccatgtcgggcgccgtgctcgtcgccatagcggcctccatcggcaacctgctgcaggggtgggataatgcgaccatagcaggtgctgtcctgtacataaagaaggaattcaacttggagagccagcctctcatcgagggcctcatcgtcgccatgtcgctcattggggcgacgtttatcacaactttctctggggcagtggctgattctgttggtaggcggcctctgctgatcgcgtcggctgtcctatacttcatcagtggcctggtgatggtctgggcgccgaacgtgtatgtgttgctcttggcgaggctcatcgacgggttcggtatcggtttggctgtcacccttgtccctttgtacatttctgagaccgccccaactgacatcagaggactgctgaacacactgccgcagttcagtgggtcaggagggatgttcctatcttattgcatggtgtttgcgatgtccctcatgccacagcctgattggaggatcatgcttggggttttgtcgatcccgtcacttatatactttgcactgactgtcttctacttgcctgaatcgccaagatggcttgtgagcaaaggaagaatggccgaggccaagcgagtgttgcaaagactgcggggaagggaagatgtctcaggagaaatggcccttcttgttgaaggattgggtgttgggaaagatacgcattttgaggaatacataattggccctgatgacgagcttgctgatgaagggctggctccagatccagagaagatcaaactctacggaccggaagaaggattatcttgggtcgcccgtcctgttaggggcggccaaagtgcacttggaagcgccttgggtctcatgtctcgtcatgggagtatggttagtcagggtaaatctatcgtggatcctcttgtcactctttttggaagtgtccatgagaagatgcctgaggtaatggggagcatgcggagcacattgttccctaactttggtagcatgtttagtgtggcggaacagcagcaggctaaagctgactgggataacgagagtcacagggatgatgaagactatgcctcagatcatggtgctgatgacatcgaggacaacctcaacagtccgcttatttctcgtcaagctacaagcgtggagggaaaagagattgctgtaccccatggcagcataatgggtgctgtgggaagaagtagtagtatgcagggaggggagtctgtcagcagcatgggcattggtggaggatggcagttggcttggaagtggactgagagagaaggtgcagatgggcaaaaagaaggcggtttccaacgcatttacttgcatgaagagggcgtgcaaggtgaccgcaggggttctatattgtctatgccaggtggtgatgttcctcctggtagtgagtatatccaggcagcagctctagtgagccaacctgctctttactcgaaggatctggtagagcagcagcttgctggtcctgccatggtacatccctctgaggcagctaccaagggtccaaagtgggcagaactatttgaacccggagtgaagcatgcactttttgttggcataggattacagatcctgcaacagtttgctggtatcaacggagttctctactacacccctcagatacttgagcaagcaggtgtcgggattcttctgtcaaaccttggactaagctctttatctgcatctatccttattagtgccttgacaaccttgctgatgcttcctagcattggtattgccatgaggctcatggatatgtcaggaagaaggtttcttctcctttcgacaatccctgtcttgatagtagcactggctatcttggttttggtcaacattctggatgtcggaaccatggtgcatgccgcactctcaacgatcagcgttatagtctatttctgcttcttcgtcatggggtttgggcctatcccgaacattctctgcgcagagattttccccacctccgtccgcggcatctgcatagccatctgcgccctaaccttctggatcggtgacatcatcgtgacgtacactcttcccgtgatgcttaacgccatcggactcgctggtgttttcggaatatatgctctcgtttgcatactatctctcgtgtttgtctacatgaaggtgcctgagaccaagggcatgcccctggaggtcatcaccgagttcttctctgtcggggcaaagcagggcaaggaagcgacagactagtcgctccgatctggtgatccgcgtcgctggtggtgattttgtggttccgaaaacttacgctgccacaagcctgcggtgctctggtaaagaaacttcaaggagagcatagaaggcctaaagagatgatgtgaacatcgtgaggctgtaatcctggtgtagacgacttttggaactaggctacctatttagatcacccgttgtttttttgctttgtgatgactttgtatttgtgttatttgggattttcttgcctctgtaactactagtgctcttcatctcaacttatgttactgttttctttttgtcctgcgcaatcttctcgtagctgtgttgttactgttttctttatgttgagaaaccccactgaattgtcaactaaccttaac

SEQ ID NO: 2755 - DNA, 3227 bp, Oryza sativa
atggtagtccaaagagtccacagcccacactcactctcctcaccccccccccctcggccctggactccctcctccaaatctcccctaaaagcttcccaatttggcgagaattccccatatatttgccccatctcggcgtcccaacgagcccttccagattcccagccgcctctcttcttgttaggggatccgaaatctcggtggacgagagacttggtggtaagattcgccggccatggcgggcgccgtgctggtcgccatcgcggcctccatcggcaacttgctgcagggctgggataatgcaaccattgcaggtgcggtactgtacatcaagaaggaattcaacttgcagagcgagccccttatcgaaggcctgatcgtggccatgtcgctcattggggcgacgatcatcacgacgttctctggagcagtggctgattcttttggtaggcggcccatgctgatcgcgtcggctgtcctctactttgttagtgggctagtgatgctttgggcgccaaatgtgtatgtgttgctcttggcgaggctcattgacgggttcgggatcggtttggctgtcacgcttgtaccattgtacatctctgagactgccccgacggacatcagaggactgctaaacacgctgccgcagttcagtgggtctggagggatgttcctttcatactgcatggtatttggcatgtccctcatgccacagccagattggaggatcatgcttggcgttctatcaataccatcacttatatactttgcattgaccatcttttacttacctgaatcgccgaggtggctcgtgagcaaaggaagaatggctgaggccaagcgtgtgttgcaaggcctgcgtggaagagaagatgtttcaggagaaatggcccttctcgttgaaggtctgggggttgggaaagacacaaaaattgaggaatacataattggacctgatgatgagcttgctgatgaagggctggctccagatccagagaagatcaaactgtatggtcctgaagaaggcttatcgtgggttgcccgtcctgttcacgggcaaagtgcacttggaagtgcattaggtctcatctctcgtcatggtagtatggtcagtcagggtaagccccttgtggatcctgttgtcaccctttttggaagtgtccatgagaagatgcctgagataatgggaagcatgcggagcacattgtttcctaactttggcagcatgtttagtgtggcggaacagcagcaagctaaaggtgattgggatgctgagagtcaacgggagggtgaagattatggatcagaccatggtggggatgacattgaagatagcctccaaagcccacttatttctcgtcaagcgacaagcgtggaaggaaaggagatcgctgcacctcatggcagtataatgggtgctgtgggaagaagtagtagtctcatgcagggcggggaggcagtaagcagcatgggcattggtgggggatggcagttggcttggaaatggactgagagagaaggtgcagatggcgaaaaagaaggtggcttccaacgtatctacttgcatgaagagggtgtgacaggtgatcgcaggggctctatactgtcattgcctggaggtgatgttcctcctggtggtgagttcgtccaggcagctgctcttgtcagccaacctgctctttactctaaggaattgatggagcaacgccttgctggccctgctatggtgcatccatctcaggcagttgctaaaggtccaaaatgggcagacttattcgaacctggagtgaagcatgctctgtttgttggcatagggatacaaatcctgcaacagtttgctggcattaatggagttctgtactacactccacaaattcttgagcaagctggtgttggtgttcttcttgcaaacattggacttagctcctcatctgcatctattcttattagcggactgacaaccttgctgatgcttcccagcattggtattgctatgaggctcatggatatgtctggaagaaggtttcttctccttgcaacaatccctatcctgatagtagcactagctatcttgattctggtcaatattctggatgtggggaccatggttcatgcctcactgtccacagtcagtgtcatactctacttctgcttctttgtcatggggttcgggcctattccaaacattctctgtgcagagattttcccgaccaccgttcgtggcatctgcatagccatctgtgccctaacattctggatcggtgatatcattgtgacatacaccctccccgtgatgctcaacgccattggactcgctggagtgtttggaatctacgcagtggtctgcatactggctttcctgtttgtcttcatgaaggtgccggagacaaagggcatgcctcttgaagtcatcaccgagttcttctctgtcggagcaaagcaggccaaggaggactagttgctcggatcaagtgatcaatcagattgctggtggtaattttgttgcttccaaatcgcgctgcgggttaaacctgtgatggatgctttgttaaagaatcttggaagagatcaaaatgcagtgagcctaaagagatgatttggctgtacatcatgaggctgaatcctgtcgtagactggattttggagcttaggatatgtagatcatctgttccttttggtttggtcattttccatttgtgtttctttggaattcttctccctgtaactagtggtctatcacagttgtgttactggttttgccttactcttgagtttgttttcttctctcggttgtgagttctgaatattagcatagccgagtactagttctgaattggtttcctctctgctgaacatctttcattgatgcttggatttcatcaagtactaaaaacccaagctcacagggtaaaaagaaatggtgaaaggtgaaaggggagaaaaggagaagcaaagcaaaggtaatgctttgagttccatatacccaggaaaagaattgtgcccactcttgtaaaggagttcaggagtaggagaagtactttgtgaataaaatttcaattttgttagctgtcagagtggaacccaaaagctactgtcccagcagaaaagcttcgagttctagtggcagcttataaattaaagcgatgcatgatggtgggaagctgtgggttcagcatgcagcaatgtgcagtttggggacaagctggagcaacagaaactgtgttgga

SEQ ID NO: 2756 - DNA, 3870 bp, Sorghum bicolor
ctcccctgcctgtgcccacctgtcaataggcattctgcgcgctgattcacacgccaagtttagctcaacacacctcccgacattcgtaccccacatataccggccccacattcagactcactacgggttgcagactgggtgccgttggagagaagaaaaaccaacgctgcctctcgctctcctctctccacgcacacaagctggctcccccacccagcactcctcgctctcatctcaccccaaccccctccaccaccccggcctactgcctccgcagactgcaggcggcagctctgctctgccctgccctgccctgccccccgcgctctccaatcccaacgcgcggcgcaaagaaaagctcggggctttgccaaaattcaccgcagcacttactcctgtctggccacctcaccacccgccgccgccgctgtttaagaaggccccgcgcccgatcgaggatcacgaatcttggccgccgccgccggagtgaggcgtagatttcggcggccatggggggcgccgtgttggtcgccatcgcggcctctatcggcaacttgctgcagggctgggacaatgcgacaattgctggagcggtcttgtacataaagaaggaattcaacttgcagagcgagcccctaattgagggcctcatcgtggccatgtccctcattggggcaacagtcatcacgacgttctctggggcagtggccgactctgttggtaggaggcccatgctgatcgcctcggctatcctctactttgttagtgggctggtgatgctctgggcgccaaatgtgtatgtcttgctccttgcaaggcttatcgatgggtttggtattgggttggccgtcacacttgttcctttgtacatttctgagactgcgccgacggatattcgagggctgttgaacacactaccgcagttcagtggttcaggagggatgttcctttcctactgtatggtgtttggaatgtccctcatgcccacacctgattggaggctcatgcttggagttctgtcgatcccatcacttatttactttggattgactatcttctacttgcctgaatcaccaaggtggctcgtgagtaaaggaaggatggctgaggcaaagcgagtgttgcaaaggctgcggggaagggaagatgtctcaggggaaatggctcttctagttgaaggtttgggggttgggaaagatacacgtattgaagaatacataattggccctgatgacgagcttgctgatgaagggctggctcccgatccagagaagatcaaattatatggacctgaagaaggtctatcttgggttgcccgacctgttcggggacaaagtgctcttggaagcgcattaggtctcatctctcgtcatgggagtatggctagtcagggtaagcccctcgtggatcctgtggtcactcttttcggaagtgttcatgaaaagatgcctgagataatggggagcatgaggagcacattgtttcccaactttggcagcatgtttagtgttgccgaacagcagcaggtgaaggctgactgggatgccgagagtcaaagggagggtgacgattatgcttcagatcatggtggcgatgacattgaggataacctccaaagcccacttatttctcgtcaagcaacaagtgtggaaggaaaggagattgctgcacctcatggtagcataatgggtgctgtgggaagaagcagtagcctgcagggaggggaggcagtaagcagcatgggcattggtggaggatggcagttggcgtggaaatggactgagagagagggcgaagatggggaaaaggaaggtggcttccagcgtatttatttgcatgaggagggcgtacaaggcaggggttctatattgtcattaccaggaggggatgttcctcctggtggtgagttcgtccaggctgcagctcttgtgagtcaaccagctctttactcaaaggaactgctggagcaacgtgctgctggtcctgcgatgatgcatccatctgaggcagttgctaaaggtccaagatgggctgacctgtttgagcctggagtgaagcatgcactgtttgttggcataggaatacagatcctgcaacagtttgctggcatcaatggtgttctctactacactcctcaaattcttgagcaagcaggtgttggtgttcttctgtcgaacattggccttagcgcatcttctgcatcaattcttattagtgccttgacaaccttattgatgcttccaagcattggtattgcaatgaggctcatggatatgtctggaaggaggtttcttctccttgcgacaatccctatcttgatagttgccctagctatcttggtcgtggtcaatattgtggatgtgggaaccatggtgcatgctgcactctccacgattagtgtcatagtctatttctgcttctttgtcatggggtttgggcctattcccaacattctctgtgcagagatctttcccaccaccgtccgcggcatctgcatagccatctgcgccttaaccttctggattggtgacattatcgtgacatacacacttcctgtgatgctgaatgccatcgggctcgctggtgtctttgggatatacgccgtcgtttgcatcctggctcttgtatttgtattcatcaaggtgccagagacaaagggcatgcctctcgaggtcatcactgagttcttctccgttggagcaaagcaagccaaggaagccagggaagattaatcacccagacccagatatcagcatcgcttgcggacttgcggtaattttgtggtttgcatacttcgctgtggttgaatcctgtgatgtcttgtgaaagaaacttgaccgacgaagtggggaccgggggaccgcagggcacctaaagagatgatttggctgtacattgtgaggcttgattctgtcatagactggccttcagaactaggaaggatgtgtagatcatcatctgttatttttttttgcttggagactttgtgcttgtgttcgttggttttttttttgggggcctatgtaactagtggtgtatgacagttatgctattggtttctttgtgttgtcaacttcatctctgtcagtactgtatttgcgcagcgagtgcgtggaaatcctgttgttggcagaatgctagtgcagttgtgttttcagtttattggtagctggtaaagtgaaagggccttcgacttccggttgttgaggaaagatcactggtggtttgttctgttcctgtggtcatctccattagtggcagagaaagtagaattgcagctactagcggagtgcatgagtgcgtctcccggagacagaatgaagaattatagccgtctgatctgatacgtaggcctccaatttgagactggcaagcataatccctgttggctgtttgagtgtagccagtgatcagttctagggcttttcatggtttgctttggcgacccatatatattatgcacagagaaaaaggccatgtgttcgcttctagtgggtccctttggtttgaaggatcgcgatggaaaagctgaggtcccaagttgccggcaaagctctttgtgtggagaatatctggaggaagatgtcggatgagagatggtcctctcatttgcagcttttcagatatatcagggtcacgctacgtactggagtggcatcggatcatgccactgcaggttttgtgtttccgtttttgttggctactagctgcaaagtcagtgtagacacctgatggcggatcttggacaagatttcaggggtgccaaatctaatttgattgatgaacgaaaagaggagacatactagtattttttattgtcaatttagtggtgaaactaaatactttacttaactaatactcctacattat

SEQ ID NO: 2757 - DNA, 2876 bp, Panicum virgatum
ccccggctccgcctgcctccgctcggcctcgctctccaatcccagcgcacagcgtggcaaggctcgccaccgtactcccctccaccggccacctcaccgcctctccagattccacgctatcgcccctccgccgcctcttaagaaggcggccccgtgcccgatcggggggatcccaaatctcggccgccagagcggggggcgtagatttcggcggccatggggggcgccgtgctggtggccatcgcggcctccatcggtaacttgctgcagggctgggataatgcgaccatagcaggggcggtcttgtacataaagaaggaattcaatttacagagcgagcccctgattgagggtctcatcgtggctatgtccctctttggggcaactgtcgtcaccacattctccggggccgcggctgactccatcggtaggcggcccatgctgatcgcctctgctgtcctctactttgttagtgggttggtgatgctctgggcaccaagcgtgtatgttttgctcctggcaaggctcatcgacggactcggtatcggtttggctgtcacgcttgttcctttgtacatctccgagactgcgccaacagacattcgagggttgttgaacacgctgccgcagttcagtgggtctggagggatgttcctttcttattgcatggtgtttgggatgtctctcttaccaaaacctgattggaggatcatgcttggtgttctatcgatcccctcgcttatataccttgcattgactgtcttctacttgcccgaatcaccgaggtggctcgtgagcaaaggaaggatggccgaggctaagagagtcttgcaaaggctgcggggaagggaagatgtctcaggagaaatggctcttctagtcgaaggcttgggtgttgggaaagatacacgtattgaagaatacataattggccctgatgacgaacttgctgatgaagggctggctccagatccagagaagatcaaattatatggacctgaaggcctatcttgggttgcccgacctgttcgtggccaaagtgcacttggaagtgcgtatggtctcatctctcagcatgggagtatggttagtcaaggcaagccccttgtggatcctgttgtcactctttttggtagtgttcatgagaagatgcccgagataatggggagcatgcgtagcacattgtttcccaactttggcagcatgtttagtgttgcggaacagcagcaggctaaagctgactgggatgccgagagtcatagggaaggcgatgagtatgcttcggatcatggtggagatgacatcgaggataccctccaaagtccacttatttctcgtcaagcaacaagtgtggaaggaaaggagattgctgcacctcatggtagcataatgggtgctgtgggaagaagtagcagtcttatgcagggaggggaggcagtaagcagcatgggcattggtggaggatggcaattggcatggaaatggactgagagagaaggtgcagatgggcaaaaggaaggtggcttccaacgtatttacttgcatgaggagggcgtacaaggcaacaggggttctatattgtcattaccagggggggatgtccctcctggtggcgagtttgtccaggccgccgctcttgtgagtcaaccagctctttactccaaggaactgatggagcagcgtgctgctggtcctgcaatggtgcatccatctgaggcagtagctaaaggtccaaaatgggccgacctattagagcctggagtgaagcatgcactgtttgttggcattgggatacagatcctgcaacagtttgctggcatcaatggtgttctctactatactcctcaaattcttgaacaagcaggtgttggtgttcttctttccaacattggacttagctcatcttcggcatctattcttatcagcgccttgacaaccttactgatgcttccaagcattggtattgcaatgaggctcatggatatgtctggaaggaggtttcttctccttgctacaatccctatcctgatagttgcactacttgtcttggtcgtggtcaacattgtggatatgggaacaatggttcatgccgcactctccacaatcagtgtcatactctatttctgcttctttgtcatggggtttggtcctattcccaatattctttgtgcagaaatctttcccaccactgttcgtggcatctgcatagccatctgcgctttaacattttggatcggtgacatcatcgtgacatacacactccctgtgatgctgaacgccattgggcttgccggtgttttcgggatatacgctgtagtttgcatcctggctcttgtatttgtgtacatgaaggtgccggagacaaaaggcatgcccctcgaggtcattaccgagttcttctctgttggagcaaagcaagccagggaggattaatcgccaacccggcgatcagtgtcgctggcagtaattttgtggtttccaaacttcactgtggttagttaatcctctgatgccgtgtgaaagatacttgaccgaccaagaaggggaacaggggactgtgtgcctaaagatcgtttgggtgtacatcgtgaggcttgatgctgtcattggccagcttttggaactagggtgtgtagatagatcatcatctgtttttttttcatgaatcatgaaactgtttgtgttcgttgtaatctttttggcctatgtaactagtgtgtatgacagttattctactggtttcgttgtcttgtcagcttctcttcatcgcttgagtcctggacacacagcaatcatgtttatcgccaatgcagctgttttctcagctcattggcagctgctaaagcgaaaggaccttgtgttccggttgtccagga

SEQ ID NO: 2758 - DNA, 3030 bp, Setaria italica
ggtgaccaggacccccacccccacactccccactctcatctcaccccctccgcccccctctgcctgcctctgctggcggcagctctgctctgccccctctcgctctccaatcccaaggcacagcgtggcaaaacacaccaccgtactcccccaccggccacctcaccgcctctccagactccacgccatcgccctccgccgcctcttaaggaggaggccccgtgcccgatcggggatcccaaatctcggccgccggagcgggggcgtagattttggcggccatggggggcgccgtgctggtggccatcgcggcctccatcggcaacttgctgcagggctgggataatgcgaccattgcaggggctgtcttgtacataaagaaggaattcaatttgcagagcgagcccctaattgagggtcttatcgtggccatgtccctctttggggcaacagtcgtcacgacattctccggggcattggctgactccattggtaggcggcccatgctgattgcctcggctgtcctctactttgtcagtgggttgtttatgctctgggcaccaagcgtgtatgttctgctcctagcaaggctcattgatggactcggtattggtttggctgtcacattggttcctttgtacatctccgagactgcgccaacggatattcgagggttgttgaacacgctgccgcagttcagtgggtcaggagggatgttcctttcttattgcatggtgtttgggatgtctctcttaccaaaacctgattggaggatcatgcttggggttctgtcgatcccctcgcttatatactttgcattgactgtcttctacttgcctgaatcaccgaggtggcttgtgagcaaaggaaggatggccgaggctaagagagtcttgcaaaggctgcggggaagggaagatgtctcaggagaaatggctcttctagtcgaaggcttgggtgttgggaaagatacacgtattgaagaatacataattggccctgatgatgaacttgctgatgaagggctggctccagatccagagaagattaaattatatggacctgaagaaggcctatcttgggttgccagacctgttcggggtcaaagtgcccttggaagtgcgtatggtctcatctctcagcatgggagtatggttagtcaaggcaagccccttgtggatcctgttgtcactcttttcggtagcgtccacgagaagatgcctgagataatggggagcatgcggagcacattgtttcccaactttggcagcatgtttagcgttgcggagcagcagcaggctaaagctgactgggatgccgagagtcaaagggaaggcgatgagtatgcttcagatcatggtggagatgacattgaggataacctccaaagcccacttatttctcgtcaagcaacaagtgtggaaggaaaggagattgctgcacctcatggtagcataatgggtgctgtgggaagaagtagtggccttatgcagggaggggaggcagtaagcagcatgggcattggtggaggatggcaattggcatggaaatggactgagagagaaggtgcagatgggcaaatggaaggtggcttccaacgtatttacttgcatgaggagggcgtacaaggcaacaggggttctatattgtcattgccagggggggatgtcccacctggtggtgagttcgtccaggctgcagctcttgtgagtcaaccagctctttactccaaggaacttctggagcagcgtgctgctggtcctgcgatggtgcatccatctgaggcagtttctaaaggtccaaaatgggccgacctgtttgaacctggagtgaagcatgcactgtttgttggcataggaatacagatcctgcaacagtttgctggcatcaatggtgttctctactacactcctcaaattcttgagcaagcaggtgttagtgttcttctttccaacattggccttagttcatcttcagcctctattcttatcagtgccttgacaacgttactgatgcttccgagcattggtattgcaatgaggctcatggatatgtctggaaggaggtttcttctccttgcgacgatccctatcctgatagttgcactgcttgtcttggtcgtggtcaacattgtggatgtgggaaccatggtgcatgctgcactctccacgatcagtgtcatagtctatttctgcttcttcgtcatggggtttgggcctgttcccaacattctttgtgcagagatcttccccaccactgttcgcggcctctgcatagccatctgcgccttaaccttctggatcggtgacatcatcgtgacatacacactcccagtgatgctgaacgccattgggcttgccggtgtcttcgggatatatgccgtcgtttgcatcctggctcttgtatttgtatacatgaaggttccggagacaaaaggcatgcctctcgaggttatcaccgagttcttctctgttggagcaaagcaagccaaggaggattaatcgcccagaccggcgatcagcaacgctggctgtaattttgtggtttccaaacctcaccgtggttagttaatcctctgatgctgtgtgaaagatactttgaccgacaaagaaggggatcgggggacagtgttcctaaagagatggtttggctgtacatcaagaggcttgatactgtcataggccggcttttggaactagggtgtgtagatcatcatctgttatttcttcttttgcttgggggactgtgtgtttgtgttcgttgtaatttctttttgccctatgtaactagtggtgtacaacggttatgttattggtttctttgtcttgtcatctcctctccatctcgagtcttgaatacccggcaatcatgtttatcgtcagtgcagttgttttttcagtttattggctgctggtaaagcgaaatggcctttgtgttccggttgttcaggaaaagattagtggatgttcagtggtcaccatctgttaagccagaaagatacttcatatcataatttaaagttgttgtatc

SEQ ID NO: 2759 - DNA, 2893 bp, Zea mays
ctctctacacgcccacaagctggtgaccaggatccccccacccaaaactccgctctcatcccaccccccctccactccactaccacggcggcacggcctgcctctgcagctctgccctgctccgcacccctcgctctccaaccccaacgcgcggcgttgctaaaattcaccgcagcgcttactccagtttggccacctcaccacccgccgccgctgtttaagaaggccccgcgcccgatcggggatcacgaaccttggccgccgctgccggagtgggggcgtagatttccggcggccatggggggcgccgtgatggtcgccatcgcggcctctatcggcaacttgctgcagggctgggacaatgcgacaattgctggagccgtcctgtacataaagaaggaattcaacctgcagagcgagcctctgatcgagggcctcatcgtcgccatgtccctcattggggcaacagtcatcacgacgttctccggggcagcggccgactgcgttggtaggaggcccatgctggtcgcctcggctgtcctctacttcgtcagtgggctggtgatgctttgggcgccaagtgtgtacatcttgctcctcgcaaggctcattgatgggttcggtatcggtttggcggtcacacttgttcctctctacatctccgagactgcaccgacagacattcgtgggctgttgaacacgttgccgcagttcagtgggtcaggagggatgttcctctcctactgcatggtgtttgggatgtccctcatgcccaaacctgattggaggctcatgcttggagttctgtcgatcccgtcacttatttactttggactgactgtcttctacttgcctgaatcaccaaggtggcttgtgagcaaaggaaggatggcggaggcgaagagagtgttgcaaaggctgcggggaagagaagatgtctcaggggagatggctcttctagttgaaggtttgggggtcggtaaagatacacgtattgaagaatacataattggtcccgatgatgaacttgctgatgaagggctggctccagatccagagaagatcaaactatatggacctgaagaaggcctatcttgggttgcccgacctgttcggggacaaagtgctcttggaagcgcgttaggtctcatctctcgtcatgggagtatggcggctagtcagggtaagcccctcgtggatcctatggtcactcttttcggaagtgttcatgaaaagatgcctgagatcatggggagcatgaggagcacattgtttcccaactttggcagcatgtttagtgttgccgaccagcagcaggtgaaagctgactgggacgccgagagtcaaagggaaggtgaagattatgcttcggatcatggtggcgatgacatcgaggataacctccaaagcccacttatttctcgtcaggcaacaagtgtggaaggaaaggagatcgctgcacctcatggtagcatattgggtgctgtgggaaggagcagtagcttgcagggaggggaggcagtaagcagcatgggcattggcggaggatggcagttggcgtggaaatggaccgagagagagggcgaagatgggcaaaaggaaggtggcttccagcgtatttacttgcatgaggagggcgtacaaggcaacaggggttctatattgtcattaccaggcggggatgttcctcctggtggtgagttcatccaggctgcagctcttgtgagccaaccagctctttactctaaggaactgctggagcaacgtgctgctggtcctgcgatgatgcatccatctgaagcagttactaaaggtccaagatgggccgacctatttgagcctggggtgaagcatgcactgtttgttggcataggaatacagatcctgcaacagtttgctggcatcaacggcgttctctactacactcctcaaattcttgagcaagcaggcgttggtgttcttctgtcgaacctcggccttaacgcttcttcggcatcaatcctcattagcgccctgacgaccttactgatgctcccaagcatcggcattgcgatgaggctcatggatatgtccggaaggaggtttctcctcctcgcgacgatcccagtcctaatagtcgcgctactcgtcctggtggtgtccaacatcgtggacgtgggggacgtggcgcacgcggcgctctccacggccagcgtcatagtctacttctgcttcttcgtcatggggttcgggcccgtccccaacatcctctgcgcagagatcttccccaccacggtccgcggtgtctgcatcgccatctgcgccctggccttctggctcggtgacatcatcgtgacgtacactctccccgtgatgctgaacgtcgtcgggctcgccggcgtctttggggtgtacgccgtcgtgtgcgtcctagccctcgcgttcgtgttcgtcaaggtgcccgagacgaagggcatgcctctcgaggtcatcaccgagttcttctccgttggggcaaagcaagccaaggaagaggaggaggaggaggccagggaaggttgatcacccggacggccggacccagttaccggcaccgcctgtggggatttttgtggtctgcacacttcactgtggttggtcctgtgatgatgtatttgtgaaaaaaaaaactttgggtagggggcagagatgatttggctgtacaatgtgaggcttgattctgccaaaggctggccttcagaactaggaagggtgtctgttatcttcttttgttgcttggagaccttgtgcttgtgttggttggaattttgttgcctatgtaactagtggtgtatgacagttatgctattggtttctttgtgttggtgccttcctccccatatgggcggccctgtatttgccgcagccgagtgcg

SEQ ID NO: 2760 - DNA, 2231 bp, Secale cereale
gtgatgctctgggcgcccaacgtctatgtgttgctcttggccaggctcatcgacgggttcggtatcggtttggctgtcacccttgtccctctttacatttcggagaccgccccgactgacattagagggctgctgaacacgctgccgcaattcagtgggtcaggagggatgttcctttcttactgcatggtgttcaccatgtcgctcatgccgcagcctgactggagaatcatgcttggggttttgtcgataccgtcgcttatgtactttgcattgactgtcttctatttgcccgagtcgccgagatggcttgtgagcaaaggaagaatggccgaggccaagcgagtgttgcagggactgcggggaagggaagatgtctcaggagaaatggcccttcttgttgaaggattgggtgttgggaaagacacacatttgaggaatacataattggacctgatgatgagcttgctgatgacgggctggctccagatcaagacaaattgaagctgtacggagctgaagaaggggtatcttggattgcccgtcctgttaggggcggtggccaaagtgcacttggaagcgccttgggtctcatgtctcgtcatgggagtatggttagtcagggtaaatctctcgtggacccacttgtcactctcttcggaagtgtccatgagaagatgcctgaggtaatggggagcatgcgcagtacattgtttcctaactttggcagcatgtttagcgtagcggaacagcagcaggctaaagctgattgggatgctgagagtcatagggatgatgaagattatgcatcggatcatggtgcagatgacattgaggataacctcaatagcccgcttatttctcgtcaagcgacaagcgtggagggtaaggagattgctgcacctcatggaagcataatgggtggtgtgggaagaactagtagcatgcagggaggggatgcagtaagcagcatgggcattggtggggggtgcagttagcttggaagtggactgagagagagggtgcagatgggccaaaaagaaaggcggcttccagcgtatttacttgcatgaggagggtgtgtcaggtgatcggaggggctctatattgtctatgccaggaggtgatattcctcctggtggtgagtatatccaggcagctgctctagtgagccaacctgctctttactcaaggacctgatagagcagcagcttgctggtcctgccatggtacatccatctgaggcagttgccaagggtacaaagtgggcagaacatttgaacctggagtgaagcatgcactgttcgttggcataggattacagatcctgcagcagtttgcgggtatcaatggagtcctctactacacacctcagatacttgagcaagcaggtgtcggggttcttctatcaacattgactaagctctctctgcatcctatccctattagtgccttgacaaccttgctgatgcttcccagcattggcatcgccatgagactcatggatatgtcaggaagaaggtttcttctcctttcgacaatccctgtcctgatagtagcactagctgtcttggttttggtgaatgttctggatgtcggaacaatggtgcacgccgcgctctcaacgatcagcgtcatcgtctatttctgcttcttcgtcatggggtttgggcctatcccaaatattctctgtgcggagattttccccacctctgtccgtggcatctgcatagccatctgcgcgctaaccttctggatcggcgacatcatcgtgacatacactctccccgtgatgctcaacgccatcggtcttgctggagtcttcggaatatatgctgtcgtttgcatactggcctttgtattcgtctacatgaaggtccctgagacaaagggcatgcccctggaggtcatcaccgagttcttctctgtcggcgcaaagcagggcaaggaagccacggactagttgctctgatccggtgatccgcgtcgctggtggttaattttgtggtgtcataactactgctgcactagtttaacctgcgatgtcgtttggtagaaagaaaccttacaaaagagagcagagtacggaagtactttacatcgtgaggctgaatcgtgccgtcggtaggccggtcgtttaggaagtaggatatgtacttagatcatctgtctttcttttgtcgtttaggtaacctttccttatttggtgtcttattcaagttaattttatt

SEQ ID NO: 2761 - DNA, 2497 bp, Hordeum vulgare
aggctgcggctgggatggctgcgatccatgcgtaccgtggggaggatgcggccttcgcgtgtgtgggagtgggagtatgcggcggggagggtggaggtcctggcgaggttgccgagggtggcgagcgcggcggtcctcccgtctgcggcgaggatggaggaggcggcgcgcgggggcgggggcgggggcgaggaaagacctggcggccttgcaggcggagtggaagagcttggaggaggaggagctcgtcatggcggcggcggcgaaactcgtcttccttgcgtccaacgtgatgctctgggcgcccaacgtctatgtgttgctcttggccaggctcatcgacgggttcggtatcggtttggcagtcacccttgtccctctgtacatttcggagaccgccccgactgacattagagggctgctgaacacgctgccgcagttcagtgggtcaggagggatgttcctttcttactgcatggtgtttaccatgtccctcatgccgcagcctgactggagaatcatgctgggggttttgtcgatcccgtcgcttatgtattttgcattgactgtcttttatttgcccgaatctcccagatggcttgtgagcaagggaagaatggctgaggccaagcgagtattgcaaagactgcggggaagggaagatgtctcaggagagatggcccttcttgttgaaggattgggtgttggaaagacacacattgaggaatacataattggacctgatgatgagctggctgatgacgggctggctccagatcaagagaagttgaaactctatggagctgaagaaggggtatcttggatcgcccgtcctgttaggggtggcggccaaagtgcacttggaagcgctttgggcctcatgtctcgtcatgggagtatggttagtcagggtaaatctcttgttgacccccttgtcactctcttcggaagtgtccatgagaagatgcctgaggtaatggggagcatgcggagcaccttgtttcctaactttggcagcatgtttagtgtggctgaacagcagcaggctaaagctgactgggatgctgagagtcatagggatgatgaagattatgcatcggatcatggtgctgatgacattgaggataacctcaatagcccgcttatttctcgtcaagcgacaagcgtggagggtaaggagattgctgcacctcatggaagcataatgggtggtgtggaaagtagtagcatgcagggaggggacgcagtaagcagcatgggcattggtgggggttggcagttagcttggaagtggactgagagagaaggtgcagatgggcgaaaagaaggtggcgcccagcgtatttacttgcatgaggagggtgtgtcaggtgatcggagaggctctatattgtctatgccaggaggtgatattcctcctggtggtgagtatatccaggcagccgctcttgtgagccaacctgctctttactcgaaggacctgatagagcagcagcttgctggtccagccatggtacatccatccgaggcagttgccaagggtacaaagtgggcagaactatttgaacctggagtgaagcatgcactgtttgttggcattggattacagatcctgcagcagtttgcgggtatcaacggagtcctgtattacacgcctcagatacttgagcaagcaggtgttgggattcttctatcaaacattggactaagctcttcctctgcatctattcttattagtgccttgacaaccttgctgatgcttggttacatttcagaccgaattggtgcaagagctattacggctgcgagtttcatgtactgctcaattccagctttgttcttctaccgtagagctatcttggttttggtgaatgttctggatgtgggaaccatggtgcacgccgctctctcaacgatcagtgtcatagtctacttctgcttcttcgtcatgggtccaatcccggaaggatccacaagctcggtcaagattgatacagatagagcgaacgcagcatcgctcgctaaagcattactaaccttctggattggtgacatcatcgtgacatacactcttcccgtgatgctcaacgccatcggactcgctggagttttcggaatatatgctgtcgtttgcatgatagccttcgtattcgtctacatgaaggtccctgagacaaagggcatgcccctggaggtcatcaccgagttcttctcggtcggggcgaagcagggcaaggaagccacagacgaagtagcggagaagatagctgagtctaggccatcggaagaatgtagatctccggtggactatgtccaagatcatgtgatggaagtgtgatcaccaactttgatcgccatttttttagtagcgttttaagttttgtttattttttcatagggaagatttcggaccagagtttaggtctgtgggaatttgtaaacatgtaatctgtattgtgatgtacattgtacataattactatatatcgatttgacc

SEQ ID NO: 2762 - DNA, 2367 bp, Secale cereale
aaggggaaggcccagaacaatggcgtccgccgcgacggcgccgcccgcggggaagcggccggcgacgggcgggcgggagggcgaccagatggtgatcaccccgctcggcgccggcagcgaggtgggccgctcctgcgtccacatgacattcaaaggccgcacagtcctttttgactgcggcatccacccagcttactccggcatggcggccttgccctacttcgacgagatcgatccctccgccatcgacgtcctcctcgtcacccacttccacctggaccacgccgcctcgctgccctacttcctggagaagacgacgttcaagggccgcgtgttcatgacacacgccaccaaggccatctacaggctgctgctctccgactacgtcaaggtcagcaaggtgtctgtggaggacatgctcttcgatgagcaggacattatccggtccatggacaagatcgaggtcatagacttccaccagacattggaagttaatggcatacgcttctggtgctatactgctggtcatgtacttggtgctgccatgttcatggtggatattgctggtgttcgcattctttacacgggtgactactcccgtgaagaagaccgtcacctcaaagctgctgagataccccagttctcccctgatatttgcattatcgagtcaacttacggtgtgcagcaacaccaaccccgccatgtcagagagaagcgcttcactgatgccatccacaacacagtttctcaaggggggcgtgttcttattccagcatttgctcttggtagggcacaggaactgttgcttatcctggatgagtattggtctaaccacccagagctccacaagattccaatctattatgcctcccctcttgcaaagaagtgtatggctgtctaccagacatacataaactcgatgaatgaaaggataaggaatcagtttgcacagtccaatcccttccatttcaagcatattgaccctttgaatagcattgacaacttccatgatgtgggtccgtcagtggtgatggcaagtccaggtagcctccaaagtgggctctccaggcagctctttgacaagtggtgcacagataagaagaacacatgtgttattccaggttatgctgtggaaggctcgcttgcaaagaccatcatcaacgaaccgagagaagtgacactagcaaatgggctcactgctcctcttaatatgcagatcttctacatctccttctcagctcacgctgatttcccccagacgagcggcttcttggaagagcttcgcccacccaacattattcttgtacacggagaagcaaatgagatgggcaggcttaagcaaaagcttatcacccagtttgatgggacaaacacaaaaatagtgtctccgaagaactgccaatctgtggagatgtacttcagttcagagaaaatggctaagacaattggcagactggcagagaaggtgccagaagtgggagaagcagtgagcggcttgcttgtgaagaaggggttcacatatcagattatggctcctgaggacctccgcgtgtacacacagctctccactgccaacattactcagcggattgcagtcccgtattctggttcttttgaggtgatcaagtacagactgaagcaaatatacgagagcgtggagtcatcaaccgaagaagatgttccaatactgactgttcacgagagggtggccatccgcctggattcagagagctacgtgacactgcagtggtcctctgatcccataagcgacatggtatccgactcggtggtggccatgatcttgaacattggccgcgagggtccgaaggttgttccgatcgaagaagcggtgaagacggaagaagaaacagagaagatggcgcggaaggtggtctactctctgatggtatcgctcttcggcgacgtcaaagttgcagaggaagggaagcttgttataactgtggatggagacatcgcgcacttggatggcaggagcggtgatgtcgagtgcgagaacgctgggctgaaagagaggatcaagaccgcgttccggcgcatacagggtgcggtgaggccgatcccgctttcggcctcctgagctgaagccatgagaatgcctttaacttttcctagggctcgtgattgaacaaagcactagcaggctgtgttacgtgttgttacgcggccattttaaccttgagcgaaatgtaattctacttcctgttgtgctttgctggatgatgggtagtccctagaagttatctgaacaatcctcgaacttgcactgaatttgagctgctgtgctttgttagatgatcaggtaggcccgttttactgcctctggaacatgatccgagttgtagcatt

SEQ ID NO: 2763 - DNA, 2462 bp, Secale cereale
cctcttcctcctattctccggacgccgcgtctcagcgggaaaggggaaggcccagaacaatggcgtccgccgcgacggcgccgcccgcggggaagcggccggcgacgggcggccgggagggcgaccagatggtgatcaccccgctcggcgccggcagcgaggtgggccgctcctgcgtccacatgacgttcaaaggccgcacagtcctttttgactgcggcatccacccagcttactccggcatggcggcgttgccctacttcgacgagatcgacccctctgccatcgacgtcctcctcgtcacccacttccacctggaccacgccgcctcgctgccctacttcctggagaagacgacgttcaagggccgcgtgttcatgacccacgccaccaaggccatctacaggctgctgctctccgactacgtcaaggtcagcaaggtgtctgtggaggcatgctcttcgatgagcaggacattatccggtcatggacaagatcgaggtcatagacttccaccagacattggaaattaatggcatacgcttctggtgctatactgctggtcatgtacttggggctgccatgttcatggtgatattgcttggtgttcgctattctttacaccggtgactactcccgtgaagaagaccgtcacctcaaagctgctgagataccccagttctcccctgatatttgcattatcgagtcaacttacggtgtgcagcaacaccaaccccgccatgtcagagagaagcgcttcactgatgccatccacaacacagtttctcaagggggcgtgttcttattccagcatttgctcttggtagggcacaggaactgttgcttatcctggatgagtattggtctaaccacccagagctccacaagattccaatctattatgcctcccctcttgcaaagaagtgtatggctgtttaccagacatacataaactcgatgaatgaaaggataaggaatcagtttgcacagtccaatcccttccatttcaagcatattgaccctttgaatagcattgacaacttccatgatgtgggtccgtcagtggtgatggcaagtccaggtagcctccaaagtgggctctccaggcagctctttgacaagtggtgcacagataagaagaacacatgtgttattccaggttatgctgtggaaggctcgcttgcaaagaccatcatcaacgagccgagagaagtgacactagcaaatgggctcactgctcctcttaatatgcagatcttctacatctccttctcagctcacgctgatttcccccagacgagcggcttcttggaagagcttcgcccacccaacattattcttgtacacggagaagcaaatgagatgggcaggcttaaacagaagcttataactcagtttgatgggacaaacacaaaaattagtgtctccgaagaactgccaatctgtggagatgtattttagttcagagaaaatggctaagacaattggcagactggcagagaaggtgccagaagtgggtgaagcagtgagcggcttgcttgtgaagaaggggttcacatatcagattatggctcctgaggacctccgcgtgtacacacagctctctactgccaacattactcagcggattgcagtcccgtattctggttcttttgaggtgatcaagtacagactgaagcaaatatacgagagcgtggagtcatcaaccgaagaagatgttccaatactgactgttcatgagagggtggccatccgcctggattcagagagctacgtgacactgcagtggtcctctgatcccataagcgacatggtgtccgactcggtggtggccatgatcttgaacattggccgcgagggtccgaaggttgttccgatcgaagaagcggtgaagacggaagaagaaacagagaagatggcgcggaaggtggtctactctctgatggtatcgctcttcggcgacgtcaaagttgcagaggaagggaagcttgttataactgtggatggagacatcgcgcacttggatggcaggagcggtgatgtcgagtgcgagaacgctgggttgaaagagaggatcaagacggcgttccggcgcatacagggcgcggtgagaccgatcccgctttcggcctcctgagctgaagccatgagaatgcctttaacttttcctagggctcgtgattgaacaaagcactagcaggccgtccattttaaccttgagcgaaatgtaattctacttcctgttgtgctttgctggatgatgggtagtccctagaagttaagttatctgaacaatcctcgaacttgcactgaatttgagctgctgtgctttgttagatgatcaggtaggcccgttttactgcctctggaacatgatccgagttgtagcattgtggacaatttgtagaagttatgtgaacaatcctctcatttgcagtagtaaatttgagctgaagttgcag

SEQ ID NO: 2764 - DNA, 2437 bp, Triticum aestivum
agagaaaaaaagatggcatccgtggtgatggcgccgccggcggggaagcggccggcgtcgggcgggcgggagggtgaccacatggtgatcacgccactgggcgccggcggcgaggtcggccgctcctgcgtccacatgtccttcaagggccgcaccgtcctgtttgactgcggcatccacccggcctactccggcatggcggcgctgccctacttcgacgagatcgacccgtccgccatcgacgtcctcctcgtcacccacttccacctggaccacgccgcctcgctgccctacttcctcgagaagacgacattcaagggccgcgtgttcatgacccacgccaccaaggccatctacaggctgctgctctcggattacgtcaaggtcagcaagttttccgtggaggacatgctgtttgacgagcaggacatcatccgttccatggacaagatcgaggtcatagacttccaccagacactggaagttaatggcatacgcttctggtgctatactgctggccatgtacttggtgctgccatgttcatggtggatattgccggtgttcgcattctttacactggcgactactcccgtgaagaagaccgtcacctcaaagctgctgagataccccagttctcccctgatatttgcattatcgagtcaacttacggtgtgcagcaacaccaaccccgccatgtcagagagaagcgcttcactgatgccatccacaacacagtttctcaagggggccgtgttcttatcccagcatttgctcttggtagagcacaggaactgttgcttatcctggatgagtattggtctaaccacccagagctccataagattccaatctattatgcctcccctcttgcgaagaagtgtatggctgtctaccagacatacataaactccatgaatgaaaggataaggaatcagtttgcacagtccaatccgttccatttcaagcatattgaccctttgaatagcattgacaacttccatgatgtgggtccgtcagtggtgatggcaagtccaggtagcctccaaagtggcctctccaggcagctctttgacaagtggtgcacagataagaagaacacatgtgttattccaggttatgctgtggaaggctcgcttgcaaagaccatcatcaacgaaccgagagaagtgacactagcaaatgggctcactgctcctcttaatatgcagatcttctacatctccttctcagctcacgctgattttccacagacgagtggcttcttggaagagcttcgcccaccaaacattattcttgtccatggagaagcaaatgagatgggtaggcttaagcagaaacttatcacccagtttgatgggacaaacacaaaaattgtttctcccaagaactgccaatcggtcgagatgtattttagttctgagaaaatggccaagacaattggcagactggcagagaaggtaccagaagtgggagatacagttagtggcttgcttgtaaagaagggcttcacgtatcagattatggcccctgaggacctccgcgtgtacacccaactgtctactgccaacattactcagaggattgctgtcccgtattctggttcttttgaggtggtcaagtacagactgaagcaaatatacgagagcgtggaatcatcaaccgaagaagatgttccagtactgactgttcacgagagagtggccatccgcctggattcagagaggtacgtgacgctgcagtggtcgtctgatcccataagcgacatggtgtctgactcggtggtggccatgatcttgaacattggccgtgagggtccgaaggttgttccgatcgaagaagcggtgaagacggaagaagaaacagagaaggtggcgcgtaaggtggtgtattctctgatggtatcgctcttcggcgacgttaaagttgcagaggaagggaagcttgttataactgtggatggagacgtcgcgcacttggatggcaggagcggtgatgtcgagtgcgagaacgctgggctgaaagaacggatcaagaccgcattccggcgcatacagggtgcggtgagaccgatcccgctttcggcctcctgagctgaagccatgagactgcctttaacttttcctagggctcgtgattaaacaaagcactagcaggctgtgttacgtgttgttacgcggccgttctaatcttgagcgaaatgtaattctactgcctgttgtgctttactggatgatcagtagtccctagaagttatctgaagaatcctctcacttgcactaaatttgagctgctgtgctttgctagatgatcaggtaggcccgttttactgcctctggaacatgatcgagttgtagcattctggacaatttgtagaagatatttgaacaatcctctgatttgcactaaatttgagctgatggagctgctctgtttgtt

SEQ ID NO: 2765 - DNA, 2670 bp, Brachypodium distachyon
atgttgggccatactgggctgggcttaagccgcttagcaataccaatatcacctagaccgagctcggccaatcttgaatcatgctgggcccgtgctttgtgggcttacctatacacgagcatacttgggccctccaaaaccctaaccccctatctcgagtccagtccagtccagtcccgtagcctctctcttccgctccgtccctcgctctcaggtccagcaaccatggcatccgtcgcgacggcgccgccggcggggaagcggccgacgtcgggcgggcgagagggggaccagatggtgatcacgccactcggagccggcagcgaggtcggccgctcctgcgtccacatgaccttcaagggccgcactgtcctcttcgactgcggcatccacccggcatactccggcatggcggcgctgccctacttcgacgagatcgacccctccgccatcgacgtcctcctcgtcacccactttcacttggaccacgccgcctcgctgccgtacttcctggagaagactacgttcaaaggccgcgtgttcatgacacacgccacgaaggcaatttacaggttgctgctctcggattatgtcaaagtgagcaaagtttcggtcgaggacatgctgtttgatgagcaggacattatccgttccatggacaaaatcgaggtcatagacttccaccagacactggaagttaatgggatacgattctggtgctatactgctggccacgtgcttggtgctgccatgttcatggtggacattgctggtgttcgcattctttacactggtgactactcccgtgaagaagatcgacacctgaaagctgccgagataccccagttttcccctgatgtttgcattgtcgagtcaacatatggtgtgcaacaacaccaaccccgtcatgtaagagagaagcgcttcaccgacgccatccacaacactgtttcacaaggggggcgcgttcttatcccagcgtttgctcttggtagagcccaggaactgctgcttatcctggatgagtattggtctaaccacccggagctccataagattccaatctattatgcctcccctcttgcgaagaagtgcatggctgtctatcagacatacataaactccatgaatgaaagaattagaaaccagtttgcacaatccaatcccttccatttcaagcacattgaacctttgaatagcatagacaattttcatgatgtgggtccatcagtggtgatggcaagtccaggtaccctccaaagtggcctctccaggcagctctttgacaagtggtgcacggataagaagaacacatgtgttattccaggttttgtcatagaaggcactctttcaaagaccattatcaacgagcctagagaagtgacgttagcgaatgggctcactgctcctcttcatatgcagatcttctacatctccttttcagctcacgctgatttccctcagaccagtgccttcttggatgagcttcgacctcctaacattattcttgtacatggagaggcaaatgagatggggaggcttaaacagaaacttattactcagtttgatggaacaaacataaaaattgtgtctccgaagaattgccagtcagtggagatgtatttcagctctgagaaaatggccaagacaattggcagattggcagaaaaggtacctgaagtgggagaatcagttagtggcctactcgtgaagaagggcttcacatatcagatcatggctcctgaggatctccgtgtgtacacacagttatctacagctaacattacacagcggatcgcggtcccgtattctggttcctttgaagtcataaagtacagactgaagcaaatatatgagagcgtggagtcatgtcccgaagaacctgatgttccgacactgattgtgcacgagagagtgaccatccgcctagagtcagaaagctatgttacacttcagtggtcctcggatcccataagtgacatggtgtctgattctgtagtggctatgatcttaaacataggccgtgaaggtccaaaggttgttccggttgaagaagcagagaagactcaggaagaaacggaaaaagtggcacggaaggtagtatacgctcttatggtgtcactctttggtgatgttaaagttgcagagggaggtaaatttgtcatatccgtggatggagatgtcgcgcacttggacgggagtagtggtgatgttgaatgtgaaaatgctgcgctgaaggaaaggattaagactgccttccgtcgcatacaaggcgcagtgagaccaatcccactttcttcctcttgaactgaagccataaacgaatgctttaacttgttcagtgtttcttaggtaaaacagagtagcaggtcgcgtttcgatgcctgaaattgtttagcagtcattttatttttgtgccaaatgtgtaatgctgcttgttgttccatatgatcactgctctcttgggcctgtttgctgccttcgaaacatgagttgtaacattgtagacatttctagaagttatatctgaacaatgggaatatttataggttcatggaatccaatgccaggttggttgggaaaaactaagtttgttggaatggagtgtggagaagaaagagtttccaaaagagtctcaatcttgctggagtggcatattattgagaaaaa

SEQ ID NO: 2766 - DNA, 2457 bp, Hordeum vulgare
gctactcggacaaggaaaggggggccagtccttcataagcaaaggggaagggagaaaaaaatggcatccgtggcgacggcgccgccggcggggaagcggccggcgtcgggcgagcgggagggcgaccacatggtggtcacgccgctgggggccggcggcgaggtcggccgctcctgcgtccacatgtccttcaagggccgcaccgtcctcttcgactgcggcatccacccggcctactccggcatggcggcgctgccctacttcgacgagatcgacccctccgccatcgacgtcctcctcgtcacccacttccacctggaccacgccgcctcgctgccctacttcctcgagaagactacgttcaagggccgcgtgttcatgacccacgccaccaaggccatctacaggctgctgctctcggattacgtcaaagtgagcaaggtgtcggtggaggacatgctgtttgacgagcaggacgtcatccgctccatggacaagatcgaggtcatagacttccaccagacgctggaagttaatggcatacgcttctggtgctatactgctggccatgtacttggtgctgccatgttcatggtggatattgcaggtgttcgaattctttacactggtgactactcccgtgaagaagatcggcacctgaaagctgctgaggtcccccagttctcccctgatatttgcattatcgagtcaacttatggcgtgcagcaacaccaaccccggcatgtcagagagaagcgcttcaccgatgccatccacaacactgtttctcaaggggggcgtgttcttatcccggcatatgctcttggtagagcacaggaactattgcttatccttgatgagtattggtctaaccacccagagctccataagattccaatctattatgcctcccctcttgcgaagaagtgcatggctgtctaccagacatacataaactccatgaatgaaaggattaggaaccagtttgcacaatccaatcccttccatttcaaacatattgagcctttgaatagcatagacaacttccatgatgtgggtccgtcagtggtgatggcaagcccaggtagtctccaaagtggcctctccaggcagctctttgacaagtggtgcacggataagaagaacacatgtgttattccaggttttgctgtagaaggctcccttgtgaagaccattatcaacgagccgagggaagtgacattagcaaatgggctcactgctcctcttcatatgcagatcttctacatctcattttcagctcacgccgatttcctacagacgagcggcttcttggatgagcttcgcccacccaacattattcttgtacacggagaagcaaatgagatggggaggcttaaacagaaacttactactcagtttgatggaacaaacacaaaaatcgtgtctcctaagaactgccaatcagtggagatgtatttcagctctgagaaaatggccaagacaattggcagattggcagaaaaggtgccagaagtgggagaatcagttagtggcttactcgtgaagaagggcttcacctatcagatcatggcccctgaggatctccgtgtgtacacacagttatctactactaacattactcagcggatctccgtcccgtattctggttcatttgaggtgatcaagtacagactgaagcgaatatacgagagtgtggaatcatcaaccaaagaacctgatgttccaacgttgattgttcacgagagggtgaccattcgcctggaatccgaaatccatgttacactgcagtggtcctctgattccataagtgacatggtgtccgattctgtggtggcaatgatcttgaacataggccgtcaaggcccaaaggttgttccgattgaagaagcagcaaagacagaagaagaaacagaaaaggtggcgcagaaggtggtatatgctctcatggcgtcgctcttcggtgatgtcaaagtcgcggaggaaggggagcttgttatatctgtggacggagacgtcgcacatttggatggaaggagtggtgatgtcgagtgtgaaaatgctgcactgaaagaaaggatcagcacagcgttccgccgcatacagggcgcggtaagaccaatcccactttcggcatcctgaggcgaagccataaacaagattatgctttaacttgttcgatgtttcctaggtaaacaaaatagcaggtcacattacttggctgaaatagttaagcagctgttttatgcttgtgccaaacgtgtatgtattgctgcacgttgttattagatggttaatagtctctggcgagcttgtttacagcctctgaaacttttcattgtaacgttgtgttcatttctgagtagcagttatgtgaagaatcctcttcacttccagtaaagttgatttccagattatttttccttttcatcaagagtttcattgcctgttcctgat

SEQ ID NO: 2767 - DNA, 2408 bp, Brachypodium distachyon
cttcctctccctccctcgctctcaggtccagcaaccatggcatccgtcgcgccagcggggaagcggccggcgtcgggcgggcgggagggggaccagatggtgatcacgccgctcggcgccggcagcgaggtcggccgctcctgcgttcacatgaccttcaagggccgcaccgtcctcttcgactgcggcatccacccagcctactccggcatggcggcgctgccctacttcgacgagatcgacccctccgccatcgacgtcctcctcgtcacccactttcacttggaccacgccgcctcgctgccatacttcctggagaagaccacgttcaaaggccgcgtgttcatgacacatgccaccaaggcaatttacaggttgctgctctcggattatgtcaaagtgagcaaagtttctgtcgaggacatgctgtttgatgagcaggacattatccgttccatggataaaatcgaggtcatagacttccaccagacattggaagttaatgggatacgcttctggtgctatactgctggtcatgtacttggtgctgccatgttcatggtggacattgctggtgttcgcattctttacactggtgactactctcgtgaagaagaccgacacctgaaagctgccgagataccccagttttcccctgatgtttgcattgtcgagtcaacttatggtgtgcagcaacaccaaccccgtcatgtaagagagaagcgcttcaccgatgccatccacaacactgtttcacaagggggccgtgttcttatcccggcgtttgctcttggtagagcccaggaactgctgcttatcctggatgagtattggtctaaccacccggagctccagaagattccaatctattatgcctcccctcttgcgaagaagtgtatggctgtctatcagacatatataaactccatgaatgaaaggattagaaaccagtttgcacaatccaatcccttccatttcaaacacattgaacctttgaatagcatagacaattttcatgatgtgggtccgtcggtggtgatggcaagtccaggtagcctccaaagtggcctctccaggcagctctttgacaagtggtgcacagataagaagaacacatgtgttattccaggttacgttatcgaaggcacccttgcaaagaccattatcaacgagcctagagaagtgacgttggcgaatgggctcaccgctccacttcatatgcagatcttctacatctccttttcagctcatgctgatttccctcagacgagcggcttcttggatgagcttcgacctcctaacattattcttgtacatggagaggcaaatgagatggggaggctgaaacagaaacttattactcagtttgatggaacaaacataaaaattgtgtcgccgaagaactgccagtcagtggagatgtatttcagctctgagaaaatggccaagacgattggcagattggcagaaaaggtaccagatgtgggagaaccagttagtggcttactcgtgaagaagggcttcacgtatcagattatggcccctgaggatctccgtgtgtacacacagttatctacagctaacgttacacagcagatcgctgtcccgtattctggttcctttgaagtcataaagtacagactgaagcaaatatatgagagcgtggagtcatgtcctgaagaacctgaggttccgacgctgatcgtgcacgagagagtgaccattcgcctagagtcagaaagttatgttacgctccagtggtcctcagatcccataagtgacatggtgtctgattctgtagtggctatgatcttaaacataggccgcgaaggtccaaaggttgttccggtcgaagaagccgagaagacacaggacgaaacggaaaaggtggcacgaaaggtagtatacgctcttatggtgtcactcttcgctgatgttaaagttgcagaggaagggaagcttgtcatatccgtggacggagacgttgcacacttggacggcagcagtggtgatgttgaatgtgaaaatgctgctctgaaggaaaggattaagactgcattccgtcgcatacagggtgcagtgagaccaatcccactttcatcctcttgagccgaagccataagcttatgcttttaacttgtctaatgtttcttaggtaaaacaaagtagcgagtctggtggcgtcctggcagctgcattttatattttgtgccaaatgtgtaatgctgcttgttgttccatatgatcactgctctgctggccctgtttgctgccttcgaaacatgagttgtaacattgtagacatttctagcagttatatctgaacaatcctctcactttcagtaaagtgcaaaactttcggtcaagttgatcctaagccactatatgtttgtcactttcattcatcc

SEQ ID NO: 2768 - DNA, 2360 bp, Triticum aestivum
ggaaaagatggcatccgtggcgacggcgccgccggcggggaagcggccggcgtcgggagggcgggagggcgaccacatggtggtcacgccgctgggcgccggcggcgaggtcggccgctcctgcgtccacatgtccttcaagggccgcaccgtcctcttcgactgcggcatccacccggcctactccggcatggcggcgctgccctacttcgacgagatcgacccctccgctatcgacgtcctcctcgtcacccacttccacttggaccacgcagcctcgctgccctacttcctcgagaagacgacgttcaagggccgcgtgttcatgacccacgccaccaaggccatctacaggctgctgctctccgattacgtcaaggtcagcaaggtgtcggtggaggacatgctgtttgacgagcaggacatcatcaggtccatggacaagatcgaggtcatagacttccaccaaacactggaagttaatggcatacgcttctggtgctatactgctggccatgtacttggtgctgccatgttcatggtggatattgctggtgttcgcattctgtacactggtgactactcccgtgaagaagaccgacacctgaaagctgctgaggtcccccagttctcccctgatatttgcattatcgagtcaacttatggtgtgcagcaacaccaaccccgccatgtcagagagaagcgcttcacggatgccatccacaacactgtttctcaaggggggcgtgttcttatcccggcatatgctcttggtagagcacaggagctgttgcttatcctggatgagtattggtctaaccacccagagctccataagattccaatctattacgcctccccccttgcgaagaagtgcatggctgtctaccagacatacataaactccatgaatgaaaggattaggaaccagtttgcacaatccaatcccttccatttcaggcatattgagcctttaaataacatagacaacttccatgatgtgggtccgtccgtggtgatggcaagtccaggtagtctccaaagtggcctctccaggcagctctttgacaagtggtgcacagataagaagaacgcatgcgtcatttcaggttttgctgtagaaggctcccttgtgaagaccattatcaacgagccaagagaagtgacgttagcaaatgggctcactgctcctcttcatatgcagatcttctacatctccttttcagcccatgctgatttcccacagacgagcggcttcttggatgagcttcgtccacccaacattattcttgtacacggagaggcaaatgagatggggaggcttaaacagaaacttattactcagtttgatggaacaaacactaaaatcgtctctcccaagaactgccaatcagtggagatgtatttcagctctgagaaaatggccaagatagttggcagactggcagaaaaggtaccagaagcggaagaatcagttagtggcttactcgtcaagaagggcttcacgtatcagatcatggcccctgaggatctccgtgtgtacacacagttatctactactaacattactcagcggatctccgtcccgtattctggttcttttgaagtcatcaagtacaggctgaagcagatatacgagagtgtggaatcatcaaccaaggaacctgatgttccaacgttgattgttcacgagagggtgaccattcgcctggaatcagaaagctatgttacgctgcagtggtcctctgattccataagtgacatggtgtccgattctgttgtggccacgatcttgaacataggccgtgaaggcccaaaggctgttccgatcgaagcagcagcaaagacagaagaagaaacggagaaggtggtgcagaaggtagtatatgctctcatggtgtcgctcttcggtgatgttaaattcgcagaggaagggaagcttgttatatccgtggatggagacgtcgcgcatttggacgggaggagtggtgatgtcgagtgtgaaaatgctgcactgaaagaaagggtcagcactgcattccgccggatacagggcgcggtgagaccaatcccactttcggcatcctgacgaaaagccataaataagattcttgtatgctttaacttgttcaatgtttcctaggtaaacaaagtaggaagttcaaacttggctgacatgaaaaaaagagtgtaatactgcctgtgaaacatgagttgtaacattatattaatataaaaagtggttcagtcgtatgtcaacgaattggtcgattatggatactagactgttgtggtcactcctagcagtggtgtgaacaatcgtcttcacttgcagtaaaactcatacgggctgaagtccc

SEQ ID NO: 2769 - DNA, 2325 bp, Triticum aestivum
gggcgcacagtcctcttcgactgcggcatccaccccgcgtactccggcatggcggctctcccatatttcgacgagatcgacccctccgccatcgacgtcctgctcgtcacccacttccacctggaccacgccgcctcgctgccatacttcctggagaagacgacgttcaagggccgcgtgttcatgacccacgccaccaaggccatctacaggctgctgctctcggattatgtcaaggtcagcaaagtgtctgtggaggacatgctcttcgatgagcaggacataatccggtccatggacaaaatcgaggtcatagacttccaccagacactggaagttaatggcatacgcttctggtgctatactgctggccatgtacttggtgctgccatgttcatggtggatattgctggtgtacgcattctttacactggtgactactcccgtgaagaagaccgtcacctcaaagctgctgagataccccagttctcccctgatatttgcattatcgagtcaacttacggtgtgcagcaacaccaaccccgccatgtcagagagaagcgcttcactgatgccatccacaacacagtttctcaagggggccgtgttcttatcccagcattcgctcttggtagagcacaggaactgttgcttatcctggatgagtattggtctaaccacccagagctccataagattccaatctattatgcctcccctcttgcgaagaagtgtatggctgtctaccagacatacataaactccatgaatgaaaggataaggaatcagtttgcacagtccaatccgttccatttcaagcatattgaccctttgaatagcattgacaacttccatgatgtgggtccgtcagtggtgatggcaagtccaggtagcctccaaagtggcctctccaggcagctctttgacaagtggtgcacagataagaagaacacatgtgttattccaggttatgctgtggaaggctcgcttgcaaagaccatcatcaacgaaccgagagaagtgacactagcaaatgggctcactgctcctcttaatatgcagatcttctacatctccttctcagctcacgctgattttccacagacgagcggcttcttggaagagcttcgcccacccaacattattcttgtccacggagaagcaaatgagatgggtaggcttaagcagaaacttatcacccagtttgatgggacaaacacaaaaattgtgtctcccaagaactgccaatcggtcgagatgtatttcagctctgagaaaatggccaagacaattggcagactggcagagaaggtaccggaagtgggcgaaacagtcagcggcttgcttgtgaagaaggggttcacatatcagattatggcccctgaggacctccgtgtgtacacgcagctgtctactgccaacattactcagcggatagctgtcccgtattctggttcttttgaggtgatcaagtacagactgaagcaaatatatgagagcgtggaatcatcaaccgaagaagatgttccagtactgactgttcacgagagggtggccatccgcctggattcagagagctacgtgacgctgcagtggtcgtccgatcccataagcgacatggtgtccgactcggtggtggccatgatcttgaacattggccgtgagggtccaaaggttgttccgatcgaagaagcggtgaagacggaagaagaaacagagaaggtggcgcggaaggtggtgtactctctgatggtatcactcttcggcgacgttaaagttgcagaggaagggaagcttgttataactgtggatggagacgtcgcgcacttggatggcaggagcggtgatgttgagtccgagaacgctgggctgaaagagaggatcaagaccgcgttccggcgcatacagggtgcggtgagaccgatcccgctttcagcctcctgagctgaagccatgagaattttctatggctcgtgattgaacaaggcactagcaggctgtgttacgtgttgttatgcagccattttaatcttgagcggaatgtaattctaccacctgttgtgctttgctagatgatcagtagtccttagaagttatctgaagaatcctctcacttgcactgaatttgagctgtggtgctttactagatgatcaggtaggcctgttttactgcctctggaacatgatcgagttgtagcattgtggacaatttgtagaagttatgtgaacaatcctctcattggcactaagtttgagctgaagttgcagtgcatctgagcctttcaacttgagtgtgtgtcgatcctctgtttgagtttctgctgt

SEQ ID NO: 2770 - DNA, 2075 bp, Secale cereale
gactccataagcaaaggggaaatgagataaaagaaaaatggcatccctggcgatggcgccgccggcggggaagcggccggcgtcgggcgggcgggagggcgaacatatggtggtcacgccgctgggcgccggcggcgaggtcggccgctcccgcgtccacatgtccttcaagggaccggcaccgtcctcttcgactgcggcatccacccggcctactccggcgatggcggcgctgccctaccttcgacgagatcgacccctccgccatcgacgtcctcctcgtcacccaccttccacttggaccacgccgcctcgctgccctacttcctcgagaagacgacgttcaagggccgcgtgttcatgacccacgccaccaaggccatctacaggctgctgctctcggattacgtcaaggtcagcaaggtttccggtggaggacatgctgtttgacgagcaggagtatcatccgttccatggacaagatcgaggtcatagacttccaccagacactggaggttaatgggatacgcttctggtgctatactgctggccatgtacttggtgctgccatgttcatggtggatattgccggtgttcgcattctttacactggtgactactcccgtgaagaagaccggcacctgaaagctgctgagatcccccagttctcccctgatatttgcataatcgagtcaacttatggtgtgcagcaacaccaaccccgccatgtcagagagaagcgtttcacggatgccatccacaacactgtttctcaaggagggcgtgttcttatcccggcatatgctcttggtagagcacaggaactgttgcttatcctggatgagtattggtctcagcacccagagctccataagattccaatctattacgcctccctcttgcaagaagtgcatggctgtctaccagacatacataaactccatgaatgaaaggatcaggaaccagtttgcacaatccaatcccttccatttcaagcatattgagcctttgaatagcatagacaacttccatgatgtgggtcctttagtggtgatggcaagcccaggtagtctccaaagtggcctctccaggcagctctttgacaagtggtgcacagataagaggaacgcatgtgtcatttcaggttttgctgtagaaggctcccttgtgaagaccattatcaacgagccaagagaagtgacgttagcaaatgggctcactgctcctcttcatatgcagatcttctacatctccttttcagcccacgctgatttccacagacgagcggctcttggatgagcttcgcccacccaacattattcttgtacacggggaagcaaatgagatggggaggcttaaacagaaacttattactcagttttgatggaacaaaacacaaaaaatcgtgtctcccaagaaactgccaatcagtggagatgtatttcagctctgagaaaatggccaagacaattggcagattggcagcaaaggtaccagaagtgggagaatcagttagtggcttactcgtgaagaagggcttcacgtatcagattatggcccctgaggatctccgtgtgtacacacagttatctactactaacataactcagcggatctccgtcccgtattctggttcttttgaagtcatcaagtacaggctgaagcagatatacgagagtgtggaatcgtcaactgaggaacctgatgttccaacgttgattgttcacgagagggtgaccattcgcctggaatcagaaagctatgttacgctgcagtggtcctctgattccataagtgacatggtgtccgattccgtggtggccatgatcttgaacataggccgtgaaggcccaaaggctgttccgattgaagaagcaacaaagacagaagaagaaacagagaaggtggtgcggaaggtagtgtatgctctcatggtgtcgctcttcggtgatgtcaaagtcgcagaggaagagaagcttgttatatccgtggacggagatgtcgctcatttggactggaggagcggtgacgtcgagtgtgaaaatgctaaactgaaagaaaggatcagcactgca

SEQ ID NO: 2771 - DNA, 2309 bp, Triticum aestivum
gggcgggagggcgaccatatggtggtcacgccgctgggcgccggcggcgaggccggccgctcctgcgtccacatgtccttcaagggccgcaccgtcctcttcgactgcggcatccacccggcctactccggcatggcggcgctgccctacttcgacgagatcgacccctccgccatcgacgtcctcctcgtcactcacttccacttggaccacgccgcctcgctgccctacttcctcgagaagacgacgttcaagggccgcgtgttcatgacccacgccaccaaggccatctacaggctgctgctctcggattacgtcaaggtcagcaaggtgtcggtggaggacatgctgtttgacgagcaggacatcatccgttccatggacaagatcgaggtcatagacttccaccagacactggaagttaatggcatacgcttctggtgctataccgctggccatgtacttggttctgccatgttcatggtggatattgccggtgttcgcattctttacactggtgactactcccgtgaagaagaccggcacctgaaagctgctgaggtcccccagttctcccctgatatttgcattatcgagtcaacttatggcgtgcagcaacaccaaccccgccatgtcagagaaaagcgcttcactgatgccatccacaacacagtttctcaaggggggcgtgttcttatcccagcatacgctcttggtagagcacaggaactgttgcttatcctggatgagtattggtctaaccacccagagctccataagattccaatctattacgcctcccctcttgcgaagaagtgcatggctgtctaccagacatacataaactccatgaacgaaaggatcaggaaccagtttgcacaatccaatcccttccatttcaagcatattgagcctttgaatagcatagacaacttccatgatgtgggtccgtcagtggtgatggcaagtccaggtagtctccaaagtggcctctccaggcagctctttgacaagtggtgcacagataagaagaacacatgtgttattccaggttttgccgtagaaggctcccttgtgaaggccattatcagcgagccgagagaagtgacgttagcgaatgggctcactgctccccttcatatgcagatcttctacatctccttttccgctcacgctgatttcctacagacgagcggtttcttggatgagcttcgcccacccaacattattcttgtacacggagaggcaaatgagatggggaggcttaaacagaaacttattactcagtttgatggaacaaacacaaaaatcgtctctcccaagaactgccaatcagtggagatgtatttcagctctgagaaaatggcgaagatagttggcagactggcagaaaaggtaccagaagcggaagaatcagttagtggcttactcgtgaagaagggcttcacgtatcagatcatggcccctgaggatctccgtgtgtacacacagttatctactactaacattactcagcggatctccgtcccatattctggttcttttgaagtcatcaagtacaggctaaagcagatatacgagagtgtggaatcatcaaccgaggaacctgatgttccaacgctgattgttcacgagagggtgaccattcgcctggaatcagaaagctatgttacactgcagtggtcctctgattccataagcgacatggtgtccgattctgtggtggccacgatcttgaacataggccgtgaaggcccaaaggctgttccgatcgaagcagcagcaaagacagaagaggaaacggagaaggtggcgcagaaggtagtatatgctctcatggtgtcgcttttcggtgatgtcaaagtcgcagaggaagggaagcttgttatatcggtggacggagacatcgcgcatttggatgggaggagtggtgatgtcgagtgtgaaaatgctgcactgaaagaaaggatcagcactgcattccgccgcatacagggtgcggtgagaccaatcccactctcggcatcctgacgaaaagccataaataagattatgctttaacttgttcaatgtttcctaggtgaaaaaatagcagttcaaacttggctgacatgaaaaaaaagagtgcaatactgcctctgaaacatgagttgtaacattatgtcaatataaaaagtggttcagtcgtatgtcaacgaattggtcgattatggatactagactgttgtggtcactcctagcagttatgtgaacaatcctcttcacttccagtaaaactcgtactggctgaagtcccagtaaagttgatt

SEQ ID NO: 2772 - DNA, 2399 bp, Zea mays
gcccgccggccgccgcaccaagaacgaaaccctaaccccgctcgctgattcaggaagggcgggaaaaccatggcgtcctccgccgcggcgccgagcggcgcgccaccggctgcgaagcgccctgcctccagcggacgggagggagatcagatggtcgtcacgccgctgggcgccggcagcgaggtgggccgttcctgcgtccacatgacattcaagggccgcaccgtcctcttcgactgcggcatccaccccgcgtactccggcatggcggcgctgccctacttcgacgagatcgacccgtccgccatagacgtcctcctcatcacccactttcacttggaccatgccgcctcgcttccgtacttcttggagaagaccacgttcaagggccgggtgtttatgacccacgccacaaaggctatttacaagctgctgctctcggattatgtcaaagtcagcaaagtgtccgtggaggatatgttgtatgatgagagtgacattgctcgctccatggataaaatcgaggttattgatttccaccagacattggaagttaatgggatacgcttctggtgctacactgctggccatgtgcttggtgccgccatgttcatggttgatattgctggcgtgcgcattctttacactggtgattactcccgtgaagaagaccgccacctacgagctgctgagctcccacagttctccccagacatttgcattattgagtcgacttatggtgtacagcaacatcagccccggattatacgtgagaagcgctttactgaggtcatccacaatactgtttcacaggggggtcgtgttcttatcccggcatttgcacttggcagagcacaagaactgttacttatcctcgatgagtattggtcaaaacatccagagctccataagattccgatctattacgcttcccctcttgccaagaggtgcatggctgtataccagacatacataaactccatgaatgaaaggatacggaaccagtttgcacaatccaatcccttccatttcaagcatatcgagtccttgaatagcattgataactttcatgatgtgggtccttcagtggtgatggctagtccaggtggtctccagagtggtctctctaggcagctttttgataagtggtgcacagataagaagaatgcttgtgttattccaggttatgttgtggaggggacccttgcaaagaccattatcaacgagccaagagaagtgacactggctaatgggctcactgctcctcttcatatgtcggtccactacatctctttttcagctcatgccgatttcccgcagacaagcaactttttggatgaacttcggccaccaaatattattctcgtgcatggagaagcaaatgaaatgtccaggcttaaacaaaaacttattactcagtttgatggtacaaatacaaaaattgtgtctcccaagaactgccaatcagtggagatgtacttcacttgtgagaagatggccaagactattggcaggttggcagaacaagtaccagaaggtggagagtcttccagtggcctacttgtcaagaagggattcacatatcagattatggctcctgaagatctccgtgtgttcacgcagttatctacagctaacatcattcagcgtatcgcggtcccttactctggatcttttgaagtcataaggtacagactgaaacaaatatacgagagcgtggagtcagcaacagaggaatctgatgttccgacgttaatcgtgcatgaaagagtgacggttcgcctggattcagaaagttatgttacactgcagtggtcgtccgatcccatcagcgacatggtgtctgattctgtggtggctatggtcttgaacatcggtcgggaaggccccaaagttgttccggtcgaagaagcggtgaagaccaaagaggagacggagaaggctgccctaaaggtggtgtatgctcttatgacatcgcttttcggtgacgttaaagtcgcagaggaagggaaatttgtcatatctgtagatgggaatgtggcgcacttggatgggaggagtggcgatgtcgaatgtgaaaatgctacgctgaaggaacggatcaagaccgccttccgtcgcatacagggcgccgtgagaccaatcccactttcagcctcttgataacttgtttgacatttcccatttgaacaaagtagcattctctgtttacaccagagtaccgggttttttttccctctctatcgaaaggaaccccagatgccttgtacggcatgctactcaagaggatttgattgttgatctgggattgcctctgtaaaatcacctgtaacattgtcatcctaacttgaaccacctccatcgttttcagtaaatttctacttaattttctgttttct

SEQ ID NO: 2773 - DNA, 4454 bp, Oryza sativa
aaaaggtctttccttctccgctcgtcagcaagtgaaggggaaaatggcgtcgtccgtcgccgccgccgccgcaccgaccgccggggggccgccggggaagcggcaggcctccggcgggcgggagggagaccagctcatcatcactccgctgggcgccggcaacgaggtcggccgctcctgcgtctacatgtcattcaagggccgcaccgtcctcttcgattgcggcatccacccggcttactccggcatggcggcgctcccctacttcgatgagatcgatccctccaccattgatgtcctcctaatcacccactttcacttggaccatgctgcctctcttccctacttcttggagaagacgacattcaaggggcgcgtgttcatgacccatgccacaaaggccatctacaggctgctcctttccgattatgtcaaagtcagcaaagtttctgtggaggatatgctgtttgacgagcaagacattcttcgttccatggataaaattgaggtcatagacttccaccagacattggaagttaatggcatacgcttctggtgctatactgctggccatgtacttggcgctgcaatgttcatggtggacattgctggggttcgcgttctttacactggtgactactcccgtgaggaagatcgccacctgaaagctgctgaacttccccagttctcccctgatatttgcattatcgagtcaacttatggcgtgcagcagcaccaaccccgccatgtacgagagaagcgcttcactgatgtaatacacacgaccgtctcgcagggtggtcgcgttcttatcccagcctttgctcttggaagagctcaagagctgctacttatcctggatgagtattgggccaaccacccagagctccataagattccaatctattatgcctcccctcttgccaagaaatgcatggctgtctaccagacatacatcaactccatgaatgaaaggattaggaaccagtttgcacaatctaatcccttccatttcaagcatattgagtctttgaatagcatagataactttcatgatgtgggtccatcagtggttatggcaagcccaggtggtctccagagtggcctctccaggcagctctttgacaaatggtgcacagataagaagaattcatgtgttattccaggttatgttgtggaaggcacccttgcaaagaccattattaacgagccaagagaagtgacactggcgaatgggctcactgctcctcttcatatgcaggtccactatatttccttttctgctcatgctgatttccctcagacaagcaccttcttggatgagctccagccacccaacattgttcttgtacacggggaagcaaatgagatgtcaagacttaagcagaagcttatttctcagtttgatgggacaaatataaaagttgttaaccccaagaattgccaatcagtggagatgtatttcagttctgagaaaatggccaagacaattggcaggttggctgaaaaggtaccggaagctggagaatcagttaatggcttgcttgtaaagaagggattcacatatcaaattatggctcctgaggatctccgtgtgtacacgcagctatctacagctaacattacccaaaggattgccgtcccatattctggttcttttgaagtcataaagtacagactgaagcaaatatatgagagcgtggagtcatcaacagaggagtctgatgttccaacattgattgtgcatgagagagtgaccattcgcctggaatcagaaagctatgttacattgcagtggtcgtctgatcctatcagtgatatggtgtctgattctgtggtcgccatggtcttgaacataggccgtgaaggtcccaaagttgtcccagttgaagaagcagtgaagacacaggaagagacggaaagggtggcccagaaggtagtttatgctcttatggtgtcactttttggtgatgtcaaagttgcagaggaagggaaacttgttatatctgtggatggacaagtagcacacttggatgggaggagtggtggtgttgaatgtgaaaatgctacactgagagaaaggatcaagactgcattccgtcgtatacagggtgctgtgagaccaatcccgcttatatcttcttgagctgaaggcgttaaagttacgcttaaacgtgtccaatgtttcctagatgaacttagtagcattacctgtctgcacatgatgagcaggcattttcatcctgcttcaaatgcctgtctaatacagcatgatgtgttgtagatcactgctctgggccatcttagtgccgttgaaataaactccagctgtaacattttgattttgtagccatttctaactgttactcatttcctgtgaaattgttcttagcttctctgttcttttccagatattctgtttgcctgctattcatttgtccagttggtgatgtactatgcaatcttaatggaaacttttgggtctcaatgacgaatctgattgagctgaacttccagagttcttttctggtcagatcagcaggatcagtaaaccaacattcgtaatacaatcatcacatcaataatctacacaccacccataatcactctgtaaaatccggccttagtactgtactcctccctgcacaaccaaattaataatctatacagtaatcaacaagcgaaatgaataagcaattaatcagccatcttcactgactaattcttgttaggacgaccacacgcaaagcaagacagcaacttggaagcaaaggagctagagcctgaggacgacgtcgacggcggcggcggcggcttcaccaccgtggggatgtgggacccgtcctcgccgcacttcctgcagcggtcgcactcgtccatccatgccttgaaggcggcgttgcagtagctggccgcctccgccaccgtcatcccctccaccagcttgcgcgggtacacgtcctcgtcggcgtggtcgccgttgagcaccgcccccagctgcaccagctcctcctggaactccgtcagcgccgcctgctccgccgcctccgtcgccggcctcatcttcaccggctccggcagggtggcggggcagtcggtgcgcggcgcgtcgcgcgtgaggacgacgtcgaaggtgcccgcccaggcgtcgcggttggtcaggaagctcttgaggttgaagagcttcttcacggtggccgggatggaggagtgctcgaactccgacgtcgggtacggccccgacggccggtgcaccaccgtgcccggctcgatccacggcgagatgaagagcgccgggacgcggacgccgaggcggttgaactcgaagaagaatggcgcggcgctgacgatgccgtcggggctgggcacgtccaccggcgtcgggacgtggtcgtagaagccgccgtgctcgtcgtaggtgacgacgaggagcgcctcctcccactgcggcccgccacgcagcgcctcgtacacctccttgacgaatcgctggccctcggagacgtcgtgcgaggggtggtcgtcgttgccggggagcatcttgaggtcgaagtagcgctgctcgacgacgacgtagttggggagcttgccctcggcgcagtgccgccggaacgcgaggtcgaaggggtggaagttgccggcgtacttgagctggcgcaagctccggtagaagagcgtggacggcgggtactggtagtagatgccgaaggagaagccggcgtcgtggagggagtcaaagatggtgcgctgcgggaggccggcgacgagcagcttggtgtcgttgctgacgagcccgtgcgacgtcgctgagtggacgaacagccggttgggctgcgtcgacgccgggttggacgcgaaccagcggtcgcacacggcgaactgccgcaccagctcgcggtacaccggcacggcctccggccggaagccgttcatgacggtgtccgccatgccgggcttctccttctccgcctgctgcgcgaagccggccatcggcggcgaggggacgccgggaggggtgatgggcgtggcgcgcgcgtcgacgaacggcgtgccgtacacctgctcgtagatggcctgcatggagtggcccgggtcagggtcgacgtactcggcgccgtcgccgaagcggatggccctggaggtcgggtcggcggcgtcgaggtggttgatctcgtcgccggtgacgccgtcgatctccgggttgagagacttcatccagcccagcatgtggtcgaaggagcggttctccatcaccagcaccaccaccgtcttgatcttgccgccggccgccgccgccgccattgctacactactgtactcttgtgttgattatattcttcttggtactttcttttttcacttttggttttggtttggatcaatttctgcatgaatacactgtgacactatatagagagaggcagagccagagagatcaggagagttgagttgag

SEQ ID NO: 2774 - DNA, 2525 bp, Sorghum bicolor
cgagcccgccggccgccgcgccacgggcagaaccctaaccccttcgctgattcaggaaggggaagaccatggcgtcctccgccgcggctccgagcggcgcgccaccggctgggaagcgcccggcctccagcggacgggagggagatcagatggtcatcacgccgctgggcgccggcagcgaggtcggccgctcctgcgtccacatgaccttcaagggccgcaccgtcctcttcgactgcggcatccacccggcgtactctggcatggcggcgctgccatacttcgacgagatcgatccgtccaccatagacgtgctcctcatcacccactttcacttggaccatgctgcctcgctgccgtacttcctggagaagactacattcaagggcagggtgtttatgacccacgccacaaaggctatttacaggctgctgctctcagattatgtcaaggtcagcaaagtgtccgtggaagatatgttgtatgatgagaatgacattgctcgctccatggaaaaaatcgaggttatagatttccaccagacattggaagttaatgggatacgcttctggtgctacactgctggacatgtacttggtgccgccatgttcatggtggatattgctggcgtgcgcattctttacaccggtgactactcccgtgaagaagaccgccacctacgagctgctgagctcccacagttctccccagatatttgcattattgagtcaacctatggtgtacagcaacatcaaccccggattgttcgtgagaagcgctttactgaggtcattcacaataccgtttcacaggggggtcgtgttcttatcccggcatttgcacttggcagagcacaagaactgttacttatccttgatgagtattggtccaaacacccagagctccataagattcctatctattacgcttcccctcttgccaagaggtgcatggctgtctaccagacatacataaactccatgaatgaaaggatacggaaccagtttgcacaatccaatcccttccatttcaagcatatcgagtccttgaatagcattgataactttcatgatgtgggtccttcagtggtgatggctagtccaggtggtcttcagagtggtctctctaggcagcttttcgataagtggtgcacagataagaagaatgcttgtgttattccaggttatgttgtggaggggacccttgcgaagaccattatcaacgagcctagagaagtgacgctagctaatgggctcactgctcctcttcatatgtcagtccactatatctctttttcagctcatgccgatttccctcagacaagcaactttttggatgaacttcggccaccaaatattattcttgtacatggtgaagcaaacgaaatgtcaaggcttaaacagaaacttaaaactcagtttgatggtacaaatattgtatctcccaagaattgccaatcagtagagatgtatttcacttgtgagaaaatggccaagactattggcaggctggcagaaaaagtaccagaaggtggagagtcttccggtggcttacttgtcaagaagggattcacgtatcagattatggctcctgaagatctccgtgtctttacacagttatcaacagctaacatcactcagcgcattgcagtcccttattctggttcttttgaagtcataaagtacagactgaagcaaatatatgagagcgtggagtcagcaacagaagaatctgatgttccagcattgattgtgcatgaaagagtgacagttcgcctagattcagaaagttatgttacgctgcagtggtcatctgatcccatcagtgacatggtgtctgattctgtggtggctatgatcttgaacattggtcgtgaaggtccaaaagttgttccggttgaagaagcagttaagaccaaagaagagacggagaaggttgctcaaaaggtggtatatgctcttatgacatcacttttcggtgatgttaaagttacagcggaagggaaatttgtcatatctgtagatggaaatgtggcacacttggatgggatgagtggcgatgttaaatgtgaaaatgctacactgaaggaacggatcaagactgcattccgtcgcatacagagcgccgtgagaccaatcccactttcagcctcttgattggagggcaatgtttaaacttgtttgacatttcccagtttttcaatgtaagattatctgtctggacttggatagcagttctttttcgaaaagaatgcccaattgcattgtaccgcaagctactcaagaggatcgttgatctgggattgccactgaaacgccagttgtaacattgtaacatgaactaactcattttcattatctgtcctgtttccttttcatacccaaatttgaaatacttcggcatgatgttccaagttctgtttggacatgtttcaacaatcttctgaagcggttgttggttgtttcaccaaggaaggcttatacaacaaatagggataccataaggttttgcactgtaaatttatg

SEQ ID NO: 2775 - DNA, 2602 bp, Panicum virgatum
tcaggttttaaaaggctgccaatttaaatctttgagctcaaaagtacgtgaaaagaattattaacttctgctaacgtccatccttgtaagccatcaacattttccatggtcatcaagctttgactttgtctgcgatctaggagtagctcatgaagcattgccttgcctccactctacacagaaaagaattgtgttgaaagtatggcccggcccagctttcaggaggcccacgaaccttccaaaaccctaacccccgctccatcccagattattcaggcaaaaagaaaagaaaagaaaaaaaccggcggacaagggaaggggggaaacaatggcatccgtcgccgcgccgagcagctcgctggccggaaagcgcccggcctccggcgggcgggagggcgaccagatggtcatcacgccgctgggcgctggcagcgaggtcggccgctcctgcgtccacatgaccttcaagggccgcaccgtcctcttcgactgcggcatccacccggcctactccggcatggcggcgctgccctacttcgacgagatcgatccgtccaccatagacgtcctcctcatcacccactttcacttggaccatgccgcctcgctgccctatttcctggagaagactacgttcaagggcagggtgtttatgacccatgccacaaaggctatttacaagctgctgcttacggattatgtcaaagtcagcaaagtttccgtggaggatatgctgtataatgagaatgacattgctcgctctatggagaaaattgaggttattgatttccaccagacattggaagttaatggcatacgtttctggtgctacactgctggccatgtacttggtgctgccatgttcatggtggatatcgctggtgtgcgcattctttacactggtgactactcccgtgaagaagaccgccacctacgagctgctgagctcccacagttctccccagatatctgcattattgagtcaacttatggcatacaacaacatcagcccaggatcgtacgcgagaagcgctttactgaggtcatccacaatactgtttcgcaggggggtcgtgttcttatcccagcatttgctcttggcagagcacaagaactgttacttatccttgatgagtattggtccaagcacccagagctccataagattccaatctattatgcctcccctcttgcaaagaggtgcatggctgtctaccagacatacataaactccatgaatgaaaggatacggaaccagtttgcgcagtccaatccctttgttttcaagcatatcgagtccttgaatagcattgagaactttcatgatgtaggtccttcagtggtgatggctagtccaggtggtcttcagagcggtctctctaggcagctttttgataagtggtgcacggataagaagaatgcttgtgttattccaggttatgttgtggagggcacccttgcaaagaccattatcaacgagccaagagaagtgacgctagctaatgggctcactgctcctcttcatatgcaggttcactatatatctttctcagctcatgctgatttccctcagacaagcaactttttggatgaacttcggccacccaacattattcttgtacatggagaagcaaatgaaatgtcaaggcttaaacagaaacttatttctcagtttgatggaacaaacaccaaaattgtgtctcccaagaactgccaatcagtggagatgtatttcacttgtgagaaaatggccaagactattggcaggctggcagagaacatgccagaaggtggagagtcttcgggtggcttacttgtgaaaaaaggattcacatatcagattatggctcctgaagatctccgagtgttcacacagttatctacagctaacatcactcaacgcattgcggttccttattctggttcttttgaagtcataaagtacaggctgaagcaaatatacgagagcgtggagtcagcaactgaagaatctgatgttccaacacttattgtgcatgaaagagtgacagttcgcctagaatcagaaagctatgttactctacaatggtcatcggatcccattagcgacatggtttctgattctgtggtggctgtggtcttgaacataggccgtgaaggtccaaaacttgttccagttgaagaagcagcgaagaccaaggaagatactgaaagggtagcactaaaggtagtttattctctgatggcgtcactgtttggtgatgttaaagttggagaggaaggggaatttgtcatatccgtcgatggagatgtggcacacttggatgggaggagtggtgatgttgaatgtgaaaatgcaacactgaaagaacggatcaagactgctttccgtcgcatacagggtgctgtgagaccaatcccgctttcagcctcttgatctggaggcgccaagatcatgctttagacttatccaacatctcctagttcaacattcgacttcatttagagagcagaacctttttttttgggttaattggatctataccattacaattattcgagttcactgatctgccattataattcgtctatttcgaaccgtgccatcacaattttacaactc

SEQ ID NO: 2776 - DNA, 2466 bp, Setaria italica
tctccggcggacaaagaaggaaggggaaaactatggcgtccgtcgccgcgccgagcgcctcgcaggcggggaagcgcccggccaccggcgggcgggagggcgaccagatggtcgtcacgccgctgggcgccggcagcgaggtcggccgctcctgcgtccacttgacattcaagggccgcaccgtcctcttcgactgcggcatccacccggcctactccggcatggcagcgctgccctacttcgacgagatcgatccgtccactatagacgtcctcctcatcacccactttcacttggatcacgcagcctcgctgccgtacttcctggagaagactaccttcaagggcagggtgtttatgacccatgccacgaaggctatttacaagctgctgcttatggattatgtcaaagtcagcaaagtttccgtggaggatatgctgtataatgagagtgacattggtcgctctatggagaaaattgaggttatcgatttccaccagacattggaagttaatggcatacgcttctggtgctacactgctggccatgtacttggtgccgccatgttcatggtggatattgctggtgtgcgcattctttacacaggtgactactcccgtgaagaagaccggcacctacgagctgctgagctcccgcagttctccccagatatttgcattattgagtcgacttatggcatacaacaacatcagcccaggattgtacgtgagaagcgctttactgaggtcatccacaatactgtttcacaggggggccgtgttcttatcccagcatttgctcttggcagagcacaagaactgttacttatccttgatgagtattggtccaagcacccagagctccataagattccaatctactatgcctccccgcttgcgaagaggtgcatgtctgtctaccagacatacataaactccatgaatgacaggattcggaaccaatttgcgcagtccaatcccttcattttcaagcatatcgagtccttgaatagcattgagaactttcatgatgtaggtccttcagtggtgatggctagtccaggtggtcttcagagtggtctctctaggcagctttttgataagtggtgcacggataagaagaatgcttgtgttattccaggctatgttgtggaggggacccttgcaaagaccataatcaacgagccaagagaagtgacgctagctaatgggctcactgctcctcttcatatgcaggtccactatatctctttctcagctcatgccgatttccctcagacaagcaactttttggatgaacttcggccacccaacattattcttgtacatggagaagcaaatgaaatgtcaaggctcaaacagaaacttatttctcagtttgatggaacaaacacgaaaattgtctcccccaagaattgccaatcagtggagatgtatttcacttgcgagaaaatggccaagactattggcaggctggcagaaaacgtaccgggaggtggagagtcttcgggtggcttgcttgtgaaaaaaggattcacatatcagattatggctcctgaagatctccgagtgttcacacagttatctacagctaacatcactcagcgcattgcagttccttattctggttcttttgaagtcataaagtacagactgaatcaaatatatgagagcgtggagtcagcaactgaggaatctgatgttccagcacttattgtgcatgagcgagtgacagttcgcctagactcagaaagctatgttacgctgcaatggtcatctgatcccatcagcgacatggtctctgattctgtggtgtctatgatcttgaacataggccgtgaaggcccaaaagtagttccagttgaagaagcagcgaagaccaaggaagatacggaaagggtagcactaaaggtagtgtattctcttatggcgtcgctttttggtgacgttaaagttggagatgaagggaaatttgtcatatctgtcgatggagatgtggcacacttggatgggaggagtggtgacgttgaatgtgtaaatggtacactgaaagaacggatcaagactgctttccgtcgcatacagggtgctgtgagaccaatcccactttcagcctcttgatctggaggcgcaagatcatgctttagaactgtccaacattttcgagttcaacgtttgccttcattcagagagcagcaacttttttttagtcaaatgtcttctagcacagctgttgaaaactcgaaatgattagtgctgagcctatgtactccctcagaaacataagttgtaacctttacgaatttctactaacagttactatgtgcattaacctgctttgataaattcttttttcccttgtttgatctgtgtttttttttcatattcatttatgtttgcatcatctgcttgttccaaacttccaattgctgtatttttgttatgtcatccaatcctccgaagagaa

SEQ ID NO: 2777 - DNA, 2546 bp, Panicum virgatum
ataataataaggatgatgaggaagacatgatgcaggccaccaccatctagcagaagcagaaaggaaaggaagacttgtgttcaaagtatggcccggcccagctttcacacggcccgcgaagaagccgttcccaaaccctaaatcccacccaccccggagcggcggacaagggcaaccatggcgtccgtcgccgcgccgaccgcctcgctggcgggaaagcgccccacctccggcgcccgggagggcgaccagatggtcatcacgccgctgggcgccggcagcgaggtcggccgctcctgcgtccacatgaccttcaagggccgcaccgtcctcttcgactgcggcatccacccggcctactccggcatggcggcgctgccctacttcgacgagatcgatccctccaccatagacgtcctcctcatcacccactttcacttggaccatgccgcctcgctgccctatttcctcgagaagactacgttccagggcagggtgtttatgacccatgccacaaaggctatttacaagctgctgcttacggattatgtcaaagtcagcaaagtttccgtggaggatatgctgtataatgagaatgacattgctcgctctatggagaaaattgaggttatcgatttccaccagacattggaagttaatggcatacgtttctggtgctacactgctggccatgtacttggtgccgccatgttcatggtggatatcgctggtgtgcgcattctttacactggtgactactcccgtgaagaagaccgccacctacgagctgctgagctcccacagttctccccagatatttgcattattgagtcgacttatggcatacaacaacatcagcccaggattgtacgcgagaagcgctttactgaggtcatccacaatactgtttcacatgggggtcgtgttcttatcccagcatttgctcttggcagagcacaagagctgttgcttatccttgatgagtattggtccaagcacccagagctccataagattccaatctattatgcctcccctcttgcaaagaggtgcatggctgtctaccagacatacataaactccatgaatgaaaggatacggaaccagttggcacagtccaatccctttgttttcaagcatatcgagtccttgaatagcattgagaatttccatgacgtaggtccttcagtggtgatggctagtccaggtggtcttcagagcggtctctccaggcagctttttgataagtggtgcacagataagaagaatgcttgtgttattccaggctatgttgtggaggggacccttgcaaagaccattatcaacgagccaagagaagtgacgctagctaatgggctcactgctcctcttcatatgcaggttcactatatatctttctcagctcatgctgatttccctcagacaagcaactttttggatgaacttcggccacccaacattattcttgtgcatggagaagcaaatgaaatgtcaaggcttaaacagaaacttatttctcagtttgatgggacaaacaccaaaattgtttctcccaagaactgccaatcagtggagatgtatttcacctgtgagaaaatggccaagactattggcaggctggcagagagcgtaccagaaggtggagagtcatcgggtggcttacttgtgaaaaaagggttcacatatcagattatggctcctgaagatctccgagtgttcacacagttatctacagctaacatcactcaacgcattgcggtcccttactctggttcttttgaagtcataaagtacaggctgaagcaaatatatgagagcgtggagtcagcaactgaagaatctgatgttcccacacttattgtgcatgaacgagtgacagttcgccaagagtcagaaagctatgttacgctgcaatggtcatcggatcccattagcgacatggtgtctgattctgtggtggctgtggtcttgaacataggccgtgagggtccaaaagttgttccggttgaagaagcagcgaagaccaaggaagatacagaaagggtagcactaaaggtagtgtattctcttatggtgtcgctttttggtgatgttaaagttggagaggaagggaaatttgtcatatccgtcgatggagatgtggcacacttggatgggaggagtggtgatgttgaatgtgaaaatgctacactgaaagaacggatcaagactgctttccgtcgcatacagggtgctgtgagaccaatcccacttttagcctcttgatctggaggtgccaagatcatgctttagacttattatccaacatttcctagctcaacattcgacttcatttagagagcagaactttttttttttgagtcaaatgtcttgtaccacagttgttgaaaacacgaaatgattagtgctctgagcctatgtactccctctgaaacatgagttacaacattgtactaatttctactaacagctactcttactatgttaaccttctttctttgagaatatcttttctgtgtctttttttaattcattttaatttgcaa

SEQ ID NO: 2778 - DNA, 2568 bp, Panicum virgatum
aatctccgtcggaaaacaatggcgtccgtcgccgcgccgagcggctcgctggcgggaaagcgcccgacctccggcgtgcgggagggcgaccagatggtcatcacgccattgggcgccggcagcgaggttggccgctcctgcgtccacatgacctttaagggccgcaccgtccttttcgactgcggcatccacccggcctactccggcatggcggcgctgccgtacttcgacgagatcgatccatccaccatagatgtcctcctcatcacccactttcacttggaccatgccgcctcgctgccctatttcctggagaagactacgttcaagggcagggtgtttatgacccatgccacaaaggctatttacaagctgatgcttacggattatgtcaaagtcagcaaagtttccgtggaggatatgctgtataatgagaatgacattgctctctctatggagaaaattgaggttatcgatttccaccagacgttggaagttaatggcatacgtttctggtgctacactgccggccatgtacttggtgctgccatgttcatggtggatattgctggtgtgcgcattctttacactggtgactactcccgtgaagaagaccgccacctacgagctgctgagctcccacagttctccccagatatttgcattattgagtcaacttatggcatacaacaacatcagcccaggattgtacgcgagaagcgctttactgaggtcatccacaatactgtttcacaggggggtcgtgttcttatcccagcatttgctcttggcagagcacaagaactgttgcttatccttgatgaatattggtccaagcacccagagctccataagattccaatctattatgcctcccctcttgcaaagaggtgcatggctgtctaccagacatacataaactccatgaatgaaaggataaggaaccagtttgcgcagtccaatccctttgttttcaagcatatcgagtccttgaatagcattgaaaactttcatgatgtaggtccttcagtggtgatggctagtccaggtggtcttcagagtggtctctctaggcagctttttgataagtggtgcacggataagaagaatgcttgtgttattccaggctatgttgtggagggaacccttgcaaagaccattatcaacgagccaagagaagtgatgctagctaatgggctcactgctcctcttcatatgcaggttcactatatatctttctcagctcatgctgatttccctcagacaagcaactttttggatgaacttcagccacccaacattattcttgtacatggagaagcaaatgaaatgtcaaggcttaaacagaaacttatttctcagtttgatggaacaaacaccaaaattgtttctcccaagaactgccaatcagtggagatgtatttcccttgtgagaaaatggccaagactattggcaggttggcagagaacgtaccagaaggtggagagtcttcaggtggcttacttgtgaaaaaaggattcacatatcagattatggctcctgaagatctccgagtgttcacacagttatctacagctaacatcactcaacgcattgcagtcccttattctggttcttttgaagtcataaagtacaggctgaagcaaatatacgagagcgtggagtcagcaactgaagaatttgatgttccaacacttattgtgcatgaacgagtgacagttcgcctagagtcagaaagctatgttacgctgcaatggtcatcagatcccattagcgacatggtgtctgattctgtggtggctgtagtcttgaacataggccgtgagggtccaaaacttgttccggttgaagaagcagcgaagaccaaggaagatacagaaagggtagcactaaaggtagtgtattctcttatggcgtcgctttttggtgatgttaaagttggagaagaagggaaatttgtcatatccgtcgatggagatgtggcacaattggatgggaggagtggtgatgttgaatgtgaaaatgctacactgaaagaacggatcaagactgctttccgtcgcatacagggtgctgtgagaccaatcccactttcagcctcttgatctggaggtgccaagatcatgctttaggcttgtccaacatctactaattcaacatttgacttcatttagagagtggaacttttttttttggaatcaaaatgtcttgtaccacagttgttgaaaacacgaaatggttagtgctctgagcctatgtactcctccctctgaaacatgagttgtaacattgtactagtttctactaacagctaccattacaatgttaaccttctttgagaatatcttttcttgttagcctgtgtctttttttcaagttcattttaatttctctcacttggttgttccaaactcgcaattgatgtatgctggttatgtttcatgcaatcttctgaagagaagttaaagaattgcttgcagattccttgtaacattagcagcaaatgcaacaaagtcacttagcctttttgaaattcgaactggtttttggtgatttggttgttccca

SEQ ID NO: 2779 - DNA, 2413 bp, Pennisetum glaucum
cgcagacgcagattcaggcaaaccatggcgtccgtcgccgcgccgagcgcctcgcaggcggggaagcgcccggcctccggcggccgggagggcgaccagatggtcatcacgccgctgggcgccggcagcgaggtgggccgctcctgtgtccacttgaccttcaagggccgcaccgtcctcttcgactgcggtatccacccggcctactccggcatggcggcgctgccctacttcgacgagatcgatccgtccaccatagacgtcctcctcatcacccacttccacttagaccatgccgcctcgctgccctacttcctggagaagactacattcaaaggcagggtgtttatgacccatgccaccaaggctatttacaagctgctgcttatggattatgtcaaggtcagcaaagtttccgtggaggatatgctgtataatgagagtgacattggtcgctctatggagaaaattgaggttatcgatttccaccagacattggaagttaatggcatacgcttctggtgctacaccgctggccatgtacttggtgctgccatgttcatggtggatattgctggtgtgcgcattctttacactggtgactactcccgtgaagaagaccgtcacctacgagcggctgagctcccgcagttctccccagatatttgcattatcgagtcaacttatggcatacagcaacaccagcccaggattgtacgggagaagcgctttactgaggtcatctacaatactgttacgcacgggggccgtgttcttatcccagcatttgctcttggcagagcacaagaactgttacttatccttgatgagtattggtccaagcatccagagctccataagattccaatctactatgcctctccgcttgcgaagaggtgcatgtctgtctaccagacatacatcaactccatgaatgacaggattcggaaccaatttgcgcagtccaatcccttcgttttcaagcatattgagtcattgaatagcatcgagaacttccatgatgtaggtccttcagtggtgatggctagtccaggtggtcttcagagtggcctctctaggcagctttttgataagtggtgcacggataagaagaatgcttgtgttataccaggctatgttgtggaggggacccttgcaaagaccattatcaacgagccaagagaagtgacgctagctaatgggctcactgctcctcttcatatgcaggtccactatatctctttctcagctcatgccgatttccctcagacaagcaattttttggatgaacttcggccacccaatattattcttgtacatggagaagcaaatgaaatgtcgaggctcaaacagaaacttatttctcagtttgatggaacaaacacaaaaattgtgtctcccaagaattgccaatcagtggagatgtatttcacttgcgagaaaatggccaagaccattggcaggctggccgaaaacgtaccggaaggtggagagtcttcgggtggcttacttgtgaaaaaaggattcacatatcagattatggctcctgaagatctccgagtgttcacacagttatccacagctaacatcactcagcgcattgcagttccttattctggttcttttgaagtcataaagtacagactgaatcaaatatatgagagtgtggagtcagcaactgaagaacctgatgttccagcacttattgtgcatgagcgagtgacagttcgcctagactcagaaagctatgttacgctgcaatggtcatctgatcccatcagcgacatggtgtccgattctgtggtgtctatgattttgaacattggccgtgaaggtccaaaagttgttccagttgaagaagcaacgaaggccaaggaagatacggaaagggtagcactaaaggtagtgtattctcttatggcgtcgctttttggtgatgttaaagttggagaggaagggaaatttgtcatatctgtggatggagatgtggcgcacttggatgggaggagtggtgatgttgaatgtgaaaatgctacactgaaggaacggatcaagattgctttccgtcgcatacagggtgctgtgagaccaatcccactttcagcctcttgatctggagctggaggtgccaagatcatgatttagactttgtccaacgtttcgcagcttagcattcatcttcatttggagagcagagcccttttctgtaacagctgttgcgattagttctctgagcttatgtaatctcccctgtaacatcagttgtaacctgtactgctgatttctacttacagttactctgtagtattaacaccccccctcccccctttccatcacttggttgttccaattttccaactgctgtattttgttatgtttcattacaatcttctgaagagaagttgcagctgaa

SEQ ID NO: 2780 - DNA, 2897 bp, Zea mays
ccgagcccgccggccgccgggccatcgcaccacggataaaacccaaaccccttcgccgattcaggaagagggaattccatggcggcctccgccgcggcgccgagcggcgcgccaccggctgggaagcgcccggcctccagcggacgggagggagaccagatggtcatcacgccgctgggcgccggcagcgaagtcggccgttcgtgcgtccacatgaccttcaaggggcgtactgtcctcttcgactgcggcatccacccggcgtacaccggcatggcggcgctgccctacttcgacgagatcgatccgtccgccatagacgtcctcctcatcacccactttcacttggaccacgccgcatcgctgccgtacttcctggagaagactacgtttaagggccgtgtgtttatgactcacgccacaaaggctatttacaagctgctgctctcggattatgtcaaagtcagcaaggtgtccgtggaggatatgctgtttgatgagagtgatattgctcgatccatggagaaaatcgaggttatagatttccaccagacgttggaagttaatgggatacgcttctggtgctacactgctggccatgtacttggtgccgctatgttcatggtggatattgctggcgtgcgcattctttacactggtgactactcccgtgaagaagaccgtcacctacgagctgctgagctcccacagttctccccagacatttgcattatcgagtccacttacggcgtacagcaacatcagccccggattgtacgtgagaagcgctttactgaggtcattcacaataccgtttcacaggggggccgtgttcttatcccggcatttgctctgggcagagcacaagaactgttacttatcctcgatgagtattggtccaaacacccagagctccataagattcctatctattatgcgtcccctcttgccaagaggtgcatggctgtctaccagacatacataaactccatgaatgaaaggataaggaaccagtttgcgcaatccaacccgttccatttcaagcacatcgagtccttgaatagcatcgataacttccacgatgtgggtccatcagtggtgatggctagtccaagtggcctccagagtggtctctccaggcagctttttgataagtggtgcacagataagaggaatgcatgtgttattccaggttacgttgtggaggggacccttgcgaagaccattatcaacgagccaagagaagtggcgctagctaatggcctcactgctcctcttcatatgtcggtccactatatctcgttttcagctcatgctgatttccctcagacaagcaactttctggacgaacttcggcctccaaatattattctcgtgcatggagaagcgaatgaaatgtcgaggcttaagcagaaacttattactcagttcgatggcacaaatacgaaaatcgtgtctcccaagaactgccagtcagtggagatgtatttcacctgtgagaaaatggccaagactatcggcaggctggcagaaaaggtaccagaagctggagagtcttccggtggcctactcgtgaagaagggattcacataccagatcatggctcctgaagatctccgtgtgttcacgcagttatctacagctaacatcatgcagcgcatcgcggtaccttactgtggttcctttgaagtcataaggtacagactggagcagatatacgagagcgtggagccagcggcggaagaatccgatgttccagcgctgatcgtgcacggaagagtgacggttcgcctggactcagaaagctatgtcacgctgcagtggctgtccgaccccatcagcgatatggtgtctgattctgtggtggctatgatcttgaacgtcggtcgtgaaggtcccaaagttgttccggtggaaggagcagtgaagaccaaagaggagacggctcaaaaggtggtgtatgctcttatggcttcacttttcggtgatgttaaagttgtggaggaagggagacttgtcatatctgtggatggaaatgtggcacacttggacgggaggagtggctatgtggaatgtgagaatgctacactgaaggaacggatcaagactgcgttccgccgcatacagggtgccgtgagaccaatcccacttgcctcctcttgatctgaggacagtgattgttgcatttcccagttgaacatagtagcattgtctgtttacattaggactaggataccagtttattttagaaaggacctggtggcccacatgtagaagtggcctggtatgtattgtacatttgtactgcacgctactcgagaggattgttgctctgggacttcctatgtcacatcacttgtaacaacaatgtaattcctaagttgaaccacatcgattgtttttcagtaattttctacttatccatcctgttttgtgttcgtactcgcttgaattcgcaatggtttgctgctgaaatttgttttttgtacgcacgcatcatcagagaatggacacagggaggaggcaagccagcaccttggaagcgaagctgctgctgctcttactctcgtcctcccccgtccccgtcgcctgggacgacggacggcggtgactgcgtatatggtgcatgcacatcaccagccatccattcgtttcattattttgcaatctggacacgattgtccttctaacacattgccggtgatacagagtgtcgttaacagctgattagtttgttcattctattcctgttggtgcaagcatattctccgttagcatagcagtgcgaacaaacaaaacgctggtctgttttagttttaggctgtagcttctcacacagaactgtcatgcagcgagtgaaaaactcatcagccatgccccttttttttcttcttttt

SEQ ID NO: 2781 - DNA, 2389 bp, Panicum virgatum
aaagaaaagaaaacgtaaaaaaaacctagccccacagcagcgaacaagggaaacaatggcatccgtcgccgcgccgaccacctcgctggcgggaaagcgccccacctccggcgcccgggagggcgaccagatggtcatcacgccgctgggcgccggcagcgaggtcggccgctcctgcgtccacatgaccttcaagggccgcaccgtcctcttcgactgcggcatccacccggcctactccggcatggcggcgctgccctacttcgacgagatcgatccctccaccatagacgtcctcctcatcacccactttcacttggaccatgccgcctcgctgccctatttcctcgagaagactacgttcaagggcagggtgtttatgacccatgccacaaaggctatttacaagctgctgcttacggattatgtcaaagtcagcaaagtttccgtggaggatatgctgtataatgagaatgacattgctcgctctatggagaaaattgaggttatcgatttccaccagacattggaagttaatggcatacgtttctggtgctacactgctggccatgtacttggtgccgccatgttcatggtggatatcgctggtgtgcgcattctttacactggtgactactcccgtgaagaagaccgccacctacgagctgctgagctcccacagttctccccagatatttgcattattgagtcgacttatggcatacaacaacatcagcccaggattgtacgcgagaagcgctttactgaggtcatccacaatactgtttcacatgggggtcgtgttcttatcccagcatttgctcttggcagagcacaagaactgttgcttatccttgatgagtattggtccaagcacccagagctccataagattccaatctattatgcctcccctcttgcaaagaggtgcatggctgtctaccagacatacataaactccatgaatgaaaggatacggaaccagtttgcgcagtccaatccctttgttttcaagcatatcgagtccttgaatagcattgagaactttcatgatgtaggtccttcagtggtgatggctagtccaggtggtcttcagagcggtctctctaggcagctttttgataagtggtgcacagataagaagaatgcttgtgttattccaggctatgttgtggaggggacccttgcaaagaccattatcaacgagccaagagaagtgacgctagctaatgggctcactgctcctcttcatatgcaggttcactatatatctttctcagctcatgctgatttccctcagacaagcaactttttggatgaacttcggccacccaacattattcttgtacatggagaagcaaatgaaatgtcaaggcttaaacagaaacttatttctcagtttgatggaacaaacaccaaaattgtttctcccaagaactgccaatcagtggagatgtatttcacttgtgagaaaatggccaagactattggcaggctggcagagaacataccagaaggtggagagtcatcgggtggcttacttgtgaaaaaaggattcacatatcagatcatggctcctgaagatctccgagtgttcacacagttatctacagctaacatcactcaacgcattgcggttccttattctggttcttttgaagtcataaagtacaggctgaagcaatatacgagagcgtggagtcagcaactgaagaatctgatgttccaacacttattgtgcatgaaagagtgacagttcgcctagaatcagaagctatgttacgctacaatggtcatcggatcccattagcgacatggtttctgattctgtggtggctgtggtcttgaacataggccgtgaaggtccaaaacttgttccagttgaagaagcagcgaagaccaaggaagatactgaaagggtagcactaaaggtagtttattctctgatggcgtcactgtttggtgatgttaaagttggagaggaaggggaatttgtcatatccgtcgatggagatgtggcacacttggatgggaggagtggtgatgttgaatgtgaaaatgcaacactgaaagaacggatcaagactgctttccgtcgcatacagggtgctgtgagaccaatcccgatttcagcctcttgatctggaggcgccaagatcatgctttagacttatccaacatctcctagttcaacattcgacttcatttagagagcagaacctttttttttggggagtcaaatgtcttgtaccacagttgttgaaaacactaaatgattagtgctctgagcctgtgactccctctaaaacatgagttgcaacattgtactaatttctcctaacagctactattgctatgttaaccttctttgagaataccttttcttgtt

SEQ ID NO: 2782 - DNA, 2899 bp, Elaeis guineensis
ctcacaagaataacacggcgggagtcatctcctctttcattcgcacgcacaaaaccctagccatcgtctaagcttccctgttcggccgctccaagcctcccacccgatcgggactcgtgaggacagaaaaaccgacggaaaagacctggggaaaacctaaggaaaaatacaacggcttcggacgctgagggcaaggaagggaaggggccacgaggggcagggggagggcggcggtgggagacggggaggaagttgtcggagacgatacaacgggaggttttttaggaaccccgcgcattgcgtgggttataagatagctgaccaacgagggatttcttgcgtatggagatggatttatagcccagctgaccaagatcgcgcctttggcggtttagagatggcgtccgccatgaccggagtccagggctcggcgttgaagaggcgggaatcgacggcgacaagggaaggggatcggctcaccattaccccattgggcgccggcaatgaggtggggcgctcctgtgtctacatgtcctacaaaggcaagaccatcttgttcgactgtggaatccatccagcgtactcggggatggctgccttgccatattttgatgagatcgatccttcaactatcgacgtgcttcttgtgactcactttcaccttgatcatgctgcatcattgccatactttctggagaagactactttcaagggccgggttttcatgacacatgcaactaaggctatttacaggctgcttttgtcagattatgtgaaagtgagcaaagtctctgtcgaggatatgctgtatgatgagcaagatattcttcgttcaatggacaaaattgaggtcattgacttccaccagacacttgaagtgaatggtattcgcttttggtgctacactgctgggcatgttctgggtgctgccatgttcatggttgatattgctggtgttcgggttctctacactggtgactactctcgtgaagaggaccggcatcttcgagctgctgaaattccacagttctcccccgacatctgtatcattgagtccacctatggtgtccagctccaccagccccgcctcatccgagagaagcgctttacagatgtcatccactcaaccatctcccaaggcggccgtgtgcttattcctgcttttgcccttggcagagcccaagaactcctcctcatcctggatgagtactggtctaaccacccagagctccataacattcccatctactatgcctcccctcttgccaagagatgcatggctgtctaccagacctatataaatgccatgaatgaaaggattcggaaccagtttgcaaactcaaacccatttgattttaagcacatttctccattgaagagcatagagaactttgatgatgtgggtccatcagtggttatggcaagtccaagtggcctccagagtgggctttctagacaactgtttgataaatggtgcacagataaaaagaatgcctgtgttattcctgggtatgttgtggaagggacacttgcaaaaaccatcatcaacgagccaaaagaagtcaccctaatgaatggcctcactgctcctcttaacatgcaggtatactacatctccttctctgctcacgcagactttgcacagacgagcaccttcttgaaggagctcatgcctcccaatataattcttgtacatggagaagccaacgaaatggcaaggcttaagcagaagcttataacccaattcgctgatgggaatactaagatcatttcccccaagaactgccagtcagtggagatgtattttagttccgaaaaaatggccaaaacaattggaaggctggctgaaaagacaccagaagttggggaaacagtcagcggcttactggtcaagaagggctttacatatcagataatggcaccagatgatctccatgtcttctcacagctgtccacagcgaacatcacgcagaggatctccatcccttattctggtgcttttggagttataaagcataggttgaagcagatatatgagagtgtggagtccccatcagaggagcctgacgtaccaacattgactgtgcatgaaagggtgacaataaggcaggagtcagagaactatgtgacattgcagtggtcatcggaccccataagtgacatggtttcggactctgtagtagctatgatcttgaatatcagccgagaaggtcccaaggtgacagcagttgtggaggccaacaagacggaggaggaaacagagaagatggcacagaaggtaatatatgctctttttgtatccttgtttggagatgtcaagattgcagaggaaggaaaactggtcgtgactgttgatggggatgtggcacgcctggatggcaagaacggtgaagtagaatgtgagaatgaggggttgaaggagagagtaaagacagcattcagacggatacaaagtgcagtgagaccaatcccactgtcagcatcttgagctgtgtagaactacagtatatttgctattgaactctgatgacttttcggtgttatgcctcacataagtagttagcaagaggccttgacttcaaggggattgttgtttattaaaaacttttcagtacctgtaatcattaaattaacataacaagttttatttttgaaatttggatgcagccaagttccatgtcatatttagatggatgagggtaatgttgtagacatattaatgtcattgaaattaatgtctcttatgcatcttctaacgaaattcatgcaggggtgttatgtcataattcgaatttagatctttatgaatgactttaactgcagatttcttttatgcactgagttgtaatttgagtatgactatgcaattgtttcgaagttgtcagtcggacaaaaaaaa

SEQ ID NO: 2783 - DNA, 2410 bp, Triticum aestivum
cgcacagtcctattcgactgcggcatccacccggcatacctcggcatggcgtcgctgcccttcttcgacgagatcgaccccgccgccgtcgacgtcctcctcatcacgcacttccacctggaccacgccgcctcgctgccatacttcctggagaagacgacgttcaagggccgcgtgttcatgacccacgccaccaaggccatctacaggctgctgctctcggattacgtcaaggtcagcaaggtgtcggcggagaacatgctgtttgacgagcaggacatcatcagctcaatggaaaaaattgaggtcatagacttccaccagacactggaagttaatggcatacgcttctggtgctatactgctgggcatgtacttggagctgccatgttcatggtggatattgctggcgttcgcattctttacactggtgactatcccgtgacaggcacctgaaagctgctgagatcccccagttctcccctgatatttgcattatcgagtcaacttacggtgtgcagcgacaccaaccccgccatgtcagagagaagcgcttcactgatgccatccacaacattgtttctcaagggggccgtgttcttatcccagcatttgctcttggtagagcacaggagctgctgcttatcctagatgagtattggtccaaccacccagagctccataagattccaatctattacgcctcccctcttgcgaagaagtgtatggctgtctaccagacatacataaactccatgaatgacaggatccgcaaccagtttgcacggtccaatcccttccatttcaagcatattgaccctttgagtagcatagacaacttccatgatgttggtccgtcagtggtgatggcaagtccaggtagcctccaaagtggcctctccaggcagctctttgacaagtggtgcacagataagaagaacacatgtgttattccaggttatgctgttgctggctcccttgcaaaggagatcatcactgagccgagaaaagtgcagctagcaaatgggctcactgctcctctcaacatgcagatcttctacatctccttttcagctcacgcggatttcccacagacgagcggcttcctgggcgagcttcgaccagccaacatcattcttgtacacggggaagcaaatgagatggggaggctcagacagaagctgatcactcagttcgagggaacagacacacagatcgtgtctcccaagaactgccaaccagtgcagctgtttttcagctctgacaagatggccaaggcaattggcagattggcagaaaaggtgccagaagtgggggattctgtcagtggcttgcttgtgaagaagggcttcacgtaccagattatggctcctgaggacctccgggtgcacacacagctatctaccaccaacattacccagcggctcgctgtcccgtattgtggttcttttgaagtcatcaagtacagactgaggcaaatatacgagagcgtggaatcatcaaccgacgaagccgatgttccaacactgattgttcatgagagggtgaccatccgcctggattcagagagctacgtgacgctacagtggtcctctgatcccataagcgacatggtgtctgattccgtggtggctatgatcttgaacatagggcgtgagggaccaaaggccgttccaatggaagaggaaacagagatggtggcgcagaaggtggtgtacgctctcatggtgtcggtcttcggcgacgttcaagtggcgggggaagggaagcttgttataactgtggatggggatgtcgcgcacttggatgggaggagcggtgacgttgagtgcgcgaacgcagcgctgaaagggaggatcgagaccgcgttccatcgcattcagggtgctgtgagaccaatcccgctgtcggcctcctgaggtgaagccatgatgtaggatgcttttaacatggtgactgtttcctaggtgattaaacagggcagcaggtcgtgttagatttagaacatgagttgtatagcattgtaggcaatttctagtggttatctgaacagtcctctcacttgcagtaactttgagctgagctgaagttgcagtgcagctgagctgagcttctccttttgtctttccgtgtgtccgctcatctcatcagtttctggtattggtgttatccctctgtaaaggaatataacaacattagtgatctaaacgctcttatatttctttacggaaggagtacttgagaaagaaggtgaagagcattcagtgaagccagatctgttctcgattacttcattttctctgcgcagaaaaatagtttgagaattactacttgattcctcggtatatggttattacaatttttgggtggtcttggtcatgctgctgctttcaacgtcgttcactttgtt

SEQ ID NO: 2784 - DNA, 2419 bp, Secale cereale
tcggccgctcctgcgtccacatgtccttcaagggccgcaccgtcctcttcgactgcggcatccacccggcctactccggcatggcggcgctgccctacttcgacgagatcgacccctccgccatcgacgtcctcctggtcacccacttccacttggaccacgccgcctcgctgccctacttcctcgagaagacgacgttcaagggccgtgtgttcatcgacccacgccaccaaggccatctacaggctgctgctctcggattacgtcaaggtcagcaaggtttccgtggaggacatgctgtttgacgagcaggacatcatccgttccatggacaagatcgaggtcatagacttccaccagacattggaagttaatggcatacgcttctggtgctatactgctggtcatgtacttggtgctgccatgttcatggtggatattgctggtgttcgcattctttacaccggtgactactcccgtgaagaagaccgtcacctcaaagctgctgagataccccagttctcccctgatatttgcattattgagtcaacttacggtgtacagcaacaccaaccccgccatgtcagagagaagcgtttcactgatgccatccacaacacagtttctcaaggggggcgtgttcttattccagcatttgctcttggtagggcacaggaactgttgcttatcctggatgagtattggtctaaccacccagagctccacaagattccaatctattatgcctcccctctggcgaagaagtgtatggctgtctaccagacatacataaactcgatgaatgaaaggataaggaatcagtttgcacagtccaatcccttccatttcaagcatattgaccctttgaatagcattgacaacttccatgatgtgggtccgtcagtggtgatggcaagtccaggtagcctccaaagtggcctctccaggcagctctttgacaagtggtgcacagataagaagaacacatgtgttattccaggttatgctgtggaaggctcgcttgcaaagaccatcatcaacgaaccgagagaagtgacactagcaaatgggctcactgctcctcttaatatgcagatcttctacatctccttctcagctcacgctgatttcccccagacgagcggcttcttggaagagcttcgcccacccaacattattcttgtacacggagaagcaaatgagatgggcaggcttaagcaaaaacttatctctcagtttgatgggacaaacacaaaaatagtgtctcccaagaactgccaatctgtagagatgtattttagttcagagaaaatggccaagacaattggcagactggcagagaaggtgccagagttgggagaagcagtgagcggcttgcttgtgaagaagggcttcacataccagattatggcccctgaggatctccgcgtgtacacacagctgtccactgccaacattactcagcggattgcagtcccgtattctggttcttttgaggtgatcaagtacagactgaagcaaatatacgagagcgtggagtcatcaaccgaagaagatgttccaatactgactgttcacgagagggtggccatccgcctggattcagagagctacgtgacactgcagtggtcctctgatcccataagcgacatggtgtccgactcggtggtggccatgatcttgaacattggccgcgagggtccgaaggttgttccgatcgaagaagcggtgaagacggaagaagaaacagagaagatggcgcggaaggtggtctactctctgatggtatcgctcttcggcgacgtcaaagttgcagaggaagggaagcttgttataactgtggatggagacatcgcgcacttggatggcaggagcggtgatgtcgagtgcgagaacgctgggctgaaagagaggatcaagacggcgttccggcgcatacagggtgcggtgaggccgatcccgctttcggcctcctgagctgaagccatgagaatgcctttaacttttcctagggctcgtgattgaacaaagcactagcaggccgtgttacgtgttgttacgcggccattttaaccttgagcgaaatgtaattctactgcctgttgtgctttactggatcctggatgatgggtagtccctagaagttaagttatctgaacaatcctcgaacttgcactgaatttgagctgctgtgctttgttagatgatcaggtaggcccgttttactgcctctggaacatgatccgagttgtagcattgtggacaatttgtagaagttatgtgaacaatcctctcatttgcagtagtaaatttgagctgaagttgcagacgaaacaaaaaaaaaaaaaaaaaaaaagaaaaaaaacaaaaaaagagaactagacaacgaacgacaacgaagggaaggtagagacccccc

SEQ ID NO: 2785 - DNA, 2579 bp, Musa acuminata
aagaagagttggtgttcttgcgtcgtcctcgctgtgatcgagcggccgggagggatggcatccgccatgaccggccagacttcgtctctcaagcggcgggatacaacggccgcgacggcggggccgagggagggggatcagcttatcgtcaccccgttgggggcgggcagtgaggtgggcaggtcctgcgtctacatgtcctacagaggaaagatcgtcttgtttgattgtgggattcatccggcctactctgggatggctgcactgccttatttcgacgagattgatccctcgactattgatgtgcttctcgtcacacattttcatcttgatcatgctgcatcgcttccatacttcttggaaaagactacgtttaaaggtcgggttttcatgactcatgctacaaaggctatttacaagcttcttttgtcggactatgtcaaagtgagcaaagtttcagttgaggatatgctctatgatgagcaagacatacttcgcacgatggataaaattgaggttattgattttcatcagactgtggaagtaaatgggattcgcttttggtgctacactgctggtcatgtcctaggcgctgccatgttcatggttgacattgctggtgtccgggtgctctacactggagactactcccgtgaggaagatcgccatctccgtgctgctgaaatcccccagttctcaccggacatctgtatcattgagtccacatatggcgtgcagctccaccagccccgccttatacgggagaaacgatttacggatgtcatccactcgacaatctctcaaggcggtcgtgtgctcatccctgcttttgctcttggcagagcccaagagttgctccttatccttgatgagtattggtcgaaccaccctgagttccataacattccgatatattatgcctctccccttgccaaaaggtgcatggctgtctatcagacctacataaatgcaatgaatgagaggatcaggaaccaatttgcaaattcgaacccctttgacttcaagcacatttctccattgaagagcatagagaattttgatgatgttggtccctcagttgtgatggcaagtccaggtagcttacaaagtggtctctcgaggcaactatttgataaatggtgctcagataagaaaaatgcttgtgtgcttcctgggtatgtagtggagggtactctcgccaaaactatcctcaatgagcccaaagaagtcaccctcatgaatggtctcactgctcctcttaacatgcaagtatactacaactctttttcagctcatgcagactttgcacagacaagtgcttttttaaatgagcttatgccaccaaacataattcttgtacatggagaagccaatgagatgggaaggcttaagcagaagcttataggccaatttgcggataaaaatacaaaaatcatgacacctaagaattgccaatcagtagagttgtacttcacttctgagaagatggctaaaactattggaaggctagctgagaagacaccagaagtaggagaaacagttagtggcttacttgtcaagaagggttttacatatcagataatggcaccggatgatcttcatgtcttctctcagctttctactgcaaacattacccagaggatatccatcccttattctggtgctttttcagttataaagcataggctgaagcaaatatatgaaagcgttgaggctcctatagaagagcctgatgtacctacattgattgtgcatgacagagtgacaatacggcaggaaacggagaaatatgtgacaatgcagtggccatctgacccaattagcgatatggtatctgactctgtggttgctatgatcttgaacatcagccgagaaggtccaaaggtaacagctgttgcagaagctgagaagacacaagaagagatggagaaaatggcccataaagtcatctacagtttactggtttccctttttggggacgtcaaggttggagaggaaggaaagttgattgtcactgttgatggggacgtcgcacggctggatggaaagaatggtgaagtagagtgtgataacgagggtttaaaggagagggtgaaaacagcattccggcggatccagagtgctgtgaggcctatcccactttcagcatcctgattcatcttgttaaggaatgacggttcaaaggagagggtggaaacagcatttcggcggatagagtactgtgaggcctatcccactttcagcatcctgatgcatattgtcaaagaaactctgagctcaccatgttccgtgcaatagtctcagatgtactgttagaatccatcctgatgcatattgtcaaagaaactctgagctgaccatgttccgtgcaatagtctcagatatactgttagaatccattatcgttattgtaacattattgtttctgagtttccttatatgacatttgacagtatttttcatcgtcgctaaccttttggttgttgtatgtggatgacctcttgttggatgttggttgcatgtggatgatgattgatagaaaattttgcacctgttgctttgtatgtacccgaaggggt

SEQ ID NO: 2786 - DNA, 2710 bp, Phalaenopsis aphrodite
cttttgggccgcgatgcttctagcgtcccgttccccttgttgctagggttttcagggtaatcgattgtccgcagacgtaaattgtcggttttggaactgcccccttactacagaactacagaagttacccctggagccgagccatctcattttggaattcgctaaatggcttccggcgtcacttcccatgcttcggctttgaagagaaaggattcggcaccgacgagggagggagaccagttgatcataacgccgttgggcgccggtaatgaagtggggcgctcctgcgtgtatatgtcatatagaggaaagacagttttgtttgattgtggaatacacccggcgtactccgggatggccgcacttccatattttgacgagattgatccttcaaccattgatatacttctcgttacacactttcatcttgatcatgctgcatcccttccatatttcctagagaagaccactttcaagggaagagttttcatgactcatgcaacaaaggctatatacagactgcttttgtccgactatgttaaagtgagcaaagtttcagttgaggatatgctgtatgatgagcaagacatacttcgttccatggataaaatcgaggttattgacttccaccagacggtagaagtgaatggaatcgtttttggtgctacacagctggtcatgtccttggagctgccatgttcatggtggacattgctggcgtcagagttctttatactggtgactattctcgtgaagaagaccgccatctccgtgctgctgaaatcccacaattctctcctgatatatgcatcatagaatccacctatggcgtgcagctccaccagccccgtgttattcgagagaaacgcttcacagatgtgatccattcaactatctctcagggaggacgagtgcttattccggcatttgcccttgggagagcccaggagctcctcctcatcttggatgaatactggtccaaccatcctgaacttcacaacatccccatctattatgcctccccgcttgctaagagatgcatggctgtttaccagacgtacatcaatgcaatgaatgagaggatacggaaccaatttgcaaactcaaatccctttgatttcaagcacatctctcctttgaaaagcatagaaaactttgatgatgtcggtccgtcagtggtgatggcgagcccaggtggtctccaaagtggtctctctagacagctttttgacaggtggtgtacagataagaaaaatgcttgtgtcctgccaggttatgttgtggaagggacacttgcaaagatcataattaatgaaccaaaagaggtgaccttaattaatggcctcactgctcctctaaatatgcaggtatattacatctccttctcagctcatgcagatttcgcgcagacaagtaccttcttgaaggaacttatgcctcccaacataattcttgtccatggagaagccaatgagatggccaggctgaagcagaagctcatcactcaatttgctgatcaaaatacaaagataatatccccaaagaattgccagtccgttgagatgtacttcagctctgagaaaatggccaaggcaataggaaggctggctgaaaggacgccagaagttggcagtactgtcaacggattgctggttaagaaaggcttcacttaccagattatggcatctgaagacctccatgttttctctcagctgtccactgcaaacatcactcaaaggatctctgttccttatactggtgcttttggagtcataaaacacagattaaatcggatatatgaaagtgtggtgtccccacaagaggaggcagacgtgccaacaattattgttcatgagagagtaaccataagacatgagtcggagagtcttgtgagtctgcagtggacttctgatccgatcagtgatatggtatcggattctgttgtggccttaatcttgaacataaacagggaaggtcctaaagtaattatgcctgcggtggagaacaacaacaacaacaacaagggggaggaggagacagaaaggatggcgcagaaggtgacatttgctttgctggtatccctttttggtgatgtgaaggttggggaagaagggaagctggtggtcacggttgatggggatgttgctcgtttggatgggaagaacggtgatgttgaatgtgataatgaggctctcaaggacagggtgagaacagcatttcaacgcattcaaagtgccgtgaggccgatcccgctatccgcatcttgatctacaaagaaatttattttattatatatgttaactggaaactgaaacttgttaaccagcagatagtttcatttttgttccttgagcactttggttgttagtgaaggaactgcgagtcatgtcgtggcaacatatatcatgttcaaagcaccgagactcaaaaaaaagggggaaattgtttttccatactaatcaatctcttatgcgataccagttgattgagagattgagaacagcgtttcagtttttctcagctgacgagcagctccagctgcctctaacagcatatttgtatttctgagggttgtcctctgttttcattaaactccctgaaccaagtagtttttgttgcctcatttttaagctttacttctttcggttatctcggatttttatgctgttcttgatttttctaaaacctaaatacccaaagtctgatattt

SEQ ID NO: 2787 - DNA, 2798 bp, Vitis vinifera
ctcacatccagaccggctattccggaccgggttttggctatctttcagagggtgaggcaaagagggaagcatctactcaaaattagggttttagttcactctcttcctctgcattgtctaaaatcatttcaaaactaaactcgtgggaaatgcaaccaattgcagagcattttgcatgaatatagagtggtgttaattgaaggggtctgagcattgttcagttgaagaatggcttctacagggccaccacagtctttgaagagaccagattcctcattaacaagagaaggagaccagctgattattacccctctaggtgctggaaatgaagtgggccgttcctgtgtctacatgtcctataaagggaaaaccatattgtttgactgtggaattcatcccgcatactcgggcatggctgctttgccatactttgatgagattgatccttcgaccattgatgtccttttggtgacacactttcacttggatcatgctgcatcccttccatatttcctggagaagaccacattcaaagggcgagtttttatgactcatgcaaccaaggctatctacaagttgcttttgtctgattatgtaaaagtgagcaaagtttcagttgaagatatgttgtatgatgaacaagacattcttcgctccatggataaaattgaggttattgatttccatcagactttagaagtaaatggcatacgattttggtgttatacagctggccacgtccttggtgctgccatgtttatggttgatattgctggtgtccgagtactttacactggagactattctcgtgaagaagatcgtcatctccgtgctgctgagatcccacagttctcccctgatatttgcataattgaatccacttatggtgtccaactccatcagcctcggcatgtgcgagaaaagcgcttcacagatgtcatccactcaaccatttctcaagggggccgtgttctaatccctgcatttgctctaggtcgtgcccaagaactcctccttatccttgatgagtattggtctaaccatcctgagctccataacatccccatatattatgcttccccccttgcaaaaaggtgcatggctgtttaccagacatacatcaattccatgaatgagaggatccgcaaccaatttgcaaattcgaatccttttgatttcaagcacatatcacctttaaagagcattgagaattttaatgatgtaggtccatcagtggtgatggcgagtccgagtgggcttcagagtgggttgtcaagacaactgtttgatatgtggtgctctgataagaaaaatgcatgtgttatacctgggtatgtcgtggaagggacattggcaaaaaccatcatcaatgaacccaaggaagttactctaatgaatggtcttactgctcccctcaacatgcaggtgcattacatttctttctctgctcatgcagattttgcacagacaagtacattcttgaaggagctcatgccacctaacatcattcttgtccatggagaagctaatgagatggggaggctcaaacagaagcttatcacccagtttgctgaccgcaacaccaaaattatttccccaaagaactgtcagtcagttgaaatgtatttcaactctgagaaaatggcaaaaaccattgggaggctggctgaaaagaccccaggagttggtgaaactgtcagtggtttactggtaaagaaaggtttcacttatcagataatggcacctgatgatctccatgtcttctcgcagctatccacggcaaatgtcactcagaggattactattccttacactggtgcctttggtgtaataaagcacaggctgaagcagatatatgagagtgtggagtcattgccagatgaagaatctgaggttccagcttttcgagtccatgaacgggtgacagtgaagcatgagtcggagaagcatatttcactgcattggacatcagatcctattagtgacatggtctctgattccattgtggctctggttttaaatatcagtcgtgagatccccaaggtagtagttgaatcagaggccataaaaactgaagaagaaaacgggaagaaagcagaaaaggttatccatgcactccttgtttctctttttggagatgtgaagttgggagagaatgggaacctggtgataagcgttgatggaaatgtggcacatcttgataaacagagtgggaatgttgagagtgaaaacgaaggccttaaggaaagggtgagagtagcattccagcggatccaaaatgctgtgaagccaatccctctatctgtgtcttagctccttccctcaggttttctctgtattttcaacttcttcctagttaattctgaattttgagattaaagttccatatgaatcaatatttcttacactaattagtctgcttattttaggaaaatattgaatattgatccacctcagtcccaagcaagatcacatacatcaactttttcttcgttgtaccttttatttggtaatgctcgagagattttcctctctgatttttgcgattcgtctgagcttcacaaatgcattaatcttgttgaacagcgttatatccccagaaattatggttttcaatgcataacttgaatgtttcattggtgaagcatgtaaataatgtttttgttttcctaggttgtgttattgtttgatgctaattctagatctagtgatgagtggtctccttctagttaagatgagacttgagcctgttagtaattttctcaccaacctttgattaaaatggagcttttgtgagc

SEQ ID NO: 2788 - DNA, 2134 bp, Secale cereale
cgcggacacggacgggcatggctcggcatgccgtcctgttgaccgtggccaccgtcgccgtgctcctcgcgcgccgagccgccgccgagtacccatggccagtctgcagcagcaccggcagcttcgcggccaacgacaccacctacctgtcgagcatcaacgccatcgccgccaccctcccgaggaacgcctcggcgtccccgggcggcctctacgccacggcgcgggccggccaggtcagggccctcgggctctgccgcggcgacgccagcgccaccgcctgctccgactgcctcgcccaggggttccaggacctgcccagcgcctgcgcctacagcaaggaggccaccatgtactacgacccctgcttcctccactactccgacgccgactcgcgcgcctccgacgacaccgccttgggctcggcgttcagcaccgcctacagcgcgaacgccacggcggagccggcccggttccaccgcgtcgtggccgcgctcctcaacgccaccgcggactacgccgcctacaactcctccgcgacgcggctgtacgcgtccggggctgtcccctttgaccgggagatccccgaggtgtacagctgggcgcagtgcacgccggacctcacgccggcgcgctgccgggattgcctcgccaacatgatccaggagttggggacgccgctgtacagcgtcggggccagggttcttgggatcaggtgcggcgtccggtacgagaacaggcccttccttgatggcccggtgttgctgcgcctaccagcaactggagctccggcgccgtcgccgacgccagcaccagccccggcgccggatgtggtgcccaatgttgtcacgccggtggctgcggtcggaggagggagaaagtacagtgttcctggcatggttcttatagttgtgctgcctagtctagcagccgcaaaccttctcgccggcttatttatatggaggaggaggcggcgatcaccagcacaaggaaagcagccatattctagttactccaccgaagctaaggacactgagagtgtagactcgatgctgatggacatttcaactctgcgagctgccaccggggactttgcagaaagcaacaagctcggcgaaggaggcttcggcgcggtgtacaagggtactctgccagacggggaagagatagcggtgaagagattgtccaagagctcgacgcaaggagtagaggagctcaagaacgagctcgccctggtcgctaagctcaagcacaagaatctcgtcaggcttgtcggcgtgtgcctggagcagcaagagcggctgcttgtctacgagttcatccccaaccggagtctggaccagatactttttgaccccgagaaacaagaccagcttgactggggaaagaggcagaggatcatacgtgggatcgctcgaggcttgcagtacctccatgaagactcccagctcaaggtcgtccatcgtgatctcaaagccagcaacgtgcttctcgacgccgacatgaaccccaagatctcggactttggcctcgcgaggctcttcgggcgaggccagacgcagggtgtaaccaaccgtgtcatcggcacatacggatacatggcaccggagtacttgatgcgtgggaactactccgtgaaatcggatgtgttcagcttcggggtaatggttctggagatcgtcacgggcaggaagaacagtgacatgtcgcaatctgaagatctgttgaccacgatctgggagcattggtcggctagaacgctgctggagatgatggatccgtgtatgaacaacatcttctcggagagcgatgcaaggaggtgcatccaggtagggctgttgtgcgtccaggagaacccggtggacaggccggtgatgtctgcggtgggcatgatgcttggaagcgacacggtgtctttaggtgccccgtcaaagccagcgcctacattttacgctagaaaccctagtgccgactccggaaacgggttcagtatctcgactatttcactgaatgatgatcccaaggatcattatagtatgacttaaatattggattgtgcatctttctttaggagtttgatcttttggattagctagtttggttgtacatctaaaattcaacatatactatcttt

SEQ ID NO: 2789 - DNA, 2343 bp, Secale cereale
taccgactgtcgtaggcgggcccgacgatgatgagcaccggccaggtcgctctcactgctactactaatacattttagttctaatcaatacacatttccctacgttaaacgtacctagcccacctcgtggaagttaaaattagtagacaaacgaacgtctagtttcctaactgacaaattaattgagttagtcgtataacgcggacacggacgggcatggctcggcatgccgtcctgttgaccgtggccatcgtcgccgtgctcctcgcgcgccgagccgccgccgagtacccatggccagtctgcggcagcaccggcagcttcgcggccaacgacagcacgtacctggcgagcatcagcgccatcgccgccaccctcccgaggaacgcctcggcgtccccgggcggcctctacgccacggcgcgggccggccaggtgagggccgtcgggctctgccgcggcgacgccaacgccaccgcctgctccgactgcctcgcccaggggttccaggacctgcccagcgcctgcgcctacagcaaggaggccaccatgtactacgacccctgcttcctccactactccgacgccgactcgcgcgcctccgacgacaccgccttgggctcggcgttcagcaccgcctacagcgcgaacgccacggcggagccggcccggttccaccgcgtcgtggccgcgctcctcaacgccaccgcggactacgccgcctacaactcctccgcgacgcggctgtacgcgtccggggctgtcccctttgaccgggagatccccgaggtgtacagctgggcgcagtgcacgccggacctcacgccggcgcgctgccgggattgcctcgccaacatgatccaggagttggggacgccgctgtacagcgtcggggccagggttcttgggatcagatgcggcgtccggtacgagaacaggcccttccttgatggcccggtgttgctgcacctaccagcaattggagctccggcgccatcgcctacgccagcacctgcgccggcgccggatgtggtgcccaatgttgtcacgccggtggctgcggtcggaggagggagaaagtacagtgttcctggcatggttcttatagttgtgctgcctagtctagcagccgcaaaccttctcgtcggcttatttatttggaggaggaggcggcgatcaccagcacaagcaaagaaaccatattctagttactccaccgaagctaaggacactgagagtgtagactcgatgctgatggacatttcaactctgcgagctgccaccggggactttgcagaaagcaacaagctcggcgaaggaggcttcggtgcggtgtacaagggtactctaccagatggggaagagatagcggtgaagagattgtccagaagctcgacgcaaggagtagaggagctcaagaacgagctcgccctggtcgctaagctcaagcacaagaatcttgtcaggcttgtcggcgtgtgcctggagcagcaggagcggctgcttatctacgagttcatccccaaccggagcctcgaccagatactttttgaccctgagaaacaagaccagcttgactggggaaagaggcagaggatcatacgtgggatcgctcgaggcttgcagtacctccatgaggactcccagctcaaggtcgtccatcgtgatctcaaagccagcaacgtgcttctcgacgccgacatgaaccccaagatctcggactttggcctcgcgaggctcttcgggcgaggccagacgcagggtgtaaccaaccgtgtcatcggcacatacggatacatggcaccggagtacttgatgcgtgggaactactccgtgaaatccgatgtgttcagcttcggggtaatggttctggagatccttacgggcaggaagaacagtgacatgtcgcaatctgaagatttgttgaccacgatctgggagcattggtcggctagaacgctgctggagatgatggatccgtgtatgaacaacatcttctcagagagcgatgcaaggaggtgcatccagatagggctgttgtgcgtccaggagaacccggtggacaggccggtgatgtctgtggtgggcatgatgcttggaagcgacacggtgtctttaggtgccccgtcaaagccagcgcctacattttacgctagaaaccctagtgccgactccggaaacgggttcagtatctcgactatttcactgaatgatgatcccaaggatcattatagtatgacttaaatattggattgtgcatctttctttaggagtttgatcttttggattagctagtttggttgtacatctaaaattcaacatatactatcttttgattgcgaa

SEQ ID NO: 2790 - DNA, 1737 bp, Triticum aestivum
attcggcacgagggttagtatccccccaaattcacgaccttccctcccctcccccaaatcaatcaagctccggctcgctcggccccagatcgtaccgtgaggatggcgggggcggaggcggtggagagggcgcacgagctctaccggggcggccgccaccgggaggcgctcgagctctactcggcggcgctggcggcggcgcggggccccgcgcagcgcatcgccctgcacagcaaccgcgccgcctgctacctcaagctccacgacttccacaaggccgcagaagagtgcacatctgtcctcgagttggataccgagcatgctggagctctcatgctacgtgcccagactcttgtcactctaaaagattaccagtcggctctatttgatgtaaaccggctaattgagataaatccatcctctgaagtatatcggaaccttcatgcgcgactgaagacacagctgtcgctagccccgattccagagtctgaagaggagtccctgtatactgaagaagacaaagaagatctgccaccaaaagacaatacaaagaatgagactgtcgttgttaagtctgatcaaccttctgcaaaagtgattcttgaaaataaacctgtaacaaaagctctgaaggttgaagtgcctcccaatctgccttcaaaacccgagggtggggggaccatacaaaaaccaaagggccattcagagcttgattacaaggaacctttaacggaagctccaaaggttcaagtgtctcccagtctgccttcaaaacccgagtgtcgggggaccatccaaaaaccgaagggccattcagggcttgattactcgaaatgggacaaagttgaggatgattcgagtgaagatgacgaggatgatgacgaagatgacttgcctcggtataaattcaaagtcagaaccatcggtgtgcgtaccgtgaagtgaatgggatcatcaataaataagtttactccatggtctgtggatagccgtttgacagcatccctactaactttggtcccatctgttcggttacatcttgaaatactccctcggttcctaaatataagtctgtttaaaggttccaatatggaccacatacggagcaaaatgagtgaaaatatgtctatacattcgtatgcagtctatattgaaatctctaaaaaaacttatatctgggaatggagggagcatacttggatgaagtgttgccgattggtgtttgtttaactcaagctcaccggcgggtgaagacataagtacccgctgctctcgcctcgtgcgctgcagctcaggtttctggatctggaaccttagcagaggaaacaagtctggagtgaaatcatgttttcagcgcaaccgtgggatggagcacagcatgcaaatcctgtagggaacccctttagattcaagctaacaatcttagtccgtagattgcagtctctgtacatagattgcgcattcatcgtgtataaaaagcttatttgtgtctgccccaagacattgtctcacgatttcagtcagcaaatttgatgctaatatttcatgatccaaccaataccggttccttttttgctcaactgcgatgaatgtgctgattagtcgcactcacactgtaattagaaaagtttctgccatgctaccgcattgatacccggatattatgaataaatgctatgatttgatttgactaaaatcatccataccaaaacttccatgtcatgaccagaaccgcac

SEQ ID NO: 2791 - DNA, 2802 bp, Secale cereale
tcagcaatgggtgacggagaggcaggcagctactagtcctcattatttgaccaccttcccttcgctgccacctcctgccctgcccgttctctctccctcctctcatccaccattcctcttccccccagcataaacacagctcagcaggccccatctccatcccattgcctctctccccctccgcgccggggcttaaatccagcacggcgattgcctcgtattattattcccgaggactccttggttcttgctgcgtcgttccagggacagggtggtggtgccgttcttggagcgctgttcccgggctgctgcttgcggtcagggtggtgttcaccggcggcgaggcaatggggagcggccgtgcctgctccgttgtcgcgtccgtcgtgctgctctggctgggcgtggccgctgcgcagggcgactccccttggaagacgcttagcggcaaagctccggcgatcatagccaagggtgggttttcaggcttattcccggactcgagcgaatttgcttaccagttcgcgatgattgcgagctcgcccgatacagtcctatattgtgatgtccggctgaccaaggatggccttggcgtctgcctaccggagattaagatggacaactgcaccaacattccagatttctatcccaagggtaagaagagttaccttgtcaatggcgtatcgacaacgggatggttctccgtggactacaatggcaccgagctctcgcaagtgtctttgaagcagtcaatcttctctcgcacgccgaggtttgatccaagcttctttccattgctcgctgtcgaagatgtggcatccaagtttaagcctcctggaatgtggctcaatatccagcatgatggtttctacagccagttcaatatgagcatgaggaagtacatcctttctgtgtcaagacgtgttattgtcgactacatctcatcacctgaagcaagcttcctcaccagcatcagtggaagggttagcaacaacacaaagctcgtgttccgctttcttgacgaagccactcttgagccatctaccaaagagacatatggttccatgttgaaaaaccttacattcatcaagacatttgcatctgggatacttgtcccaaagaagtacatctggcctgtttcaccagataattatctgcaaccatacacttcgatcgtcgatgatgctcataaagcggggctggaaatttatgctgctgattttgccaacgactttgtgctcagttacaaccatagctacgatccattagctgaatctctctcgttcattgataatggtgcattttctgttgatggcatattgactgatttccctgttacgccttcagaagccattggctgttttgcgaatttgaacaaaagcaacacagatcatgggaaacctctaattatttctcacaatggtgccagtggagattacccaggctgcaccgatctagcttatcagaaagcagtcgatgatggtgcagatgtcattgattgccctgtgcaagtgaccaaagacggcataccagtatgcatgggatccattaacttaatggatagtactactgttgcaaaatcaccatttgcgtcccaggcagcagtaatgaaagatattgagagtgtcctaggagtctttactttcaacctcacttgggatgacatcgtgaagaatctaaaacccaaaatatctaccccacttagcaccttcagtttggacagaaatccaaggtacaggaatgcagggaatttcatgagattatcggactttctagacttttcaaaagacaaggatttatcaggaatcatgattagcatagagcatgctgcttttctagcagaggaactcggatttgacatggtagatgcggttattaaagcgcttgacgactccggctacagcaagcaaactgctcaaaaagttatgatccagtcaaccaacagctcggttctggtgaagttgaagcagcaaacaaagtacgaccttgtgtacatgatcaacgaagatgtcagtgatgctgcgccttcctccctcgcgggcattaaaaagtttgccgatgccgtttctgtggaaaccagctctgttttccctgaaaaccgccatttcacgtcgcaccagacagaccttgtcgagtccctgcagaccgccgggctctcagtctacgcctacactctcatgaacgagtttgttgctcagccgtacgacttcttctcggatgcgaccgcggagatcattgcctatgttcagggtgccggagtggatgggctgatcaccgacttcccggcgacggcccggagatacaaatcgaacacttgcatgaacatggggaacaaaactccgagcttcatggcccctcctaggcctggtgatctgctgcagctcatcagtaagccggcgcaaccaccggcactagccccgatgccgctgctaatggattccgacgtgtcagagccgcccctaccgcccgcaagattgaacaatgctactacggctccagcaccttcgtctgcacgcaggatgcagactcgtatcccgttcctcgtcaccttagcgatgctttgcgcctgggccacggtctgaggtcgcaatgccacatgacacgctagaggtctgccggtctactaatacaatgttctttcccctccctcggtaattcgtttgttcttgtaatttttgtggtgcggggtttatatacggatgcccctatggcactcagtccctagtgattatcagtacatatgtgttggaatatatcctcttatgttctggaccgagttctcaacaatctgaatttctgagg

SEQ ID NO: 2792 - DNA, 2599 bp, Triticum aestivum
cgttcttagagtgctgttcccgggctgctgcttgcggccagccgtcccgtcagggtggtgttcgccggcggcgaggcaatggggagcggccgtgtctgctccgttgtcgcgtccgtcgtcttgctctggctgggcgtggccgctgcgcagggtgactctccttggaagacgcttagcggcaatgctccggcgatcatagccaagggtggattttcaggcctattccctgactcaagtgaattcgcttaccagttcgcgatgattgctagctcgcccgatacaatcctgtactgtgatgtccggctgacaaaggatggccttggcgtctgcctaccggacattaagatggacaactgcaccaacattccagatttctatcctaagggtaagaagagctaccttgttaatggcgtatcgacaaccggatggttctccgtggactacaacggcaccgagctctcgcaagtgtctttgaagcagtcaatcttctctcgcacgcccaggtttgatccaagcttcttcccattgcttgccgttgaagacgtggcatcaaagtttaagcctcctggaatgtggctcaatatccagcatgacggtttctacagccagttcaacatgagcatgaggaaatatatcctttctgtgtcgagacgtgttattgtcgactacatctcttcacctgaagcaagctttctcaccagcatcagtggaagggttagcaacaacacaaagctcgtgttccgctttctcgatgaggccactcttgagccatctaccaaagagacatatgcttccatgttgaaaaatcttacatttatcaagacatttgcatctgggatacttgtcccgaagaagtatatctggcctgtttcaccagataattatctgcaaccatacacttcgatcgtcgatgatgctcataaagcggggctggaaatttatgctgctgattttgccaacgactttactctcagttacaaccatagctatgatccattaactgaatctctctcgttcattgataatggtgcattttctgttgatggcatattgactgatttccccgttacgccttcagaagccattggctgttttgcgaatttgaacaaaagcaacacagatcatgggaaacctctaattatttctcacaatggtgccagtggagattacccaggctgcaccgatctagcttatcagaaagcagtcgacgatggtgcagatgtcattgattgccctgtgcaagtgaccaaagacggcataccagtatgcatgggatccattaacttaatggatagtactactgttgcaaaatcaccatttgcgtcccaggcagcagtaatgaaagatattgagagtgtcctaggagtctttactttcaacctcacttgggatgacatcgtgaagaatctaaaacccaaaatatctaccccacttagcaccttcagtttggacagaaatccaaggtacaggaatgcaggaaatttcatgagattatcggactttctggacttttcaaaagacaaggatttatcaggaatcatgattagcatagagcatgctgcttttctagcagaggaactcggatttgacatggtggatgcagttatcaaagcgcttgatgactccggctacaacaaacaaaccgctcagaaagttatgattcagtcaaccaacagctcggttctggtgaagttcaagcaggaaacaaaatacgacctcgtgtacatgatcaatgaagatgtgagcgatgccgcgccttcctctctggcgggcattaagaagtttgccgatgccgtttctgtggaaaccagctctgtttaccctgaaaaccgccatttcacgtcgcaccagacagaccttgtcgagtccctccagaccgccgggctctcggtctacgcctacaacctcatgaatgagtttgtttctcagccatacgacttcttctcggatgcgaccgcgcagatcattacctatgttcagggtgccggagtggatgggttgatcacggatttcccggctacggcccggagatacaaatcgaacacttgcatgaacatggggaacaaaaccccaagcttcatggcccctcctcgtcccggtgatctgctgcagctcatcagtaagccggcgcaaccaccggcactagccccgatgccgttgctaatggattccgacgtgtcggagccgcccctaccgcccgcaagattgaacaatgctaccacagctccagcaccttcgtctgcacccagaatgcagactcgtatcccattcctcgtcaccttggcaatgctttctgcctgggtcgcggtctgaggtcgcaatgccatatgacacgctagaggtgtctactaatccaatgttttctcctcctccggtgattcatttgttcctgtaatttttgcgttgcggggttattatccgggatgcccctatgacacacccctagtgattattatcagtacatatgtgttggaatatatcctcttatgttcaggaccgagtgtttgcgatccagatggtacagttctcaacaatctgaatttctacattagaaaaaaaatctgaaattctgaggcatggtttatcgtgtgcgagagtt

SEQ ID NO: 2793 - DNA, 2917 bp, Triticum aestivum
agggtgactctccttggaagacgcttagcggcaatgctccggcgatcatagccaagggaggattttcaggcttattccccgactcgagcgaattcgcttaccagttcgcgatgattgctagctcgcccgatacaatcctatactgtgatgtccggctgaccaaggatggccttggcgtctgcctaccggagattaagatggacaactgcaccaacattccagatttctaccctaagggtaagaagagctaccttgtcaatggcgtatcgacaacgggatggttctccgtggactacaacggcaccgagctctcgcaagtgtctttgaagcagtcaatcttctctcgcacgcccaggtttgacccaagcttcttcccattgctcgccgtcgaagacgtggcatccaagtttaagcctcctggaatgtggctcaatatccagcatgacggtttctacagccagttcaatatgagcatgaggaagtacatcctttctgtgtcgagacgtgttattgtcgactacatctcatcgccggaagcaagcttcctcaccagcatcagtggaagggttagcaacaacacaaagctcgtgttccgctttcttgacgaggccactcttgagccatctaccaaagagacatatggttccatgttgaaaaatcttacatttatcaagacatttgcatctgggatacttgtcccgaagaagtatatctggcctgtttcaccagataattatctgcaaccatacacttcgatcgtcgatgatgctcataaagcggggctggaaatttatgctgctgattttgccaacgactttgcgctcagttacaaccatagctacgatccattagctgaatctctctcgttcattgataatggtgcattttctgttgacggcatgttgactgatttccctgttacgccttcagaagccgttggctgttttgcgaatttaaacaaaagcaacacagatcatgggaaacctctaattatttctcacaatggtgccagtggagattacccaggctgcaccgatctggcttatcagaaagcagtcgacgatggtgcagatgtcattgattgccctgtgcaagtgaccaaagacggcataccagtatgcatgggatccattaacttaatggatagtactactgttgcaaaatcaccatttgcgtcccaggcagcagttatgaaagatattgagagtgtcctaggagtctttactttcaacctcacttgggatgacatcgtgaagaatctaaaacccaagatatctaccccacttagcaccttcagtttggacagaaatccaagatacaggaatgcaggcaatttcatgagattatcagactttttggacttctctaaagataaggatttgtcaggaatcatgattagcatagagcatgctgcttttctcgcagaggaactcggatttgacatggtagatgcagttatcaaagcgcttgacgactccggctacaacaaacaaactgctcagaaagttatgattcagtcaaccaacagctcggttctggtgaagttcaagcaggaaacaaaatacgacctcgtgtacatgatcaatgaagatgtgagcgatgccgcgccttcctctctcgcgggcattaaaaagtttgccgatgccgtttctgtggaaaccagctctgttttccctgaaaaccgccatttcacttcgcaccagacagacctcgtcgagtccctccagaccgccgggctctcggtctacgcctacaacctcatgaatgagtttgtttctcagccgtacgacttcttctcggatgcgaccgcgcagatcattgcctatgttcagggtgccggagtggatgggctaatcaccgacttcccggcgacggcccggagatacaaatcgaacacttgtgtgaacatggggaacaaaactccgagcttcatggcccctcctaggcctggtgatctgctgcagctcatcagtaagccggcgcaaccaccggccctagccccgatgcccctgctaatggattctgacgtgtcggagccgcccctaccgcccgcaagattgaacaatggtactacagctccagcaccttcgtctgcacccaggatgcacactcggatcccattcctcgtcaccttagcgatgctttgcgcctgggccacggtctgaggtcgcaatgccacatgacacgctagaggtctgccggtctactaatccaatgttctttcccctccctcggtaattcgtttgttcttgtaatttttgcgttgcggggtttatatacggacgcccctatggcactctcagtccctagtgattattcagtacatatgtgttggaatatatcctcttatgttctggaccgagttctcaacaatctgaatttctgaggcttgatttaggccccgcttggaatgtctgtgaaattttacaactgtaaattacctggatattactgtacaccagtaaaatacaaccgaatacattcccgcctgtaatccgccgtcagatcgcaacacccaagcggccccgatgtgtctcagcactgtatcatccaacgatgattgaagaaatacaacaaacatccaaaggatggagagggggcagaggtgaccgcgagcatggtgcggatctggccgcttggagcaggaggagggagcgagcggccgccgctcgccgccgtcaacatcacgttcaaacgaccgcctgcccttagaccccgcgcatatcgcggtcgccggggacctcgccggcttcggagcggacggcatctctcatccctgtaaatagccagcgcctcgcccctgccgcgtcgtggacgccggcgacgcctcccgtccctcgttacggcggcgcaacgctcagcatatagtctcgagcgaggaggtggggaaatacgacgcccagagatctgtatcgtt

SEQ ID NO: 2794 - DNA, 2946 bp, Brachypodium distachyon
ctggggagagcatcaatgggggctggactccggtgtccggaggcagatatccctcattatttgatcaccactactctactccctcccaccaccttcccctccgctgccacctcccctcctgcccgttcttctctcctctccccccagcagaacacagctcaccaccacctccccggtctccgtcccacgcagtctctcttggggcttaaatccagcacggccggccggccatcgaacctcctgctcccgaggattacttggtctcttccagggaaagaaaaaggacgagttgtggtggtcgcggtgtgttcttggagtgctgttccaaggttgctgcttgcggtgagggtggtggtactggtctctcgcggcaatgaggagcggcaaccatgtctgctccgctgttgcgtccttcgtcttgctgtggctgggcgtggccgccgcgcagggcgcctcgtcttggaagacacttagcggcgatgctccggcgatcatagccaagggtggattttcaggcttattccccgattcgagcgaattcgcttatcagttcgcgctgattgctagctcgccagacacgatcctatactgtgatgtccggctgacaaaggatggccttggagtttgtctaccggacattaagttggacaactgcaccaatattccagaattctatgctgacggtaaaaagagctaccttgttaatggcgtgtcgacgacgggatggttctcagtggactacaatggcaccgagctctcccaggtttctttgaagcagtccatctatagtcgcacgcccaggtttgacccaagcttctttccattgcttgctgttgaagacgtggcatccaagttcaagtctcctggaatttggctcaatatccagcatgacagtttctacagccagttcaatatgagcatgaggaactatatcctttctgtaacgaaacgtgttgttgttgattatatatcatcgcccgaagcgagctttctcaccagcatcagtggaagggttagcaacaaaacaaagctcgtattccgctttcttgacgaggccactctcgaaccatctaccaaacagacatatggttccatgttaaaaaatctcacatttgtcaagacatttgcatctggaatacttgtcccgaagaagtatatctggcctgtttcaccagataattatctgcaaccatacacttcaatcgtcgatgatgctcataaagcagggttggaaatttatgctgctgattttgcaaatgactttacgctcagttacaaccatagctatgatccattaacagaatctctctcgttcattgataatggtgcattttctgttgatggaatattgactgatttccctgttacaccttcagaggccattggctgttttgccaatttaaacaaaagcaacacagatcatgggaaacctttaattatttcccacaatggtgctagtggagattacccaggctgcaccgatctagcttaccaaaaagcagttgacgatggtgcagatgtaattgattgtcctgttcaaatcaccaaagatggcataccagtatgcatgggttccattaatttaatggatggtactactgttgcaaaatcaccatttgcttcccagatagcagtgatgaaagatattcagagtgtgctaggagtctttactttcaacctcacttgggaagacattgtgaagaatctaaaacccaaaatatcaacccctcttagcaccttcgctttggacagaaatccaagatacaggaatgcaggaaatttcatgagattatcggactttctggacttctcaaaagataaggatttatcaggaatcatgattagcatagagcatgctgcttttttagcagaggaacttggatttgacatggtagatgcagttatcaaagcgcttgacgcttccggttacaacaaacaaactgcccagaaaattatgattcaatcaacgaacagctcagttctggtgaagttcaagcagcaaacgaagtatgaccttgtgtacatgatcaatgaagatgtcagggatgccgcgccctcctcacttgccgatattaaaaagtttgccagtgctgtttctgtcgataccggctctattttccctgaaaaccaccatttcttgacatccccgagcggtcttgtccagtccctgaagaccgctaatctctcgatctacgcctatactctcatgaacgagtttctttctcagccatacgacttcttctcagatgcgaccgcacagatcaatgcatatgttcagggtgccaaagtggatgggctaattactgattatcctgcgacagcacggagatacaaactgaacgcctgcaagaacatggggaaaaaagcaccaagcttcatggcccctgctcgccctggtgatctgctgcagatcatcagtaaaccggcgcagccaccagcattggccccgatgccgcttctagtggattcagacgtgacggagccacccctacctgcagccagatcaaacaatggcacagctccagcaccttcatttgcatggaggatggagactcgtgtcccaattcttgtcacgttggcagtgctctgtgcctctgtcctgatctgagattgcagctcagcatgacacagctagagataagcgaatatgccaatctactaatccgatatctttttttctgcttcagtaattttttgcggtgaggggttgcccccgtggaactctccctagtgtttatcagtacatatgtgttggaatatattctcaatgttatggaccaagtgtctgtaaatcagatggtatagttctctacaatctgaatctccgaggcatcattattttgttctggaatctgaatagtacgtgatgtctgtctctgaattatgatggtgtcatgctgtgccatgtgccacagcagatggggcatacaggttgccaagcgacta

SEQ ID NO: 2795 - DNA, 2957 bp, Oryza sativa
ggaagcatcaatgggggctggactccggtgtcctgaggcagatacatctcattatttgaccaccaccaccaccactactactgccaacgcccaccaccttccccctcctgctcgcctgtgtctcctcctcccatctcccctcacagctcagtgccaccccggcaaaagtctctccatcttgtcatcgtcttctccagctctcgatcgagctctcgaccgaggcaatacaaaatccaggacaggccattgcgccggcctgctgctccccgaggatttttgtttgattatttgctgcctccagtgggttgggtgttcttggggggctctgtttcccggggtggtgcttgttggtgagcgtggtgttctccggcggcaatgaggggcagccatgtctgctccctggtttcctccctcgttttcctgtggctgggggttgctgctgcgcagaaggcctcttcttggaagacgctgagcggcaatgctccggcaatcatagccaagggaggattttcaggcatattccccgattcaagcgaatttgcgtaccagtttgcgctcattgctagttcgccagatacaatcctatactgtgatgttcggttgaccaaggatggtcttggtatctgcctgccggacataaagatggacaactgtaccaatattccagatttctatcaacagggtaggaagagctaccttgtcaatggcgtgtcgacggcgggatggttctccgttgattacaatggcaccgagcttggccaagtgtctttgaagcaatcaatcttttctcgctcgccgaggtttgatccaagcttctttccaattcttgctgtcgaagacatagcatccaaatttaagcctcctggaatgtggctcaatgtccagcatgacagtttctacagtcagttcaatctaagcatgtcaaactacatattttctgtgtcaaaacgtgttattgttgactatatctcatcacctgaagtgagcttccttactaaagtatctggaaagcttagcaacaacacgaggcttgtgttccgttttctcgatgagagcacaatcgaaccatctaccaaacagacatatggatccatgttgaaaaatcttacatttgtcaagacattcgcatctggtataattgtcccaaaaaaatatatctggcctgtttcaccagataattatctggaaccacacacttcagtcgtcgatgatgctcataaagcagggttggaaatttatgctgccgactttgccaatgactttatgttcagttacaaccatagctatgatccattagcagaatatctctcattcattgacaatggtgctttctctgttgatggagtattgactgattttcctgttacaccttcagaagccataggctgctttactaatctgaagaaaagcaaaacagatcatggaaagcctctaattatttcccacaatggtgctagtggggattacccagcctgcactgatctagcttatcaaaaagcagttgatgatggtgccgatgtcattgattgccctgtccaattgaccaaagatggcataccaatatgcatgagttccattaacttgatggatgatactacagttgcaaaatcacagttcgcctctcagacagcagtaatcaaagatattgagagtgtgctaggagtctttaccttcaaccttacttgggatgacatcgtaaagaatctgagacccaaaatctctaccccgtttagctccttcaaactggacagaaatccaagatataggaatgcggggaatttcatgagattatcagactttctggacttcacaaaggataaggatttatcaggaattatgatcagcgtggagcatgctgcttttgtggcggaggaacttgggtttgacatggtagactcagttatcaagaccctcgatgctgctggttacagcaaccaaactgcccagaaagttatgattcagtcaagcaacagctcggttttggtgaagttcaagcagcaaacgaagtacgaccttgtgtacatgatcaacgaggaggtcaaggacgccgcgccttcttccctcgctgccatcaagaagtttgccgatgccgtttccgtcgaaggcaactctatattccccgagaaccgccatttcactacctaccagaccaacctcgtcgagtccctgcagaatgccggtctcccggtctatgtttacactctcatgaacgagttcgcttctcagccatacgacttcttctcggacgcgaccgcgcagatcaatgcgtatgttcagggtgctggagtgaatggcgtgatcacagatttcccggcaacagcacggagatacaaattgaacacctgtatgcacatggggaacaacacgccgagcttcatggccccggctcgcccgggtgacctgctgcagatcatcagtaagccggcgcagccgccggcgatgtcgccgatgcccctcctgacgggctcggacgtggcggagccgccgctgccgcctgcaagaacagctcaggcgccgtcgctcgcgagcaggatgcaggctcatgccgcgatcgtcgtcacattggcgatgcttctcgcttgccatcccctggtatgaccggacaacgcagcaggttcacaagccaaaatactaatccagtctgtttgttctgttctttcttttttttttctttttttttctcatgtagcgattcgtttcatcctcatgtatttttttttgcattgatgatcgtccccgatttgcctattactgtcctcagtggtctcagtatatatgtgtggtatgaatctaaatacatacatatgtctagattcattaatatctaaatgaatgtgggcaatgctagaaagtcttatattgtaaaacggaggaagtagtaagtagtatctgaaattcggatgctgtatttctctctcacgatctaatgcctcgttgtcaattttgtcactttggtc

SEQ ID NO: 2796 - DNA, 955 bp, Triticum aestivum
cacaagtccacctcgaacggactgatcactgatggagtgggcgtacagcggcggcggccactcgtcgtcgggaacgaaatctccggcggccggcggccgggaggagggctcgtacatgacggtgtcgtcggcgccgcccaagcggcgggcggggaggaccaaggtcagggagacgaggcacccggtgtacaagggggtgcgcagcaggaaccccggccggtgggtctgcgaggtgcgcgagccgcacgggaagcagcggctgtggctcggcaccttcgacaccgccgagatggcggcgcgcgcgcacgacgtcgccgccctcgcgctccgcggccgcgccgcgtgcctcaacttcgcggactcgccgcgcacgctccgggtgccgccgcagggggccggccacgaggagatacgccgcgccgcggtcgaggcggccgagctgttccgcccggagcctgggcagcgcaatgcagctactaccgaggcgccggctgcttcaccggcagacgcggggaacgcggagctcgttgcaaactctccttaccacctcatggatggtttagaattcgaaatgcagggctatcttgacatggcgcacggcatgctgatcgagccaccgccaatggcggggccgtcgacgtggatcgaggaggactacgactgcgaggtcagcctgtggaactactgatgccgcgcacctgagccggctcgggcctggccttcatggctcactgtcactgtacatacagcttaatatcgccatccaggatgccctgtacttgtggtgtgtaatgtttccctgctattctgacgaaaatgtcatggcaatgtgggtcaacaaacaattagtgccagagatagcactcgcacgggcgatcttggcacgctgaaattcaagcctttactcgaccgattcatatatttcctgctttgagataacttggtcagactaaca

SEQ ID NO: 2797 - DNA, 673 bp, Secale cereale
taggtacaaaaagtaacaaaacaatctcgaacggaccgatggagtgggcgtactgcgggagcgactactcgtcgtcgggagcgcagtctccgttggccggcggccgggaggagggctcgtacatgacggtgtcgtcggcgccgcccaagcggcgggccggaaggaccaaagtcagggagacgaggcacccggtgtacaaaggggtgcgcagcagggaacccccggacggtgggtctgcgaggtgcgcgagccgcacgggaagcagaggctatggctcggcaccttcgacaccgccgagatggcggcgcgcgcgcacgacgtcgccgccctggcgctccgcggccgcgcagcgtgcctcaacttcgcggactcgccgcgcacgctccgggtgccgccccaagggggccggccacgacgagatacgccgagccgccgtcgaagcggccgagctgttccgccggcgcctgggcagcccatgcagctaccgaggcgccggctgcttcgccggtggcatcggggaacgcggagctcgtcgaaagctctccttactgcctcatggatggactggaattcgaaatgcagggctatcttgacatggcgcacggcatgctcatcgagccaccgccaatggcggggccatctacgtggatcgaggaggactacgactgcgagg

SEQ ID NO: 2798 - DNA, 1544 bp, Oryza sativa
tcaagaccaaatcggataatttcaaatccttgtcgagtgaactgatccatcgatggagtgggcgtactacggcagtgggtactcctcgtcggggacgccgtcgccggtgggcggcgacggggacgaggactcgtacatgacggtgtcgtcggcgccgcccaagcggcgggcggggaggaccaagttcaaggagacgaggcacccggtgtacaagggcgtgcgcagcaggaaccccgggaggtgggtctgcgaggtgcgcgagccgcacggcaagcagaggatctggctcggcaccttcgagaccgccgagatggcggcgcgcgcgcacgacgtcgcggcgatggcgctgcgcggccgcgccgcctgcctcaacttcgccgactcgccgcgcaggctccgcgtgccgccgctgggggccgggcacgaggagatacgccgcgccgcggtcgaggccgccgagctgttccgcccggcgcccgggcagcacaatgcggctgccgaggcggcggccgctgtcgctgcgcaggcaaccgcggcgagcgcggagctctttgccgacttcccttgctacccgatggacggactggaattcgaaatgcaggggtacctcgacatggcacagggaatgctcatcgagccgccgccattggcagggcaatcgacgtgggccgaggaggactacgactgcgaggtcaatctatggagctactgatgatcgcccgtgcacctgaaccgaaccagccctgatgagcaggaggactcaatgtacagcttattatggtatataatcaagtacgaaccgtacttatggtgtgccgtttccctgctattctgacgaaaatggaatgcgatcagaaggagcagaggagtgtcctttaggttggtagggggggctccatgctcgtgcgacactggcaatgggggccaaaaattttattggcgccagaaatagcacttgctgcggatgatccctttagtttctgtagtaacaagcctcacctcccaggcttgtctaataagcagctaagtttgctgcatatttgaccttgtacgtggttatgaccctcgagggagctaatgaagtggatatatggtcgatcagctaattccatctggaattgtcacggtacaggctacaaatggtctcatttccagataaacgcggaagcaggaaggggagaggaaaagatcgctatcccagcatttggttgtgatgtcactgctccagaatctttactagtacgactatggacctatggtggattttgttgtttgtccgatggtcctggaatttgttttgagctaattgttgaattttaaaaagcaaagctaccaggttgcatctaattatgatttcgggagcactaggcatcgtcgtattgtatcgacttatcgttattggacccaggactggtaccttttactggacaatttcagaattctactaagcggcggagcttccggtatggttagattttgtcagtgagcatatgtacaattaaagtctaatcactaatgaatatactaatcactgtgtttttacc

SEQ ID NO: 2799 - DNA, 1719 bp, Secale cereale
ctgacctaaccaaatccgaccctaggcggctccatctctcctagactgtaccacgccgtgccctgccgtagcactgcgttaccgccgacgccccccccccccaccccactcccccactccgcctctctcacgcgcctcgccgcctcgccgttcccgttcttcctcgccgccaattttcgtccctgctgtctccgccccgtccgcaatctcgggccattgggttttgaggttccagggattggcgtctggaatgcaatggtggggatagcctgaccgtccagagcccgaaagaagagcacatttctcgttccgatctcggtttccttggatttcgattcgtttgttcagggcctgccgagatggacgacgatggcagtttgagcattcggaattggggcttctatgagacgatgaaaggcaacctcggcctgcagctgatgccatctgtggccggcggccaccgtgacacaaagccgctgctccccaacggcaccttcttgccgcaccacaacgccccgcaccacccgccacattcacatcacccccgcgactatggtaacggcgaaccctctggtggcatgcccaccgacccgccggctattcacatggattttgtgcgcaatgaggcctggatgcacccctcgcagcatcagcaccagcaccaccaccagaaccaacatcaacagcagcatcagcatcagcatcagcatcaacattcccgtgagcagaaggtccttcatgctgttcctcttgggcctgctggacatattggacatcctggacatgctgtgcatcaccaccctacaggttttgggatgatgccagatgcgcgtggtgcgcacactctccagatgatgcagccacaggagcctcctgtgcccgaggaggaaaaaattaccccaccgttggttgaagagcattctgtggtcggaagcaagcctccggtaaagaagaggcagcaaggtcgtcagcctaagttgccgaagccgaagaagccgaagaaggttgctactccaggggaagatggggcacccaaggcccgtgcaccccgaagcaggggccctcttaagcctgtggaaatggtaattaatggtattgattttgacatttcaaggataccaacacctgtctgctcatgcactggagctccccagcaatgctaccggtggggtgcaggtggctggcagtctgcatgctgcacaacttctatttcgacatacccactgccaatgaacacaaagcgccggggcgcacgtattgctggaaggaagatgagccaaggtgcatttaaaaaggttcttgagaagctagctggtgaagggtacaaccttaataatccaattgacttgaagaccttctgggccaagcatggcacaaacaagtttgtaacaatcaggtaagagacatgctatgttgatcgccttgtagggtccaacgctgcagtttggtctgagttattctctgtacccgctcttgccaatctgtagacgtctttagaagtagcttgtagccatgttcagtttcctggacttaatttacatgcctatttcgagcttcagctgtgaagtaggaagtctgtctgtatctgtcatgtcaatttagaagttgtagtgtaatggcaacagtttttctgatttagttagcatttaatgcttcaatgtctgttatgacctggatgtttatggcttcatgtagaggttttctccattaaagttgaaa

SEQ ID NO: 2800 - DNA, 1870 bp, Triticum aestivum
ctcctgacctaaccaatccgacccaaggcggctccatctctcctagactgtaccacgacgtgccctgccgtagcactgcgttaccgccgacgcctcacccccaccccaccgcacccccactcccacatcccctccgcccctctcacgcgcctcgccgccatcgccgtccccgttcttcctcgtcgccgaatttcgtccctgctgtccccgccccgtccgcaatctcgggccattgggttttgaggtcccagggattggcgtctggaatgcaatggtggggatagcctgaccgtccagagcccgaaagaagagcacatttctcgttccaatctcggttttcttggatttcgattcgtttgttcagggccggccgagatggacgacgacggcagcttgagcattcggaattggggcttctatgagacgatgaaaggcaacctcggcctgcagctgatgccatctgtggccggcgccggccaccgggacacaaagccgctgctccccaacggcaccttcttgcagcaccacaacgccccgcaccacccgccgcattcacatcatccccgcgactatggtaacggcgaaccctctggtggcatgcccaccgagccgccggctattcacatggattttgtgcgcaatgaggcctggatgcacccctcgcagcatcagcatcagcaccagcaccagcaccaccaccagaaccaacatcaacagcagcatcagcatcagcatcaacattcccgtgagcagaaggtccttcatgctgttcctcttgggcctcctggacatattggacatcctggacatgctgtgcatcaccaccctacagattttgggatgatgccagatgcgcgtggtgcgcacactctccagatgatgcagccacaggagcctcctgtgcctgaggaggaaaaaattgccccaccgttggttgaagagcattctgtggtcggaagcaagcctctggtaaagaagaggcagcaaggtcgtcagcctaagttgccgaagccgaagaagcctaagaaggttgctactccaggggaagatggggcacccaaggcccgtgcaccccgaagcaggggtcctcttaagcctgtggaaatggtaattaatggtattgattttgacatttcaaggataccaacacctgtgtgctcatgcactggagctccccagcaatgctaccggtggggtgcaggtggctggcagtctgcatgctgcacaacttctatttcgacatatccgctgccaatgaacacaaagcgccggggcgcacgtattgctggaaggaagatgagccaaggtgcattcaaaaaggttcttgagaagctagctggtgaagggtacaaccttaataatccaattgacttgaagaccttctgggccaagcatggcacaaacaagtttgtaacaatcaggtaagagacatgctatgttgatcgccttgtaggctccaacgctgcagtttggtctgagttattctctgtacctgctcttgccaatctgtagacgtctttagaagtagcttgtagccatgttcagtttcctggacttaatttacatgcctatttcgagcttcagctgtgaagtaggaagtctgtctgtatctgtcatgtcaatttagaagttgtagtgtaatggcaacagtttttctgatttagttagcatttaatgcttcaatgtctgttatgacctggatgtttatggcttcatgtagaggttttctccattaaagttgaaagataatcgctacctcttctagggctagttatcatttaatttggtatttctttacatctgccaagtttatatatgaaatactcgcatgactcatgcggttcttatctttgacctgctattaagcttg

SEQ ID NO: 2801 - DNA, 1045 bp, Leymus cinereus x Leymus triticoides
  misc_feature (1009)..(1012): n is a, c, g, or t
agctgagggaaagatgagggagctggtctcctcctcctcttccaccgcgggcaacgcggcgctccggggatggtgggaggacgtcaacgagtcgccggcgtggcaggacggcgccttcttctccctcaccgccgcctacgccctcgtctccgccgttgcgctgattcagctggtcaggatccagcgcagagtgcccgagttcggctggaccacgcagaaggtgttccacctcatgaacttcgtcgtcaatggggttcgtgccgttgtattcggattccatgcctatgtcttccttctccaaacaaaagtttataagttggtgttactagacctccccggcttgttgttcttctcggcctacaccttacttgttcttttctgggcagaaatataccatcaggctaggagtctccccaatgataagttaaggattatatacctagccgttaatagcatcttatatgtaattcaggtctgtatttgggtataccttggaataaacgacaatccgttggttgagctggtgagcaaaatcttcattgtatctgtctccgctgtggcccttcttggtttcgcagtatatggtggaaggctgtttgtcttgctgagacgtttccccattgaatcaaaggggcgaaaaaagaagctttatgaggttgggactgtgacgacaatctgctgcacctgtttcctgataagatgcatcgtggttgccgtatctgcgtttgatgctgatgtttctttggaggttttagatcatccaatcctagatttcttctattatatgttgacagagatactgccttcggcgctggtccttttcatccttcggaagcttccacctaagcgagtatcggcccaatatcaccctattaactagaagtttctgtgcttatttatgatattatgcttagaataatggataaacttggaagtgcccaaaattctacatgtctggtgcgagctgaatgctggtgtttgagctgtgtgttttccaaaagcatcgaannnntgttgatggatcatgcaatgtgcagttcaaaaa

SEQ ID NO: 2802 - DNA, 3076 bp, Triticum aestivum
ctctccgtctccccccacagaaagtgtgagaacgccaagagcgtcaagctgagggaaagatgagggagctggtctcctcctccacctcctcccccaccgcggccctcgtcgccgcgggcaacgcggcgctccggggatggtgggaggaggtcaacgagtcgccagcgtggcaggacggcgccttcttctccctcaccgccgcctacgccctcgtctccgccgtcgcgctgattcagctggtgaggatccagcgcagagtgcccgagttcggctggaccacgcagaaggtgttccacctcatgaacttcgtcgtcaatggggttcgtgccgtcgtattcggattccatgcttatgtcttcctcctccaaacaaaagtttataagttggtgttactagacctccccggcttgttgttcttctcggcctacaccttacttgttcttttctgggcagaaatataccatcaggctaggagtctccccaccgataagttaaggattatatacctagccgttaatagcatcgtatatgcaattcagatctgtatttgggtgtaccttggaataaacgacaatgcgttggttgagctggtgagcaaaatcttcatcgtatctgtctccgctgtggcccttcttggtttcgcagtatatggtggaaggttgtttgtcttgctgagacgtttccccattgaatcaaaggggcgaaaaaagaagctttatgaggttgggactgtgacgacaatctgctgcacctgtttcctgataagatgcatcgtggtggcagtatctgcatttgatgctgatgtttctttggaggttttagatcatccaatcctagatttcttctattatatgttgacagagatactgccttccgcgctggtccttttcatccttcggaagcttccacctaagcgagtatcggcgcaatatcaccctattaactagaggtttttgtgcttatgtatgatgttatgcttagaataatggatgaacttggaattgcccaaaattttacatgtctggtgcgagctgaatgctggtgttcgagctgtgtgttttccaaaatcatcgaagtgttgtcgatggatcatgcaatgtgcagtccaggggccctgtaactgtgaattttctgtcttctgcttgttgtgtttctggtggaatttggttgagagctttgcgctagtagaggagaaaatcctagtggattccctgatgtttatccgagtcgttttgtgattgcacttgccatgtttaccatcagagtgttgctggttatgccgactggagcttaatatttgtaaaatgttaccagtctcttgaattatgtgtgtattgtagagggcctcaaaagtcatatttgtaagtgtaactggtttggagtagatgatgtcctgcgcgttgccaaatttcatttcaagaatgtgagaaatacttggcatgattgcaatagtatttgtaatcgtactacatttcatttgcaatcatacagctgaatggtggatgcatcattcggatcaggctactaaattgtttgaaatcatttgctgatgcctgctgcaactgtggtggttgtgtctattggctcgatgtcgatgaggagcccccgagcaggggacggcatcgggtacctggagaagctgccgtcgcagccgtcggcgagcttccacccgaacccggtgacgatgtagtgcatggccaccagcgtctccaccctagtgaactcgttgccagggcacatgcgcgcgccgccgccgaacgccacgaagctgtagggtggtatcgggctctcgaacctcgccggctcgaacctgcttggctccgggaagatggccgggtcctgctgcgtcaggttcatcgcccccaacacctgccatcccttggggatgaggtggccgtcaaactccacgtctgccaccgccctcttgagcatggagaacacgggaggtaccaggcgcagggtctccatcgccgccgaccatgtgtacttcatcttgccaaggtcgtcccacgacagagcttcccccggagccttgctcctggcgacctcttgttgctctgccacgaccctgccgtagcgtcccggttgccaccgaggtgccggaggaggaaggtgaggagggtagcggtggtgtcgtgcgccgctaccatcatgaacatgacgttgtcgatgatctcctcgtcggccagcccctcggcgagcatgtgggtcatgaggtcgtcggacggcgaactatgcccgctctccagcttggcgcgcttctccttgatgattgccgcgacggttcgccggcctcgccggctcgcggcgaggcacttgccgaaggaggtgaaaggcaggttcaccgggatcgcccagatgcccctcaccagctgctggaactccgcggagagctcccgcctcacggcggcgtggtcagctctcccgagcccgaagatgacggtgcacatgatgtcgaaggtgagcgacttcatcgacggcatcaccgcgacggtcgtgcggccgtcccagtgggcgcggaggtggtgccggacctcgtcgtccatgctggcgacgtagctcctcacgatgtccagcttgaggaactggacatcatggccctcacgcggcggtggtcgtcgccgaccagctcccggatgttgcgcctgccgaccatactgttgaaggaggtggagctcttggcggtgagcgcggcgctggcgaagaggaacttgttggcggcggggccgacgaggaaggccgtgtggaggccgaagagggagagctttgagatggggccgtactcggaggcccagcgccggagccatgcctcgccggtgttggcgcggagggcgcgcagtaggccgaccgtctggccgacgacgggaaggccgaaggagcccggaggcagctgacggcgccgatcgtcttgagatgagctctgctttctgaggtgtggcaataccaacaagatgaaagcgatgattactgccgcaagagctgccaagacgggagcctccatttccatcttcttgatccaagctctccaatgcttgtttttctcatcagatggactccacttgtccactgtctagta

SEQ ID NO: 2803 - DNA, 1379 bp, Triticum aestivum
gtcatgcggacccacgttcttccctccctctctccaatttcttttgtgcttctcctctctctctctctccgtctccccccacagaaagtgtgagaacgccaagagcgtcaagctgagggaaagatgagggagctggtctcctcctccacctcctcccccatcgcggccctcgtcgccgccggccacgcggcgctccggggatggtgggaggaggtcaacgagtcgccggcgtggcaggacggcgccttcttctccctcaccgccgcctacgccctcgtctccgccgtcgcgctgattcagctggtgaggatccagcgcagagtgcccgagttcggctggaccacgcagaaggtgttccacctcatgaacttcgtcgtcaatggggttcgtgccgttgtattcggattccatgcctatgtcttcctcctccaaactaaagtttataagttggtgttactagacctccccggcttgttgttcttctcggcctacaccttacttgttcttttctgggcagaaatataccatcaggctaggagtctccccaccgataagttaaggattatatacctagccgttaatagcatcgtatatgcaattcagatctgtatttgggtgtaccttggaataaacgacaatgcgttggttgagctggtgagcaaaatcttcatcgtatctgtctccgccgtggcccttcttggttttgcagtatatggtggaaggttgtttgtcttgctgagacgtttccccattgaatcaaaggggcgaaaaaagaagctttatgaggttgggactgtgacgacaatctgctgcacctgtttcctgataagatgcatcgtggtggcagtatctgcatttgatgctgatgtttctttggaggttttagatcatccaatcctagatttcttctattatatgttgacagagatactgccttccgcgctggtccttttcatccttcggaagcttccacctaagcgagcatcggcgcaatatcaccctattaactagagtttttgtgcttatgtatgatgttatgcttggaataatggataaacttggaagtgcccaaaattttacatgtctggtgtgagctgaatgctggtgttttccaaaagcatcgaagtgttgtcgatggattatgcaatgtgcagttcagggggcctatagcagtgaatttccgtcttctgcttgttctttttttggtggaatttggtcgatagctttgctctagtagaggagaaaatcgtagtggattccctgatgtttatccgagtcgttttgtgattgcctttgccatgtttaccatcggagcgttgctggttatgccgcttggagcttaatatttgtaaattttaccagtctcttgaattatgtgt

SEQ ID NO: 2804 - DNA, 1401 bp, Secale cereale
aagtgtgagaacgccaagagcgtcaagctgagggaaagatgagggagctggtctcctcctcctcctcctcccccaccgcggtcctcctcgccgcgggcaacgcggcgctccggggatggtgggaggacgtcaacgagtcgccggcgtggcaggacggcgccttcttctccctcaccgccgcctacgccctcgtctccgccgttgcgctgattcagctggtgaggatccagcgcagagtgcccgagttcggctggaccacgcagaaggtgttccacctcatgaacttcgtcgtcaatggggttcgtgccgttgtattcggattccatgcctatgtcttcctcctccaaacaaaagtttataagttggtgttactagacctccccggcttgctcttcttctcggcctacaccttacttgttcttttctgggcagaaatataccatcaggctaggagtctccccacagataagttacggattatatacctagccgttaatagcatcgtatatgcaattcaggtctgtatttgggtgtaccttggaataaacgacaatccgttggttgagctggtgagcaaaatcttcatcgtatctgtctccgctgtggcccttcttggtttcgcagtatacggtggaaggttgtttgtcttgctgagacgtttccccattgaatcaaaggggcgaaaaaagaagctatatgaggttgggactgtgacgacaatctgctgcacctgtttcctgataagatgcatcgtggtggcagtatctgcatttgatgctgatgtttctttggaggttttggatcatccagtcctagatttcttctattatatgttgacagagatactgccttccgcgctggtccttttcatccttcggaagcttccacctaagcgagtatcggcgcaatatcaccctattaactagaggtttttgtgcttatgtatgatgttatgcttagaataatggataaacttggaagtgcccaaaaatttaacatgtctggtgcgagctgaatgctggtgtttgagctttgtgttttccaaaagcatccaagtgttgtcgatggatcatgcaatgtgtggttcaggggccctataacagtgaattctgtcttctgcttgctctgttgttggtggaatttggttgagagctttgctctagtagaggagaaaatcctagtgacctgatgtttatccgagtcgttttgtgattgcacttgccatgtttaccatccgagtgttgctggttatgccgactggagcttaatatttgtgaaattttatcagtctctttaattatgtgtgtattgtagttgcagagggccttaaaagtcatttgtaagtgtaactggttttaagtaaatgatgtcctgtgcattgccaaattcctttcaagaatg

SEQ ID NO: 2805 - DNA, 1429 bp, Secale cereale
ctttcttttgtgtcctctcctctccccgtccccccccacgacaagtgtgagacgccagagcgtcaagctgagggaaagatgagggagctggtctcctcctcctcctcctcccccaccgcggtcctcctcgccgcgggcaacgcggcgctccggggatggtgggaggacgtcaacgagtcgccggcgtggcaggacggcgccttcttctccctcaccgccgcctacgccctcgtctccgccgttgcgctgattcagctggtgaggatccagcgcagagtgcccgagttcggctggaccacgcagaaggtgttccacctcatgaacttcgtcgtcaatggggttcgtgccgttgtattcggattccatgcctatgtcttcctcctccaaacaaaagtttataagttggtgttactagacctccccggcttgctcttcttctcggcctacaccttacttgctcttttctgggcagaaatataccatcaggctaggagtctccccacagataagttacggattatatacctagccgttaatagcatcgtatatgcaattcaggtctgtatttgggtgtaccttggaataaacgacaatccgttggttgagctggtgagcaaaatcttcatcgtatctgtctccgctgtggcccttcttggtttcgcagtatacggtggaaggttgtttgtcttgctgagacgtttccccattgaatcaaaggggcgaaaaaagaagctatatgaggttgggactgtgacgacaatctgctgcacctgtttcctgataagatgcatcgtggtggcagtatctgcatttgatgctgatgtttctttggaggttttggatcatccagtcctagatttcttctattatatgttgacagagatactgccttccgcgctggtccttttcatccttcggaagcttccacctaagcgagtatcggcgcaatatcaccctattaactagaggtttttgtgcttatgtatgatgttatgcttagaataatggataaacttggaagtgcccaaaattttacatgtctggtgcgagctgaatgctggtgtttgagctttgtgttttccaaaagcatccaagtgttgtcgatggatcatgcaatgtgtggttcaggggccctataacagtgaattctgtcttctgcttgctctgttgttggtggaatttggttgagagctttgctctagtagaggagaaaatcctagtgacctgatgtttatccgagtggttttgtgattgcacttgccatgtttaccatccgagtgttgctggttatgccgactggagcttaatatttgtgaaattttatcagtctctttaattatgtgtgtattgtagttgcagagggccttaaaagtcatttgtaagtgtaactggttttaagtaaatgatgtcctgtgcatggccaaattcc

SEQ ID NO: 2806 - DNA, 1366 bp, Hordeum vulgare
gtcatgcggacccacgttcttccctccctctctccaatttcttttgtgcttctcctctctctctctccgtctcccccccacgcccacagaaagtgtgagaacgccaagagcgtcaagctgagggaaagatgagggagctggtctcctcctcctcctcctcctcctcctcccccaccgcggtcctcgtcgccgcggccaacgcggtgctccggggatggtgggaagacgtcaacgagtcgccggcgtggcaggacggcgccttcttctccctcaccgccgcctacgccctcgtctccgccgttgcgctgattcagctggtcaggatccagcgcagagtgcccgagttcggctggaccacgcagaaggtgttccacctcatgaacttcgtcgtcaatggggttcgtgccgttgtattcggattccatgcctatgtcttcctcctccaaacaaaagtttataagttggtgttactagacctccccggcttactgttcttctcggcctacaccttacttgttcttttctgggcagaaatataccatcaggctaggagtctcccaaccgataagttaaggattatatacgtagccgttaatagtatcgtatatgcaattcaggtctgtatttgggtgtaccttggaataaacgacaatccgttggttgagctggtcagcaaaatcttcatcgtatctgtctccgctgtggcccttcttggtttcgcagtatatggtgggaggctgtttgtcttgctgagacgtttccccattgaatcaaaggggcgaaaaaagaagctttatgaggttgggactgtgacgacaatctgctgcacctgtttcctgataagatgcatcgtggtggcaatatctgcatttgatgctgatgtttctttggaggttttggatcatccaattctagatttcttctattatatgttgacagagatactgccttccgcgctggtccttttcatccttcggaagcttccacctaagcgagcaacggcgcaatatcaccccattaactagaggtctttgtgcttatgtatgatgttatgcttagaataatggataaacttggaagtgctcaaaattttacatgtctggtgcgagctgaatgctggtttttgacactgttttccaaaagcatcaaagtgttgtcgatggatcatccagtgtgcagttcaggggccctttggcagtgaatttccgtgttctgcttgttctcgtttttggtggaatttggttggagagctttgctatagtagaggagaaaatcatagtgggctccctgatgtttatccgagtcattttgtgattacatttgccatgtttaccatctgagtgttgccggttatgccgcctggagc

SEQ ID NO: 2807 - DNA, 1456 bp, Oryza sativa
atcctctcctctcgcatcgcaactcgcgcgcacacagaaaaagaaaaaaagaaagagtcaaggggagggaaggcgagagagagagatgagggagccggtggtcgtggcagcttcttctgcggcggcgttgcggggtttctgggaggaagtcaacgagtcgccggcatggcaggacggcgccttcttctccctctccgccgcatacgccctcgtctccgccgtcgcgctgattcaattgatcaggatccagcgccgagtgcccgaattcggatggaccacgcagaaggtctttcacctcatgaacttccttgtcaatggagtccgtgctctcgtctttggattccatctccatgtcttccttctctccgcaaaagtttataagttggtgctgctagacctccccggcttgttgtttttctccacctacactctgcttgttctcttctgggcagaaatataccatcaggccaggagcctcccaacagataagttaaggattatatacatagccgtcaatgccatcatttacacaattcaggtttgtatttgggtatacctcggaatcaacgacaacccattggttgagctggtcagcaaaatcttcatagtagttgtctcttttgtggctcttcttggcttttcagtatatggtggaaggctgttcttcttgctgagacgtttccccattgaatctaaggggcgaaaaaagaagctttatgaggttgggacagtgactgcaatctgctgtgcttgtttcctgataaggtgcatagtggtggcgatatcagcatttgattctgatgtatctctggaggttttggaccatccaattcttgatttcttctactatatgttgacagagatactgccttcagctcttgtccttttcatcctccggaagctccctcctaagcgggtgtcagcgcagtaccacccaatcaactagctagaggcctcctagttagttactacataatatgatgttattatatactactgtacttagtatgttagttatgggaaaactttgaactcctcccaaaaagaagaaagaaaacaaactagaattgcgcctggcaagcaggagcgggatgctggtagtgctttgagctgtaaatgattgaaagcgtcaacaaggccttgttacttggatggatagtcagctgctccattaatgatgaatgaattttggtgcttgtgtagtattgtatagttctctcatatgcatgcatgtttagagcgtacagaggtgatgctgatttgtgtgtgttacagccaaacgtttccatcagtgcaggtgcagtgcagtgtaatgcaatgcacggtgttgtccccaactatatcttgggcctgtttagctgataaaatgaaaatttttgggtgtcatatcggacgtttgaccggatgttggaagaggttttcggacatgaatgaaaaaactaatttcataactcgc

SEQ ID NO: 2808 - DNA, 1325 bp, Zea mays
cgtgtgccggcgccaaacgcaatccgctgctgaaaaaaaaaagagagaagggaatcccaccgctctccccacctcactgctgccgggccccagccgccgcgcacgcccaaaacacacactgacgcgtgggcccactgccttttcccttgttgcctctctcctttgtgcgtcttcttcctccctcgcgcaccgcaggcaaggcacacaagagaaaagcagagggggccagatgaggagggacctcgcatcctccttcgctaccgccgcatcctcttcctcggcagccgacgcgctccggggctggtgggatgacgtcaacgagtcgccccagtgccaggacgcggccttcttctccctcgccgccgcctacgccctcgtctccgccgtcgcactgattcagctcgtcaggatccagcgccgggtgcccgagttcggatggaccacgcagaaggtcttccacctcatgaacttccttgtcaacggggtccgtgctctggtattcggcttccatgtccacgtcttcctcctccgcgcaaaagtatacaagttggtgttgctagatctccctggtctgttgtttttctccacctacaccttgctcgtgctcttctgggcagaaatataccatcaggctaggagtctcccaacagacaagctgaggcctgcatacattgccgttaacaccatcatatacgttgttcaggtttgcatatggatataccttgggataaatgataatgctgtggtcgagctagccagcaaaatattcatcgtagctgtctccttcgttgcgcttcttggcttttcagtatatggtggaaggttatttgtcttgctgagacgtttccctattgaatctaaggggcggcaaaagaagctttatgaggttgggactgtgacagcaatttgtgttacctgcttcctgataagatgtgttgtggttgcattatctgcgtttgatgccgatgtatctctcgaggttttggaccatccagtcctagatttcttctattatatgcttgcggagatactgccttctgcgctagttctcttcgtccttcggaagcttcctcccaagcgggtttcggcacaataccaccctattaactagagagttttgtttttttttaatgatgttacatgctaagaactccggataatctgaaactactggaaacctacagccggctgtagttggatgcttttgcttgtgctgttatgtttatggaagcatcagtgttggcgatgaatataatgacgatcattctatatggggaagtggtgctaatgaatgaatactccttttatatatggttgcatctcat

SEQ ID NO: 2809 - DNA, 1749 bp, Zea mays
aagcagaacgggagttgagttgagacagtctgaacacgtggagtcgacgtgtgcccgcgccggcgccggccaaacgcaatccgctgacgcagagcgctaaacaaaagaagggtccctgttgccggggcccagccgccgcgcacgcccaaaacacacactgacgcgtggggccaccgcctttttttcccctttgctgcgtgtcttgttgttcctcctctcctccctcgcggacacacaaacccaaagcagagaggtgagagggagaggaccgagggagagaggagagagagcgatcgagagatgaggagggagcttgcctcccccttagctactgccgccgctgccacggccggtgcctccttctcggctgccgcctcgctccggggctggtgggacgatgtcaacgagtcgccccagtggcaggacggggccttcttctccctcgccgccgcctacgccctcgtctccgccgtcgcactgattcagctcgtcaggatccagcgccgggtgcccgagttcggatggaccacgcagaaagtcttccacctcatgaacttccttgtcaatggggtccgtgctctggtgttcggcttccatgtccatgtcttcctccttcgcacaaaagtatacaagttggtgttgctagatctccccggcttgttgtttttctccacctacaccttgctcgtgctcttctgggcagaaatataccatcaggctaggagtctcccaacggacaagctaaggcctgcatacattgccgttaacgccatcatatacgttgttcagctttgcatatggatatacctcggaataaatgataatgccgcggttgagctggccagcaaaatattcattgtagctgtctcctttgttgcgcttcttgggttttcagtatatggtggaaggttgtttgtcttgctgagacgtttccctattgaatctaaggggcggcaaaagaagctgtatgaggttgggaccgtgacagcaatttgtgttacctgctttctgataagatgtgttgtggtcgcgctatctgcatttgatgctgatgtatctctcgaggttttggaccatccagtcctagatttcttctattatatgtttgcggagatactcccttctgcgctggttctcttcgtccttcggaagcttcctcccaagcgggtatcggcgcaataccaccctattaactagggagttctttgtttttatgatgttacatgctaagaactccggataagctggaactgctgaaaacctacatccggttgtattgctgtaatattttatggaagcatcccagggttggcaagatgcatcatcaccatcatgctctatgagaaaagagttttgagtggtgctaatgagtttgtgctactgctagccagagcatcacatgacatctccagcagagtaccataccattatttgaattgcatgtgcattcttgacgcggacaaggccaatgatttatcgccttgttggtcccagtgacttttatggagtacttgtgtggtaattgttggtattcctgaggactagatctgaaactgaaaatgcgttatatcagctatcggtcgtcctaatatcaatttttgttaggcttttatctgtttcagcgttccagagtagagcctttagcctaatgttgtcaggatctgtaattcgaggagcagtgttggtaggattattattgtagttttggtgctggattgttctggtaaatcgatcgatcttccatgcttt

SEQ ID NO: 2810 - DNA, 1845 bp, Sorghum bicolor
tctgcgtgtcttgttcctcctctctccctccctcgcggcgggtcgcggcgcaggcaggcggcatacacagaaagccaaagcagagagggagagggcgaggaccaagggggagagagagcgagagcgagagcgagcgagccagagatgaggagggagctcgcttcctccttcgctactgccgccgccacggcgggcgcttcctcctcggctgccgacgcgctccggggctggtgggacgacgtcaacgagtcgccccagtggcaggacgcggccttcttctccctcgccgccgcctacgccctcgtctccgccgtcgcactgattcagctcatcaggatccagcgccgggtgccagagttcggatggaccacgcagaaggtcttccacctcatgaacttcctcgtcaatggggtccgtgctctggtattcggcttccatgcacatgtcttcctcctccacacaaaagtatacaagttggtgttgctagatctccccgggttgttgtttttctccacctacaccttgcttgtgctcttctgggcagaaatataccatcaggctaggagtctcccgaccgacaagctaaggcctgcatacattgccgttaacaccatcatatatgttgtccaggtttgcatatggatatacctcggaataaatgataatgctgtgattgagctggccagcaaaatattcattgtagctgtctccttcatcgcgcttcttggcttttcagtttatggtggaaggttatttgtcttgctgagacgtttccctattgaatctaaggggcggcaaaagaagctttatgaggttgggactgtgacagcaatttgtgttacctgcttcctgataagatgtgttgtggttgcattatctgcattcgatgccgatgtatctctcgaggttttggatcatccaatcctagatttcttctattatatgttcgcggagatactgccttctgcgctagttctcttcgtccttcggaagcttcctcccaagcgggtatcggcgcaataccaccctattaactagagagttttttttttttgtttttgttttatggtgttacatgctaagaactccggataagctgaaacggctgaaaacctacatccggttgtagttgaatgcttttgcttgtgctgttatgtttatggaagcatcagtgtttgtgacgaatgaccatgcatcgtcgtcatcatcatcaattctatatgagaaagagttctgagtggtgctaatgaatttgacgactccttttgtggttgcatctccaagttgttatttggtcggttgtgctactgctacccggagcatgacatgacatctccagcagtaccataccattatttgaattgcatgtgcattcttgacgaagataaggccaatgatttgtggtcttgttggtccctgtgatgtttatggagtactttgtggtaattgtattcctgaggactggatctgaaactgaatgaactgtgcagtaatactgttatatattgcagatttgaggggtcgttaaggtagggttattgttatagttttggtactaactggattgtcctggcaaattgatcttacatgcttgcttgagaaatgagaacagaacactagtaatagtactagtggttcttgttactccttgctgtggtcgagtctatgccgtgtggggggcatcagccagctgccagccaaccggccggccggctcctctgacctgaactgcaatgcggagaccggcgacctggctgacgctgaccccgtccagtcaacatgctgccgtggttgtcactctctgcttccacttgacgttcttccacatccattgcttggccgtgc

SEQ ID NO: 2811 - DNA, 1214 bp, Saccharum officinarum
ctcctctcctccctcgcgggtcgcggcgcaggcacacacagaagcagagagggagaagggggagagaggaccaaggggggagagagagcgagccagagggagggagagatgaggagggagctggcttcctccttcgctactgccgccgccacggcgggtgcttcctcgtcggctgccgacgcgctccggggctggtgggacgatgtcaacgagtcgccccagtggcaggacgcggccttcttctccctcgccgccgcctacgccctcgtctccgccgtcgcactgattcagctcatcaggatccagcgccgggtgcccgagttcggatggaccacgcagaaggtcttccacctcatgaacttccttgtcaatggggtccgtgctctggtattcggcttccatgtccatgtcttcctcctccgcacaaaagtatacaagttggtgttgctagatctccccgggttgttgtttttctccacctacaccttgcttgtgctcttctgggcagaaatataccatcaggctaggagtctcccgaccgacaagctaaggcctgcatacattgccgttaacaccatcatatatgttgttcaggtttgcatttggatatacctcggaataaatgataatgctgtggttgagctggccagcaaaatattcattgtagctgtctccttcatcgcacttcttggcttttcagtatacggtggaaggttatttgtcttgctgagacgtttccctattgaatccaaggggcggcaaaagaagctttatgaggttgggactgtgacagcaatttgtgttacctgcttcctgataagatgcgttgtggtggcgttatctgcattcgatgccgatgtatctctcgaggttttggatcatccaatcctagatttcttctattatatgttcgcagagatactgccttctgcgctagttctctttgtccttcggaagcttcctcccaagcgggtatcggcgcaataccaccctattaactagagagcttttttttttatttcgtgttacatgctaagaactccggataagctgaaactgctgaaaacctacatccggttgtagttgaatgcttttgcttgtgctgttatgtttatggaagcatcagtgctgtcatcatcatcattctatatgagaaagagttctgagtggtgctaatgaatttgacgactccttttgtggtaaaaaaaaaaccc

SEQ ID NO: 2812 - DNA, 1621 bp, Panicum virgatum
ggaaacgtgaacgttttgcttaacgaaacagacctcgtgaggccaggtccgccgcctggtgctcctccctcgattccgacttgtctgtgtatctcacgtcgacggcgactcgccggcggccacggagcattacaactccctccccctcgccttttccctcccggagaagagaagaagagcgagatgaggaagctggcctccttcgccgccgctacctccggtgcctactcctctgcatccgccgcgctccgggtccggggctggtgggacgacgtcaacgagtcgcgccagtggcaggacggggtcttcttctccctcgccgccgcatacgccctagtctccgccgtagcactgattcagctcatcaggatccagcgacgggtgcccgagctcggatggaccacgcagaagatcttccacctcatgaacttccttgtcaatggggttcgtgctctcgttttcggcttccacgtccatgtcttcctcctccacacaaaagtatataagctggtgttacttgatctccccggcttgctcttcttctccacatacaccctactcgtcctcttctgggcagaaatataccatcaggctaggagtctcccaacggacaagctaaggcccgcatacattgccgttaacagcatcatatatgtagttcaggtctgcatatggatatacctcggaataaatgataatgccgccgttgagctggccagcaaaatcttcattgtagctgtctccttcgtcgcccttcttggcttttcagtatacggtggaaggttattcttcttgctgagacgattccctattgaatccaaggggcggcaaaagaagctttatgaggttgggactgtgacagcaatttgtgtgacctgcttcctgataagatgtgtcgtggtggcattatctgcatttgatcccgacgtatctctggaggttttagaccatccaatcctagacttgttctactacacgctgacggagatattgccatctgcgctagtcctcttcgttctacggaagctcccccccaagcgggtatcggcacaataccaccccattaactagagaaattttatgatgttataagaatgtatggatgagctggaaaagctgaaaacctacatccagttgagttgaatgctttttgcttgctgttgtgtttatggaagcatggaagcactggtggtgatgatgcatcgtcatcacatcatatgagaaaagagttttggtgttggatggcactaatggaacttgagactccttttgtggttggatctccaaggtgttgtttgcttggttgtgctacccggggcatggcatgacattgacatgacatgacttatttagcagtagtgttatgccattatctgaattacagtggtcattcttgatgattgccattatctgaattacagtgttcattcttaatggttgcctgttgatgcagacaatggccaaatgatttgttggtgctggtgatgcacattactaccatacctgtgtaaccattatcaccaatggtcgggcaacggccgttgcttttgccgtgcgccacgaagggcactcagcaaataaagacgtttgccgtgtgccaatattttttgccgtgttcccg

SEQ ID NO: 2813 - DNA, 2237 bp, Setaria italica
gcgagatgagggagctggcctcctccttcgcggccgccgccagtgcttcctcctctgcctccgcgccgctgctcgggggctggtggaacgacgtcaacgagtcacccgagtggcagcacgcggccttcttctccctctccgcagcatacgccctcgtctccgccgtcgcactgattcagctcatcaggatccagcgccgggtgcccgagctcggatggaccacgcagaagatcttccacctcatgaacttccttgtcaatggggttcgtgctctcgtcttcggcttccatgtccatgtcttcctcctccgcacaaaagtatataagctggtgctactagatctccccggtttgctcttcttctccacatacactctactcgtgctcttctgggcagaaatttaccatcaggccaggagtctcccaacagacaagctaaggcctgcatacattgccgttaacagcatcatatatgtcgttcaggtttgcatatggatatacctcggaataaatgataatgccgcggttgagctggccagcaaactcttcattgtagctgtctcctttgtcgcgcttcttggcttttcagtatatggtggaaggttatttttcttgctgagacgtttccctattgaatcaaaggggcggcaaaagaagctttatgaggttgggactgtgacagcaatttgcgtaacctgcttcctgataagatgtgtcgtggtggcattatctgcatttgatcgggatgtatctctggaggttttggaccatccaatcctagacttgttctactatacgctgacggagatattgccttccgcgctagtcctgttcgtcctacggaagcttcctcccaagcgggtatcggcacaataccaccccattaactagagagattttatgatgtttgtatggtactatataagaagtgtggatgagctgcatccagttgagttgaatgcttttgcttgccttgttgtgtttatggaagcctggaagcattcatccattggtggtgacgcatcatcatcatcatcatcaacatattatatgatgagaagagtcttggtgttgagtggtactctgatgaaatgaaactggcgactccttttgtggttgcatctccaagtgaagcgtgtacttcccccaatgccgtgtgcgccggcgagcacgcccaggccgccgtggagtcgccgcactggcagtccgccaactacgagcccaccacttgggactacgactccatctgctcatcgctcagccagcaaccagcaacaaccaccctcaaggagagagtgaggcgtctgctggtgctggaggaggctgcaagtgcaagcagcaggctgaggatgatccatcagctgcagagtcttggcatcgcctaccatttcgaggaggagatcgaagccatcctcctctccattcatcatactgctgccgatgacaaggaggagcaggaagacaacgaccttgatctgcattcggcagcgcttctcttccgaatgcctcgcctgctgcatggcggtgggcctggtgcaccggcgaggaccaagcccgcgccgccgacacctggaaggagctcaacaaggagatgtcatctgccccggatcagaacatggccagcaacctgtgcctcaaccttgcccggatcatccactgcatctaccaggacgaggacgcagcacctcgccgactcatcgcatgaagagcatggtccaggacctgctcttcaatcctaccctattctagttcccacatgtaatgggttattattgtaatttcacagcttcagctgattgtgtgtttgtacgtgtgcagcgcatacaatgcaagtagcagggcagttcactctatggaatgtagaaaattaaatgttcaaataagacaagtagagcacccggaactatttcagaaacaccatcacaagtgcgatttagccagtaaaaggtaaccacaatgtaatgtcgtctacagcctcagctgacaagtcactctgaacccgagttaagctaccaaaattcagccaatccaacaggttaaagggggctaaattctcgacgtctgtaaaaactcttagtcccaggcatcgcaggggggcttccgtgctgggatacggagctatttctcatgggagcgcaactaaggaagaaagctatatttccaaaaaggagaggaagttcttccgagttcatggaccaaaaatctctctacatgctgttccttgtgatgttccttcac

SEQ ID NO: 2814 - DNA, 1406 bp, Panicum virgatum
ggaacgttttgcttaacgaaacagacctcgtgaggccaggtccgccgcctggtgctcctccctcgattccgacttgtctgtgtatctcacgtcgacggcgactcgccggcggccacggagcattacaactccctccccctcgccttttccctcccggagaagagaagaagagcgagatgaggaagctggcctccttcgctgccgctacctccggtgcctactcctctgcatccgccgcgctccgggtccggggctggtgggacgacgtcaacgagtcgcgccagtggcaggacggggtcttcttctccctcgccgccgcatacgccctagtctccgccgtagcactgattcagctcatcaggatccagcgacgggtgcccgagctcggatggaccacgcagaagatcttccacctcatgaacttccttgtcaatggggttcgtgctctcgttttcggcttccacgtccatgtcttcctcctccacacaaaagtatataagctggtgttacttgatctccccggcttgctcttcttctccacatacaccctactcgtcctcttctgggcagaaatataccatcaggctaggagtctcccaacggacaagctaaggcccgcatacattgccgttaacagcatcatatatgtagttcaggtctgcatatggatatacctcggaataaatgataatgccgccgttgagctggccagcaaaatcttcattgtagctgtctccttcgtcgcccttcttggcttttcagtatacggtggaaggttattcttcttgctgagacgattccctattgaatccaaggggcggcaaaagaagctttatgaggttgggactgtgacagcaatttgtgtgacctgcttcctgataagatgtgtcgtggtggcattatctgcatttgatcccgacgtatctctggaggttttagaccatccaatcctagacttgttctactacacgctgacggagatattgccatctgcgctagtcctctttgtcctacggaagctcccccccaagcgggtatcggcacaataccaccccattaactagagaaattttatgatgttataagaatgtatggatgagctggaaaagctgaaaacctacatccagttgagttgaatgctttttgcttgctgttgtgtttatggaagcatggaagcactggtggtgatgatgcatcgtcatcacatcatatgagaaaagagttttggtgttggatggcactaatggaacttgagactccttttgtggttggatctccaaggtgttgtttgcttggttgtgctacccggggcatggcatgacattgacatgacatgacttatttagcagtagtgttatgccattatctgaattacagtggtcattcttgatgattgccattatctg

SEQ ID NO: 2815 - DNA, 1221 bp, Panicum virgatum
agcccacgcgtccgggaagagaagagaagagaagacttgcctccccgtccccttcttcccttctcccggagaagaagaagcgaagaagaagagcgagatgagggagctggcctcctccttggcggccaccggtgcctactcctcctcctctgcatcctccgcgctccggggctggtgggtcgacgtcaacgagtcgcgccagtggcaggacggggccttcttctccctcgccgccgcatacgccctagtctccgccgtagcactgattcagctcatcaggatccagcgacgggtgcccgagctcggatggaccacgcagaagatcttccacctcatgaacttccttgtcaatggggttcgtgctctcgtattcggcttccacgtccatgtcttcctcctccgcacaaaagtgtataagctcgtgttacttgatctccccggcttgctcttcttctccacatacaccttactcgtcctcttctgggcagaaatataccatcaggctaggagtctcccaacggacaagctaaggcccgcatacattgccgttaacaccatcatatatgtacttcaggtttgcatatggatatacctcggaataaatgataatgcggccgttgagctggccagcaaaatcttcattgtagctgtctccttcattgcccttcttggcttttcagtatacggtggaaggttattcttcttgctgagacggttccctattgaatcaaaggggcggcaaaagaagctttatgaggttgggactgtgacagcaatttgtgtgacctgcttcctgataagatgtgtcgtggtggcatcatctgcatttgatcccgacgtatctctggaggttttggaccatccaatcctagacttgttctactacacgctgacggagatattgccatctgcgctagtcctcttcgtcctacggaagctcccccccaagcgggtatcggcacaataccaccccattaactagagagattttatgattttataagaaagtatggatgagctggaaaagctgaaaacctacatccagttgagttgaatgcttttgcttgctgttgtgtttatggaagcgtggaagcactggtgatgatgcatggtcatcatatcatatgagaagagagttttggtgttgaatggcactaatgaaaactggagactcctttttgtggttgactctccaaggtgttgtttgcttggttgtgctac

SEQ ID NO: 2816 - DNA, 1249 bp, Hordeum vulgare
aatctcacccgacccaacctctcgggtctccggtatgaactctgacgcctgaactacccctaaacccatcccgtccccgccgccgccgccgccgccttccgccccctctcccctccagaccccgtactcctccgcggctatggacgccgccaccgacggtgagcagaggcgcctcctctccatccccaaggagggcgagcgcgtcatcgcgccgacgcgccgcccggacgggaccctccgcaaggagatccgcatccgcgccggctacgtcccgcaggacgaggtcgccatctatcagtccaagggcgccctcatgaagaagacagggcccgacgtgccgcccgggtacgaccctgcgctcgatgccaagcccaagacgaaggcggccaagcgcaacgagcggcgcaaggagaaacggcaccagggtggttcaacaaatgataaagggaagagcttggatatagacgagcctgatgctggagaaactgacaaggttcattcctccaaaactaagcagagggatacagtggacagtgtaacagagcacataagtggcattgctatctctgaatctccagttatggcgaccccttccacaaatgctgctgacaacttacaaacggagtcatctgttccagagatagataagaaaatccgagcactgaagaaaaagatacggttagccgaagcacaagtgcaaggggacccagaaaaattgaagcctgagcaactggagaaaacgaaaaagattgaaggatggcgtgaagagctgaagcttttggagtctacgagggttcattctgcatcatagacaaagccgacttggctctgatgtaaactgagctgtcagctctgcacacccgctgcggtgttgttgctgacccaaaattcaatcgatcatgctatgcttctccagtacctacgggtttgctggaaatgcattccggtggacgtggggtttgcacagaatggaagatttttcaccacatttgttgtctcatgtaacgcttgtcagttccaaaatttatatcgcaatatcggtttgtcaaagatcatacattgaggtgataactgattggccatgggatggctgttgctttcgtgtgctataccaactttgtggttcctttgacgctggactgatttacttttttatgttgagttgtattctctccctttttttctattgatttcacacctcgagtggaggaataaaaaaacaaactgatggaataaacagaggaatttg

SEQ ID NO: 2817 - DNA, 1183 bp, Secale cereale
tcagctctggggtctccggtcttaactctgacgcctgaactacccctaaacccatcccgtccccgccgccgccgccgcccgccgcagccttccaccccctctcccctccagacctcgtacgcctccgcggctatggacgccgccaccgacggcgagcagcggcgcctcctctccatccccaaggagggcgagcgcgtcatcgcgccgacgcgccgcccggacgggaccctccgcaaggagatccgcatccgcgccggctacgtcccgcaggacgaggtcgccatctatcagtccaagggcgccctcatgaagaagtcagggcccgacgtgacgccggggtacgaccctgcgctcgatgccaagcccaagacgaaggcggccaagcgcaacgagcggcgcaaggagaaacggaaccagggtggttcaacaaatgataaagggaagagcttggatatagaggaggctgatgctggagaacctgacaaggttcattcttccaaaactaagcagagggatacagtggacagtataacagagcagataagtggcattgctatttctgaatctccagctacggcaaccccttccacaaatgctgccaacaacttacaaacagagtcatctgttacagagatagataagaaaatccgagcactgaagaaaaagatacgcttagctgaagcccaagtgcaaggggacccagaaaaattgaaacctgagcaactggagaaaacaaaaaagattgaaggatggcgtgaagagctgaagcttttggagtctacaaggggtaatgctgcttcgtaggcaaagcgggcttggccctgatgtaaactgatctgtcagttctgcacgcccgcttggcgttgttgctgacccgaaattcagtcgatcatgctatgcttctccagtacctatgggtttgctggaaatgcattcaggtggacgtggggtttgcacagaatggaagatttttcaccacatttgttgtctcatgtaacacttgtcagttccaaaatttatattgcaatatccgtatgtcaaagatcatacagtggaggcggtaactgatttgccatgggatggctgttgctttcgtgtgttataccaactttgtggttcctttgacgctggacttaatttacctttttaaagttgagttgtcttctcctctgtttattccatc

SEQ ID NO: 2818 - DNA, 1162 bp, Triticum aestivum
ccttccaccccctctcccctccggaccccgtacgcctccgcggccatggacgccgccaccgacggcgagcagcggcgcctcctctccatccccaaggagggcgagcgcgtcatcgcgccgacgcgccgcccggacgggaccctccgcaaggagatccgcatccgcgccggctacgtcccgcaggacgaggtcgccatctatcagtccaagggcgccctcatgaagaagtcagggcccgacgtgacgccggggtacgaccctgcgctcgatgccaagcccaagacgaaggcggccaagcgcaacgagcggcgcaaggagaaacggcaccagggtggttcaacaaatgataaagggaagagcttggatatagaggaggctgatgctggagaacctgacaaggttcattcttccaaaactaagcagaggaatacagtggacagtataacagagcagataagtggcattgctatttctgaatctccagctacggcaaccccttccacaaatgctgccaacaacttacaaacagagtcatctgttacagagatagataagaaaatccgagcactgaagaaaaagatacgcttagctgaagcccaagtgcaaggggacccagaaaaattgaaacctgagcaactggagaaaacaaaaaagattgaaggatggcgtgaagagctgaagcttttggagtctacaaggggtcatgctgcttcgtaggcaaagcgggcttggccctgatgtaaactgagctgtcagttctgcacgcccgcttggcgttgttgctgacccgaaattcaatcgatcatgctatgcttctccagtacctacgggtttgctggaaatgcattccggtggacgtggggtttgcacagaatggaagatttttcaccacatttgttgtctcatgtaacacttgtcagttccaaaatttatattgcaatatccgtttgtcaaagatcatacagtggaggcgataactgatttgccatgggatggctgttgctttcgtgtgttataccaactttggggttcatttgacgctggactaatttacctttttaaagttgagttgtcttctccctttttttttgctactattgattgatttcacacttcgagtggaggaatatcgaaacaaagtgattgaataaacagaggaatt

SEQ ID NO: 2819 - DNA, 2044 bp, Triticum aestivum
gcatccgtgccgccgtccgcggttccggctggaggcgagcttgtcggcctccacgccggcgcccgcgccggcgacagcggacgatggggccgctgcggggccgtgccccgtggtcaggttcgacatggccgacttcactgtcgccgaccgcgtcagcgtcgggctccacggacggtccgatgagatgatcttcgaggccacggtgcgcgatcctagcagtgagctgtacgggtcgacggtggtgttgcggcagctgactagctcacaggcgaagcggaggggccgccgcgcgctagaggtgctcaagaagctggcccgtcgccagatgatgtaccactcttacgcgatgcaggtccatggctacgtcactccgagcaaggccatggaagagggtgatagtccgcttgtcttggtgcacgggtaccatgggagttactccttgcgtcactggttgcaactctcggattggcttccaaccttggaagcaacattagcattggatgaagaacaagtaaggagggtaggagatgattcggttggagggcctgctgtaactcggcagctgcgtttaatcaggatattgatgagagaccttctgattggtgtaaattatctgcatagccatggaatggcgcatactgagcttagactggagaatgttcatgtaagcccagtagacaagcatgtcaaagttggtattcttgggaatgctgttgattttcatgacaatgaccccagcaacagtgcagtagcaagtaacaatgagaggcggaaaatgatgatagcatttgacatgaggtgcgtgggcttcataatggcaaagatggttttgagagagctcatggattcatcgacattccaaaaattcaagtcattcttgaataagggaaatgatccatcatgtctgcgtgagttccttttaccgattctaagccaaaattctccatctgggaatattggtctgcagatgctagataggcactggggtgctggctggaatcttttggccttattactggcaacaaaatctgacaaaaggataagttgtgtcgatgcactgcgtcaccccttcctttgtggacctaaatggcgtataagtccaacagtgaatgtcgtacgctggggcttgggatctactgctgtccgcctggctgaagattatatttatgggcatcatcagcgtagacggttagcatatttcattgagttgatggaggtgctaaaccctaattcaagtacagagaattggcttcgcctcctacctggtcgctggtgcctcttgtactgcactggaaggcacatcggtctaacacttcgtcagcctacccccagagtcctcatcaacgatgcgttcctcacattcgccgaagccccagaatctgtggatcccattttatctctgacctcagatattggtttcaaaatcatgccggaatccgactggccccacgacaaatctggaaccgaaggaaatctgtcagttaccacatcggcaaggataactcctgggaggatttacaccaatgccgaggatggtaaagagagtagtagtaggattacatcttccagatatcttggtggtaaatggggaaaagccgcaaagatgaaggagctgccagccagcctccccaccgctagcgttaacgtggatgaggacgacgtcgacgtgtccatgagttgcggctcaactttgaacgtcaagtctgcacgcaatgtgctgcaagaggtccgtacgcagacgccaccggagatgttcgacctgtcaaagattgtttgcggtacatacattgattcaaggttgatggttcttcgcggtgttaatgggtcggctttacttttcgttagatcaaaccgtacgtctgacccctgaggagcatatttgtaacccattgtctcctgtagcattcttgtatctgtaggtgtacattattcatttttagcaagtgtacataataaaggttctagaaataaaatcagtgttatgttaaaaatgtactagtatgttacataaactgggagggttctacacaatcttgagaaaggg

SEQ ID NO: 2820 - DNA, 2919 bp, Panicum virgatum
cggtcaaggtagaaataccgttctcacacttgactgccgcgcttaactttgcacagtgcgacaatagctgcctagctggacggtagacacagcccgcggagcaccactcgacttcgtcgctccacctcagttgcccagacggcggaaacggacagccccggcgcacgtccgagctggtgcaccgggcctataaaaaaatcgtgccccccgcacggccgcgcggccgctggcgcggcgcggggtgaggcgggcggaaagggatccgctgcagctcggcagcctgcagttgggccactgacaggtgggcttgtatgtgtaggcccatgtgttagggacaccactgcagggcactcaactgcagcggatctcgttccgaggcggacgcgcgccgggctcatggcagctgccgccccgccgcttccctgcacgcaaccgcctcgcgcctccgcctcttcttaagtcaatccccccgcgtggcctccctccgctgcgccgcgacgatctcctcccactcgcagtcgcggaccaacggcggcgacggtactaggtactagcaagtgccggccccacatgcctctcgcggcggccgccgccgctgccggcgcctgccccatcccggtcggcctcggccgccccttgtgccgtgtccacgcacatccgcgccgccggtgggggttccggttggaggctagctcatcggcgcccgcgcccgcgcccgcgccggccgcggcggatgagggggctggagcggggccgtgccccgtggtcaggttcgacatggacgacttcgccatagctgaccgcgtcagcgtcgggctccacggacggtcggatgagacgatcttcgaggccacggtgcgcgatccgagcagcgagctgtacgggtcaacggtggtgctgcggcagctgaagagctcgcaggcgaagcgcaggggccggcgcgcgcttgaggtactgaagaagctggctcgccgccaaatgatgtaccactcgtacgcactgcaggtccatggttacatcgccccgggcaatgccgtggagcaggaagatatccctttcgtattggtgcatgggtatcatgggagttattccctacgtcactggttgcaactctcggattggctcccaaccttggaagcaacattagcattggatgaagaacaagttaggagggtaggagatgactctgttggaggaccggctgtatctcgacagctacgtttaattaggattttgatgagagaccttttgattggtgtaaattatctacatagccatgggctggcacatactgagcttagattagagaatgttcacgtgagcccaatagacaagcatgttaaggttggtattcttggaaatgctgctgattttcatgacaatgatcctagcagtagcacagtagcaagtaacaatgaaagacggaaaatgatgatagcatttgacattagatgtgttggcttcatcatggcaaagatggttttaagagagctaatggattcttcaactttctttaaattcaaatcattcctgacaaagggaaatgatccatcctgtttgcgtgagttccttctaccaattctgtgccaaaattctccatctgggaatattggtttgcagatgctagataggcaatggggtgctggttggaatcttttggccttattgctggcaacaaaacctgagaaaaggataagttgccttgatgcattgcggcaccccttcctctgtggaccaaaatggcgtataaatccatcaactagtatcattcgatggggcttgggatcgactgctgtccgcatggctgaagattatatctatggaagtcatcagcgtaggcggttagcgtattttgttgaattgatggaggtcctcaaccctaatttaagaacagagaactggcttcagctcctacatggtcgctggcgtctcttgtactgcactggaagacacattggcctcacgcttcgtcagccgtcccctagaatcctcatcattgatgtgttcctcacagttagttcagactccgctgatccagtcttctcactgacgtcagatattggtttcagaattatgccagaatctaattggcctcatgacaaatctggcactgaaggagttttgtctgtcacaacatcagcaaggatagctgctgggaggatttatattaatgaacaggacagtaaggagagtagggctgcatcttctagatcttctaggagatataatcgcggtaaatggagaacagcttcaaagatgaaggagctgccagctagtctccccagtgtaaacattgccatggatgaagtcgacgtatcgatgagctgcaactcaactttgaatgtgaattctgcacagaaagtgctgcaagagatccgcacgcaaaccccaccagaaatgttcgatttgtcaaagattgtctgcgggacatacatcgatgcaaggttgatggttcttcgtggtgtcaacgggtcggctctgcttttcgttagatcaaatccaatgatcgattcctgaggagaatccattcgccgtgtaatgtaatgcgtattctctatgtacattctgtattcctagctgcgcattcatttgtagcaagtgtggataagatgctgtaggccatagttactgctagactgttatattcctttgaatgatccttggtcatacgctcagcccaggggctgaggcgctggcaccgtgcgtctacattcgccccctgtatagaactgcaagacttttcgccttttggtgagctgatagctacacgatggtcattttcttggtcatccactcagattttggtgcagtgactgtaatgtcgtttcacaatttttttcttttgtttactggatcgtgttttttttttgaaacggaaacttgagcttccattaactaatggttccaagcaaattgccg

SEQ ID NO: 2821 - DNA, 2354 bp, Setaria italica
gcaaccgcctcgcgcccccgcctcttgttaagtcaagcccccgcgcctccctctccctccgctgcgccgcgacggtctcctctccctctcccactcgcactcgcagaccaacggcgacggtacaggtattaaccggtgccccgtgcccgccccacatgcctctcgcggcggccgctgccgtcgccgcatgcccctcgccggtcggcctcgcccgccccttgtgccgcgcctacgcgcatccgcggcgcccgcgggggttccggttggaggctagctcatcggcgcccgcgccggccgcggcggatgagggggctggagcggggccgtgccccgtggtcaggttcgacatggacaacttcgccatcgcagaccgcgtcagcgtcgggctccacggacggtcggacgagatgatcttcgaggccacggtgcgcgatccgagcagcgagctatatgggtcaacggtggtgctgcggcagctgaagagctcgcaggcgaagcgcaggggccggcgcgcgattgaggtactgaagaagctggctcgccgccaggtgatgtaccactcgtacgcactgcaggtccatggttacattgctccgggcaatgcggtggagcaggaagatgtcccgttagtattggtgcatgggtatcatgggagttattccctgcgccactggttgcaactctcggattggctcccaaccttagaagcaacattagcattggatgaagaacaagttagaagggtaggagatgactctgttggaggacctgctgtaactcgacagctacgtttgattaggattttgatgagagaccttttgattggtgtaaattatctacatagccatgggctggcacatactgagcttagattggagaatgttcatgtgagcccaatagacaagcatgttaaggttggtattcttggaaatgctgctgattttcatgataatgatcctagcagtagtacagtagcaagtaacggcgaaaggaggaaaatgatgatagcatttgacatgagatgtgttggcttcatcatggcaaagatggttttgagagaactaatggattcttcaactttctttaaattcaaatctttcctgacaaagggaaacgacccatactgtttgcgtgagttccttttaccaattctctgccaaaattctccatctggaaatataggtttgcagattctagataggcaatggggtgctggttggaatcttttggccttattgctggcaacaaaacctgacaaaaggataagttgtgttgatgcattgcggcaccccttcctctgtgggccaaaatggcgtataaatccatcaactagtatcattcgatggggcttgggatcgactgctgttcgcatggctgaagattatatctatggacatcatcagcgtaggcggttagtgtatttcattgaattgatggaggtcctaaaccctaatttaagaactgagaattggcttcagttcctacctggtcgttggcgtctcctgtactgcactggaagacatattggcctcacgcttcgtcagccttcccctagaatcctcatcagtgatgtgtacctcacagttagttcagagtccatcgatccagtcttctctctgacctcagatattggtttcagaattatgccagaatctgattggcctcatgacaaatctggcactgaaggagttttgtctgtcaccacatcagcaaggatagctgctgggaggatttatattcatgaacaggacaataaagagactagggtcacatcttcaagatcttctaggagatatcttggtggtaaatggagaaaagttgcaaagatgaaggagctgccagccagtctccccagtgtaaacattgctacggatgaagtagacgtatcaatgagctgcaactcggctttgaatgtcaattctgcacaaaaggtgctgcaagagatccgtacacagaccccaccggaaatgttcgatttgtcaaagattgtctgtgggacatacattgacgcgaggttgatggttctccgtggtgttaatgggtcggctctgcttttcactagatcaaatccgacgaccgattcgtgaggccatgtaatgctattctttctctgtacattctgtatttctagctgtacattcatttgtaacaagtgtaaataataagatggtgtaggccatagttaggctgttatatattcctttgtaattttgtatgatctttttcggtcatgtgcccagcccaggctgaagcgctggcagcgtgagtataattaaattcgttcctgtatagaaccacaaaaccttcggtgagcttgatagccaaataatgtcattttcgaagttgctctcgca

SEQ ID NO: 2822 - DNA, 3436 bp, Oryza sativa
gcctcgcgcccccccttcctcttcttaacccccccgcctcctccccactccacacctcctcgctgcccagccaccgccgccctcccgtcccgcggagccgacgacggtgaccgccgacgaccccacccgcgatgcctgtcgtcgcggccgccgccgccgccgtcgccgcccgaccgaccggggctggccccgcgcgccccttgcgcggcggcgtgtccgcgcgcccgtgccggcggcgggggttccgggcggaggcgagctcgtcggcgtcaacgcccgcgccggtggcggcggatgagggggcaggagcggggccgtgccccgtcgtcaggttcgagatgggcgacttcgacgtcgctgaccgcgtcagcgtcgggctccacgggcggtcggacgagatgatcttcgaggccacggtgcgcgatccgagcagtgagctgtacggttcgacggtggtgctgcggcagctgatgagctttcaggcgaagcgcaggggccggcgcgcgctggaggtgctgaagaagctggctcgccgacagatgatgtaccactcttacgcgatgcaggtccatggatatgttactccaggcaatgacgtggagcaggacgatggatccttcatcctggtgcacgggtaccatgggagttactctttgcgccactggttgcaactctctgattggcttccaaccttagaagcaacattagcgttggatgaggaacaagttaggagggtaggtgatgattcagtaggaggacctgctgtaacccggcagctacgtctaatcaggatattgatgagagaccttctgattggtgtgaattatctgcatagccatgggctagcacatactgagcttagattggagaatgttcatgtaagcccaatagacaaacatgttaaagttggtattcttgggaatgctgttgattttcatgacaatgatcctagaaatagcacattagcaagtaatgatgaaaggagaaaaatgatgattgcatttgacatgagatgtgttggctttatcatggcaaagatggttctgagagagctaatggattcttctactttcctaaaattcaagtcattcttgacaaagggagatgacccagcatgtctgcgtgagttccttttacctattctgtgccgaaattctccatccgggaatattggtctgcagatgcttgatcgacaatggggtgctggttggaatcttttggcgttattgctggcaacaaaacctgacaaaaggataagttgtgtggatgcattgaggcaccccttcctttgtggacctaaatggcgcataaatccatcagttgatgtcatacggtggggcttgggttctactgctgtccgcatggctgaagattatatttatggacagcatcagcgtagacgattagcatattttgttgaattgatggaggtgctaaaccctaatccaagaacagagaactggcttaacatcctacctggtcactggcgtctcttatactgtactggaaggcacatcggtctaacacttcgtcagccttctccgagaatcctcatcactgatgtgtttctcacatttgcacaaacttcagactccattgatcctgtgttctctctgacctcagacattggtttcaaaattatggcagaatctgattggcctcatgacaaatctggtagcgaaggaacattatctgttacctcatctgcgaggatagcaactggaagaatttatattcacgaacaggatggtgatgatagtagggttgcatcttcaagatcttctaggagataccttcgtggtaagtggagaaaagtttcaaaaatgaaagagctgcctgctagcctccccacagtaaacattaccatggatgaactcgacgtatcaatgagctgcagctcgactttaaatgtcagttctgcgcagaaggtgctgcaagagatccgcactcagaccccgccagaaatgtttgatttatcaaaaattgtttgtgggacatacgttgatgcaaggttgatgattcttcgtggtgttaacgggtccgcgttatttttcaccagatcaaattctagagctgattcctgacgataatcagtgaagcttgtaaccaatattctttgggtgtacattctttgtatttctagctgtacattattcataactagcaaatgtaaataatagagtgtaagctaaatctgtcagtcatccttccgaatcaggagagaaatatgttgccgctttattatttgatcttggaaaatgagtaaatgacgaattgacgatgtctacagcagagtccagggtggaagcataaagagggttccaagttccaactctcaatcagaactcgagcatgcagacgaaggagatggccaagcgaaggcgcagtccactgctgtcaacctgtgatgcgtgcctcagccatcaaatcccggtcgccatgttttaaggctccagcttcgatgtcatcctctcttgcctcgtccttcggttcttcctgtaggcaagcgagcacggcggtgcttctcctcatttcagtatttcttgcagaaatttgggatcatgccatcggaaaaaaaagtgatttggaatatcatcatttcaattggagttagttaaaataccactctaaactagaccatctacgccggaaaaccatcgtcgacataattatcctttaggttgttcttcttcctccctccaacaccggaagagctagtccatggtcactgtgcattttggccaccaccagcttattgcctccttgcacatcgactaacctccactccctctatgtcacaactgtcgtgctctcctactttgcgtagggccacctgtcgctcccgcggtgctccaggacttctccttgagcttgcggaggcggttggcctcctcgagccagccttgtgccggtcgaaaaactcagagtccgacagtgacactaggtagaagttctcctagtcccatgccaacaacagcgatgacctaaccatcggttttcggaacgacgactacgcggggctggtgatgttggagtcggacatgatgtgcgacaccatgaggtaacaacggggcacgggattgccacaagagcaagcgggggaggtgggtgcttagggaataatgtcaggacaatgctatagacgagggtgctgatgacgacattgttgggatcaacacatattggtgagcgatgggcgaccttgcatgaagcggggagagcatgggtgtggatgtagtcagcgtgcatggaggcaagcagctaatgtcaaccatgacgcacgatgccagttggcgatctcttctggggactacctacattttgtggacaaattttcttcaaaaaaattaatagatgtaaatataatacaatcgtgattataacttgtatgtaaccttcaaaaatctctcggtaacatactattttcatgaaacag

SEQ ID NO: 2823 - DNA, 2325 bp, Sorghum bicolor
ggcggacgcgcgccgggctcatggcagctaccgctccgccgcttccccgcacgcaacagcctcacgcctctgcctcttcttaaagtcagtccccgagccttcttctccctccacttcgccgcgacgatctcctccactagaccaacagcaacggtactaaccagtgccagccccgcatgcctctcgcggcggctgccgcggccgttgccgcctgtccttccccgatcggcctcacccgccctttgtgccgtatcgaggcgcatccgcggcgccggcggaggttccggtcggaggcaagctcatcggcgtccgctcccgcgccggccgcggtggatgagggaggcggagcggggccgtgccccgtggtcaggttcgacatggctgatttcaccgtcgccgaccgcgtcaacgtcgggctccatggacggtcggatgagatgatcttcgaggccacggtgtgcgatccgagcagcgagctgtatgggtcaacggtggtgctgcggcagctgaagagtttgcaggcgaagcgcagggggcgtcgcgctctcgaggtgctgaagaagctggctcgtcgccaaatgatgtaccactcctacgcacttcaggtccatggttacattgctccgtgcaatgccgtggaggaggaagatgtcccgttagtattggttcatgggtatcatgggagtcattccctgcgtcactggttgcaactctcagattggctcccaaccttagaagcaacattagcattggacgaagaacaagtcaggagggtaggagatgactctgttggaggaccagctgtaacccggcagctgcgtctaatcaggatattgatgagagaccttttgattggtgtaaattatctacatagccatgggctggcacatactgagcttagattagagaacgttcacgtgagcccaatagacaagcatgttaaagtcggtattcttggaaatgctgctgattttcatgacaatgatcctagcagtagtacaacagcaattaacaatgacaggcggaaaatgatgatagcctttgatatgagatgtgttggcttcatcatggcaaagatggttttgagagagctaatggattcttcaactttctttaaattcaaatcattcctgacaaagggaaatgacccatcctgtttgcgtgagttcctattaccaactctctgccaaaattctacatctgggaatattggtttacagatgctagataggcagtggggtgctggttggaatcttttagccttattgctggcaacaaaaccggaggaaaggataagttgtgttgatgcattgcggcacccattcctttgtgggccaaaatggcgtataaatccatcagcaaatctcatacgttggagcttgggatcaactgctgtccgcatggctgaagattatatctatggacatcatcagcgtagacgcttagcatattttgttgaattgatggaggttctaaaccctaacttaagaacacagaattggattcacctcctacctggtcgttggcgtctcttgtactgcactggaagacacattggcctaacacttcgccagccttcccctagagtcctcatcagtgatgtgtaccttacagttagttcagagtcagtcgatccagtcttctctctgacctctgatactggtttcagaattatgccagaatctaattggcctcacgacaaatctggcactgaaggacttctgtttgtcaccacatcagcaaggatagctgctgggaggatttatattaaggaacaggacagtgaagagagtagggtcacatcttctagatcttctaggagatatcttcatggtaaatggggaaaagtttcacaaatgaaggagctgccatctagtctcccaactgtaagcattgctgctatggatgaaatcgacgtatcgatgagctgcgactcgagtttgaatgtcaattctgcacaaaacgtactgcaagagatccgtacacagaccccaccggaaatgttcgatttgacaaagattgtttgtgggacatacattgatgcgagactgatgattcttcgtggtgttaacgggtcggctctgctcttcactagagcaaatccaacgagtgacccctgaggagactccgttccccatgtaacgcgtattcttcctctgtacatgtgtatttctagcagtacattcatctgtaacaagtgtaggtaacgaggtgtgtatgccataggttagaacgttacatattcctttttaaaatgatttgttgcttcaagtaggaagccttggcagggcttgagctgataaatgattgttactcccccccccc

SEQ ID NO: 2824 - DNA, 2643 bp, Panicum virgatum
tttacatactggttcaaggactaaatcgttagcggttatattctgcaggggggtcatttcgtgtttattgacaccgtcggcgttccactcggctgtgatgtatgcctgtcgtaatattttatctggagctggagaggagggcctcactcttcctgatggcttaatatccgcatgagatcgcatcctcaacaatctcgtgcccaacaatagtagtctagtacatgataaagcaaagcttatacgatggtggaactatttgtgcccatctccaccagattgtttgtgtacgaattgggctgatattttccgtgtacatattctgtatcaattgtgagaaacgtaaagttatgtaatgtacgaattctttatttgattttcaagacccaaacttgcactacgcaaatcatgtccttgcaaaaacaaattcttacgccgaaaacaccaccggactccagttgcattgctcgccaggtagttgttagagctgatatttggacatcatatgttcctgtgttcaaatggttttctctattttttgcataaatcgaagcgttttctacaaaaaaaatctagaaactactgaattatgcaaattttatgaagctttgcgcgtcaatcgtcgtgggctcgtggccacttagcgcaggcaacctctcccggtctctcggccccactcagacttcctttgatgagcctgagcccacaggcagctagtcgtgcggctgcacgggtagcagagcatggcggcggcggcaggctcttcgccggcctcgccgccgccacctcccggatcgcctccctcggccgcgcgggcgacgcagccgcagcgcgcgccgtgttcgacgcgatgccgcggcgcgacgcggtggcctggaacgcgatgctcaccgcctacgcgcgcgccggccggccccgcgacgcgctcgcgctcttcacccgcgcgcccgcgcccgacgcgttctcgctcaccgccgcgctcgccgcggccgcggcgctccggtgccacgccgccggcgcgcagctccacgcccggctcctccgcatcggcctgcgggcgccgctccccgtcggcaacgcgctcgtcgccatgtacgccaagtgcgcccgcgccgacgacgctgagcgtgccttccgggagatgcacgaccgcaatgcgctgtcctggtgctcgctcctgcacgcctatgtcgcctcaggccacttgaggctcgcgcaggacttgtttgatgaaatgcctagcagaaacaacgtcgcctggaacacgttgcttatggggtattcacgcagtggcaatgccagacaatgcctgattctcttcagcaagatgtggatggcggggcttacctgtgacgatgcaacactctgcattcttgttgatgcttgcaccgagctagcccacccatctaccggctttgcagttcacaagattgtagtgcagagtggatgggatgcaatggccgaggtcagtaactccctgatttccttgtacactaagttcagtttgctcgatgacgctgtgcgaatttttgagtccatggaggtgcggacaattgtgtcatggaattcactgattgatgcttacatgaagcttggctacatggagcaggctgcttctctttttcgaactgtacccgagccaaatgttatctcatggacagcaatgattggaggacttgcaaggaacggctgtgctgatgaagccctcagactatttgtcgagatgttggcacatgatcatattcgtccagacgacttcacatttggggctgtgcttcatgcttgtgctacttctgtgtctcttgcaagtggaagggcggtccatggtagagtgttccaaactgggtttgcatcctacctgtatgtagccaacagttgatggacatgtatgccaagtgcggggatgtcaagagtgcaagcgatgtgttcaatggcatctttgccaaggacctggtctcatggaacacaatgttgttcggatttgcgataaatgggtgggccaacgaagcactgatggtgtacgaaaccatgaaatcccatgaagtctgccctgatgaggtgacatttgcatgcttgcttacagcctgtagccactctggccttctggagcaagggaaaatgttcttcgagtcgatggtgtctgttcatggaattcagccaaagccagagcatctgtcttgcgttcttgacatgtttgcgaggtcaggggacatcacaaaggctattgagatgctcagtcattgttcggaaacagttcagactcatagcagcgacatacatgaagctctgcttagtgtgtgctcgtcggagcacctgaatgtcagtgttgcccggaaggtggtgaaagacatggtgaggactgatcctccaagagatgcaggctatgtcatgctgtccaacttgttctgcgccagtgggcaatggagcgaggccgagagggtgagaaaagcaatggctgagcacggtgtcaagaagtcccctggttgcagctggatcgaggtggaaggtgctgttagggtatttgtatcaggtgtgcaagatcctgatcatacaggttttgtatgcaatgttcttcgcctattagatggggagatgagaaacatcacccaatgctgaaattacggtcgaccataacataccccctcc

SEQ ID NO: 2825 - DNA, 2170 bp, Sorghum bicolor
aacctctctctcgcctactcaaacttttgatgagcctaagcccacatgccgctggtcgcgcggctgcacgggtagcagagcatggcggcggggggcgggcccttcgccggcctcgtcgccgccacctcccggattgcttccctcggccgcgcgggcgacgcggcctccgcgcgcgccgtgttcgacgccatgccgcggcgcgacgccgtggcctggaacgccatgctcaccgcttacgcgcgcgccggacagccgcgcgacgcgctcgcgctcttctcccgcgcgcccgcgccagacgcgttctcgctcaccgctgcactctccgcggccgcggcactccgaagccccaccgccggagcgcagctgcacgcccgcctcctccgagtcggcctgcgggcgctgcttccagtgggcaactcgctcatctccatgtacgccaagtgcgcccgcgcggaagacgccgcgcgcgccttcggtgagatgcgcgagcgcaatgcgctgtcctggtgttcgctcctggatgcctatgtcgcctcggacgacttgaggctcgcacaggaactgtttgatgaaatgcccaacagaaacaatgtcgcctggaacacgttgcttatgggatattcacgcagcggcaatgctaaccactgcttgcttctcttcaacaagatgcgaatggcgggactcacctgtgatgatgcaacactctgcattcttgttgatgcttgcaccgagctggccaacccatctgctggctctgcaattcacaagattgtagtgcagagtggatggaatgcaatggccgaggtcagtaactctctgatttccctgtatactaaattcagtttacttgatgatgccgtgcggatctttgagtccatggaggtgcagaccattgtatcgtggaattcactgattgatgcttacatgaagcttggctgtgtagaaaaagccacttctctcttcggaagtgtacctgagaccaatgtcatctcatggactgcaatgatcggaggacttgcaaggaacggccttgctgatgaagcactcattctatttgtcgagatgttggcacacgaacacatccatccggatgacttcacatttggggctgtgctgcatgcttgtgctactgcggcatctctagcaagtggaaggatggtccactgtagggtgttccaaagcgggtttgtgtcctacttgtatgtggccaacagcttgatagacatgtatgccaagtgcggggatttggagggtggtactaatgtgttcagtaccattgtcaacaaggacctggtctcatggaacacaatgttgttcggatttgctataaatggattgcccaatgaagcactggtggtgtacgacagcatgaaatcccatgatgtctgccccgatgaggtgacatttacaggcttactcacagcctgtagccactctggtcttctggagcatgggaaaaccttcttcgagttgatggtgtctgttcatggaattcagccaaagccagagcatctgtcttgcattcttgacatgtatgcgagatcagggaacattacaaaggccatggagatgctggatcgttattcagaaatgattcagacacataacagcgacatacgtgaagctctgcttagcgcatgctctttggaacacctgaattttagtgttgcaaggaaggcagtgaaagacatggtggcgaccaagtctgcgggagacgtgggttatgtcatgctgtccaacttattctgcgccactgggcagtggaaccaggctgagcgggtgcgaatagcaatggctgagtatggcatcaagaaatcacctggctgtagctggatcgaggtccaaggtgctgttaaagtttttgtatcaggtgcacaggatcttgatcattcaggttgggatgttattagcttgttggatggcgagatgagagatatcatgtttttcgatgtacagtcgtataggtcatcatagtgaaccgcattgagattgttgttatgttccaaatgggacttcctttgtttccgtatatgctctacggcaatgaagttctaactcagtgttgctaacgaaagctcaagctaggttctgtttgtgtttatatgctgtgacgttgtcatcttggacatcttcgctaagaatggacagcgaaacaataatagactttgca

SEQ ID NO: 2826 - DNA, 1810 bp, Panicum virgatum
cacgcgtccgcactcgcaaactacaagctaccaccttatcacaacgcgatcgatcgacccaaccaaaggtagcttaattagtgatcatcgatcactcgagggaggaggagaaaattaaagaaaaaggaagcaggtgctgcggtgaagtggccggtgagggagcgagctgatcgaccatgggtaccatcgggttcccggtgacgaggacgagcaggtcgctggtggcgccgtcgtcggcgacgccgcaggagacgctgcacctgtcggtgatcgaccgcgtggcggggctgcggcacctggtgcggtcgctgcacgtgttcgacggccgccgcggcgaggcggcggtgaggacgccggcggagacgctgcgggcggcgctggggaaggcgctggtggactattacccgctggcggggcggttcgtggaggaggacggggaggtgcgggtggcgtgcacggcggggggcgcctggttcgtggaggcggcggcggcgtgcaccctggaggaggtgaagcacctggaccaccccatggtcatccccaaggaggacctgctgccggagccggcgccggacgtcaaccccctcgacatgccgctcatgatgcaggtgacggagttcgcgtgcggcggcttcgtggtgggcctcatctccgtgcacaccatcgccgacggcctgggcgccgggcagttcatcaacgcggtggcggactacgcgcgtggcctcccgaggccccgcgtgctccccgtctgggcgcgcgacgtcatcccggcgccgtccaggatcgtgtccccgccgccgcggttcgacctcctggacctccgctacttcaccgtggacctcagcccggagcacatcgccaaggtcaagtccagcttcttcgaggcgacggggcagcgctgctcggcgttcgacgtgtgcgtcgccaagacctggcagtcccgcgtccgcgcgctccggctggacggcgacgacccggcgcggcccgtccacgtgtgcttcttcgccaacacgcggcacctcctgccgcagctggcgcccgggttctacggcaactgcttctacaccgtgagggcgacgcggccctgcggcgaggtggcggcggccggcgtggtggaggtggtgcgcgccatccgggacgccaaggcgcggctgggcgcggacttcgcgcggtgggcggcgggcgggttcgagcgcgacccctacgagctcaccttcagctacgactcgctcttcgtctccgactggacgcggctggggttcctggaggcggactacgggtggggcgcgccggcgcacgtcgtgcccttctcctaccaccccttcatggccgtcgccgtcatcggcgcgccgccggcgcccaagcccggcgcgcgcgtcatgaccatgtgcgtcacggagaagcacctgcccgagttccaggagcagatgaacgccttcgccgccgggaaccaccagtgacgacaacgtgtacgtacgcccatcgccatgatcgatccatccatcgtctagcttgctatgctatatatgcctcaacaactgctgaatggatttgtttgcttgcgtgtaatttggatttcaaattcgccacaactagcgttgcctgccaggctgccccaaaatggaagcgtctgtacatcgcggatgaaataaaaaccggtgcacgatttgtgcattgctagctagagtttggttgtgtgctgcaaatgtgtgcccgtatgtgatcgtctgctgtctgtggtttgtaaaacgaaaatggtcgtgcaatgtaaaaggacagatgcatgatctaccatattctctatttgtgt

SEQ ID NO: 2827 - DNA, 2145 bp, Panicum virgatum
tttgatccgaaccgttcattaattcaatcggacggtccgaattgggcgatcagtccggtatccgttggcccagggcgtggggccaatcaatcctcctcctccacctgctaccacaaaagataacccttctcttgatcgagtagacacttcaccaagaaattgtatgcaccacaaaatatacattaagcctctctcatctattcatcatatgttaattattcactatcagttgtggacgccctcctggggctatatatactcatgctatctcctccacatttcatcgatcatgagcactcgcaaactacaagctaccaccttatcacaacgcgatcgatcgacccaaccaaaggtagcttaattagtgatcatcgatcactcgagggaggaggagaaaattaaagaaaaaggaagcaggtgctgcggtgaagtggccggtgagggagcgagctgatcgaccatgggtaccatcgggttcccggtgacgaggacgagcaggtcgctggtggcgccgtcgtcggcgacgccgcaggagacgctgcacctgtcggtgatcgaccgcgtggcggggctgcggcacctggtgcggtcgctgcacgtgttcgacggccgccgcggcgaggcggcggtgaggacgccggcggagacgctgcgggcggcgctggggaaggcgctggtggactattacccgctggcggggcggttcgtggaggaggacggggaggtgcgggtggcgtgcacggcggggggcgcctggttcgtggaggcggcggcggcgtgcaccctggaggaggtgaagcacctggaccaccccatggtcatccccaaggaggacctgctgccggagccggcgccggacgtcaaccccctcgacatgccgctcatgatgcaggtgacggagttcgcgtgcggcggcttcgtggtgggcctcatctccgtgcacaccatcgccgacggcctgggcgccgggcagttcatcaacgcggtggcggactacgcgcgtggcctcccgaggccccgcgtgctccccgtctgggcgcgcgacgtcatcccggcgccgtccaggatcgtgtccccgccgccgcggttcgacctcctggacctccgctacttcaccgtggacctcagcccggagcacatcgccaaggtcaagtccagcttcttcgaggcgacggggcagcgctgctcggcgttcgacgtgtgcgtcgccaagacctggcagtcccgcgtccgcgcgctccggctggacggcgacgacccggcgcggcccatccacgtgtgcttcttcgccaacacgcggcacctcctgccgcagctggcgcccgggttctacggcaactgcttctacaccgtgagggcgacgcggccctgcggcgaggtggcggcggccggcgtggtggaggtggtgcgcgccatccgggacgccaaggcgcggctgggcgcggacttcgcgcggtgggcggcgggcgggttcgagcgcgacccctacgagctcaccttcagctacgactcgctcttcgtctccgactggacgcggctggggttcctggaggcggactacgggtggggcgcgccggcgcacgtcgtgcccttctcctaccaccccttcatggccgtcgccgtcatcggcgcgccgccggcgcccaagcccggcgcgcgcgtcatgaccatgtgcgtcacggagaagcacctgcccgagttccaggagcagatgaacgccttcgccgccgggaaccaccagtgacgacaacgtgtacgtacgcccatcgccatgatcgatccatccatcgtctagcttgctatgctatatatgcctcaacaactgctgaatggatttgtttgcttgcgtgtaatttggatttcaaattcgccacaactagcgttgcctgccaggctgccccaaaatggaagcgtctgtacatcgcggatgaaataaaaaccggtgcacgatttgtgcattgctagctagagtttggttgtgtgctgcaaatgtgtgcccgtatgtgatcgtctgctgtctgtggtttgtaaaacgaaaatggtcgtgcaatgtaaaaggacagatgcatgatttgtctagattttgactgtgtgatgcgtgcgcgcgtactccctccgtattgtaaagaaaatcattttaagttt

SEQ ID NO: 2828 - DNA, 1774 bp, Panicum virgatum
atactcgtgccatctcctccacatttcatcatgcatgagcactctctcacacactactacctccctatcttataacgcgatcgatcgaccctgattaaaggtagccaagtgatcatcgtatcactcgagggaggagttaaagaaaaattaaaggaaggtgcggctccgttgaagtggccggctggccggtgagctagctagggagcgagcgagcatgggtaccatcgggttcccggtgacgaggaggagcaggtcgctggtggcgccgtcgtcggcgacgccgcaggagacgctgcggctgtcggtgatcgaccgcgtggcggggctgcggcacctggtgcggtcgctgcacgtgttcgacggccggcgcggcggggaggcggtggtgaataataataagacgccggcgccggcgccggcggagacggtgcgggaggcgctggggaaggcgctggtggactactacccgttggcggggcggttcgtggaggaggacggggaggtgcgggtggcgtgcacggcggagggcgcgtggttcgtggaggcggaggcggcgtgcaccctggaggaggtgaagcacctggaccaccccatgctcatccccaaggaggacctgctgccggagccgccggcgccggacgtcgaccccctcgacatgccgctcatgatgcaggtgaccgagttcgcgtgcggcggcttcgtggtggggctcatctccgtgcacaccatcgccgacggcctcggcgccgggcagttcctcaacgcggtggcggactacgcgcgcggcctccccaggccccgcgtgtcccccgtctgggcgcgcgacctcatcccggcgccgtccaggatcgtgtcgccgccgccgcgcttcgagctgctggacctccgctacttcaccgtggacctgagcccggagcacatcgccaaggtcaagtccatcttcttcgaggcgacggggcagcgctgctcggcgttcgacgtgtgcgtcgccaagacctggcagtcccgcgtccgcgcgctccggctggacggcggcgacccggcgcggcccgtgcacgtgtgcttcttcgccaacacgcggcacctcctgccgcagctgtcggcgcccggcgggttctacggcaactgcttctacacggtgagggcgacgcggccgtgcggcgaggtggcgggcgccggcgtggtggaggtggtgcgcgccgtccgggacgccaaggcgcggctggcggcggacttcgcgcggtgggcggcgggcgggttcgagcgggacccctacgagctcaccttcagctacgactcgctcttcgtctcggactggacgcggctggggttcctggaggcggactacgggtggggcgcgccggcgcacgtcgtgcccttctcctaccaccccttcatggccgtcgccgtcatcggcgcgccgccggcgcccaagcccggcgcgcgcgtcatgaccatgtgcgtcacggagaagcacctgccggagttccaggaccagatgaacgccttcgccgccgggaaccaccagtgacgacgacggcgtgcgcccatcgccattatggatcgatcgatcgtctagcttgctatgcctctctctctcaagaactgcatgctgagtggatttatttgcttgctgcgtgtaatttgtagtatttcaaactcgccacaactagcgttgcctgccagcaggctctgcccgaaaatggaagcgtctgtaaatcatcgcggatgaaataaaaaccgagatgcacgattaatttgtgcatggctagct

SEQ ID NO: 2829 - DNA, 1475 bp, Pennisetum glaucum
gcgccgtcgccgtcgccggcgaggacgctgcgcgaggcgctggggaaggcgctggtggactactacccgtttgcggggcggttcgtgacggaggaggacggcgaggtgcgggtggcgtgcacggcggagggcgcgtggttcgtggaggcggcggcggagtgctccctggaggaggtgaagcacctggaccaccccatgctcatccccaaggaggacctgctgccggagccggagccggacgtcaacccactcgacatgccgctcatgatgcaggtgacggagttcacgtgcggcggcttcgtggtcggcctcatctccgtgcacaccatcgccgacggcctcggcgccggtcagttcatcaacgcggtggcggactacgcgcgcggcctccccaagccccgcgtggcccccgtgtgggcgcgcgacgtcatcccggcgccgtctcagatcgcctcggagccgccgcgcttcgagctcttcgacctccgctacttcaccgtcgacctcggcccggaccacatcgccaaggtcaagtccagcttcttcgaggcgacggggcagcggtgctcggcgttcgacgtgtgcgtcgccaagacgtggcagtcccgcgtccgcgcgctccggctcgacgctgacgacccgtcccgccccgtccacgtctgcttcttcgccaacacccggcacctcctgccgccgacgccggggttctacggcaactgcttctacacggtgaaggcgacgcggccctgcggcgaggtcgccgccgcgggcgtggtggaggtggtgcgcgccatccgggacgccaaggcgcggctgggcgcggacttcgcgcggtgggcggcgggcgggttcgagcgcgagcgcgacccctaccagctcaccttcacctacgactccctcttcgtctccgactggacgcggctcgggttcctggaggcggactacgggtggggcacgccggcgcacgtcctgcccttctcctaccaccccttcatggccgtcgccgtcatcggagcgccgccggcgcccaagcaaggagcgcgcgtcatgaccatgtgcgtcacggagaagcacctgccggagttccaggagcagatgaacgccttcgccgccgggaactgacatcgtcggcggcacatcctctgatatctcaagtcaaattaaagcgtacgtccatgcaacgaactactgcaaagtttggaaaatttgccagcaatcgtgtctccaatccatcgtctagcttgctgctatatatgcctcaagaaactcatgatcatgagtggattatttgcttgcgtgtgatgtgttttccaaatttgccacagctagcgttgtttgtaatccgttcttgtgtatcacctgcatgcccggctgcccaaaaaatggctggctagctcgcttttctgtatatgctcctgtaaattgtgatacgtacgacagaaataaaggtggatgcgatgcatgatgtgtacctg

SEQ ID NO: 2830 - DNA, 1788 bp, Saccharum officinarum
gaacccctgtggcgacccacgcgtccgcacacactactagctgctagcagcttaattcctacacacactccaaaaaggaaaaacaagcaaggtgctagctagctaagctaagcatgggcaccatcgatgacaccgccgggttattctcggtgatgaggacgagcaggtcgctggtgccgccgtcgtcggcgacgccgcgggagacgctgcacctgtcggtgatcgaccgcgtggcggggctgcgccacctggtgcggtcgctgcacgtgttcgagaacaagaaggcggcggggacgacgccggcggcgccgaagccggcgaaggcgctgcgggaggcgctggggaaggcgctggtggactactacccgttcgcggggcggttcgaggaggaggatggggagacgcgggtggcgtgcacgggcgagggcgcctggttcgtggaggccgccgcggcgtgctccctggaggaggtccgccacctggaccaccccatgctcatccccaaggaggagctgctcccggagccggcgccgggcgtcaacccgctcgacatgccgctcatgatgcaggtaacggagttcacgtgcggcggcttcgtggtgggtctcatctccgtgcacaccatcgccgacgggctgggcgccgggcagttcatcaacgcggtggcggactacgcccgtggcgtcaccaaaccccgcatcacccccatctgggcgcgcgacgtgatcccggacccgccgaagatgccggcgccgccgccgcgcctggacctgctcgacctggtgtacttcacgacggacctgagcccggaccacatcgccaaggtcaagtcgcggtacctggaggccacggggcagcgctgctcggcgttcgacgtgtgcgtggcgcgcacctggcaggcccgcgtccgcgcgctcgcgatccctgacccggccgcgcccgtccacgtctgcttcttcgccaacacccgccacctgctccccgccacggcggcgccggccagcgggttctacggcaactgcttctacaccgtgaaggcgacgcggcccagcggggaggtggcggcggccgacgtggtggaggtggtgcgcgccgtccgggacgccaaggccaggctcgccgccgacttcgcacggtgggcggcgggcgggtttgatagggacccctacgagctcaccttcacctacgactccctcttcgtctccgactggacgagactcgggttcctcgaggccgactacggctggggcacgccgacacacgtcgtgccgttctcctaccacccgttcatggccgtcgccgtcatcggggcgccgcccgcgcccaagcccggcgcgcgcatcatgaccatgtgcgtccaggagcagcacctgcccgagttccaggagcagatgaaccagccctcctggtgatcaatccgatccaacctgctagtacgtacacgtgtacgtatatcatcatgcatccaggtgcaagtttggaattatttgtcaataaacgaacgaacgaaccgtacgtcgtcgtcgtcttcctgatcgacgatgagcttgctatatagtacacctcgacaactgaatggattcgaattcgcgtgtaatttgctgcttctttttattcaaatctgccacaactagcgttgtaaatccgtcctacttgtatgtatgtatgtcaacaccgtatacctgcccggctgcctaaaaatggcgggctagctaagcttttctttatgcacctgtaccaattcacacggatgaacgaatgaatgaaataaaggtccatgatttgtat

SEQ ID NO: 2831 - DNA, 1301 bp, Cenchrus ciliaris
  misc_feature (465)..(465): n is a, c, g, or t
  misc_feature (470)..(470): n is a, c, g, or t
ctccactcccttctccgcatccccaccgtaccggaaggcgaaggcccggcgtggatcgagcgatggcggcgacacctccccctcccgcggcggcgctggagcagctcagcagcaacaagatgttcggcggccgcaacctccgcttccgccaccagagcgccaccctcggctgccccatgaccttctccgtctacctgcccccgtcccctgcgtccagcatccccgtgctttactggctttcgggcctcacctgcactgacgagaacttcatcataaaggccggcgctcagcgcgccgccgccgcccacgggatcgcccttgtcgcgcccgacacctccccacgcgggttaaatattgaaggagagtcagacagctatgattttggtgtgggtgctgggttttatttgaatgccacaaatgaaaagtggaaaaactggcgcatgtatgactatgttgtgaaagaanttccnaaagttctgagcgatcactttgaacagttcaacactacacaggcatccatttttgggcactcaatgggaggccatggtgcactgacaatttacttgaaaaatactgataaatacaagtcagtatcagcatttgctccaatcgccaatccgataaactgcccatggggtcagaaagcattctcaaattacctgggctcaactaaatcagattgggaggaatatgatgctacctgcctggttaaaaagaacaacaaagtttcgtctcctatcctaattgaccagggggaggatgacaagttcctggctgagcagctgctaccgcgcaactttgaggaggcgtgcaaggctgttggggttcctctgatcttgcgcatgcagcctggatatgaccattcatactttttcatcgctacattcgtcgatgatcacattgcacaccatgctcagtttctgaagagcgcctgacttcaaagtctcctataatgtgaggaagccatctagagagacgggaggcagttctgtggtttcgaagcctctgctcacagcatgtgtcactgtatcccgctgctgacagtcgcttcgacgttctattgtctgctactccctccgtcccaaaaagagtatcgctagaaaaccgtgtttgtctcacagacacactttccggacgacgctctttctgggagacggagagacggagggagtaggtgctagcttgaggtgaacaatatacccgcatgcaaataagatgaaagactcgtccttgctgtctgttctagcgggtatgaggatctcgactcggtggtgcattctattgtagtttcattgtctcca

SEQ ID NO: 2832 - DNA, 1502 bp, Panicum virgatum
ctctctctctctctctcttctcgtcgtcttgccgtcttctagaaccatctcatctctctccgcccaacgccagtcaccactcccattctccccatctccaggcgaaggcccggcgtggatcgagcgatggcggcgacacatcctgcttatccggcggaggtggagcagctgagcagcaacaagatgttcggcggccgcaacctccgcctccgccaccagagcgccaccctcggctgccccatgaccttctccgtctacctgccgccgtccccggcgtccaatgtccccgtgctgtactggctctcgggcctcacctgcactgacgagaacttcattatcaaggccggagctcagcgcgccgccgccgcccacggcatcgccctcgtcgcgcccgacacctccccacgtggattaaatattgaaggagagtcagacagctatgattttggtgttggtgctgggttttatttgaacgccacaaatgaaaaatggaaaaactggcgcatgtatgactatgttgtgaaagaacttccaaaagttttgaatgagcactttgtactgctcaacactaaacaggcatccatttttgggcactctatgggaggccatggtgcactgacaatttacttgaaaaacaccaataaatacaagtcagtatcagcatttgctccaattgtcaatccgataaactgcccgtggggtcagaaagcgttctcaaattacctgggctcatctaaatcagattgggaggaatatgatgctacctgcctgattaaaaagaacaacaaagtttctactcctatcctaatagaccagggggaggatgacaagttcctggctgagcagctgctaccttacaacttcgaggaggcgtgcaaggccgccggggttcctctggtcttgcgcatgcagcctggatatgatcattcctactttttcatcgctacattcattgatgatcacattgcgcaccatgctcagtttctgaagagcgcctgacctcgaagtctcctgtaatgtgaggaagctatcaaaagaagagagttggggaggcagctctgtgatttctgcggtgcccggtccgaagcctgtcactatatcccgctgccgacagtcttttggactttctcatgtctgctaggtgctagcttcaggtgaacaatatagctacatgcaaataagacgaaagacttgtctctgttgtagcaggaatgggatctcgatggtgcatttgagtgtagtttccttgtctttggttgtgcgcaattattggcccctgatgcagccacttgtggtgtaagaaatgattgcccatgcgtgcaattgactcttctttgcttctgcaggggaggaaaactgtatgaccagggcggtttatatgattgtatcgccgtcgcccttcctcctcgatactttgccgtcttggccactcgtattgtctgttactcgctgcagtggcaatttgcctctgcgtatttgcaacttgatgcaaggatgctgta

SEQ ID NO: 2833 - DNA, 1896 bp, Panicum virgatum
atcatctcatctccctccgcccaacgccagtcaccactcaccactccccactcccattctccccgtctccaccgtaccggaaggcgaaggcccggcgtggatccagcgatggcggcgagacctcccacaacggaggtggagctgctgagcaccaacaagatgttcggcggccataacctccgctaccgccaccagagcgccaccctcggctgccccatgaccttcaccgtctacctgcccccgtccccggcgtccaatgtccccgtcctgtactggctctcgggcctcacctgcactgacgagaacttcattattaaggccggcgctcagcgcgcggccgccgcccacggcatcgccctcgtcgcgcccgacacctctccacgcggattaaatattgaaggagagtcagacagctatgattttggtgtcggtgctgggttttatttgaacgccacaaatgaaaaatggaaaaactggcgcatgtatgactatgttgtgaaagagcttccaaaagttttgagtgatcactttgaacagctcaacatttcacaagcatccatttctgggcactctatgggaggccatggtgcactgacaatttactcgaaaaacactgataaatacaagtcagtatcagcatttgctccaattgtcaatccgataaactgcccgtggggtcagaaagcattctcaaattacctgggctcaactaaatcagattgggaggaatatgatgctacctgcctgattaaaaagaacagcaaagtttctactcctatcctaattgaccagggggaggatgacaagttcctggctgagcagctgctacctcgcaacttcgaggaggcgtgcaaggccgcgggggttcctctgatcttgcgcatgcagcctggatacgatcattcgtactttttcgtcgctacatttatcgatgatcacattgcgcaccatgctcaatttctgaagagcgcctgacctcggtgtcacctgtaatgtgaggaagctatcaaaagaagggagttggggaggcagctctgtgattgctgcggtgtccccgcttaaagcatgtcactatatcccgctgccaacagtcttttggacttctcttgtctgctaggtgctagcttcaggtgaacaatatagctacatgcaaataagatgaaagacttgtgcatgctgtctgctgtagcaggaatgggatctcgatggtgcatttgagtgtagtttccttgtctttgggttgtgcgcaattattggccctgatgcagccacttctggtgcaagaaattgcccatgtgtgcaattgactcttctttgcttctgctggggaggaaacctgtatgggtttgtatgattgtatctctgtcgcccttccacaatactttgccatgttgcccactcgtatttctgtagttgctcgtgtgcccagtttctcgcggcagtggcaatttgccgctgcgtatttgcaactcgatgcaaaggatgctgtagcctacgtgagtcattgtagcggagccggagctggatgaggccgaccggagtcgccttcggtccggtcactgattctaggaggggaaggcctaggatgatgtttgggtggtatgccaatggatgatcttcgcaccgacacatttctgcattcataattgtggatcagcgcaccagaaaattcagattgtgaccaggaatacagtgatctgttgtcgctggtgattggttctccgcgatccgtcctgtaacctcagcgagcgacagtgggtgtgccttggcacagggttcaggttgttgaggcagcccatttgttggggcgcctggacgccaacgccaaggacatggtgggtacatgcagtatcttgagccaggtacggcagattgcgtccaaccaccgggaccaag

SEQ ID NO: 2834 - DNA, 1247 bp, Panicum virgatum
ccagtcaccactcaccactcaccactcccattctccccatctccaccgtaccggaaggcgaaggcccggcgtggatccagcgatggcggcgacacctcctgcttatacaacggaggtggagcagctgagcaccaacaagatgttcggcggccataacctccgcctccgccaccagagcgccaccctcggctgccccatgaccttctccgtctacctgccgccgtccccggcgtccaatgtccccgtgctgtactggctctcgggcctcacctgcactgacgagaacttcattatcaaggccggagctcagcgcgccgccgccgcccacggcatcgccctcgtcgcgcccgacacctccccacgtggattaaatattgaaggagagtcagacagctatgattttggtgttggtgctgggttttatttgaacgccacaaatgaaaaatggaaaaactggcgcatgtatgactatgttgtgaaagaacttccaaaagttttgaatgagcactttgtactgctcaacactaaacaggcatccatttttgggcactctatgggaggccatggtgcactgacaatttacttgaaaaacaccaataaatacaagtcagtatcagcatttgctccaattgtcaatccgataaactgcccgtggggtcagaaagcgttctcaaattacctgggctcatctaaatcagattgggaggaatatgatgctacctgcctgattaaaaagaacaacaaagtttctactcctatcctaattgaccagggggaggatgacaagttcctggctgagcagctgctaccttacaacttcgaggaggcgtgcaaggccgccggggttcctctggtcttgcgcatgcagcctggatatgatcattcctactttttcatcgctacattcattgatgatcacattgcgcaccatgctcagtttctgaagagcgcctgacctcgaagtctcctgtaatgtgaggaagctatcaaaagaagagagttggggaggcagctctgtgatttctgcggtgcccggtccgaagcctgtcactatatcccgctgccgacagtcttttggactttctcatgtctgctaggtgctagcttcaggtgaacaatatagctacatgcaaataagacgaaagacttgtctctgttgtagcaggaatgggatctcgatggtgcatttgagtgtagtttccttgtctttggttgtgcgcaattattggcccctgatgcagccactt

SEQ ID NO: 2835 - DNA, 1221 bp, Pennisetum glaucum
gcaacaagatgttcggcggccgcaacctccgcttccgccaccagagcgccaccctcggctgccccatgaccttctccgtctacctgcccccgtcccccgcgtccagcatccccgtgctgtactggctctcgggcctcacctgcaccgacgagaacttcgtcatcaaggccggcgcgcagcgcgccgccgccgcacacggcatcgccctcgtcgcgcccgacacctccccacgcggattaaatattgaaggagagtcagatagctatgattttggtgttggtgctgggttttatttgaacgccacaaatgaaaagtggaaaaattggcgcatgtatgactatgttgtgaaagaacttccaaaagttctgagcgatcactttgaacagctcaacactacacaggcatccatttttgggcactcaatgggaggccatggtgcactgacaatttacttgaaaaacactgataaatacaagtcagtatcggcatttgctccaatcgtcaatccgataaactgcccgtggggtcagaaagcattctcaaattacttgggctcatctaaatcagattgggaggaatatgatgctacctgcctggttaaaaagaacagcaaagttttggctcctatcctaattgaccagggggaggatgacaagttcctggctgagcagctgctacctcgcaactttgaggaggcgtgcaaggctgttggggtccctctggtcttgcgcatgcagcccggatatgaccattcatactttttcatcgctacattcgtcgatgatcacattgcacaccatgctcagtttctgaagagcgcctgacttcacagtctcctgcaatgtgaggaagaagccatctagagagacggggaggcagagcccctgtggtctcgaagcctctgcttgcagcatgtggcactactgtatcctgctgccgacagtcgttttcgacgctctcttgtctgctactaggtgctagccttgaggtagtgaacgatatacccacatgcaaataagatggaagactcgtcccttgctgtctgttctagcgggtatggggatctcagctcggctcggtggtgcatttgatgagtgtagttcccttgtctcctgttgcgcgcaattattggccctgaatccctcctgatgcaggcatttccggtgcaagaaatgattgcccatgtgtgcaatttggctcctatggggaggaaacatgctg

SEQ ID NO: 2836 - DNA, 1168 bp, Zea mays
tgcggctccgcccaacgccagttaccactcaccagtcaccagtctccactctggagtctggaactcccctcatcctccacatctccaccgcatcggaactaggaaggcgaagccgaaggcgcggcgcggcgcggcacggatcgagcgatggcggtggcccctcctacggcggcggcgctggagcagctaagcagcagcaagatgttcgacggcttcaatctccgcttccgccaccagagcgccacccttggctgcgccatgactttctccatctacctgcccccgtccccggcgtccaaccttcccgtgctgtactggctctcgggtctcacctgcaccgacgagaatttcatcataaagtccggcgcccagcgcgccgccgctgcccacggcatcgccctcgtggcacctgacacctccccacgtgggttaaatattgaaggagagtcagacagctatgattttggtgtgggtgccgggttttatttgaatgccacaaatgaaaagtggaaaaactggcgcatgtatgactacattgtgaaggaacttccaaaagttttaagtgataactttgaacaactcaacacgtcacaggcatcaatttttgggcactcaatgggagggcatggcgcgctgacaatttacttgaaaaacactgataaatacaagtcggtgtcagcatttgctccaattgccaatccgataaactgcccttggggtcagaaagcattctcaaattacctgggctcaactaaatcagattgggaggaatatgacgcaacctgcctgattaaaaagaacagcaaagttcccactactatcctaattgaccagggggaggccgacaagttcctggctgagcagcagttgctacctcacaagttcgaggaggcgtgcaaggccgcaggggctgctctgaccttgcgcatgcagcctggatatgaccactcgtactatttcatcgctacgttcgtggacgatcacattgcgcaccatgctcagtttctcaagagcgcctgactgtaaatgtgtagcgtgaggaagacaaggaggcagcctagcatgggtgttttatctatgccgacagtgttgtctcgtgtggcagcttgaggagaggtgaacagcacaccccacatgcgaaataagatggaagatttgctgttcctgt

SEQ ID NO: 2837 - DNA, 1460 bp, Saccharum officinarum
cgggatccccccatcctccacatcgccaccgcatccgaactcggaaggcgaagccgaagccgaagccgcggcgcgaatcgaacgatggcggcggcgctggagcaactgagcagcagcaagatgttcgacggcttcaacctccgcttccgccaccagagcgccacccttggctgcgccatgaccttctccatctacatgcccccgtccccggcgtccaacatacccgtgctgtactggctctcgggcctcacctgcactgacgagaatttcatcatgaagtccggcgcccagcgcgccgccgccgcccacggcatcgccctcgtcgtgcctgacacctccccacgggggttaaatattgaaggagagtcagacagctatgattttggtgttggtgctgggttttatttgaacgccacaaatgaaaagtggaaaaattggcgcatgtatgactatgttgtgaaggaacttccaaaagttttaagtggcaacttcgaacagcttaacacttcacaggcatcaatttttgggcactcaatgggagggcatggtgcgctgacaatttacttaaaaaacactgataaatacaagtcagtatcagcatttgctccaattgccaatccaataaactgcccgtggggtcagaaagcattctcaaattacctgggctcaactaaatcagattgggaggaatatgacgcaacctgcctgattaaaaagaacaacaatgtttccactcctatcctaattgaccagggggatgctgacaagttcctggctgagcagcagttgctacctcacaacttcgaggaggcgtgcaaggctgtaggggctactctgatcttgcgcatgcagcctggatatgaccattcctactatttcatcgctacgttcatggacgatcacattgcgcaccatgctcagtttctcaagagcgcctgactgcagaagtcccgtgtaatgtgtagtgtgaggaagacaaggagaggcagagctctgaggttcctgaggtgtctgcttgcagcatgttagccatgccgacagtcttctcttgtctgccagcttgaggtgaacaatacacccacatgcaaaataagatgaaagatttgctgttcctgtccattgagaagctcgaatgggactgatgttgcattgaaaaaaaaaaagctttatgtcttggtggatcggatgttttgggaggtttactaggattgagggtacggctggtttgcagggtatctacgtttcgttcgtcatgattgctatgttggcgtctgttggtattggattcttggttgggtatggattgatacgctcatggtggggcttgtatgggcatgcaaattttagggaagctcgctttatgtaagtgattgtaattgtatattgaaggctaattctcacgcgatgcgttattggtcccgttagtgtatccgttcagctaaaggtaagagctatgcgta

SEQ ID NO: 2838 - DNA, 1134 bp, Avena sativa
ccactcccctctcctccccacctcgccggcgatccagcgatggcggcggccgctccccctcccgcagcggcgctggagcagctgagcaagaccaggatgttcggcggccacaaccttcgcttccgtcaccagagcgccacactcggctgccccatgacctcctccctcttcctccccgcttccccggcgtccaagctccccgtgctgtactggctctccggcctcacctgcacggacgagaacttcatcatcaagtccggtgtccagcgcgccgccgcggcccacggaatcgccatcgtcgcccccgacacctccccgcgtggactaaatgtagaaggagaggcagatagttgggattttggtgttggtgctggattttatttgaatgccacaaatgagaagtggaaaaactggcgcatgtatgactatgttgtgaaggagctgccaaacgttttaagtgacaactttgaacagcttaacacgtcatgtgcatcaatttctggtcactctatgggagggcatggtgcactgactatctacctgaagaacactgacaaatacaagtcggtgtctgcatttgctccaattgctaacccaataagctgcccttggggtcagaaagcattctctaactatttgggctcagctaaatcagaatgggaggaatatgatgcaacctgcttgattaaaaagtccaacggagtttcaacttctatcctgattgaccagggagatgacgacaagttcctggccgagcagctgctgcctggcaactttgaggaggcgtgcaaggccgcgggagttcccctgaccctccgcatgcagcccggatacgaccattccttcttcttcatcgccacgttcgtcgacgatcacatcgcacaccatgcccagtttctcaagagcgcttgactgtccagtcgcctgtaattatgcagtgaaggggagatgcggagttgggctgtgtcgcttttgacgtgtcggctcacaatctgtaccgtctgtctgtctgtctgtgtaaacgtgctctttgctagctttgcgttgaacgttgtgtccagctgggaataatatggtagacctgttctgctatcacggcctgatgcaagctggaggtcaagacgttttttacaa

SEQ ID NO: 2839 - DNA, 1598 bp, Triticum aestivum
attggggatccatccccttctagaatctacactctcccatctccagtccagtctccacccaccaccactcccccacaccccgccggcgatcgcgcgatggcggcggccgctccccctcccgcggcggcgctggagcagctgagcaagaccaagatgttcggcggccacaacctccgcttccgccaccagagcgcctcgctcggctgccccatgaccttctccctcttcctccccgcgtccccggcctccaagctccccgtgctgtactggctctccggcctcacctgcaccgacgagaacttcatcatcaagtccggcgcccagcgcgccgccgcggcacacggcgtcgccctcgtcgcccccgacacctccccgcgtggactaaatgtagaaggggaggcagatagttgggattttggtgttggtgctggattttatttgaatgccacaaatgagaagtggaaaaactggcgcatgtatgattatgttgtgaaggagctgccaaaagttttaactgacaactttgaacagcttaacacgtcatgtgcatcaatttttggccactctatgggagggcacggtgcactgactatctacttgaagaacactgacaaatacaagtcggtgtctgcatttgctccaattgctaacccaataaactgcccttggggtcagaaagcattctcaaactatctgggcacaactaaatcagaatgggaggaatacgatgcaaccttgttggttaagaagtgcaacacactttcaactcctatcctggttgaccagggagaggatgacaagttcctggcggagcagctgctggcgggcaacttcgaggaggcgtgcaaggcggcgggcgctcccctgatcctgcgcatgcagccgggatacgaccattccttcttcttcatcgccaccttcatcgacgaccacatcgcgcaccacgcccagttcctcaagagcggctgactggccagccacctgtagcgagtgatgcgatcggtagaagtgccgagtcagcggcgtcgcctgcctccatatactaccatctgtgttgttatcacttgtgtgtatgcgtcgtgtgtcggttggattgagacgagacgaagtgtgtggaaataatgtggacggcttgcggtcgtctctgaagtgcgcgtgcgtgcgtgcatgcatgccttggctggaaattcagtcggtagaatttgctggccctgctgtagtagcatttgaggtttaaagcgtctgtggcagcctagtaaagcacacatgccgagcgtagcaggtgtcacgtgatgggttgccctcgtctggatctgcaattttttctttgtgcacggaatgcgctatgtcgatcggaatctttgcccgtagtatggcgtgtgaccatgcacgcgcggggagttatttcgtggtcatgtcaaaacttgtacgtggatcagcagtaatcttactgtaattcgtacagctacaaggtgatactctctcgaactgatacgtggattagcagtaaacttactgtgtactgcacgtttttctctatttcgtacagctacaaggtgatgctacctcttgtcctttttagtgtgcatattagtttt

SEQ ID NO: 2840 - DNA, 1258 bp, Secale cereale
tcagcccttctagaatctacactctcccatctgcagtccagtctccacccaccaccactccccccacacccccccggcgatcgcgcgatggcggcggccgctccccttcccgcggcggcgctcgagcagctgagcaagaccaagatgttcggcggccacaacctccgcttccgccaccagagcgccgccctcggctgccccatgaccttctccctcttcctccccgcgtccccgccctccaagctccccgtgctgtactggctctccggcctcacctgcaccgacgagaacttcatcatcaagtccggcgcccagcgcgccgccgcggcccacggcgtcgccctcgtcgcccccgacacctccccgcgtggactaaatgtagaaggagaggcagatagttgggattttggtgttggtgctggattttatttgaatgccacaaatgagaagtggaaaaactggcgcatgtatgattatgttgtgaaggagctgccaaaagttttaagtgacaactttgaacagcttaacacgtcatgtgcatcaatttttggccactctatgggaggccacggtgcactgactatctacttgaagaacactgacaaatataagtcggtgtctgcatttgctccaattgctaacccaataaactgcccttggggtcagaaagcattctcaaactatctgggcacaactaaatcagaatgggaggaatacgacgcaaccctgttggttaagaagtgcaacacactttcaactcccatcttggttgaccagggagaggatgacaagttcctggcggagcagctgctggcgggcaacttggaggaggcatgcaaggcggtgggcgctcccctgaccctgcgcatgcagccggggtacgaccattccttcttcttcatcgccaccttcatcgacgaccacatcgcgcaccacgcccagttcctcaagagcggctgactggccagccgcctgtagcgagtgatgctgtcagttgaaccgccaagtcagcggtgtggcctccatataccagcttgttacgatctgtgttatcacctaggctatgtgtacgtgtcgatgcagatgcagtgcactgtgtgttagattgagacgagaccatgtgtgtggtgtggaaataatgtggacgagttgcggtcgtctctgaagtgccttggctggaaattcagtgggtagaattttaaagcggcaagcctgggccatgggtgagtaaagcacaaagcaggggcgggctatgacg

SEQ ID NO: 2841 - DNA, 1911 bp, Sorghum bicolor
cggatacttcctgcctatccgcccaacgccagtcagtcagtccccactccgtgcaccggaccccccaatcctccacagcgacaccgcatccgaactcggaaggcgaagccgaagccgcggcgcggatcgaacgatggcggcggcgctggagcaactgagcaggagcaagatgttcgacggcttcaacctccgcttccgccaccaaagcgccaccctcggctgcgccatgactttctccatctacatgcccccgtccccggcgtccaacatacccgtgctgtactggctctctggcctaacctgcaccgacgaaaatttcatcatgaagtccggcgcccagcgcgccgccgccgcccacggcatcgccctcgtctcgcctgacacatccccacgtgggttaaatattgaaggagagtcagacagctatgattttggtgttggtgccgggttttatttgaacgccacaaatgaaaagtggaaaaactggcgcatgtatgattatgttgtgaaggaacttccaaaagttttaagtgacaactttgaacagcttaacacttcacaggcatcaatttttgggcactcaatgggagggcatggtgcgctgacaatttacttgaaaaacactgataaatacaagtcagtatcagcatttgctccaattgccaatccaataaactgcccgtggggtcagaaagcattctcaaattacctgggcccaactaaatcagattgggaggaatatgatgcaacctgcctgattaaaaagaacagcaatgttcccactcctatcctaattgaccagggggatgctgacaagttcctggctgagcagcagttgctacctcacaacttcgaggaggcatgcaaggctgtaggggctactctgatcttacggatgcagcctcgatatgaccattcctactatttcatcgctacgttcatggacgatcacattgcgcaccatgctaagtttctcaagagcgcctgactgcaaagtctcctgtaatttgtagcgtgaggaagacaaggaggcagagctctgtggtttctgaggtgtctgcttgcagcatgttacccatgccgacagtcctctcttgtctgccagcttgaggtgaacaacacacccacatgcgaaataatatgaaagatttgctgttcctgtccattgaggagctcgaatgggactgatgttgcattgattgtagtttccttgtcattcgctatgcacaattattggccctgatgctgccatttcttttctggtgcaagaattgattgcccaagtgtgcagttgactcttctcgcaaatctgcagggcagcaaatcggtatgatcagagcctggtttgtaagttggtctcgttgtcgctgccctatgtcaatacgaattctgccatggttccccccttggtgctgtctgtagtatgtgttcctgtgtgctggggttcagttacagctttgcctatgtcatatttgcaacatgatgttgtatcttgtgtgatcctttctggccgagctggatgccggagcatgaggacgacgcgtcgacgccaggccagagtcgccttccgtccggtcactgttgtagttgtagggcggggaaggcctaggggggctaggaggagacagtatttggcatgcagcaatgaatgaagttggtgccttcgcaccgacacgtatctgcagcatagatatggatggtgatgatcatctctcgattcagaatttcattcagaccatggtcccgtccactctcaagacgttcaagatgttgtgatctgaccaggaaaactgcgatctacctgacagtcattctggtgctctgtgttgccctcgacgaacgaatggcagtaggattttcagacagtctacctgttctgttgggcctgagacacagccacgacgagacgag

SEQ ID NO: 2842 - DNA, 963 bp, Festuca arundinacea
  misc_feature (249)..(249): n is a, c, g, or t
gcggcggtgctggagcagctgagcaagaccaagatgttcggcggccacaacctccgcttccgccaccagagcgccacgctcggctgccccatgaccttctccctcttcctccccgcctccccggcgtccaagctcccagtgctgtactggctctcgggtctcacctgcaccgacgagaacttcatcatcaagtccggcgcccagcgcgccgccgcggcccacggcgtcgccctcgtcgcccctgacacntccccgcgtggactaaatgtagaaggagaggcagatagttgggattttggtgttggtgctggattttatttgaatgccacaaatgagaagtggaaaaattggcgcatgtatgactatgttgtgaaggagctgccagaagttttaagtgacaactttgaacagcttaacatgtcatgtgcatcaatttttggtcactctatgggagggcatggtgcactgactatctacttgaagaacactgacaaatacaagtcagtgtctgcatttgctccaattgctaacccaataaactgcccttggggtcagaaagcattctcaaactatttgggttcagctaaatcagaatgggaggaatacgacgcaacctgcttaattaaaaagtccaatggagtttcaacttctatcctgattgaccagggagaggatgacaagttcctggctgagcagctgctggctggcaacttcgaggaggcgtgcaaggccgcgggagttcccctgaatctccgcatgcagccaggatacgaccattccttcttcttcatcgcaacgttcatcgatgatcacatcgcccaccatgcccagtttctcaagagcgcttgactgtccagtcacctatagtgatgcagtcaagagtgttggggagtcatggtgccactccgacctgtcaacttaccatctgtactgtcgtgtgtctgtgtaaacgtgctctttgct

SEQ ID NO: 2843 - DNA, 883 bp, Leymus cinereus x Leymus triticoides
  misc_feature (849)..(850): n is a, c, g, or t
cccctcccgcggcggcgctggagcagctgagcaaaaccaagatgttcggcggccacaacctccgcttccgccaccagagcgcctccctcggctgccccatgaccttctccctcttcctccccgcgtccccggcctccaagctccccgtgctgtactggctctccggccttacctgcaccgacgagaacttcatcatcaagtccggcgcccagcgcgccgccgcggcacacggcgtcgccctcgtcgcccccgacacctccccgcgtggactaaatgtagaaggagaggcagatagttgggattttggtgttggtgctggattttatttgaatgccacaaatgagaagtggaaaaattggcgcatgtatgactatgttgtgaaggagctgccaaaggttttaagtgacaactttgaacagcttaacacgtcatgtgcatcaatttttggtcactctatgggagggcatggtgcactgactatctacttgaagaacactgacaaatacaagtcggtgtctgcatttgctccaattgctaacccaataaactgcccttggggtcagaaagcattctcaaactatctgggcacaactaaatcagaatgggaggaatacgatgcaaccttcttggttaagaagtgcaacacactttcaacatctatcctgattgaccagggagaggatgacaagttcctggcggaacagcttctggccggcaacttcgaggaggcgtgcaaggccgcgggggctcccctgatcctccgcatgcagccgggatacgaccattcctttttcttcatcgccacattcatcgacgatcacatcgcgcaccacgcgcagttcctcaagnncgcctgactggccagtcacctgtaatgagtgat

SEQ ID NO: 2844 - DNA, 1041 bp, Pseudoroegneria spicata
cccctcccgcggcggcgctggagcagctgagcaagaccaagatgttcggcggccacaacctccgcttccgccaccagagcgccgccctcggctgccctatgaccttctccctcttcctccccgcgtcgccggcctccaagctccccgtgctgtactggctctccggcctcacctgcaccgacgagaacttcatcatcaagtccggcgcccagcgcgccgccgcggcacacggcgtcgtcctagtcgcccccgacacctcccctcgtggactaaatgtagaaggagaggcagatagttgggattttggtgttggtgctggattttatttgaatgccacaaatgagaagtggaaaaactggcgcatgtatgattatgttgtgaaggagctgccaaaagttttaagtgacaactttgaacagcttaacacgtcatgtgcatcaatttttggccactctatgggaggccacggtgcactgactatctacttgaagaacactgacaaatacaagtcggtgtctgcatttgctccaattgctaacccaataaactgcccttggggtcagaaagcattctcaaactatctggggacaactaaatcagaatgggaggaatatgatgcaaccttgttggttaagaagtgcaacacactttcaactcctatcttggttgaccagggagaggatgacaagttcctggcggagcagctgctggccggcaacttcgaggaggcgtgcaaggcggcgggggctcccctgatcctgcgcatgcagccgggatacgaccattccttcttcttcatcgccaccttcatcgacgatcacatcgcgcaccacgcgcagttcctcaagagcgcctgaatggccagtcacctgtaatgagtgatgcgatcagtcgaatcgtcatggagtcagcggcgtcgcctccgtaccagcttgttacaatctgtgttgagcacctgtatgcgtcgatgcactctctgtgtgttaatagattgagacgagacgaactgtgtggaaataatatggacgacccaccatcgtc

SEQ ID NO: 2845 - DNA, 1512 bp, Brachypodium distachyon
tgtctctctggtcctcctcgccagtggctccatccagtcaggctctctgctcgctccacccaccgtcccctctccactccctctgctccggcgatggcggcggccgcgccccctcctccggcggcggcgccggcgcagctcagcaagagcaagatgttcggcggccacatcctccgcttccgccaccacagcgccgcgcttggatgccccatgaccttctccctcttcgtcccggcgtccccggcttccaacctccccgtgctgtacttcctctcggggctcacctgcaacgacgagaacttcgtcatcaagtccggcgcccagcgcgccgccgcggcacacggcatcgccctcgtcgcgcccgacacctccccgcgtggcttaaatatagaaggagaggcggatagttgggattttggtgttggtgctggattttatttgaatgccacaaatgagaagtggaaaaattggcgcatgtatgactatgttgtgaaggagctgccaaaagttttaagtgacaactttgaacagcttaacacttccagggcatcaattttcggacattcaatgggagggcatggtgcactgactatctacttgaagaacactgacaaatacaagtcggtttctgcgtttgctccaattgctaacccaataaactgcccctggggtcagaaggcattcacaaactatttgggcacaactaaatcagaatgggaggattatgatgcgacctgcttgattaaaaagtgcaatggagtttcaactcctatcctgattgaccagggagatgatgacaagttcctggccgagcagctgctacctggcaacttcgaggaggcgtgcaaggctgccggggttcccctgaccctccgcatgcaacctggatatgaccattccttctttttcatcgcgacattcattgatgatcatatcgcccaccatgctcagtttctcaagagcgcctgactggcaagtcacctgtagtgatgcagtcagtagaaaggcgtctgagccagccgcgttgcttcgatgagtgtaagcctaccatctctgttatcttctgtctgtaatggacatgctgtttgttggtgaggtgaacacctaacggtttacccagctggtaataattcggactgctgttatcgcgtctcaagcgtgccacagctgtcatttgctttgtgtaatcgttggcccgggcgcgagctattttctggaggaaagaagtgattgtatgtgccaccgtctgactcttgtatgcttttacaggggagcaaatcgtctgatccctgtttatcagctaaaagttggctcgtagcacgccaatgtcagtgtcacgcctcctccagctacaaagtcagcgattcagtacgcatcaaccgagcatggttttccccacgaagacgccgagcttttctccgtgcaattgcccgtctcgtgaaccccgaatcaatcactgtccgtccacatctcatctgactgggtacctcgctgtcgatcttagcacagtag

SEQ ID NO: 2846 - DNA, 1172 bp, Secale cereale
cccgcggcggcgctcgagcagctgagcaagaccaagatgttcggcggccacaacctccgcttccgccaccagagcgcctccctcggctgccccatgaccttctccctcttcctccccgcgtccccggcctcaaagctccccgtgctctactggctctccggcctcacctgcaccgacgagaacttcatcatcaagtccggcgcccagcgcgccgccgcggcccacggcgtcgccctcgtcgcccccgacacctccccgcgtggactaaatgtagaaggagaggcagatagttgggattttggtgttggtgctggattttatttgaatgccacaaatgagaagtggaaaaactggcgcatgtatgattatgttgtgaaggagctgccaaaagttttaaatgacaactttgaacagcttaacacggcatgtgcatcaatttttggccactctatgggaggccacggtgcactgactatctacttgaagaacactgacaaatacaagtcggtgtctgcatttgctccaattgctaacccaataaactgcccttggggtcagaaagcattctcaaactatctgggcacaactaaatcagaatgggaggaatacgatgcaaccctgttggttaagaagtgcaacacactttcaactcccatcttggttgaccagggagaggatgacaagttcctggcggagcagctgctggcgggcaacttggaggaggcgtgcaaggcggcgggcgctcccctggtcctgcgcatgcagccggggtacgaccattccttcttcttcatcgccaccttcatcgacgaccacatcgcgcaccacgcccagttcctcaagagcgcctgactggccagccgcctgtagcgagtgatgctatcagtagaaccgccaagtcagcggcgtggcctccatataccagctcgttacgatctgtgttatcacctagtatgtgtatgtgtcgatgcagatgcagtgcactgtgtgttagattgagacgagaccatgtgtgtggtgtggaaataatgtggacgagttgcggtcgtctctgaagtgccttggctggaaattcagtgggtagaattttaaagcggcaagcctgggccatgggtgagtaaagcacaaagcaggggcgggctatgacgagttgtgggtctggactggtgtgc

SEQ ID NO: 2847 - DNA, 1225 bp, Secale cereale
gccggcggtcgcgcgatggcggcggccgctcccctcccgcggcgcgctcgagcagctgagcaagaccaagatgttcgcggccacaacctccgcttccgccaccagagcgcctccctcggctgccccatgaccttctccctcttcctccccgcgtccccggcctccaagctccccgtgctctactggctctccggcctcacctgcaccgacgagaacttcatcatcaagtccggcgcccagcgcgccgccgcggcccacggcgtcgccctcgtcgcccccgacacctccccgcgtggactaaatgtagaaggagaggcagatagttgggattttggtgttggtgctggattttatttgaatgccacaaatgagaagtggaaaaactggcgcatgtatgattatgttgtgaaggagctgccaaaagttttaagtgacaactttgaacagcttaacacgtcatgtgcatcaatttttggccactctatgggaggccacggtgcactgactatctacttgaagaacactgacaaatataagtcggtgtctgcatttgctccaattgctaacccaataaactgcccttggggtcagaaagcattctcaaactatctgggcacaactaaatcagaatgggaggaatacgacgcaaccctgttggttaagaagtgcaacacactttcaactcccatcttggttgaccagggagaggatgacaagttcctggcggagcagctgctggcgggcaacttggaggaggcgtgcaaggcggcgggcgctcccctggtcctgcgcatgcagccggggtacgaccattccttcttcttcatcgccaccttcatcgacgaccacatcgcgcaccacgcccagttcctcaagagcggctgactggccagccgcctgtagcgagtgatgctatcagttgaaccgccaagtcagcggcatggcctccatataccagctcgttacgatctgtgttatcacctagtatgtgtacgtgtcgatgcagtgcactgtgtgttagattgagacgagaccaagtcaagtgtgcggaaataatgtggacgagttgcggtcgtctctgaagtgccttggctggaaattcagtgggtagaattttaaagcggcaagcctgggccatgggtgagtaaagcacgaagcaggggcgggctatgacgagttgtgggtctggactggtgtgccaggggtaaattatgatgactgatgt

SEQ ID NO: 2848 - DNA, 1491 bp, Secale cereale
tcaggatccatccccttctacggagtagaatctacactctcccatctgcagtccaatctccacccaccaccactcccccacaccccgccggcgatcgcgcgatggcggcggccgctcccctcccgcggcggcgctggagcagctgagcaagaccaagatgttcggcggccacaacctccgcttccgccaccagagcgccgccctcggctgccccatgaccttctccctcttcctccccgcgtccccgccctccaagctccccgtgctgtactggctctccggcctcacctgcaccgacgagaacttcatcatcaagtccggcgcccagcgcgccgccgcggcccacggcgtcgccctcgtcgcccccgacacctccccgcgtggactaaatgtagaaggagaggcagatagttgggattttggtgttggtgctggattttatttgaatgcaacaaatgagaagtggaaaaactggcgcatgtatgattatgttgtgaaggagctgccaaaagttttaagtgacaactttgaacagcttaacacgtcatgtgcatcaatttttggccactctatgggaggccacggtgcactgactatctacttgaagaacactgacaaatataagtcggtgtctgcatttgctccaattgctaacccaataaactgcccttggggtcagaaagcattctcaaactatctgggcacaactaaatcagaatgggaggaatacgacgcaaccctgttggttaagaagtgcaacacactttcaactcccatcttggttgaccagggagaggatgacaagttcctggcggagcagctgctggcgggcaacttcgaggaggcgtgcaaggcggcgggcgctcccctgaccctccgcatgcagccggggtacgaccattccttcttcttcatcgccaccttcatcgacgaccacatcgcgcaccacgcccagttcctcaagagcggctgactggccagccgcctgtagcgagtgatgctatcggttgaaccgccaagtcagcggcgtggcctccatataccagcttgttacgatcggtgtatgtgttgatgcagtgcactgtgtgttagattgagacgagaccaaagtgtgtggaaataatgtggtatgtggacgagttagcggtcgtctctgaagtgcacgtgcgtgccttggctggaagttccgtcggtagaattttaaagcggcaagcctgggccatgggtgagtaaagcccaaagcaggggcgggctatgtcacgtccggatctgcaatttcttttgtgtgtacgaaataagctatgtcgatcggaatcttcacccgcactatggcgtgtgaccagcacgcgggcggagttattcgtggtcatgtcaaaacgatacgtggatcagcagtaatcttactgtgattcgtacattgcttgtataataatactaaacgtctacttcttactaattaaaaaaaaaaaaaacctagaagactagacaacg

SEQ ID NO: 2849 - DNA, 1397 bp, Pennisetum glaucum
ggcaccacgacgaccgttccattcccatccccatccccaccaccagcagcagcagcttcctcgtcctcctccgtcgccgccaccgccagggccagggccagggccagggtccccgccggccttcctcccgaccgccgccgcgccaggccccttcctcctccgcttcgctgcgcatcctcctccccaggaatggagcccggcgctggcactgccttgtaccctctgcaccgctgcaaaaccatttacctggtcaggcacgcccagggcattcacaacgtcgcaggcgagaaggatttcagcgcctacaagtcatacgacctcttcgatgcgcagctcactcctctcggttggagccaagttgatggtctgcgggagcacgtgaagaaaagtggacttgcaaaaaaaatcgagctcgttattacttcccctttgctgaggactatgcaaactgcagtgggggtctttggtggtgaaaactatactgatggtgtaaatgcaccaccattaatggttgaaaatgctggacacagtggacgtcaggcggtttcaagtttgaactgcccaccatttcttgcagttgaaacctgcagagagcacttgggtgtccatccctgtgacaagaggaggagcataacagaataccggcctctctttcctgctattgatttttcattgatagagaatgatgaagatgttctttgggaaccagatgttagagaagaaaacgaggctgtgggactgaggggtatgaagttcattgactggttatggacaagagaagagaaggagatagctattgtcagtcatagtggcttcttgtatcataccttgaatatgtatagcaaggaatgtcatccaaccataagagacgaagttggcaagcactttgcgaattgtgagctccggtcgatggtgttggttgacaggagtatgcttgggtcagattccccaagtttcaattaccctggaaagattccagctggacttgatcttcctagcgacgttgcagatgagaagcatcttgaggaaactcagaagaactgattgttctgtctgaggcggttgagcattgatgccttgattcttttatcaactcattctgaccctgttcaagtttgtgttgaagaagagaagctaaacaatctctacagataggacttacgggtttttaatcgagcatgaattacggaatgtatttgtgtcttttatgtcatcccatattaaaattcatggtattgaactccatagcaataatacgtgtacggtacttgacaaaattcttttggttgcttgtgttgttataggatgattcccaagagttgcatatcttatttctgacggatggtgataaaaatgatgtatggtttgttcatcttacatttggaaagagcttgggg

SEQ ID NO: 2850 - DNA, 1595 bp, Panicum virgatum
ccaccgcacgtggagagagacaaagttgtggttgtgaataaataaacaaatccgtaaattaaattagtggacacgagttaatactaatggcgatggtctacggcactacgagctacagtgccaccatattctcctcctctcccgctgccacccaatcatcctccccaccagcaccggccgccgccgccgccgccgcctcctccgccagggtccgggtccgggtcggccttcttcccggccgccgcggcaagccccttccgcttcgctgcgcatcctcaggctcaggaatggagcccatcgctggcactgccctctaccctctgcaccgctgcaaaaccatttacctggtcaggcatgcccagggcattcacaatgttgccggcgagaaggatttcaatgcctacatgtcacaggacctgttcgatgcgcagctcacccctcttggctggagccaagttgatggtctgcgggagcacgtgaagaaaagtggacttgcaaaaaagatcgagctggttattacttcccctttactgaggactatgcaaactgcagtgggggtctttggcggtgaaaactatactgatggtgtaagtgctccaccactaatggttgaaaatgctggacacagtggacgcccggcggtttcaagtttgaactgcccaccatttcttgcagttgaaacctgcagagagcacttgggtgtccatccctgtgacaagaggaggagcataacagaataccggcctctctttcctgctattgatttttcattgatagagaatgatgaagatgttctctgggaaccagatgttagagaagcaaatgagtctgtcacactgaggggtatgaagttctttgactggttatggacaagggaagagaaggagatagctattgtcagtcatagtggtttcttgtatcataccttgagcacgtacagcaaggagtgtcatccaaccataagagacgaagttggcaagcactttgcaaactgtgagctccggtcgatggtgttggttgacaggagcatgcttgggtcggattcctcaagtttcaattaccctggcaagattccagccggactcgatctgcctagtgacgttgcagataagaagcatgtagaggaagctcagaagaactgatgagcccgtctgaggatattgagcattgccgctttgattcttttatcaactcattctgaccccattcaagtctgcagttgaagaagacaagctaaacagtatctacaggtaggacttgccggttgttaattgagcatgaattacggaatgtattacgtattacgtttgttatcgcagcccatattgaaattcagggtattgaaatccatagcaataatacctacgctacatgacaaaattctcctggttgcttgtgttcttcgttcttggttaaaacccaagcaagggttgcccatctgctctctcgtagatggtagtagaaatgtgtgtggcttgttcatcttaaatttgggaggagcttcggattatagcttctttatatttttcactgattatattgtcacatcagttatatacaaaaaggctacagtggttaccaaagtggggaaaaaa

SEQ ID NO: 2851 - DNA, 1699 bp, Sorghum bicolor
attttggtgggataatttgattgattcgaggggagaagaggagctccgtgcccttccctggcgggcatgatttggtttttattttattttcacaagtcgcattctgatttgctcgtggagtaataatcatatacagcagcatgagcagccgtgtcatccacctcctcctcctctgctcgaccaccaccaccaccaccgtcccaggaggaggcccagcagcagcagcagcagcagcagcaggagctcctcccccgtcgtcttcctcctcctctgtcagggtcagggtccaggtcgggcttcctcccggccgccgcgccaaatcccgtctcgttcttccgcctcgctgcgcatcctcagcaggaatggaacccggcgccaccactgccctctaccctctgcaccgctgcaaaaccatttacctggtcaggcatgcccagggcattcacaatgtcgcaggtgaaaaggactttggtgcctacatgtcacatgacctcttcgatgctcagctcactcctttgggatggagccaagtcgatggcctgcgggagcacgtgaagaaaagtgggcttgcagagaagattgaattggttatttcttcccctttactgaggactatgcaaactgcagttggggtctttggtggtgaaaagtatactgatggtgtaaatgcacctccactaatggttgaaaatgctggacacagtggacgtccagcagtttcaagtttgaactgccccccatttattgcagttgaaacctgcagagagcacttgggtgtccatccctgtgacaagaggaggagcataacagaataccggcctctctttcctgccattgatttttcattgatagagaatgatgaagatgttctttgggaaccagatgtgagagaagcaaatgaagctgttgcattgaggggtatgaagtttatggactggttgtggacaagggaagagaaagagatagctattgtcagtcacagtggtttcttgtttcacaccttaagcatgtacagcaaggagtgccatccaaccataagagacgaagttagcaagcactttgcaaactgcgagctacggtcaatggtgttggttgacagaagcatgcttgggtcatattctccaagattcaactaccctggcaagattccagccggactagatctgcctagtgatattgcagataagaagctcgttgaggaagctgagaagaactgaggcagcttcaaaagcattgatattatgacttgattatcaagccattctgatctttacgaagcttgctttgaagaggacaagctaaaggggcatctacagatagggcttacattacacataccattttgttaatcgagatgaactacgcagcaatgtattagcatgtctgctctcttgtctcggcctgtattcagattcagagtattggactaggatcatctattttttatggtaataataactggatcgcctacattcaccaggtgatacatggcaaagttcgcttggtttcctagatgttctagtctaggatataaaaaacctaggggttgctctactcttgtccacgctagctattctggtttctgatggatggtgataaaaccgatccatgtatggtttttgtttctacagattaaatttgatggatggattcgttgtattatggctttgcttatattttttactaattttgagttgtt

SEQ ID NO: 2852 - DNA, 1525 bp, Zea mays
actaagcttatataaattccgttagatactcggtttgacatctcttttttatatacatttcgataagatcgtaaaaatctcacctcgcgcgcaaagcgcgcgttagacacaagttgcttctcacttggaaggaattatttgagttagaagaggagctccgtgctctgcttccttcccggccaatttttattttttatttcacagtcccattctgatcctgtggacagtgggttaataatagtaataaaaatgataatccacctcctctgcttcccaggcccagcagcaggagctcccccgtctccgtcctcctccgcctctgtcagggtcccggtcggacttcctcacgaccgccgcgccaaatcccgtctcgttcctccgttccgctgcgcatcctcaggaatggaacttggcgccaccactgccctgtaccctctgcaccgctgcaaaaccatttacctggtcaggcatgcccagggcattcacaacgtcgcaggcgagaaggacttcggcgcctacatgtcacatgaactgttcgatgctcagctcacccctttgggttggaaccaagtcgatggtctgcgggagcatgtgaagaaaagtgggcttgcagagaagattgaattggttattacttcccctttactgaggactatgcaaactgcagttggggtctttggtggtgaaaagtatactgatggtgtaaatgcacctccactaatggttgaaaatgctggacacagtggacgtccagctgtttcaagtttgaactgccccccatttattgcagttgaaacctgcagagagcacttgggtgtccatccatgtgacaagaggaggagcataacagaataccggcctctcttccctgccattgatttttcattgatagagaatgatggagatgttctttgggaaccagatgtgagagaaacaaatgaggctgtcgcattgaggggtatgaagtttatggactggttgtggacaagagaagagaaagagatagctattgtcagtcacagtggtttcttgtttcacaccttaagcatgtacagcaaggagtgccatccaaccataagagacgaagttagcaagcactttgcaaactgcgagctacggtcgatggtgttggttgacagaagcatgcttgggtcatattcgtcaagattcaactatgctggcaagaatccaaccgggctagatgtgcctagtgatattgcagataagaagcaggttgatgaagctcagaagaactgaggcaaccttgaaagcataccgtagatgacttggattatcaaaaagccactctgacctttgcgaagcttgcttgcttgctttgaagagggcatctactacagatagagtttacacataccattgcgttagtcgagatgaactacgcagcaatgtataagcatgtctgctcttttgtctcagcctacatttgagattcagggcattggactaagatcgcctatttatgataataataataataataaccggatcaccccacattcaccag

SEQ ID NO: 2853 - DNA, 1423 bp, Zea mays
agctacgaaccgaaaggcctggtctccctccaccctcctctgtcagggtcctccgaatcggacttcctcacggccgccgcgccaaatcccgtctcgttgctccggtccgctgcgcatcctcaggaatggaacttggcgccaccactgccctctaccctctgcaccgctgcaaaaccatttacctggtcaggcatgcccagggcattcacaatgtcgcgggggagaaggacttcggcgcgtacatgtcacatgaactgttcgatgctcagctcactcctttgggttggaaccaagtcgatggtctgcgggagcatgtgaagaaaagtgggcttgcagaaaagattgaattagttatttcttcccctttactgaggactatgcaaactgcagttggtgtctttggtggtgaaaagtatactgatggtgtaaatgcacctccactaatggtcgaaaatgccagacacagtggccgtccggcagtttcaagtttgaactgccccccatttattgcagtcgaaacctgcagagagcacttgggtgtccatccctgtgacaagaggaggagcataacagaataccggcctctctttcctgcgattgatttttcattgatagagaatgatgaagatgttctttgggaaccagatgtgagagaaccaaatgaggctgtcgcattgaggggtatgaagttcatggactggttgtggacaagagaagagaaagagatagctattgtcagtcacagtggtttcttgtttcacaccttaagcatgtacagcaaggagtgccatccaaccataagcgacgaagttagcaagcactttgcaaactgcgagctacggtcgatggtgttggttgacagaagcatgcttgggtcatattcctcaagattcaactatgctggcaagaatccaaccggactagatgtgccaagtgatattgcagataagaagcaggttgacgaagctcagaagaactaaagcaacctcgaaagcataccatatatgacttggattatcaagaaattctgacctttgcgaagcttgtttgctttgaagaggacaagctaagagggcatctacagatagagtttacgcataccattttgttagtcgagttgaactacgcagcaatgtattagcatgtctgctcttttgtctcagcctacattgaggttcagggcattggactaggatcatctatttatgataataataaccggatcacctacattcaccaggtgatgcatggcaaagttctcttggtttccgagctgttctagtctaggggtggctgtacaacgtccacggctccacgcaattccgtctcatggatggtgataaaaccaatcgatgtatggttttggtttctgcagattacatttgatggttgggttcgctgtattatggcttgcgtattttta

SEQ ID NO: 2854 - DNA, 1321 bp, Triticum aestivum
agcgagccgacacgaggcgcgatgctgccgaatcctcctgcttttagtaccaccaccgccccggccctccgcctctgcctccctatctcgcccccggccgcagcagcctcgtcgtcgcccccctccttcgccgtcggacgagtttccctccgccgtcgccgtcgccgtcgccgccgcgcttccttcagcggctgccgctgctcctcgtcctcccactcagaaatggaggccggcgctgggacagctctgtaccccgcgcaccgatgcaaaaccatatacctggtgaggcatgcccagggtattcacaacgtggagggcgagaaggattttgcagcatacaagtcacatgcgctgcttgatgctcaacttacccctttgggctggagccaagttgataccctgcgagagcatgtgacaaaatctggactggcaaaaaagattgagttggttattgtttcccctctactgaggactatgcaaactgcagtaggggtctttggtggtgggaactatactgatggagcaagtgcatcaccattaatggtagaaggtgctggaaacagtggacgtcagccaatttcaagtttgaactgcccaccgtttcttgcagttgaggcctgcagggagcacttgggtgttcatccctgtgacaagaggagcagcataacaaaataccgtacactctttcctgccattgatttttccttgatagagaatgatgaagatgttctctgggaacccgatgtcagagaaacaaatgagtctgttgctctcaggggcatgaagttctttgactggttatggacaagagaagagaaagagattgctattgtcagccatagcggtttcttgtatcacaccctaaacatgtacggtaaagagtgtcatccaaccatagcagaggagctgggcaagcacttcgccaactgtgagctccggtcaatggtcttggtcgacagaagtaaccttggatcggatgcctctaaatacaacttcgctgggaagataccgaccgggcttgatatgcccagcgatgtcgcagacgagaaggaggctgaagaagctagcaagaactgaaactgccgggcgcatggatgtctttgattcttttatcaaaccttggttctggctcacaatgaactgagaatagacaggcgacatctacggataggaactgccgtctgttgctctggtgtatgatcggcacgattggttatgtttatctgatttgttgtttgaacagaagatacccaaattcatgggaaataaggacttacacgcatacccctcattttgagaacgaggacaatacgttgaaccc

SEQ ID NO: 2855 - DNA, 950 bp, Hordeum vulgare
ctgtctgttcacgttgtgtttatctatcttaattgtcagtggatagtaataatatacagtagtagtaatgtgtttcttttgctcagaaatggaggccagcgctggcacagctctgtaccctgcgcaccgatgcaaaaccatatacctggtcaggcatgcccagggtattcacaacgtggaaggcgagaaggattttgcagcgtacaagtcacatgcgctgcttgatgctcaacttacccctttgggctggagccaagttgataccctgcgagagcatgtgacaaaatctggactggcaaaaaagattgagttggttgttgtttcccctctactgaggactttgcaaactgcagtgggggtctttggtggtgggaactatactgatggagcaagtgcatcaccattaatggtagagggtgctggaaacagtggacgtcagccgatttcaagtttgaactgcccaccatttcttgcagttgaggcctgcagggaacatttgggtgttcatccctgtgacaagaggagcagcataacaaaataccgtactctctttcctgccattgatttttccttgatagagaatgatgaagatgttctctgggaacctgatgtcagagaaacaaatgagtctgttgctctcaggggcatgaagttctttgactggttatggacaagaaaagagaaagagatagccattgtcagccatagtggtttcttgtatcataccctaaacatgtacggtaaagagtgtcatccgaccatagcagaggaactgggcaagcacttcgccaactgtgagctccggtcgatggtgttggtcgacagaagtaacctgggatcggatagctctacatacaacttcgctgggaagataccggccgggctcgatatgcccagcgatgtcgcggacgagaagcacgctgaagaagctagcaagaactgaagactgt

SEQ ID NO: 2856 - DNA, 1609 bp, Brachypodium distachyon
tttttgttgggacagaagacagcaaacagaccccagcctcagcgtgagacgacgcaaagatccaatttttctctttccatctggagctactgaataaataaagcgagccccgagacggggcgagatgctgctgcacattgctcctcctcctcctcctcctacttgttgtacccccgcagccccggccatccgcctcctctccccttcctccgccgccgctccatcgtcgtcttcctcctccgttaggcgccgccgcgccaaccttcgctgctcctcctcctccgcagaaatggctgccactgctggcactgctatctaccctctccaccgttccaaaaccatacacctggtcaggcatgcccagggtattcataatgtggaaggtgagaaggatcatgctgcttacatgtcacctgcactgcttgatgctcaccttacccctttgggctggagccaagttgattccctacgagaacatgtgacaaaatgtggacttgctaaaaagatcgagttggttattacttcccctctaatgaggactatgcaaactgcagttggggtctttggtggtgggaactatgctgatggggtaagtgtatcaccattgatggtagaaggtgccggacacagtgggcgtgaggcaatttcaagtttgaactgcccaccatttcttgcagttgagacctgcagggagcacttgggtgttcatccctgtgacaagaggagcagcgtaacagaatatcgtagtctctttcctgccattgatttttccttgatagaaaatgatgaagatgttctttgggaacctgatgtaagagaagcaaacgagtctgttgcagctaggggcatgaagttctttgactggttatggacaagagaagaaaaggagatagctattgtcagccatagtggtttcttatatcacaccttaaacatgtacggcaaggagtgtcatccaaccataacagaggaactgggcaaacactttgccaactgtgagctccggtcgatggtattggtcgacagaagtatgcttggatcgcattcccccacctgcaacttccctggaaagacaccggctgggcttgatctgcctagtgatgtcgcagacaagaaacaccttgaggaagctcagaagaactgagaccgttgagcacactgatgtctttgtttcttttgtcaagccaattctggcacggtccgattttgcaccagaagtttgaatttgaagcagagataaacagcttctacggataggacttgccttctgttgctctgaagtattgtttacggggttggttatgtttgttgtctcggtatgtgctgaacttcacggtaataaggatgatcatagcgttctgaaaagaacgaggacaatatattgatagagcttttgagttacagaatattgtatatctttatctgtagctttatcttgaatatttattcgattatatgatgtgccaagatcaatttatctttctcttgatttcttttacaaaagaaccatgttatgtcagtacaaaattcgttcgatgtttatgttcttcctattttcatagtttctataacttgctgcttaatggattaccacgtttgtgctttgaaa

SEQ ID NO: 2857 - DNA, 1411 bp, Secale cereale
cggctgccgctgctccccgtcctcctccccagaaatggaggccagtgctggcacagctctgtaccccgcgcaccgatgcaaaaccatatacctggtgaggcatgcccagggtattcacaacgtggagggcgagaaggattttgcagcatacaagtcacatgcactgcttgatgctcaacttacccctttgggctggagccaagttgataccctgcgagatcatgtgacaaaatgtggactggcaaaaaagattgagttggttattgtttcccctctactcaggactatgcaaactgcagtgggggtctttggtggtgggaactatactgatggagcaagtgcaacaccgttgatggtagagggtgctggaaacagtgaacgtcagctgatttcaagtttgaactgcccaccgtttctcgcagttgaggcttgcagggagcacctgggtgttcatccctgtgacaagaggagcagcataacaaaataccgtactctctttcctgccattgatttttccttgatcgagaatgatgaagatgttctttgggaacccgatgtcagagaaacaaacgagtctgttgctctcaggggcatgaagttctttgactggttatggacaagagaagagaaagagatagctattgtcagccatagtggtttcttgtatcacaccttgaacaagtacggtaaagagtgtcatccaacaatagcagaggaactgggcaagcacttcgccaactgtgagctccggtcaatggtcttggtcgacagaagtaaccttggatcggatacctctacatacaacttcgctgggaagataccgaccgggcttgatatgcccagcgatgtcgcagacgagaagcaggctgaagaagctagcaagaactgaggctgtcgagcacatggatgtctttgattcttttatcaaaccttggttctggctgacaatgaactgaggttagatactaagcgacatctacggataggacttgccgtctgttgctccggtatatgatgggcaccactggtcatgtttatctgatttgttgtttgaacacatacccaaattcatgggaaataaggacttgtacgcatacccctctttttgagaatgaggacaatacattgaaccctaaatagcattttaataacatgtaaaataaccggaaattgcttttgtaggccgagctctatggaggcctccaaatgcaaaatttgaaattcatgaaaatctatatttttacatttcagaaagttctgaaaaaagtcagggatagatgaaggcatagtgcacaagtatgtaagcatagaagacaaattttgagctttctaacacatgctactattcatcctcccagaccttgaatttatctttcttacaggttccatttcaatttgaaattttattaac

SEQ ID NO: 2858 - DNA, 1094 bp, Secale cereale
cagaaatggaggccagcgctggcacggctctgtaccccgcgcaccgatgcaaaaccatatacctggtgaggcatgcccagggtattcacaacgtggagggcgagaaggattttgcagcatacaagtcacatgcgctgcttgatgcccaacttacccctttgggctggagccaagttgataccctgcgagatcatgtgacaaaatgtggactgttaaaaaagattgagttggttattgtttcccctctactcaggactatgcaaactgcagtgggggtctttggtggtgggaactatactgatggagcaagtgcatcaccattaatggtagagggtgctggaaacagtggacgtcagccgatttcaagtttgaactgcccaccatttctcgcagttgaggcttgcagagagcacctgggtgttcatccctgtgacaagaggagcagcataacaaaataccgtactctctttcctgccattgatttttccttgattgagaatgatgaagatgttctttgggaacccgatgtcagagaaacaaatgaggctgttgctctcaggggcatgaagttctttgactggttatggacaagagaagagaaagagatagctattgtcagccatagtggtttcttgtatcacaccttgaacaagtacggtaaagagtgtcatccaacaatagcagaggaactgggcaagcacttcgccaactgtgagctccggtcaatggtcttggtcgacagaagtaaccttggatcggattcctctacatacaacttcgctgggaagataccgaccgggcttgatatgcccagcgatgtcgcagacgagaagcaggctgaagaagctagcaagaactgatgctgtcgagcacatggatgtctttgattcttttatcaaaccttggttctggctgacaatgaactgggaataggtaagcgacatttaaggataggacttgccgtctgttgttccagtgtatgatcggcacgattggttatgtttatctgatttgttgtttgaacagatacccaaatttgtgggaaataaggacttatacgcatacccctctttttgagaatgagacaatacatt

SEQ ID NO: 2859 - DNA, 1321 bp, Triticum aestivum
ccctccgcctctgcctccctatcccgcctcgggccgctgcctctgcctcatcgtcctcctcgcgctcgcactccttcgccgctgccggacgggtttccctccgccgtcgccgccgccgcgcttccttcaccgactgccgctgctcctcctcctcctccccagaaatggaggccggcgctggcacggctctgtaccccgcgcaccgatgcaaaaccatatacctggtgaggcatgcccagggtattcacaatgtggaaggcgagaaggattttgcagcatacaagtcacatgcgctgcttgatgctcaacttacccctttgggctggagccaagttgataccctgcgagatcatgtgacaaaatgtggactagcaaaaaagattgagttggttattgtttcccctctactcaggactatacaaactgcagtgggggtctttggtggtgggaactatattgatggagcaagtgcatcaccattgatggtagagggtgctggaaacagtgaacgtcagccgatttcaagtttgaactgcccaccgtttctcgcagttgaggcttgcagagagcacctgggtgttcatccctgtgacaagaggagcagcataacaaaataccgtactctctttcctgccattgatttttccttgatcgagaatgatgaagatgttctctgggaacccgatgtcagagaaacaaatgagtctgttgctctcaggggcatgaagttctttgactggttatggacgagagaagagaaagagatagctattgtcagccatagtggtttcttgtatcacaccttgaacatgtatggtaaagagtgtcatccaacaatagcagaggaactgggaaagcacttcgccaactgtgagctccggtcgatggtcttggtcgacagaagtaaccttggatcggatgcctctaaatacaacttcgctgggaagataccgaccgggcttgatatgcccagcgatgtcgcagacgagaagcaggctgaagaagctagcaagaactgaggctgtcgagcatgtggatgtctttgattcttttgtcaaaccttggttctggctgacaatgaactgagaatagatactaagcgacatctaaggataggacttgccgtctgttgttccggtgtatgatgggcacgattggttatgtttatctgatttgttgtttgaacagatacccaaattcatgggaaataaggacttatacgcatacccctctttttgagaacgaggacaatacgttgaaccctaaatagcattttaataacaggtaaaataaccaaaaattgcttttggaggccgagctc

SEQ ID NO: 2860 - DNA, 1546 bp, Triticum aestivum
ggaaccggcagcaagccaaactgccgttacccatggaggacaagacgcgatttgcagctgactcgttcgctcgtgctactgcctaattgaattgaataaattaaattaagcgagccgacacgaggcgcgatgctgccgaatcctcctgcttttgcttttagtagcatcatcaccaccaccgccccggccctccgcctctgcctccctatctcgcccccggccgcagctgcctcatcgtcgcccctctccttcgccgtcggcagcgtttccctccgccgtcgccgccgccgccgccgccgcgcttccttcagcggctgccgctgctcctcgtcctcctccccagaaatggaggccggcgctggcacagctctgtaccccgcgcaccgatgcaaaaccatatacctggtgaggcatgcccagggtgttcacaacgtggaaggcgagaaggattttgcagcatacaagtcacaggcgctgcttgatgctcaacttacccctttgggctggagtcaagttgataccctgcgagatcatgtgacaaaatgtggactagcaaaaaagattgagttggttattgtttctcctctactcaggactatgcaaactgcagtaggggtctttggtggtggcagctatactgatggagcaagtgcatcaccattaatggtagaaggtgcaggaaacagtggacgtcagccaatttcaagtttgaactgcccaccgtttcttgctgttgaggcctgcagggagcacttgggtgttcatccctgtgacaagaggagcagcgtaacaaaataccgtactctctttcctgccattgatttttccttgatagagaatgatgaagatgttctttgggaacccgatgtcagagaaacaaatgagtctgttgctctcaggggcatgaagttctttgactggttatggacaagagaagagaaagagattgctattgtcagccatagcggtttcttgtatcacaccctaaacatgtacggtaaagagtgtcatccaaccatagcagaggaactgggcaagcacttcgccaactgtgagctccggtcgatggtgttggtcgacagaagtaaccttggatcggatacctctaaatacaacttcgctgggaagataccgaccgggcttgatatgcccagcgatgtcgcagacgagaaggaggctgaagaagctagcaagaactgaaactgtcagggtgcttggatgtctttgattcttttaccaaaccccggttctggctgacaatgaactcagaatagatgagcgacatctacgggtaggacttactgtctgttgctccggtgtatgatcaacacgattggttatgtttatgtgatttgttgtttgaacagatacccaaattcatgggaaataaggacttacacgcatacccctcattttgagaacgaggacaatacgttgaaccctaaatagcattgtaataacaggtaaaataaccggaaattgcttttggaggccgagctctatggaggtgtatacacaaacaggttaccacgtctataaatatgta

SEQ ID NO: 2861 - DNA, 1027 bp, Secale cereale
cagaaatggaggccagcgctggcacagctctgtaccccgcgcaccgatgcaaaaccgtatacctggtgaggcatgcccagggtattcacaacgtggaaggcgagaaggattttgcagcgtataagtcacatgcgctgcttgatgcccaacttacccctttgggctggagccaagttgataccctgcgagatcatgtgacaaaatgtgaactatcgaaaaagattgagttggttattgtttcccctctactcaggactatgcaaactgcagtgggggtctttggtggtgggaactatactgatggagcaagtgcaacaccgttgatggtagagggtgctggaaacagtgaacgtcagccgatttcaagtttgaactgcccaccgtttctcgcagttgaggcttgcagggagcacctgggtgttcatccctgtgacaagaggagcagcataacaaaataccgtactctctttcctgccattgatttttctttgatcgagaatgatgaagatgttctttgggaacccgatgtcagagaaacaaatgagtctgttgctctcaggggcatgaagttctttgactggttatggacaagagaagagaaagagatagctattgtcagccatagtggtttcttgtatcacaccttgaacaagtacggtaaagagtgtcatccaacaatagcagaggaactgggcaagcacttcgccaactgtgagctccggtcaatggtcttggtcgacagaagtaaccttggatcagattcctctacatacaacttcgctgggaagataccgaccgggcttgatatgcccagcgatatcgcagacgagaagcacgctgaagaagctagcaagaactgaggccatgccgggcacatggatgtctttgattcttttatcaaaccatggttctggctgacaatgaactgagaatagatactaagcgacatctacggataggacttgccgtctgttgctccggtgtatgattggcaccactggttatgtttatctgatttgttgtttga

SEQ ID NO: 2862 - DNA, 1183 bp, Secale cereale
tccctatctcgcccccctcccccttcgccgtcgggtcacgcgttcccctccgccgtcgccgtcgccgtcgccgggcttccctcatcggctgccgctgctccccgtcctcctccccagaaatggaggccagcgctggcacagctctgtaccccgcgcaccgatgcaaaaccgtatacctggtgaggcatgcccagggtattcacaacgtggaaggcgagaaggattttgcagcgtataagtcacatgcgctgcttgatgcccaacttacccctttgggctggagccaagttgataccctgcgagatcatgtgacaaaatgtggactatcgaaaaagattgagttggttattgtttcccctctactcaggactatgcaaactgcagtgggggtctttggtggtgggaactatactgatggagcaagtgcatcaccattgatggtagagggtgctggaaacagtgaacgtcagccgatttcaagtttgaactgcccgccgtttctcgcagttgaggcttgcagggagcacctgggtgttcatccctgtgacaagaggagcagcataacaaaataccgtactctctttcctgccattgatttttctttgatcgagaatgatgaagatgttctttgggaacccgatgtcagagaaacaaatgagtctgttgctctcaggggcatgaagttctttgactggttatggacaagagaagagaaagagatagctattgtcagccatagtggtttcttgtatcacaccttgaacaagtacggtaaagagtgtcatccaacaatagcagaggaactgggcaagcacttcgccaactgtgagctccggtcaatggtcttggtcgacagaagtaaccttggatcggatacctctacatacaacttcgctgggaagataccgaccgggcttgatatgcccagcgatgtcgcagacgagaaggaggctgaagaagctagcaagaactgatgctgtcaagcacatggatgtctttgattcttttatcaaaccttggttctggctgacaatgaactgggaataggtaagcgacatttaaggataggacttgccgtctgttgttccagcgtatgatcggtctgttgttccagtgtatgatcggcacgattggttatgtttatctgatttgttgtttgaacagatacccaaattcgtgggaa

SEQ ID NO: 2863 - DNA, 3400 bp, Oryza sativa
gagcgaagcagcagctccagatctgtgggtgtctttgggtgagtgggcaaataaacaaacaaaagtggcaagccaagtagccaatccgaacgcatccccgtctttctttctttctttctttctttctttgtgcccaactctgacacgactcacagtttttttggcacgagctgaaagcctcaaagtagtaatggtccagctgctccagcactcgcatctgcacactgtattcgccgccgcgaccaccaccatcggagtcggacagtttccccgccgccgtgccaaattccccacctcccttgttcttcttcctcgctgcacctcctcctcctcctcctcctcctcaggagctccaatggacgccaatcctcctaccaccgccatgtatcctctccaccgctgcaaaaccatctacctggtcaggcatgcccagggtgttcacaatgtggaaggcgagaaggatcacagcgcctacatgtcgccccaactctttgacgcccaccttactccattgggctggaaccaagttgactgcctgcgtgagcacgtgaaaaaaagtggacttgcacaaaagattgagctggttattacttcccctctactgaggactatgcaaactgcagtcggggtctttgggggtgaaaactctgttgatggagtaagtgcaccaccattaatggtggaaaatgctggacatagtagccggccagctatttccagtttgaactgcccaccgtttcttgcttttgaggcctgcagggagcacttgggtgtgcatccctgtgataaaaggaggagcattacagaataccgcgctctctttcctgccattgatttttcgctgatagagaatgatgaagatgtactttgggaaccaaatgtcagagaagcaaattcatctgtcgcagctaggggcatgaagttcattgactggttatggacaagggaagagaaagagatagctattgtaagccatagtggattcttatatcacaccttaagcatgtacagcagggagtgtcatccaaccataagagaagaagtgggcaagcactttgccaactgtgagctccggtcgatggtgttggtcgatacaagcatgcttgggtctgattcccccagttacaactaccctggaagtattccagctggacttgatcttcctagtgatgctgcaccttgagcaaattcaagacctgtgttagagattgttaccgtgcattggtgccttgattatttttcccagcccattgacactattcaagctagcactggaagtcagaaacttgggtgaattcaaacagcatctacagatagaacttaccatttgttgcccaaaagtatgatcacgattttacaggatattttatgcttacaactttagagcatatcatgttttaaaattttacaagatactttatgtcgtatctcaacacgtactgaacttgactgtaataaacgtacgatttacatattttactcatgtactttgtgttgcttttgtttgcttacggcttgggagttcacgggacaaattcttcggaatagcgttgtaaagctactactttggagctcgttcttcttgctctttcttttcctttagtcgatgctgacatgcattgtgatctaatactagattacgctaaatatcttcggttcttcatagacaaaatggtaaaatggcccaatatcccatcccgattttgtcctcggtaaataggagcaaaacatccagccttaaatccggccacccagatgaacacgaagatatcaccagctaggtaatgcagacttgaaagatcaaaatttagcaacccgtatggttattcttatgattattgacttctccacgagtaaatagtgaacaagttcagaataatgttctacttgaagcaactaatctctcgaataacaaaatccatcgaagggaaaagttacaccacagcacgtcaaaagcactaattatctacactttattattcttcgccatctcttccacatcaagctctactgccagaactggtgaatcctggttcatggccattcggctgttgcataaagcaggagcaaaagcaaaaagttgatgtcaaattacaacttactgtgtagatgagaggcagcccagaatataacaaggatcctacctgttctccactgggccatggtcgacagccgttcttaaagagtatatcactctgccaaggatatcagtcatagggactggtccaaacaagcggctatccctagcttcctgttaccaaaagagcttatgtgaagtacataaagaaggtatgtgctcaaattcaatacacatatttgttaaaccacaccacaacgatgtgtgcatctaagagaatgtgcccaaatctcacttttttgttgcaacaatgagaagatatctaggtaaaacactaacctctctacgctttgtgcatctaaaaggatcatgtgcccgttgctcgcctttatgtccaaataataggaaggtattttggtagaacaccaaccaacaaaactatgtctactatttcttcatgcatcaactaacatactacatacctttggctttagtgattggttgtctgccagaacccagcattgatccttgtcaagtacaaacggctcatccttctcatcattagagaccatctcataaccttctagggcagccaatcgtcgaacgattaaatcatcagatttctctgggtcttttagtaagacaacatcaccaacaaagacttgtctgtgaagataattagatgcataaatggttaccacatatggattatggacatgatataatatctaactaaaaaaggtatctgcattaagttatgtcaacttcatacatggttattctatgagacccataacccattagttgttttaagagaagatatcaaatattaaccagcccaacacaattacacaatgatatagccagttttttttttgtcaattacacctcatgaaatcagcatcttctcaaaattatcatattttttaaactaacaagacaagatcaatgaacaaaaatagtcaagaccgaaaccatatattcagagtactctccaaaatttttatacaaggacacaaaactggtatgcaaaaagttgaaaggttagcatatggataccaagcaaaataacaacaaagcaaagtggagcagttgatgtagtctcaaaagattggcaaaaggaattatcacaggcaaacactaacaattgaacagttgcatacaattatctcactcttctgttaagatctcagaactacagcctcaactttaataactattcattagtaaaacaatgcattggttcaagaaaggaggcagaattagctagtgtatttattaagggtgtaggtcttgtttatcagtggtcctcgtagcctattt

SEQ ID NO: 2864 - DNA, 1153 bp, Panicum virgatum
gggtcacaggacctgtttgatgcgcagctcactcctcttggctggagccaagttgatggtctgcgggagcatgtgaagaaaagtggacttgcaaaaaagatcgagctggttattacttcccctttactgaggactatgcaaactgcagtgggggtctttggcggtgaaaactatactgatggtgtaagtgctccaccactaatggttgaaaatgctggacacagtggacgtccggcggtttcaagtttgaactgcccaccatttcttgcagttgaaacctgcagagagcacttgggtgtccatccctgtgacaagaggaggagcataacagaataccggcctctctttcctgctattgatttttcattgatagagaatgatgaagatgttctctgggaaccagatgttagagaagcaaatgagtctgtcgcactgaggggtatgaagttctttgactggttatggacaagggaagagaaggagatagctattgtcagtcatagtggtttcttgtatcataccttgagcacgtacagcaaggagtgtcatccaaccgtaagagacgaagttggcaagcactttgcaaactgtgagctccggtcgatggtgttggttgacaggagcatgcttgggtcggattccccaagtttcaattaccctggcaagattccagccggactcgatctgcctagtgacgttgcagataagaagcatgtagaggaagctcagaagaactgatgagcccgtctgaggatattgagcattgccgctttgattcttttatcaactcattctgaccccattcaagtctgcagttgaagaagacaagctaaacagtatctacaggtaggacttgccggttgttaattgagcatgaattacggaatgtattacgtattacgtttgttatcgcagcccatattgaaattcagggtattgaaatccatagcaataatacctacgctacatgacaaaattctcctggttgcttgtgttcttcgttcttggttaaaacccaagcaagggttgctcatctgctctctcgtagatggtagtagaaatgtgtgtggcttgttcatcttaaatttgggaggagcttcggattatagcttctttatatttttcactgattatattgtcacatcagttatat

SEQ ID NO: 2865 - DNA, 1084 bp, Triticum aestivum
cagctctgtaccccgcgcaccgatgcaaaaccatatacctggtgaggcatgcccagggtgttcacaacgtggaaggcgagaaggattttgcagcatacaagtcacaggcgctgcttgatgctcaacttacccctttgggctggagtcaagttgataccctgcgagatcatgtgacaaaatgtggactagcaaaaaagattgagttggttattgtttctcctctactcaggactatgcaaactgcagtaggggtctttggtggtggcagctatactgatggagcaagtgcatcaccattaatggtagaaggtgctggaaacagtggacgtcagccaatttcaagtttgaactgcccaccgtttcttgcagttgaggcctgcagggagcacttgggtgttcatccctgtgacaagaggagcagcataacaaaataccgtactctctttcctgccattgatttttccttgatagagaatgatgaagatgttctctgggaacccgatgtcagagaaacaaatgagtctgttgctctcaggggcatgaagttctttgactggttatggacaagagaagagaaagagattgctattgtcagccatagcggtttcttgtatcacaccctaaacatgtacggtaaagagtgtcatccaaccatagcagaggagctgggcaagcacttcgccaactgtgagctgcggtcgatggtcttggtcgacagaagtaaccttggatcggatgcctctagatacaacttcgctgggaagataccgaccgggcttgatatgcccagcgatgtcgcagacgagaagcaggctgaagaagctagcaagaactgaggctgtcgagcacatggatgtctttgattcttttaccaaaccccggttctggctgacaatgaactcagaatagatgagcgacatctacgggtaggacttgccgtctgttgttccggtgtatgatcggcacgattggttatgtttatgtgatttgttggttgaacagaagatacccaaattcatgggaaataaggacttatacgcatacccctctttttgagaacgagtacaatacattgaaccctaaa

SEQ ID NO: 2866 - DNA, 1394 bp, Panicum virgatum
taataggacaacagagcaaccgagtaaccgaggagtaaacaaattttaccattttaccgtgtccctaccccactagaggagaggaaggcaacccaatagtaaacctgtgagccgccgccgtatcacgggcggttaccgccacctcagctcgctgcctccgccgctccgcatcctcctccctccttcgtcctcagggagggtcatcgacggccgccgcaaccagatctccgacgatcctcctcctcctgctgctaatacataccgaggagtcaggaataatggagctcagcgctggcactgccatctaccctctgcaccgctgcaaaaccatacacctggtgaggcatgcccagggtgttcacaatgtcgaaggcgacaaggatcacagtgcctacatgaaaccagagttctttgatgcttgcgtcactcctttgggctggaaccaggtcgactgtctacgagagcatgtgaaaaaaagtggacttgcagaaaagattgagcttgttatttgttcccctttactgaggactatgcagactgcagtgggtgtttttggtggtgagaattatactaatggaataagtgcacctccactaatggtggaaaatgctgcagacagtggacgtccggcaatctcaaatttgaactgcccaccatttcttgctgtcgagacctgcagggagcgcttgggtgccaatccttgtgacaagaggaggagcatcacagagtatcgtactctgtttcctgccattgacttttcactgatagagaatgatgaagatgttctttgggtaccggatgtcagagaaacctttgagtcactaggggagaggggcaggaagtttatcgactggttatggacaagagaagagaaagagatagccattgtcacccatagtggtttgttgtggcataccttacgtatggacagcaaagagtgtcatcctactgtaaggcatgaagtgagcaagtactttgcaaattgtgagctccggtcgttggtgctggttgataggagcatgcttggatcagattcccccagttacaactaccctggcaagatcccagatggtgttgatctgcctagcgatgtcgctgacaagaagcaacttgaggaggaagctcaagagagaactgagcctgtctgaggctcgtttcgtgttttaccctgattccttgattcttttgtgaacccatcttgacacctccctagttgcattcagtggaagctaaacacctgcatattggactgaccatttgttattacgtatgtttcctctgaagttcactgaaatgaaatgttcttttcacttctggtgatgagatttttttttatacttttctttcaagaggatcgatataattgagagtaatgttaaagaagccagactaaa

SEQ ID NO: 2867 - DNA, 1195 bp, Panicum virgatum
ccacctcagctcgctgcctccgccgctccgcatcctcctccctccttcgtcctcagggagggtcatcgacggccgccgcaaccagatctccgacgatcctcctcctcctgctgctaatacataccgaggagtcaggaataatggagctcagcgctggcactgccatctaccctctgcaccgctgcaaaaccatacacctggtgaggcatgcccagggtgttcacaatgtcgaaggcgacaaggatcacagtgcctacatgaaaccagagttctttgatgcttgcgtcactcctttgggctggaaccaggtcgactgtctacgagagcatgtgaaaaaaagtggacttgcagaaaagattgagcttgttatttgttcccctttactgaggactatgcagactgcagtgggtgtttttggtggtgagaattatactaatggaataagtgcacctccactaatggtggaaaatgctgcagacagtggacgtccggcaatctcaaatttgaactgcccaccatttcttgctgtcgagacctgcagggagcgcttgggtgccaatccttgtgacaagaggaggagcatcacagagtatcgtactctgtttcctgccattgacttttcactgatagagaatgatgaagatgttctttgggtaccggatgtcagagaaacctttgagtcactaggggagaggggcaggaagtttatcgactggttatggacaagagaagagaaagagatagccattgtcacccatagtggtttgttgtggcataccttacgtatggacagcaaagagtgtcatcctactgtaaggcatgaagtgagcaagtactttgcaaattgtgagctccggtcgttggtgctggttgataggagcatgcttggatcagattcccccagttacaactaccctggcaagatcccagatggtgttgatctgcctagcgatgtcgctgacaagaagcaacttgaggaggaagctcaagagagaactgagcctgtctgaggctcgtttcgtgttttaccctgattccttgattcttttgtgaacccatcttgacacctccctagttgcattcagtggaagctaaacacctgcatattggactgaccatttgttattacgtatgtttcctctgaagttcactgaaatgaaatgttcttttcacttctggtgatgagatttttttt

SEQ ID NO: 2868 - DNA, 1049 bp, Saccharum officinarum
ttgttttcaaccgtcccattctgtttctgtggacagggcacgtggtccgtgctcgtggggtaatacagtaagttaagtgataataaaaaaaataatcctacgatgagatgatctacggcaggcagcatgagcagccgtgtcatccacctcctctgctctaccaccaccaccgtcccaggcccagcagcagcgggagctccctcgtcttcctcctcctctgtcagggtccaggtcgggcttcctcccggccgccgcgccaaatcccgtctcgctcctccgcttcgctgcgcatcctcaggaatggaactcggcgccagcactgccctgtaccctctgcaccgctgcaaaaccatttacctggtcaggcatgcccagggcattcacaatgttgcaggcgaaaaggacttcagcgcctacatgtcacatgacatgttcgatgctcagctcactcctttgggttggagccaagtcgatggtctgcgggagcatgtgaagaaaagtgggcttgcagagaagattgaattggttatttcttcccctttactgaggactatgcaaactgcagttggggtctttggtggtgaaaagtatactgatggtgtaaattcacctccactaatggttgaaaatgctggacatagtggacgtccggcagtttcaagtttgaactgccccccatttattgcagttgaagcctgcagagagcacttgggtgtccatccctgtgacaagaggaggagcataacagaataccggcctctctttcctgccattgatttttcgttgatagagaatgatgaagatgttctttgggaaccagatgtgagagaaacaaatgaggctgtcgcattgaggggtatgaagttcttggactggttgtggacaagagaagagaaagagatagctattgtcagtcacagtggtttcttgtttcacaccttaagcatgtacagcaaggagtgccatccaaccgtaagagacgaagttagcaagcactttgcaaactgcgagctacggtcaatggtgttggttgacagaagcatgcttgg

SEQ ID NO: 2869 - DNA, 1617 bp, Pennisetum glaucum
ctgcggtcgttcgtggaggtgccggcgggctcgcactttcccattgcttgcttctcctccccctcctctgcccggccgccctgtgtcaactctcaatctagagagcgagttgttggctggcacacaccagcagccgggcagaggagggggaggagaagcaagcaatggcggaggcgaggcagctgcggtcgttcgtggaggtgccggcgggctcgcacttccccatccagaacctgccctttggggtcttccgccggcgtgggtcgtcgcagccgcgccccgcggtggcgatcggggacttcgcgctcgacctcgccgccgtcgccgacgccggcctcttcgatgggcccgcgctcgccggctccacgtgcttccaccaggagacgctcaacgtgttcttggggatgggacggccggcgtggaaggaggcgcgcgccacgctccaaaaaatcctctcagctgatgaaccagtcttgcgtgacaatgaggccctcaggaagaagtgtcttgtgccaattagtgatatagagatgatcatgccaatcactgttggaggctacacggacttcttttgttctgttcaccacgccaggaattgtgggtttatcttccgtggaccgcagactccagtcaatccaaattggtttcatcttccaatcggttacaatggacgggcatcatctgtagttgtgtctggaacagatgtcattcgacctagaggacaaggacatccaacaggaaactctgctccgtatttcggtccctctcggaagcttgattttgaacttgagatggctgccattgttggtccagggaatgaattaggcaaacccatcgatattaatgatgctgaagaacatatttttggcctagctttgatgaacgattggagtgccagagatatccaggcttgggaaaccatacctctcggacctttccttgggaaaagcttcagtactacaatatcgccatggattgtcactttggatgctttaaagcctttcacgtgtgaggctcctaagcaggaacctgagcctttgccatacttagctgaaaagaatcacataaactacgatattccccttgaagtctggattaagcccaaagatcaaagtgatgcctcaattgtttcgaagactaatttcaaacatttgtattggacggtgacgcagcagctagcacaccacactatcaatggatgcaacatgagaccgggggatatatttgcaaccggcacactcagtggacctgaacctgaatctttggggtgtctgctggagctaacatggaacgggcagaaggacatagcagttggaaattcaacccggaagtttctagaagatggggatgaagtgatcttgaccggctgctgcaagggtgaaggctacaacattggtttcggaacctgcacagggaaggttctgccagcgcttccttagccaacgtctcttcacttctgttctcaggggtctcaataatcacaaaggaatccattcgccgaatctagcaagctgcttagtttgtgttaagggtagtgatggtgatttagggattgtttttcttgaatgtttaagaggaaacctgtactctcttctgcaataaaatcgatgctaagcc

SEQ ID NO: 2870 - DNA, 1725 bp, Panicum virgatum
cttgctccgatccaacccgtctatttatacggccgcctggtctcagctcggcccccaacgagagcgaagcgtgctgttagctacacgagcgcacaccagcggcagccagacgcgagcagagcaatggcgggggcggagcagcagctgcggtcgttcgtggaggtgccggcgggctcgcacttccccatccagaacctgcccttcggggtcgtccgccggcgggggtcgcgggcgccgccgcgccccgcggtggcaatcggggacctggcgctcgacctcgccgccgtcgccgacgccgggctcttcgacgggcccgcgctcgccggctccccgtgcttccaccaggagacgctcaacatgttcttggggatgggccggccggcgtggaaggaggcgcgcgccacgctccagaaaatcctatcagctgatgagccagtcttgcgtgacaatgaggccctcaggagcaagtgtcttgttccaatgagtgatattgagatggttctgccaatcactgtcggaggctacacagacttcttttgttccgtgcaccatgccaggaattgcgggtttatcttccgtgggccgcagactccagtcaatccaaattggtttcatcttcccataggttacaacggaagggcatcatctgtagttgtgtctggaacagatgtcattcgacccagaggacaaggacatccaacaggaaactccagtccttattttggtccatctcagaagcttgattttgaacttgagatggctgccattgttggcccagggaatgaattgggaaaacctatcgatattaataatgctgaagaccatatttttggcctagctttgatgaatgattggagtgccagagatatccaggcttgggagactatacctcttggaccattccttggaaaaagcttcagtaccacaatatcgccatggattgtcactctggatgctttaaagcctttcacctgtgaggcacctaagcaggaacctgagcctttgccttacttggctgaaaagaatcacgtgaactacgatattcctcttgaagtttggattaagcccaaagatcaaagtgacgcctcaatcgtcgcaaagactaatttcaaacatttgtattggacggtgacgcagcagctagcacaccacactatcaatggatgcaacatgagaccaggggatatatttgcaactggcacactcagtggacctgaacccgagtctctggggtgtcttctggagctaacatggaacgggcagaaggagataccagttggaaattcgacccgcaagtttctagaagatggggatgaagtcatcttgaccggctgttgcaagggtgaaggctacaacattggatttggaacctgcacagggaaggttctgccggcgcttccttgagccaacatatcttcacttcagttcatggagtctcgatgatcccaaaggagttcatgcgctgaaatctaccaagctccgatccttagtctgtttaaagcctactagttatggtaactggatattaggtattgtttttcttgaatgcggaaaaggaaactggtccctctctctagtgcaataaaactgatgctaagtcatctttttatacaattttttccctctgggagttgttttaaacttgtaatgccctgtgcgacaaggatagtgttatgctaaatttgttctaggacagtccaaaagaagggaacatctattcatcgc

SEQ ID NO: 2871 - DNA, 1567 bp, Panicum virgatum
gtcagctccacgagcgcacaccagcgacagcagccagacgcgagcggagcggagcaatggcgggggcggggcagctgcggtcgttcgtggaggtgccggcgggctcgcacttccccatccagaacctgcccttcggggtcttccgccggcgggggtcgcgggcgccgccgcgccccgcggtggcaatcggggacctggcgctcgacctcgccgccgtcgccgacgccgggctcttcgacgggcccgcgctcgccggctccccgtgcttccaccaggagacgctcaacatgttcttggggatgggccggccggcgtggaaggaggcgcgcgccacgctccagaaaatcttatcagctgatgagccagtcttgcgtgacaatgaggcgctcaggagcaagtgtcttgttccaatgagtgacattgagatggttctgccaatcactgttggaggctacacggacttcttttgttccgtgcaccatgccaggaattgcgggtttatcttccgtgggccgcagactccggtcaatccaaattggtttcatcttcccataggttacaacggaagggcatcatctgtagttgtgtctggaacagatgtcattcgacccagaggacaaggacatccaacaagaaactccggtccttatttcggtccatctcagaagcttgattttgaacttgagatggctgccattgtcggcccagggaatgaattgggaaaacctatcgatattaataatgctgaagaccatatttttggcctagctttgatgaatgattggagtgccagagatatccaggcttgggagactatacctcttggacctttccttggaaaaagcttcagtaccataatatcgccatggattgtcactctggatgctttaaagcctttcacctgtgaggcgcctaagcaggaacctgagcctttgccttacttggctgaaaagaatcacgtgaactacgatattcctcttgaagtttggattaagcccaaagatcaaagtgatgcctcaattgtcgcaaagactaatttcaaacatttgtattggacagtgacgcagcagctagcacaccacactatcaatggatgcaacatgagaccaggggatatatttgcaacaggcacactcagtggacctgaacccgagtctctggggtgtcttctggagctaacatggaacgggcagaaggagataccagttggaaattcgacccgcaagtttctagaagatggggatgaagtcatcttgaccggctgttgcaagggtgaaggctacaacattggatttggaacctgcacagggaaggttctgcctgcgcttccttgagccaacatatcttcacttcagttcatggagtctcgatgatcccaaaggagttcatgcgctgaaatctaccaagctccgatccttagtctgtttaaagcctactagttatggtaactggatattaggtattgtttttcttgaatgcggaaaaggaaactggtccctctctctagtgcaataaaactgatgctaagtcatctttttatacaattttttccctctgggagttgttt

SEQ ID NO: 2872 - DNA, 1639 bp, Zea mays
gagtgctagtcttcacggcggggttgttgtcgcttgtggccagccgccagcaccagcacaaggcgatcgagagtggtgaccaccagtaaactgcaaagtgcaaaccaaacaccacccacgagaaagcggaggagggagcaatggcggagccgagccagcagctgcggtcgttcgtggaggtgccggcgggctcccacttccccatccagaacctgcccttcggggtcttccgccggcggggggtgcaggcgcaggcgccgcgccccgcggtggccatcggggacttcgcgctcgacctcgccgccgtcgccgacgcggggctcttcgacgggcccgcgctctccggctccccgtgcttccaccaggagacgctcaacatgttcttggggatgggccggccggcgtggagggaggcgcgcgccacgctacagaaaatcctatcagccgacgagcccgtcttgcgtgacaacgaagcactgaggaacaagtgtctggtaccaatgagtgatatagagatggttctaccaatcacggttggaggttacacggacttcttttgttctgtgcaccatgcaatgaattgtggattcatcttccgagggccgcagactccagtcaatccaaattggttttatcttccagtaggatacaatgggcgagcatcatctatagttgtgtctggaaccaatgtcattaggcccaggggacaaggacatccaacaggaaactccgctccttattttggtccctcgcagaagcttgattttgagcttgagatggctgccattgttggtccagggaatgaattaggcaaacctattgatattaatgacgccgaagaacatatttttggcctaactttgatgaatgattggagtgccagagatatccaggcttgggagactatacctcttggacctttccttgggaaaagcttcagtaccacggtatcaccatggattgttaccctagatgctttgaagcctttcatgtgtgatgctcctaagcaggaacccgagcctttaccgtacttagccgaaaagaatcacataaattatgacattcctcttgaagcctggattaagccgaaagatcaaaatgacgcatcaattgtcacaaaaactaatttcaagcatctgtattggacgctgacacagcagctagcacaccacaccatcaacggatgcaacatgaggccgggggatatatttgcgactggcacactgagtggacctgaaccggactccctcgggtgtctgctggagctgacatggaacgggcagaaggagataccggtggggaatttgacccgcaagttcctagaagatggagatgaagtcatcttgacaggatgttgcaagggtgaaggctacaacattggttttggaacctgcaccgggaaggttctgccggcacttccctgagccaacacgtcttggcatcagttctccggagtctcaacgatctcagctatcagagagttgtctcaacggtctcaactatcaaagagttcatgccgctatctagcaaggctgctatgtaactgaacaatatgaatatgggttgttttcctgggctgttgaagatgaggagactgatgctctgttgtgcaataaaaccgcttcaccattttatacga

SEQ ID NO: 2873 - DNA, 1699 bp, Zea mays
acgaagaaactatttcgaatgacatttgtacgaagcacgatgtttagagtcacaaatatacaattatctccggggttttttaccttaaaaaggtttagtaaaccctgctgtctgctggtcttcagttttcacggcgggttgtcgtggcctgtggctgggagcctgggtggctgtgggcaggagtatgccaagatgatcgagacaccaacaaaccaaacaccatccgccacgaccacgactccacgagagagcggaggaggagggggagcaatggcagagccgggccagcagttgctgcggtcgttcgtggaggtggcagcgggctcgcacttccctatccagaacctgcccttcggggtcttccgccggcgggggtcgccaccgcaggctccgctccccccggtggccatcggggacttcgcgctcgacctcgccaccgtcgccgacgcgggtctcttcgacgggcccgcgctctccggctccccgtgcttccaccaggagacgctcaacatgttcttggggatgggccgaccggcgtggagggaggcgcgcgccacgctacaaaaaatcctctcagccgacgagccagtcttgcgtgacaacgaagccctgaggaataaatgtcttattccaatgagtgatatcgagatggttctaccaatcacggttggaggttacacagatttcttttgttctgtgcaccatgcaaggaactgcggattcatcttccgagggccgcagactccagttaatccaaattggttttatcttccaataggatacaatggacgagcatcatctatagttgtgtctggaaccgatgtaattaggcccagaggacaaggacatccaacaggaaactccgctccttattttggtccctctcagaagcttgattttgagcttgagatggctgccattgttggtccaggaaatgaattaggcaaaccaattgatatcaatgatgctgaagaacatatttttggcctaactttgatgaatgattggagcgccagagatattcaggcttgggagactatacctcttggacctttccttgggaaaagcttcagtaccaccatatcaccatggattgttactcttgatgctttgaagcctttcatgtgtgaggctcctaagcaggaacccgaacctttaccatacctagctgaaaagaatcacataaactatgacattcctcttgaagtcttgattaagcctaaagatcaaaatgttgcactaattgtcacaaaaactaatttcaagcatctgtattggacggtgacgcagcagctaacacaccacactatcaatggatgcaacatgaggccgggggatatatttgcaactggcacactcagtggacctgaaccggactccctcggatgtctattggagctaacatggaacgggcagaaggagataccagtgggcaatttgacccgcaagtttctagaagatggagatgaggtcatcttgacaggatgctgcaagggtgaaggctacaacattggttttggaacttgcactgggaaggtcctgccggcacttccctgagccaacacgtctttacatcagttctcgagtccaaacactcaacaatctagcaagatgctatgtaactgaacaacgggggttgttttcgcataggaaactgatactctgttgtggaataaaatcggttcaccattttatacac

SEQ ID NO: 2874 - DNA, 1946 bp, Sorghum bicolor
tcttggaatcacttataatttgggatggagggagtacatgtttgactccgataaaactcgcttgacagacgggtagattcagaaccgtatactgcattatatttccaaacaagtaaagtaggaaaccaaaccagcagtgccccgccacatctgtctatttatacaaacggctggccggggggagtctgctgcctctgcgagtcttctcttcacggcgggcgggttgttgtggcctgtggctgctgtggtgtggtgtgggtaggcagcacgagacgatcgagagttcgactagtcgtcgagaccaccaacaaaccaaacaccacaacacaacacgactcgagcgagggacggaggagcaatggcggagccgagccagcagctgctgcggtcgttcgtggaggtgccggcgggctcgcacttccccatccagaacctgcccttcggggtcttccgccgccaggggtcggctcaggcgcaggcgcaggcgccgcgccccgccgtggccatcggggacttcgcgctcgacctcgccgccgtcgccgacgcggggctcttcgacgggcccgtgctctccggctccccgtgctttcaccaggagacgctcaacatgttcttggggatgggccgcccggcgtggagggaggctcgcgccacgctacagaaaattctctcagctgacgagccagtcttgcgtgacaacgaggccctgaggaacaagtgtctggtaccaatgagtgatatcgagatggttctaccaatcacggttggaggttacacagacttcttttgttctgtgcaccatgcaaggaactgcggattcatcttccgagggccgcagactccagtcatgccaaattggttttatcttccaataggatacaatggacgagcatcatctatagttgtgtctggaaccgatgtcattagacccagaggacaaggacatccaacaggaaactcttctgctccttattttggcccctctcagaagcttgattttgaacttgagatggctgccattgttggtccggggaatgaattaggcaaacctattgatattaatgacgctgaagaacatatttttggcctaactttgatgaatgattggagtgccagagatatccaggcttgggagactatacctcttggacctttccttgggaaaagcttcagtaccaccatatcaccatggattgttactctagatgctttgaagcctttcatgtgtgatgctcctaagcaggaacccgagcctttaccgtacctagctgaaaagaaccacataaactatgacattcctcttgaagtctgggttaagcccaaaggtcaaaatgatgcatcagttgtcacaaaaactaatttcaagcatctgtattggacggtgacgcagcagctaacacaccacactatcaatggatgcaacatgagtccaggggatatatttgcaactggcacactcagtggacctgaaccagagtccctcggatgtctgctggagctaacatggaacgggcagaatgagataccggtggggaattcaacccgcaagtatctagaagacggggatgaggtcatcttgacaggatgctgcaagggtgaaggctacaacgttggttttggaacctgcaccgggaaggttctgccggcacttccctgagccaacaccgtcttcgcatcagttctccagagtctcaacaatcaaaaagagttccttccgatatctagcaagctgctatgtaactgaacaatacgggttgttttcctgcactgttgaagatgaggagactgatactctgttgtgcaataaaattggttcatcattttacacattttccctctctctactaatattcgtgttattaaacttgtactacattacattgcaatgtcctctgacaagaaatttagaaatgtcacgcggattgtgaaacagagagcatatcatc

SEQ ID NO: 2875 - DNA, 1781 bp, Saccharum officinarum
cacgagggtgggttggttgttgtggctgtggcctgtgggtaggcagcacgccagcacaagacgatcgagagttcgacgagtcgtcgagaccacccaccaacaaaccaaacaccacccatcgactccacgagagagcgtaggagggacgggagcaatggcggagccgagccaggagcagctgctgcggtcgttcgtggaggtgccggcgggctcgcacttccccatccagaacctgcccttcggggtcttccgccgccgggggtcgcaggcgcaggcgccgcgccccgcggtggccatcggggacttcgcgctcgacctcgccgccgtcgccgacgcggggctcttcgacgggcccgtgctctccggctccccgtgcttccaccaggagacgctcaacatgttcttggggatgggccggccggcgtggagggaggcgcgcgccacgctgcagaaaatcctctcagccgatgagccagtcttgcgtgacaacaaggccctgaggaacaagtgtctggtaccaatgagtgatatcgagatggttctgccaatcacggttggaggctacacagacttcttttgttctgtgcaccatgcgaggaactgcggattcatcttccgaggaccgcagactccagtcatgccaaattggttttatcttccaatagcatacaatgggcgagcatcatctatagttgtgtctggaaccgatgtcattaggcccagaggacaaggacatccaacagggaactcttctgctccttattttggcccctctcagaagcttgattttgaacttgagatggctgccattgttggtccagggaatgaattaggcaaacctattgatattaatgacgctgaagaacatatttttggcctaactttgatgaatgattggagtgccagagatatccaggcttgggagactatacctcttggacctttccttgggaaaagcttcagtaccaccatatcaccatggattgttactctggatgctttgaagccttttatgtgtgatgctcctaagcaggaacccgagcctttaccgtacctagctgaaaaaaaccacataaactatgacattcctcttgaagtctgggttaagcccaaaggtcaaaatgatgcatcaattgtcacaaaaactaatttcaagcatctgtattggacggtgacgcagcagctaacacaccacactatcaatggatgcaacatgagtccgggggatatatttgcaactggcacactcagtggacctgaaccggactccctcggatgtctgctggagctgacatggaacgggcagaatgagataccggtggggaattcgacccgcaagtatctagaagatggagatgaggtcatcttgacaggatgctgcaagggtgaaggctacaacgttggttttggaacctgcaccgggaaggttctgccggcacttccctgagccaacaacacgtcttcgcatcagctctccggagtctcaacaatcccaactatcaaagagttcattccgcaatctagcaagctgctattgttttcctgcactgttgaagatgaggagactgatactctgttgcgcaataaaatttggttcatcattttacacacacactctctctctaagagttgtgttattaaactcgtacattgcaatgtcctctgacaagaaatttagaaatgtcacgcggattgtgaaacagagagcatatcatcgaacgtgaatgtatatatggaacgaaattacagttacactagtagaataagcaagttcgtagatt

SEQ ID NO: 2876 - DNA, 2068 bp, Oryza sativa
gcgagtgtgggggcgcagccttaatactttatagagtccatagaaagagacctgatcgtacatggctccttttttttttttggataaatcacgcagctaatttttctttttcttttttaccagtagtaggagtgtaggacacttcatatcgttgtactagtatccggcgccgcttccgttcatctgcgcctatttattgcggcctcttcttcctcctctcctcgcctcgcctcgctcttccactgttcatctgcgccacgacacgacacgacacgacacgagacgagagaggagtcggcaatggcggaggggtcgcggtcgccgctgaggtcgttcgtggaggtggcgccggggtcgcacttccccatccagaacctccccttcggggtcttccgccgcaggggctcgccggagccggagccgccgcgcccggccgtcgccatcggggacttcgcgctcgacctcgccgccgtctccgacgcgggcctcttccacgggcccctcctctccgcctccccctgcttccgccaggaaacgctcaacatgttcctggggatggggcgtccggcctggaaggaggcgcgcgccacgctgcagaagatcctctcagctgatgagccggttttgcgtgacaacgaggccttgaagaagaagtgccttgttcccatgagcgacacagagatgcttctgccaatcacggtaggagactacaccgacttcttttgttctgtgcaccatgcaaggaattgtgggttcatcttccgtgggccacagaccccagtcaacccaaattggtttcagcttccagtaggttatcatggtcgtgcatcctctgtgattgtatctggaacagacatcattcgacccaaagggcaaggccatccaacaggagattctcgaccttattttggtccttctaagaagcttgattttgaacttgagatggcagccattgttggaccagggaatgaattgggaaaacctatcgatattaatgatgctgaagaacatatctttggcctaatgataatgaatgattggagtgccagagatatccaagcttgggaaactatacctcttggacctttccttgggaaaagtttcagtaccacagtatcaccctggatcgttactatggatgccctaaagcctttcacctgtgaagctcctaagcaggaacctgaacctttgccttacttagctgaaaagaaccacgtaaactacgatattcctcttgaggtctggattaagcccaaggagcaaagtgaaccatcaatggttgcaaagagtaacttcaagcatctgtattggactttaacacagcaactagcacaccacactgttaatggatgcaatctgagaccaggggatatgtttgcaactggcacactaagcggacctgagacagaatctttgggatgtttgctggagctaacatggaatgggcagaaggagatatcagttggaaactcgacccgcaagttcctagaagatggggatgaggtcatcttgacagcttgttgcaagggtgaaggctacaatgtcggattcggaacctgcactgggaaggttctgcctgcacttccatgatccaacatatagaggatagcctgctttcatctcatcagtgtgtcaataatctctgaagaaagcatgcaatgaggcaatgtatctagctagttacatctatattttagtgcttagtgatggtaaaaatactaataaggtatgcttccctgagctttacagaagggatgtaattaatgttctccagttacaataagaacttatttgaagtcgtcattgtctcagtgattttggcatgcaatgctggatgtgaaaatcgatgtaatgttggtcgcatgatcgaacggttcagaacgttgaggccaaaattttggtttggattttggaggtgagctggtgaaaccactcgtgcatgctgcatgtattgcagggctatgctagtacgtggtagcaagctatctggtaaaagcaaaagtaaaaacacaacaaaatgttttactgggtgcaaatcagggttcgacttaccgtcggtaaccgcgcg

SEQ ID NO: 2877 - DNA, 1600 bp, Hordeum vulgare
ctcccacccgacccgctatcccctacggcttttactgcgccctccgaccaaacaaccacgaagcccacgacgcgcgcaagagagagagacgctgcagcaatggcggaggcgaagctcctgcggtcgttcgtggaggtgccgagggactcgcacttccccatccagaacctccccttcggggtcttccgccggaggggccagcccgaggacccgccgcgcccggcgacggccattggggacttcgcgctcgacctcgccgccgtctccgccgccggcctcttcgacggtcccctcctctccgcctccccatgcttccgccaggaaacgctcaacatgttcttggggttgggccggccggcgtggaaggaggcgcgcgccacgctccagaaaatcctctcagctgatgagccggtgttgcgtgacaacgaggccttgaggaagaactgccttgtgccaatgagtgatgtagagatgcttctacctatcacggtgggagactacacggatttcttttgttccgtgcaccatgcaaggaactgtggattcatcttccgtggaccgcagactccagtcaatccgaattggtttcatttaccagttggttaccatggacgggcatcatctgtaatcatatctggaacagacattattcgacccagaggacaaggtcatccaacaggaagctctcaaccttatttcggtccttctcaaaagcttgattttgaacttgagatggctgccattgttggaccagggaatgaactgggcaagcctattgatattgctgatgccgaggatcatatatttggcttagtggtaatgaatgattggagtgccagagatattcaagcctgggagaccatacctcttggacctttcctcggcaaaagcttcagtacatctgtatcaccttggattgtcactctggatgccctaaagccttttgcctgtgaggctcctaagcaggaacctgagcctttgccttacttagctgaaaaggatcacataaactatgatattcctcttgaagcttggattaagcccaaagaacaaagtgacgcatcaattgtcacaaagaccaatttcaaacatatgtactggactgtgacgcagcaactagcacaccacactgttaatggatgcaatctgagaccaggggacatgtttgcgactggcaccctcagtggacctgaaccggactctttgggatgcttgctggagataacgtggaacgggcagaaggagatatcagttgggaattcgacccgcaagttcctccaagatggggatgaagtcatcttgacagcttgttgcaagggcgaggactacaacgtcggattcggaacctgcaccgggaagatcgtgccgtcactgccatgagccaacagggaggatgatcttcatttcttggaataaagcagagctgccatgtatcttcaagggcttagtagtgatggtatatatgatgctgaggtgcattccctgaactttaggagaagagagatgtcgcgattactatttactagtgtgtgataacatgattacttaaatacttatattatagtcgtacttcctcgatgatgtcatgattctgtcaagt

SEQ ID NO: 2878 - DNA, 2864 bp, Secale cereale
agcaaacaaccacagagcacacgacgcgcggagagcaagtcggagtcggcaatggcggaggggaagctgcggtcgttcgtggaggtgccgagggagtcgcacttccccatccagaacctccccttcggggtcttccgcaggaggggccagcccgagggcccgccgcgcccggcgacggccatcggggacttcgcgctcgacctcgccgccgtctccgccgccggcctcttcgacgggcccctcctctccgcctcgccatgcttccaccaggaaacgctcaacatgttcttggggttgggccgaccggcgtggaaggaggcgcgcgccacgctccagaaaatcctctcagctgatgagccagtgttgcgtgacaacgaggccttgaggaagaactgccttgtgccaatgagtgatgtagagatgcttctacctatcacggtaggagactacacggatttcttttgttccgtgcaccacgcaaggaactgtggattcatcttccgtggaccacagactccagtcaatccgaattggtttcatctaccagttggttaccatggccgggcatcatctgtaatcatatctggaacagacattattcgacccagaggacaaggtcatccaacaggaagctctcaaccttatttcggtccttctcaaaagcttgattttgaacttgagatggctgccattgttggaccagggaatgaactgggcaaacctattgatattgctgacgctgaggatcatatatttggcttagtggtaatgaacgattggagtgccagagatattcaagcctgggagaccatacctcttggacctttccttggcaaaagcttcagtacatctgtatcaccttggattgtgactctggatgccctaaagccttttgcctgtgaggctcctaagcaggaacccgagcctttgccttacttagctgaaaagaatcacataaactatgacattcctcttgaagcttggatcaagcccaaagagcaaagtgacgcatcagttgtcacaaagaccaatttcaaacatatgtactggactgtgacgcagcagctagcacaccacactgtgaatggatgcaatctgagaccaggggatatgtttgcaactggcaccctcagtggaccagaaccagactctctgggatgtttgctggagataacgtggaacgggcagaaggagatatcggttgggaattcggtccgcaagttcctccaagatggggatgaagtcatcttgacagcctgttgcaagggcgaggactacaacgttggattcggaacctgcaccgggaagatcctgccgccgcttccatgagccaagatggaggatgatcttcagttgttggaataaagcaggcagtgtgtttagcaagctgccatgtatcttgaagggcttagcaggggtggtaaatagtggtactagtaataaaattgggatgaattcccccctagtggtgtgatgacatgattacttttagtcatacttcctcgatgatatcgtgattctaccgtgtgtcatttcgttttcttcccttttctcctctgcaacagggcatccaccgtaggaggatgcgatgttgagattgttccgaggttagttttgtatcattaacaagttaacaaaaagaatcagacacttgctatcattgacaagtaaactgtcagctgcttacaccagttgattaacaaaactgaaaacaaacgtatgatattaggaagcaaaaagaaagaagaaattaatcaaatcaagaaaagaatgaatgtgtgcggtttcagttagaggcatgcgagctccttgacgacgttgagggacttgccgacggcgttcttgcagacggccatggtcttgttgttggtgccggtgtacttgaggttgacgttgacgagctgcaggccctggcagggcacgttgttgacgcagttgagcgtgacggcctcgggcgtggcggaggtgccgacgatgttcttgaagacgatgtcggcgaccaccaccttggatgcgccgggggccttggcgcagatgttgtttgggcagtacttctggtcgatgacgatggggtaggagacgttgtccatgcgcacgtcgtcgtagacgaagcgggtggccctgagcgacgacttggagtcctcgtacgacttgatccggagcccgttggtggcgcccttgatggtgcagttggtcacctggatgtcctccacgtccttctcgtccttgtaccgccccaggctgcccacgctgatgccgtggcccgggccgcaccgggagccgtggatcttgatgtgcttgctcccgggcccgatggagatgcagtcgtcgcccacgccgatgttggtcgacttgatggtcacgtcctccgagtcccccatgtggatgccgtccgtgttggggctgttccccggcgccgtgatctccacgttctccaccagcaccgtcttgcagttgaagaggttgaggtggaagaactttgcgttcttgagcgtgatgccgcggatcgtcgcgttgttcacgtagtccagcaccaggctgttggggaggatcttgcagtcgtagtgcttgctgcactggttcttctcccacaccagggggccctgcccgtcgatggtgccgtggccgttgatggcgaagttgtccacgcgcatcacctcgatccagttcttcttgtacgcgttgaggtcgccggtgccgaggaggttgccgtccagccggatgatgatggaggaggtgcaggggcccgacagctccagcgcgcccaccaggaagttgcccgccgggatgatgatcttctgcgtccccgtcgccccgcacgcgttcttccacgccttcatcaccgcctgtgtcgcgtccgtctt

SEQ ID NO: 2879 - DNA, 1657 bp, Triticum aestivum
atcccccacggcttttactgcgccctccgagcaaaccagagaggaggacagagcacacgacgcgcgcaagagagagacactacggcaatggcggaggggaagctgctgctgcggtcgttcgtggaggtgccgagggactcgcacttccccatccagaacctccccttcggggtcttccgcaggaggggccagcccgagggcccgccgcgcccggcgacggccatcggggacttcgcgctcgacctcgccgccgtctccgccgccggcctcttcgacgggcccctcctctccgcctcgccatgcttccaccaggaaacgctcaacatgttcttggggttgggccggccggcgtggaaggaggcgcgcgccacgctccagaaaatcctctcagctgatgagccggtgctgcgtgacaacgaggccttgaggaagaactgccttgtgccaatgagtgatgtagagatgcttcttcctatcacggtaggagactacacggatttcttttgttctgtgcaccacgcaaggaactgtggattcatcttccgcggaccacagactccagtcaatccgaattggtttcatttaccagttggttaccatggacgggcatcatctgtaatcatatctggaacagacattattcgacccagaggacaaggtcatccaacaggaagctctcaaccttatttcggtccttctcaaaagcttgattttgaacttgagatggctgccattgttggaccagggaatgaactgggcaaacctattgatattgctgacgctgaggatcatatatttggcttagtggtaatgaatgattggagtgccagagatattcaagcctgggagaccatacctcttggacctttccttggcaaaagcttcagtacatctgtatcaccttggattgtgactctggatgccctaaagccttttgcctgtgaggctcctaagcaggaacctgagcctttgccttacttagctgaaaagaatcatataaactatgacattcctcttgaagcttggattaagcccaaagagcaaagcgacgcatcaattgtcacaaagaccaatttcaaacatatgtactggaccgtgacgcagcaactagcacaccacactgtgaatggatgcaatctgagaccaggggacatgtttgcgactggcaccctcagtggacctgaaccagactctctgggatgtttgctggagataacgtggaacgggcagaaggagatatcggttgggaattcgatccgcaagttcctccaagatggggatgaagtcatcttgacagcctgttgcaagggcgaggactacaacgttggattcggaacctgcaccgggaagattctgccgtcgcttccatgagccaagacgggggatgatcttcagttcttggaataaagcaggcagtgtgtttagcaagctgccatgtatcttgaagggcttagcaatggcggtaaatagtactagtagcaataaaattgggatgaattccccctagtggtgtgataacatgattacttttagccgcatttcctcgatgatatcgttattctaccatatcgttattctaccgtgcgtcatttcgttttcttcctttttctcctctgcaacaccgcaggaggatgcgatgttgcgattgttccgaagt

SEQ ID NO: 2880 - DNA, 1679 bp, Avena sativa
gcaataccaacacacgacagagaggaattctcaaaaaaaaaaaaaaacacacgacagagaggaggcgtcggcaatggcggaggcgaagctactccggtcgttcgtggaggtggcgcgggactcgcacttccccatccagaacctccccttcggggtcttccgcaggaggggccagccggcggacccgccgcgcccggccgtggccatcggggacttcgcgctcgacctcgccgccgtctccgccgccgggctcttcgacgggcccgtcctctccggatccccatgcttcaaccaggagacgctcaacatgttcctggggatggggcggccggcgtggaaggaggcgcgcgccacgctccagaaaatactgtccgagaatgagccagtgctgcgcgacaatgaggccctgaggaagagctgccttgttccaatgagtgatgcagagatgcttctaccaatcactgtaggagactacacagatttcttttgttctgtgcaccatgcaaggaattgcgggttcatattccgtggaccacagactccagttaatccaaattggtttcatttaccagttggttatcatgggcgagcatcatctgtgatcgtatctggaacagacattattcgaccaagaggacaaagccatccaataggaagctctcaaccttctttcggcccttctcagaagcttgattttgaacttgagatggctgccattgttgggccagggaatgaattgggcaaacctattggtattgatgatgctgaggatcatatatttggcttagtggtaatgaatgattggagtgccagagatatccaagcctgggagaccatacctcttggacctttccttggcaaaagctttagtacatcagtatcaccttggattgtgaccctggatgcccttaaaccttttgcttgtgaggctcctaagcaggaacctgagcctttgccctacttagctgaaaagaatcacatcaactatgacattcctcttgaagcttggattaagcccaaagagcaaagtgatccatcagttgtcacaaagacaaatttcaaacatatgtattggaccgtgacgcagcaactagcacaccacactgttaatggatgcaatctgagaccaggggatatgtttgcaactggcaccctcagtggacctgaacccgactctctgggttgtttgctggagataacgtggaacgggcagaaggagataccggttgggaattccatccgcaagttcctcgaagatggggatgaagtcatcctgacagcttgctgcaagggtgaggactacaacgttggatttggatcctgcacggggaaggttctgccagcacttccatgagccaagatggcgaggatggtcttcaattcttgagtagatgaaataataagaaagcagtcagtgtatctggctagctgccatgtatctttgaagggcttagcgtgtttccctgaactttaggagaagggagataatatatcccattgatatgatatactaatataatttcttataatcgcacgttggtgatatcttgatttgatggggcatcatcccctgtttctcctctgctgcaccagtgatgcagatgttcggagattagtttgtactagatgaatgcctgtgtgttgctacggtgttctaacttttttcttgccacacagct

SEQ ID NO: 2881 - DNA, 1700 bp, Brachypodium distachyon
ctctctcgctcgctccgcccacccgttgctgtctcctgctggtaccaaacaaggaagcacacacgacgagcgcagagggacagggagagagagaggagtcggcaatggcggaggcgaagctgaggtcgttcgtggaggtgccgcgggactcgcacttccccatccagaacctgcccttcggggtcttccgccggaaaagccagccggaggacccgccgcgcccggcggtggccatcgggggcttcgcgctcgacctcgcctccgtctccgccgcgggactcttcgacgggcccgtgctctccgggtcgccatgcttccgccaggaaacgctcaacatgttcttggggatggggcggccggcctggaaggaggcgcgcgccacgctccagaaaattctctcagctgacgagccagtcttgcgtgataacgaggccttgaggaagaactgccttgtgccaatgagtgatgcagagatgcttttaccgatcacggtaggagactacacagatttcttttgttccgtgcaccatgcaaggaattgtgggttcatcttccgtggaccacagactccagtcaatccaaattggtttcatttaccagttggttatcatggtcgggcatcatctgtaatcatatctggaacagacatcattcgacccagaggacaaagccatccaacagcaagctctcaaccttctttcggcccttctaagaagcttgatttcgaacttgagatggctgccattgttggaccagggaatgaattgggcaaacctattagtattgataatgccgaggatcatatatttggcttagtggtaatgaatgattggagtgccagagatatccaagcttgggagaccatacctcttggacctttccttggcaaaagcttcagtacatctgtatcaccttggattgtgacccttgatgccctgaagccttttgcctgtgaggctcctaagcaggaacctgagcctttgccttacttagctgaaaagaatcacatcaactatgatattcctcttgaggcttggattaagcccaaagagcaaagcgatccatcagttgtgacaaagaccaatttcaagcatatgtattggactgtgacgcagcaactagcgcaccacactgttaatggatgcaatctgagaccaggggatatgtttgcaactggcaccctcagtggacctgaaccagactctctgggatgtttgctggagataacatggaacgggcagaaggagatatcggttgggaattcaatccgcaagttcctcgaagacggggatgaagtcatattgacagcttgctgcaagggcgaggactacaacgtcggattcggtacctgcactggaaagattctgccagcgcttccatgagctaagacggtctccaattcttcagtgcatcaaataatctcgcaagaaagcgtgcattgtatcttttaaggtcttattaggaatggtaaataacatgggatgtgtttctctgaactttaggagaagggaagcaatgttccccagtgataatataattttatctttagacgtatattgtcgtgattcaatggtgcgtcctgctggttgtgttcccaagttggtttgaaatttcgttgggtttcctgtgcgagacgcacgcacaggtagaataaccggtgattgttagctaagtaccatatcaccgggggccatgcatgc

SEQ ID NO: 2882 - DNA, 888 bp, Pennisetum glaucum
agaacgtgcgcaggggagtttcaggtagcagagacaggcaggaagaagagacgatggggacgtcgccgtcgcggcatgaggcgtcgtccgactcgtcgcgcgccggcgacggccgcgccgtggcggtgtcgacgagcagcgccgcctctggcaccggtagcagcagcaaccatgcccagtcgaagcgggcgccggctcctcacatgttccatgagatcgtcgcgcaggagaagacggccaccgcggctgagctggaggatcaggtgctcagtggagggatctacctggctgggaaaacaaagaagtactgggtgcacgagaaaacgaggtgcaactgcttcatgctgttccccagagggctctccatcacttggagtgaggaccccaaatactggagctggcatcccctgaaagagacaagcgactccgagatcgaggcggtgtcgctgcagaacgtgtgctggctggagatccacgggaagctggagctgtcccatctcacgccgggagtcacctacgacgtcgtcttcgaggcgatgctcaccgagccggcgtacgggtggaccgcgccggtgaacctccgtctcaagctccccgacggggcggtgcaggagcagaaggagaagctgcaggagaagcccaggaaccagtggctggagctcaaggccggggaggtcaagtcgcagccggggcagaagggggaggtggagatctccatgttcgagtacgatggcgggcagtggaagagagggctcctcgtcaagggcatcaaaattgtgccaaaggagtgaatgagtgattagcattttgtttgaggatgatcgttagccttttgcctgtcaggtgttctaagatcaatgagatatgtggaataatgatgtgtgtggc

SEQ ID NO: 2883 - DNA, 2204 bp, Panicum virgatum
ctctccatctccgctccctcttcttctccaatgcggccggggtgtgaggccaagatctcaccgtcggcgaggaagtggtcgatgaaatgcgcacgagagaagatcgatgaaacgaatcgtcgatctcctccccttctggtgttcacctgatctttattgctttccagtctatctgaaccttggaattgctaaacatgtcaccggctgcgctcaccgctcatcgccgtagcgcacagcattactggtagtgggcaggcacaggagcatgcaaatcctggccaccctcacccgaaagctaggggcctgattggttctcggatgaactcagccaggctcgcaccactcatacaggctcacgtcggccaggcatgccacacgcaacaaccttttgtttggtttgcatctgaacggagacaggctagcaagaaactgcgtttggttgcctagctcgtagctgccagcttgcttttttgtctctacacgtttacccaggcgcgctcgttttgcatctcgcaagcctggcccgccggaaacagtcgattttgccgtatcagcagagccggcccggtggtgcattttgcatcgtcggggcaggcccgaaacgtagtgcaggtaagcaatcagatggaagttgcatccggcgagcctggatgacccctatgcgggcatccaatcaggccctagattctcctgaggcaaatggctgccactgtctccgtgcacaaaatccatcatctcgaatcagattctgcgcacaaagctggagcaaaagaacaggctcagttcctagctttcccccgccgcaagcgctttatgccgtctcgcctgctgacatcgatcttctggacacatctcgccggccgtccatggcgcaaaagtcaggatggttacattccctctgcatttcttttccaggaatcgtaaagcagctgcttcagaagagcttgttcatccgctctcgcctacttgttcctctgcaccaatatatatatgccgctggtcatcagctgagctttcatcccacggcgcgcaggggattttcagttggtcaggcaggcgagatatgggggcgtcgccgtcgcggcatgagacgtcgtccgactcgccgcgcgccggcgagggccgcgccgtggcagtggcggcgagcagcgccgcttccggcaccggcagcaacagcaaccaggcccaatcgaagcgggcgccggctccgcacatgttccacgagatcgtggcccaggagaaggccgccaccgcagcggagctggaggatcaggtgcacggcgcagggatctacctggctgggaaaacaaagaagtactgggtgcacgagaaaaccaggtgcaactgtttcatgctgttccccagagggctgtccatcacttggagcgaggaccccagatactggagctggcatcccctgaaagaaacaagtgattccgaggtcgaggcggcgtcgctgcagaacgtgtgctggctggagatccacgggaagctggagctgtcccacctcacgccgggcgtcagctacgacgtcgccttcgaggtgatgctcaccgagccggcgtacgggtggaccgcgccggtgaacctccggctcaagctccccgacgggacggtgcaggagcggaaggagaagatgcaggagaggcccaggaaccagtggatggagctcaaggccggggagctgaaggcgcaaccggggcagaagggcgaggtggagatctccttgttcgagtacgatggtgggcagtggaagaggggcctcctcgtcaagggcatcaaggttgtgccaaaggagtgattagcatttgtttgatggtgatcattattagtctttgcctgtcaggtgtgctaagatcaatgagataccaggaataaaattgtgcgtggcactacaagttttaagccttgaaggctgaatgaaacttgagtctttctcagatgacaatgactcggacgatgtcaaagtgatccacttgagaagcaaagttttgcaccccctccgaaaggtcgaagtgtacgtgcctcttaattgatagtgcagaactactgagtgatggcttcattctttaccaactccatcctgtatagtcaaggagatgactggcctattgaccgattttgatggtttttccaaaattaaggatgcaatgcaagtggataattaatagtattatctacgtcatctgaataattaccatggc

SEQ ID NO: 2884 - DNA, 1172 bp, Panicum virgatum
  misc_feature (588)..(588): n is a, c, g, or t
agattttcacgttggtcaggcaggcgagatatgggggcgtcgccgtcgcggcatgagacgtcgtccgactcgtcgcgcgccggcgagggccgcgccgtggcagtggcggcgagcagcgccgcttccggcaccggcagcaacagcaaccaggcccaatcgaagcgggcgccggctccgcacatgttccacgagatcgtggcccaggagaaggccgccaccgcagcggagctggaggatcaggtgcacggcgcagggatctacctggctgggaaaacaaagaagtactgggtgcacgagaaaaccaggtgcaactgtttcatgctgttccccagagggctgtccatcacttggagcgaggaccccagatactggagctggcatcccctgaaagaaacaagtgattccgaggtcgaggcggcgtcgctgcagaacgtgtgctggctggagatccacgggaagctggagctgtcccacctcacgccgggcgtcagctacgacgtcgccttcgaggtgatgctcaccgagccggcggacgggtggaccgcgccggtgaacctccggctcaagctccccgacgggacggtgcangagcggaaggagaagatgcaggagaggcccaggaaccagtggatggagctcaaggccggggagctgaaggcgcaaccggggcagaagggcgaggtggagatctccttgttcgagtacgatggtgggcagtggaagaggggcctcctcgtcaagggcatcaaggttgtgccaaaggagtgattagcatttgtttgatggtgatcattattagtctttgcctgtcaggtgtgctaagatcaatgagataccaggaataaaattgtgtgtggcactacaagttttaagccttgaaggctgaatgaaacttgagtccttctcagatgacaatgactcggacgatgtcaaagtgatccacttgagaagcaaagttttgcaccccctccgaaaggtcgaagtgtacgtgcctcttaattgatagtgcagaactactgagtgatggcttcattctttaccaactccatcctgtatagtcaaggagatgactggcctattgaccgattttgatgggttttccaaaattaaggatgcaatgcaagtggataattaatagtattatctacgtcatctgaataattaccatggct

SEQ ID NO: 2885 - DNA, 2752 bp, Panicum virgatum
ctgagcacgtcgggctggctgactggctctctctctcccacccagccagctaatgcgaaagctcgccccctctccgtttccacggaacggtcccgtttcccgttgtaacggaacgcgatggcctgtcgtccttgactccttcggccggcgagagggaccgacagagcggacaccggacaggaacaggggcgagccagcgagagagcgggagacccgggcgccacggcacccccgttccagttccgtccgctgaccacccccgtccacatcccctcgccggcgtcttccgcaggcgcagacgcagagccccgcccccttcccctccccgtcgccgtcgcttcccctcgggttgacttgacttgtactgttcctcttccacaccacacccctccactgaccaccaccccaataatcgtattccattctcctcctcgcttttgcactttgcgcctctttcttcctctctttccatctccccatccctccgccggcctctctttctcgagcttgcttcggtccgagaggaggtctgaatctgggatatcggaggtcccgtgggcagccgccggagtccgcgaagagcgtgagctcctcggtgccggcgggaaggtccataacatgatggctgcagagttagttaagcaatactcaaacatcactctggtagaagacagtgagatatgtgatattaaacatgagcttaaggcattgagaaagaagatccttagtttggattttgacaactccgtgcatgtccacgatccacaggactcatttgagtacttggaagtgctgtacaaaatcagacgactgtctgaaaggttaaggagcttagacccttgtggagaagcaaaacagctggatgaactcactgtgtatgctaatgacctttctgaaatggcaatggcaaggcttgaagaggaatttgtttatcttcttacacattacaaacagccattagaacaggaagttctctcttttcgctctacagaggatggcagtgtggaagacttctcaagcagctcattcagtgaggaacaatcagaagggaaggcaacaccaaatgatgtcactggaggaccggaacattttgttcctgatttgattcaacctggtgcactctctgctgtcaagtccattgctaaatttatgttcctgaatggctatgataaggagtgttgccaggcttatataaactcacggcagaatgcaatagatgagtactttgggtctcttcgtctggacaagctcagtatagaagagcttatgaacacaagttggaacaaactgaatacattaataaggagatggaaccgagcaatgagggtttttatccgtgtctaccttgtaagcgagaagcgccttagcaatcatgtctttggtgaacttacagattcaactgcagacttgtgcttctatgaaatttcatttaactcagtcatgcaacttctgagcttttatgtatctgtagcaattggtgctcctaaaacggaaaagctttttcgtttgcttgatatgtatgaggtcctgaatgatcttctccctgaagctgaatccctgtttgaatcaggatacgatgatatgatcttgaatgaatatcatgaagcactacttcaactgggagaatctgcaagaaagacatttgcagaattcaagtatgccatccaatcatacagttcatcaaatgcagtgcctcgtggagaagtgcatccacttacaaagtatgttatgaactacataagggctctcacagcatacagcaaaactcttgattcacttctcaaggacacagatcgaagacacctgcatcttgcttctgacattcagttgatggcaaacgcgtgtcctagtttcacagcaacagctttgcatctacagtctgttgctgcaattttggaggcaaatcttgaagctgggtccagattgtacagagatgatcggttgcagaacatttttatgatgaacaacatccactacatggtccagaaagtgaagaactcggatctcaaaagttttcttggtgatgactggatccggattcacaacaggaagtttcagcagcaagcgacaggatacgagagggcgtcatggaacaatgtcctctcttacctgagtgatgatggcttgtgtgctgctggtgatgctgcttctcgcaaaaccatcagggagaagataaaaaatttcaacctgtcctttgaagaggtttatcgagttcagacagcatggtctgtcccagacgaccaacttcgtgatgatgtccggatttcaatatccctgaaagttatacaggcctacaggacattcgtcggaagatattcaagcttccttgatggctcaaggcatcgagatcgttatatcaagtatagacctgaggatttggagactcttttgcttgatctttttgaaggaactcaaaagtcactgcagcattcttgccgagtttgaagcttaaagcagtgaagagatacctcagccccctccaccttacttttggttttcttctttggtttgtattagaatggtgcagttgaattattataatgacgtattgttctgcacaacttgcatcggtttgccgtttcttcacggctcctcttgctgcatagaattccttacaacattgcagaagttcagagaatgttaggaatagcaatctattgttcccaaaactttggtacctgagtatgtatagtttctgaatgttttggtactgatacagtaatctagcccaaatgctttctcctaaaaataa

SEQ ID NO: 2886 - DNA, 2157 bp, Panicum virgatum
gcaggggaggtccatagcatgatggctgcagagttagttaagcaatacccaaacatcactctgggagaagacagtgagatatgtgatattaaacatgcgcttaaggcattgagaaagaagatccttactttggattttgacaactccgtgcatgtccatgatccacaggactcatttgagtacttggaagtgctgtacaaaatcagacgactttctgaaaggttaaggggcttggacccttgtggagaagccaaacagctggatgaactcactgtgtatgctaatgacctttctgaaatggcaatggcaaggcttgaagaggaatttgtttatcttcttacacattacaaacagccattagaacaggaagttctctcttttcgctctacagaggatggcagtgtggaagacttctcaagcagctcattcagtgaggaacaatcagaagggaaggcagcaccaaatgatatcattggaggaccggaacattttgttcctgatttgattcaacctggtgcactctctgctgtcaagtccattgctaaatttatgttcctgaatggctatgataaggagtgttgccaggcttatataaactcacggcagaatgcaatagatgagtactttgggtctcttcgtctgaacaagctcagtatagaagagcttatgaacacaagttggtacaaactgaatacattaataaggagatggaaccgagcaatgagggtttttatccgagtctaccttgtaagcgagaagcgccttagcaatcatgtctttggtgaacttacagattcaactgcagactcgtgcttctatgagatttcatttaactcagtcatgcaacatctgagcttttatgtatctgtagcaattggtcctcctaaaacggaaaagctttttcgtttgctcgatatgtatgaggtcctgaatgatcttctccctgaagctgaatccctgtttgaatcaggatatgatgatataatcttgaatgagtatcatgaagtgctacttcaactgggagaatctgcaagaaagacatttgcagaattcaagtatgccatccaatcatacagttcatcaaatgcagtggctcgtggagaagtgcatccacttacaaagtatgttatgaactacataagggctctcacagcatacagcaaacctcttgattcacttctcaaggacacagatcgaagacacctgcatcttgcttctgatattcaggtgatggcaaacacatgtcctaatttcacagcaacagctttgcatctacagtctgttgctgccattttggaggcaaatcttgaagctgggtctagattgtacagagatgatcggttgcagaacatctttatgatgaacaacatccactacatggtccagaaagtgaagaactcggatctcaaaagttttcttggtgatgactggatccggatccacaacaggaagtttcagcagcaagctatgagatatgagagggcgtcatggaacaatgtcctctcttacctgagtgatgatggcttgtgtgctgctggtgatgctgcttctcgcaaaaccatcagggagaagataaaaaatttcaacctgtcctttgaagaggtttatcgagttcagacagcatggtctgtcccagacgaccaacttcgtgatgatgtccggatttcaatatccctgaaagttatacaggcctataggacattcgtgggaagatattcaagcctccttgatggatcaaggcatcgagatcgttacatcaagtatagagccgaggatttggagacacttttgcttgatctttttgaaggaactcaaaagtcactgcagcattcttgccgagtttgaagcttcaacaacctcagcaccctccaccttttggttttcttctttggtttgcattagaatggtacagttgaattattatagtgatgtattgttctgcccaacttgcatcggtttgccgtgtcttcacggctcctcttgctgcatagaattccttgcaacattgcaaaagttcagaggatgttaggaatagcaatctattgttcccaaaactttggtacctgagtatgtatagtttctgaatgttttggtaataatacagtaatctagcatccctgatccgtttaatgactttcctgcactaaacgagatatg

SEQ ID NO: 2887 - DNA, 2740 bp, Sorghum bicolor
ggagtcgactagtcagtcgtccgtacggtcctcaagtgcgaaagctcacccttcactccgtttccgcggaacggtcgcgtttcccgttggaacggaatgccggggcctgtcgtccttgactccttcggcgagagggaggggacggacggacggacagcaacagggacgagcgagggagagccccggcaccacggcatctcgttccaattgcgtccgctgaccatccccatccccatcctcatcctccgcagtccgcagagcccccttccctcccgtcgccgtcgcttccctcgggttgacttgactggtactgttccacacagctccactgaaaacttgaccaccacaccccaataatcgtactccgttctctttctctctctcttttgtactttgcgcctctcttcctcttccgccgcgagcctctcttcctcgctcttgtctcctgggcgtgggcgagttctgaatctaggattgcggcggcggtcccgtgggcgaccgccggagtgggcgaaagaggagcagtagctcttcggtgccggtgggaaggtccataatatgatggctgcagagttagttaagcagttttcaaacattactctgggagaagataatgagatatgtgatgttaaacaagcgcttaaggccttgagaaagaagattcttggtttggattttgacaactccatgcatgtccatgatccacaggactcatttcagtacttggaagtactgagcaaaatcaaacaactgtctgaaaagttaaggacattagaccctggtggagaagccaaacagctggatgaactcactgtgtatgcatatgacctttctgaaatggcaatggcaagactcgaagaggaatttgtttatcttcttacacattacaaacaaccattagaacaggaggttctctcttttcgctctacagaggatggtagtgcggaagacttttcaagcagctcatttagtgaggaacagtcggaagggaaggaaacaccaaatgatatcagtggaggaccagaatattttgtgcctgatttaattcaacctggtgcactctctgctgtcaagtccattgctaaattcatgttcctgaatggctatgataaggagtgttgccaagcttatataaattcacggcagagtgcgatagatgagtactttggttctcttcgtctggaaaagctcagtatagaggagcttgtgaacacaagttggaacaagttgaattcattaataaagagatggaaccgggcaatgagggtttttattcgagtatatcttgcaagtgagaaacgccttagcaaacatatctttggtgaacttacagattcaactgcagacttgtgtttctctgagatttcatttaactcagttatacaacttctgagcttttatgtatctgtagcaattggtccccccaaaacagaaaagctttttcgattgcttgatatgtatgaggtcctggatgatcttctccctgaagctgaatccttgtttgaatcaggatatgatgatatgatcctgaatgagtatcatgaagcactactgcaactgggagaatctgcaaggaagacatttgcagaattcaagtatgccatccaatcatacacttcatccagtgcagtagctcgtggagaagtgcatccacttacaaagtatgttatgaactacataaaggctctcacagcatacagcaaaactcttgattcacttctcaaggacatggatcgaagatgcctggcttctgacattcagttgatggcaaactcatatcctaatttcacggcaacagctttgcatctacagtctgttactgctgttttggaggcaaatcttgaagctgggtctagattgtacagagatgatcgattgcagaacatcttcatgatgaacaacatccactacatggttcagaaagtgaagaactcggatctcaaaagctttcttggtgatgactggatccggattcataacaggaaatttcagcagcaggctatgagatatgagagggcgtcatggaatcatgttctctcttacctcagtgatgatggcttgtgtgctgctggtgatgctgcttctcgcaaaaccatcagggagaagataaagaatttcaatctgtcctttgaagatgtttaccgagttcagacagcatggtctatcccagatgaccaactccgcgatgatgtccggatttcaatatcactgaaagttatacaggcctataggacgttcgagggaagatattcaggctttcttgatggcacaaggcatcgagatcgttatgtaaagtacaggccagaggatttggagacacttttgctagatctttttgaaggaaatcaaaagacactgcagcattcttgtcgagtgtaaagctgaaaccaaatcttgaagaagagatggctcaatccccaccacctgtattttggtttccttctttggtttgcaatggtactcttgaatgtgtatagtgatgtcctgttctgccaaactagcatgattttgccatttcttgtggcctgtcttgctgcatactgtaggattcctttcctcgtgacattgtagaagtacatatgatattagagtagcattgtactgttcacgaaactttggtaatggagtgtatagtttcctaatgttttggtagtgatacagtaattaatttgcctccattaaaatggaggatatgtgttggtctgccagttcagaatcgaatgtctggaaggtctgaaag

SEQ ID NO: 2888 - DNA, 2524 bp, Zea mays
cgcgtttcccgttggaacggaatgccgcagcctgtcgtccttgactccgtcggggagagggacggacggcgacgggcagctacaggacgatcgagcgacagacccggcaccacggcatcccgttccaattgcgtccgctgaccatccccatctccccaccggtgtcctcccctccctcccgtcgccatcgcttccctcggttgacttgacttgtactgttccacacacctccagtgacctgacaaccacaccgcaataatcgtattcagttctttttctcccttttgtactttggggtttgggcctctctttctcttcccctgcgagcctctttcctcgctcttgtctcctgggcgagttctgaatctgggatcggcggtaacgtgggcgaccgccggagtgggcgaagcgcagcagctcttcggtgccggtgggaaggttcataatatgatggccgcagagttagtaaagcagtattcaaacatcactctgggagaagataataagatatgtgatattaaacaagcgcttaaggccttgagaaagaagattcttagtttggattttgacaactccatgcacgtccatgacccacaggactcatttgagtacttggaagtgctgcgcaaaatcaaacaactatctgaaaagttaaggaccttagaccctggtggggaagccaaacaactggatgaactcactgtgtatgcatatgaaatttctgaaatggcaatggcaagacttgaagaggaatttatttatctccttacacatttcaaacaaccattagaacaggaggttctctcttttcgctctacagaggatggtagtgtggaagacttttcaagcagttcatttagtgaggaaccatcggatgggaaggcaacaccgaatgatatcagtggaggaccagaatattttgtgcctgatttaattcaacccggtgcactctctgctgtcaagtccattgctaaattcatgttcctgaatggctatgataaggagtgtttacaggcttatataaactcacggcagactgcaatagatgagtactttgggtctcttcgtctggaaaaactcagtatagaggagcttatgaacacaagctggaataagttgaattcattaataaagagatggaaccgggcaatgcgtggttttattcgagtatatcttgtaagtgagaaacggcttagcaaccatgtctttagtgaacttacagattcaactgctgacttgtgcttctctgagatttcattcaactcagttgtacaacttctgagcttttatgtatctgtagcaattggaccccccaaaacagaaaagctttttcgattgcttgatatgtatgaggtcctggatgatcttctccctgaagttgaatccttgtttgaaccaaagtacggtgatatgatcctgaatgagtatcatgaagcactactgcaactgggagaatctgcaaggaagacatttgcagaattcaagtgtgccatccaatcatacacttcatccaatgcagtagctcgtggagaagtgcatccacttacaaagtatgttatgaactacataaaggctctcactgcatacagcaaacctcttgattcacttctcaaggacacggatcgaagatgcctgacttctgatattcagttgatggcaaatacatatcctaatttcacggcaacagctttgcatctacagtctgttactgcagttttggaggcaaatcttgaagctgggtctagattgtaccgagatgatcgactgcagaacatcttcatgttgaacaacacccactacatggttcagaaagtgaagaactcggatctcaaaagctttcttggtgatgactggatccggattcataacaggaaatttcagcagcaagctatgagatatgagagggcatcatggaataatgttctctcttacctcagtgatgatggcttgtgtgcttctggtgatgctgcttctcgcaaaaccatcagggagaagataaaaaatttcaatctgtcctttgaagaggtttaccgagttcagacagcatggtctgtcccagatgaccaacttcgcgacgacgtccggatttcaatatcactgaaagttatacaggcctataggaccttcgtgggaagatattcaggctttcttgatggctcaaggcatcgagatcgttatgtaaagtacagggcggaggatctggagacacttttgctagacctttttgaaggaactcaaaagacactgcagcattcttgtcgagtgtaagattaaaccagttcttgaagaagagatgcctcagtcttttctgggttccttctttggtttgtaatggactaatggtactgttgaatgagtatagtgatatcctgttctgccaaactagaatgattttgttagagatagcattctactgttcacgaaactttggtaacggagcgtatagttttcgattgtttttttttgtagtgatacagtaattaatttgcctccactaaaatgaaggatatgtgttggtctgccg

SEQ ID NO: 2889 - DNA, 2403 bp, Panicum virgatum
cgtgtagtgctgctctctggatggagattccgggcgccgatgccgatcggtggcggggcaaacatctccggacgatgggggacgggctgggcctgggcggtcagtggcccttgcccgggcggaagccgcaccgtctcgtggcaaacaaaagtcgggaccgtgccacttgcgctcctgtagctgcggtgcctgtagccatgtcatgtccctgacccgtcgccgaccggtgggcatccccccaagcccccacatgccgtgccgactcgtgacactgtactggcctctgcttcctagcctagcttagtagctgcctccacccgcactgaccagttgagtcccgcccgggcgagaagagccgagcctgccgcctcccgccggcccagcgggagcgcctggtgatcaccggcgatggcggtgcgcgactcgctcgaggtggtggacgggcgctgcggctgcgacgacgacgggcggcgcccgcggcgggccggcacggcgtggacgtgcgcggcgcacgtgatcacggcggtgatcggctccggggtgctgtcgctggcctggagcgtcgcgcagctgggctgggtcgtcggccccgcctgcatgctctgcttcgcgctcgtcacctacgcctccgccgcgctgctcgccgactgctaccgccgcggcgaccccgggaagggcctgccgaggaacccgctcctacaccgacgccgtccgcgcctacctcggcaagaagcacacctgggcctgcggctcgctgcagttcgtgagcctgtacggctgcggcgtcgcctataccatcaccaccgccactagcataagggctatcctgaaggccaactgctaccacgagcacgggcacgatgcgccctgcagctacggcggcagctactacatgctcgtcttcggcgccgcgcagctcctcctctccttcataccggacttccacgacatggcgtggctctccgtcgtcgccgccgtcatgtccttctcctacgccttcatcggcctcgggctcggcctcgccaccaccattactaacgggacgatcaaaggaagcataacaggtgttccgatgaggacgcctgtgcagaagatctggcgcgtctcgcaggccataggcgacatcgcgttcgcgtacccgtactccctaatcctcctggaaatacaggacaccctgaagtcgccgccagccgagaacaagacgatgaagagggcgtcgatgatctcgatcctcgtcacgaccttcttctacctctgctgcggctgcttcggctacgccgccttcgggagcgacgcgccgggcaacctcctcaccggcttcggcttctacgagccctactggctcatcgacttcgccaacgcctgcatcatcctccacctgctgggcgggtatcaggtgtacagccagcccatcttccagttggcggacaggttcttcgcggagcggttcccggacagcgggttcgtgaacgacgtccacaccgtgcgggtcccgtgcctgccgccgtggcgggtgaacctgctgcgggtgtgcttccggacgctgtacgtggcgtccacgacggcggtggccgtggccttcccctacttcaacgaggtgctggccctgctgggcgcgctcaacttctggccgctggccatctacttccccgtggaggtgtacatcatccagcggaacgtgccccggtggtccgcccgctgggtcgtcctgcagaccttcagcgtcgtctgcctcctcgtcagcgccttcgcgctcgtcggctccatcgaggggctcgtcacccagaagctggggtaggactcgcctggctagtgtagtgtgtgtgtgcccttcctcgatcgtctgtgttttgcattggattgcttctcttcctgttgtagtgggctagtggcaatggagaacgcagcgagtggggaggatggcgtctctctccctgggatgacgaggagcagcagcataccagtggcaggtcatctgcgttctgcaggacccgggagtgccgggttgcgcagtgttctttgatgccttcctgctgcattagagacttaaagagtgaaacatgtacacagtgtcacattgcatacatgtagtggtattgcccaagacacttcagaagttcagaagaactaatttgaggaaccagtgctggcgtcgatgcctgtggtctccgagtttcatgaaagctgtggacactagtctgttctcattataaattacaagctcccactcaatttgcatctcggttttgcatgatcatttggtcaggcacaagccttgcgcctgaattcaggcgcctcttggagttgtactgcccttggcttccatgatcttgctgattaggataggagaataaaatagcagcttcatctcaatagtgtagtcaaagtgcattccaattattg

SEQ ID NO: 2890 - DNA, 1948 bp, Zea mays
atttttagatcgtgatcatgctgacaaaaaaaacctggcgccgccgaccgccgccgcggcagttgttgcttaggcatagctcctcccgtaccgactgatactgcgccgcagtgctccgacggtccgaccgatcacaacccgcggtccgacggttcgtgtggtggaacgccgcgcgcggagatctctcgtaccgtcgtacgggaatcgcatgcaatggcggtgcaccacgcgctcgaggtgctcgacggccgctgcgacgacgacggccacccgcgcaggactgggactgcgtggacgtgcgcggcgcacatcatcacggcggtgatcggctccggggtgctgtccctggcctggagcgtggcgcagctgggctgggtggtcggcccggcctgcatgttctgcttcgcgctcgtcacctacgtctccgcggcgctgctcgccgactgctaccggcgcggtgaccccggcaacgggccacggaaccgctcctatatggacgccgtccgtgtctacctcggcaagaagcatacctgggcgtgcggctcactgcagtacgtgagcatgtacggctgcggcgtcgcctataccatcaccaccgccactagcataagggcgattctgaaggcgaactgctaccacgagcatggacacggcgcgcactgcgagtacggtggcagctactacatgctcatcttcggcggcgcccagctcctcctctccttcataccggaattccacgacatggcgtggctctccatcgtcgccgcggtcatgtcattctcgtactccttcatcggcattggcctcggcctcgcaacaaccattgctaacgggacgatcaaaggaagcataacaggtgttcggatgaggacgcctatgcagaaggtttggcgcgtctcgcaggccgtcggcgacatcgccttctcgtacccctactccttgatcctcctggaaatacaggacaccctgaagtcaccgccggccgagaacaagacgatgaagagggcatcgattggctcgatcctcgtcacgacgttcttctacctctgctgcggctgcttcggctacgccgccttcgggagcgactcgccgggcaacctcctcaccggcttcggcttctacgagccgtactggctcatcgacttcgccaacgcctgcatcatcctccacctgctgggcgggtaccaggtgtacagccagcccatcttccagttcgcggaccggttcttcgcggagcggttccccgacagcgggttcgtgaacgacttccacaccgtccgggtcgcgtgcctgccggcgtgccgggtgaacctgctgcgcgtgtgcttccgggcgctgtacgtggcgtccacgacggcggtggccgtggcgttcccctacttcaacgaggtgctggcgctgctgggcgcgctcaacttctggccgctggccatctacttccccgtggagatgtacttcgtccagcggaacgtgccccggtggtccacacgctgggtcgtcctgcagaccttcagcgtcgtctgcctgctcgtcagcaccttcgcgctcgtcggctccatcgaggggctaatcacccagaagctaggctaggctaggctattccagatttccagtccagtatgtgttttggattgcttttcttcttgttgtaatgatataatggagaatgcagcagcagtaggctaaagcgaactggagattgtttatctccaacaaggaccaagggccgggatgacgaacagcagcagcatatactagcagtacgtagcaggtcacctgcaggatctgggacagggagtggcagcgttctctatgattttcaagtgcattcctcctttattgccgtggagtggaaacatgtcgcattgatactgccagagttgcctcggagttcagaagaacgcgaggaacctgtgtcactgaatgccgcctatgttgtttcagtttc

SEQ ID NO: 2891 - DNA, 2320 bp, Oryza sativa
gcggtggtctcatcagaagcggatcgctcgatcgatcgccttatacctccacgtctcgccgtccgtctccaaccccaaccccacccactgatcctgcagctagctagcctcttctcccgtcgcgcggcgaaccaggcgcaatggcggtgcaccactccctcgaggtggccgccgcaggaggcgacggcggcggcggccgatgctacgacgacgacggccacccggcacgcaccgggacggtgtggacgtgcgtggcgcacatcatcacggcggtgatcgggtccggggtgctgtcgctggcgtggagcgtggcgaagctggggtgggtggggggaccggcctgcatggcctgcttcgcgctcgtcacctacgtctccgccgcgctgctctccgactgctaccgccgcggcgacgacgacaagggcccccggagccgatcctacatggacgccgtccgcgccttcctcggcaagaagcacacctgggcctgcggcttgctccagtacgcgagcctgtacggctgcggcgtcgcgtataccatcaccaccgccactagcatgagggcgatcctgaggtccaactgctaccacacgcacggccacgacgcgccctgcaaatacgggggtagctactacatgctcatgttcggcgcggcgcagctgttcctctccttcataccggacttccacgacatggcgtggctgtcggtcctcgccgcggtcatgtcgttctcctactcgttcatcggcctcggcctcggcctcgccaacacaattgctaatggaacgatcaaaggaagcataacaggtgctccaacgagaacccctgtgcagaaggtctggcacgtctcgcaggccatcggcgacatcgcattcgcgtacccgtactcattaatcctcttggaaattcaggacacactgaaggctccaccggccgagaacaagacgatgaagaaggcgtccatcatctcgatcgtcgtcaccaccttcttctacctctgctgcggctgcttcggctacgccgccttcgggagcgacgcccctggcaacctcctcaccggcttcggcttctacgagccctactggctcatcgacttcgccaacgcctgcatcatcctccacctgctcggcggctaccaggtgtacagccagccgatataccagttcgcggacaggttcttcgcggagaggtacccggcgagccggttcgtgaacgacttccacacggtgaagctgccgctgctgccgccgtgtcgggtgaacctcctgcgggtgtgcttccggacggtgtacgtggcgagcaccacggcggtggcgctcgccttcccctacttcaacgaggtgctcgcgctgctcggcgccctcaacttctggccgctcgccatctacttccccgtggagatgtacttcatccagcgccatgtcccgcggtggtcgccccggtgggtcgtgctgcagtcgttcagcgtcctctgcctcctcgtcagcgccttcgcgctcgtcggctccatccagggcctcatcagccagaagctaggctaaagatttagcctagcatcctgaatttcggatttgctttttctttgtgtaaccgtaatgggatgagaatgcatttggtggtcgtgtgttgtttgtaacaactggggagcggagctttgtccctggtgaatggcgcgatgaactcatgaacaatagcatagtggtggtggtacattgtgtctgcaggggtcagagggtggtggcactctgtttttcagtgcctttcctcctgtgctgcagagaaactgctcctatatatgtacagaatgtcgtcatattattgccatgatacttggaacggtgaaaggaacctgctcttgaatgatgtataaatcagagagagaaaaaaagactgctcagtactgtgtttatctatcagcttcgtagagctcggtatgcatcgattaattggtttcaggtcgcgttggcattgagcatgcgtaagccatgtatctgcgtggttgattttactgaaatggtgggaaaagaacatgattcagggtgttcttggaactggcagccgctggcctttgtgttcttgatgataaggataggggaataaaatagcatcctcatatcaagagtgtaatcaactaatcatagtgctgcagcccatagaaatacgcattccccttgcttgtaaagatcctactaggataaaactgtgtgcagaaatgaatcgtttatctttgacagttttttttttctttttgagtctatcctcctgaacctaaggctgtaaatttgttcggacaaggatcattactcatagcctgctatgt

SEQ ID NO: 2892 - DNA, 2266 bp, Sorghum bicolor
tacggagagagaggagccaatcacaagcaaggtcgagcactcaaacttgtacaagtacctacaccgtccttttcaaggagacagaaggagaggaaaaaacaaaaacgaagcgctaaacacacgccattttttcctcctcgagtgatctagccagccagacacaccactcgccaggtgtgcttcaaatagtcgcccgcccctgagactgagacggagaggcaggcacacgcaaaactagtccccttcaccccgttcgttcattcctccgatccgcaagaggattaggaatttattaggatcagggtcagggaccgatcggcggagcccgcccgagcgacgacctgctgctcggcccacccgcccggcgaggcgaggcgatcgatcgatatggcgctcggcgagggcagggatcacggcgccgccctgcccctcatcgcggaccaggcgaaacatggcgccggcggcatcgtccgaagcgggagcatgtggacggcggcggcgcacgtgatcacggcggtgatcgggtccggcgtgctgtcgctggcgtggagcatcgcgcagctcgggtgggtggccggccccggcgccatgctcgtcttcgcggccgtcacggcgctgcagtccacgctcttcgccgactgctaccggtcgccggaccccgagcacggcccgcaccgcaaccgcacctacgccaaggccgtcgaccgcaacctaggtagcagcagctcgtgggtgtgcatgctgcttcagcacacggccctgttcggctacggcatcgcctacaccatcacggcctccatcagctgcagggcgattctgaaggcgaactgctaccacaagcatgggcacgacgcgcactgcgactacggtggcagctactacatgctcgtcttcggcgccgcccagctcctcctctccttcataccggacttccacgacatggcgtggctctccgtcgtcgcggcggtcatgtcgttctcgtacgccttcatcggctttggcctcggcctcgcaacaaccattgctaacgggacgatcaaaggaagcataacaggtgttcagatgaggacgcctatgcagaaggtttggcgcgtctcgcaggccatcggcgacattgccttcgcgtacccctactccttgatcctcctggaaatacaggacaccctcaagtcaccaccagccgagaacaagacgatgaagagggcatccatgatctcgatccttgtcaccacattcttctacctttgctgcggctgcttcggctacgccgcctttgggagcgacgcgccgggcaacctcctcaccggcttcggcttctatgagccctactggctcatcgacttcgccaacgcctgcatcatcctccacctgctgggcgggtaccaggtgtacagccagccgatcttccagttcgcggaccggttcttcgcggagcggttcccggacagcgggttcgtgaacgacttccacaccgtccggttggggtgcctgccggcgtgccgggtgaacctgctgcgcgtgtgcttccggacgctgtacgtggcgtccacgacggcggtggccgtggcgttcccctacttcaacgaggtgctggcgctgctgggcgcgctcaacttctggccgctggccatctacttccccgtggagatgtacttcatccagcggaacgtgccccggtggtccgcccgctgggtcgtcctgcagaccttcagcgtcgtctgcctcctcgtcagcgccttcgcgctcgtcggctccatcgaggggctaatcacccagaagctaggctaggctagtccagtccagtagaacatgctatgtgctttgggttgcttttcttgttgttgtaatggtataatggagaatgcagcagcagtaggctaaaagcgaatgcggggatgacgacgaacagcagcagcgtacactagtatagtagcaggtcttcagcaggatcagggaatggcagcgtgatctatttattttcagtgccttcctcctgcattggattgtaacatggaaactgtgttaccatgtatacatgtcgtgttgataccgccgtgttacctcagaagttcagaagacggtttgagggaacctgtgtcactgaatgccgcctatgtctatctagtttcagtttcaatttcagactttcagggactcctctgcatgtctccttgcaatttcctggccctcaatctgcacctcgtaatgtattcagtttttgccaccatgtccactttgatttgagcatgcataagccgtggaccag

SEQ ID NO: 2893 - DNA, 2490 bp, Panicum virgatum
gggcggggaccgcggggccgccgcgcccctcatcgcggacgccgggaagcatgccggcggcatcgtgcgcagcgggagcatgtggacggcggcggcgcacgtgatcacggcggtgatcgggtccggcgtgctgtcgctggcgtggagcatcgcgcagctggggtgggtggccgggccggccgccatgctcgtcttcgccggcgtcacggcgctgcagtccacgctcttcgccgactgctaccggtcgccggaccccgagcacggcccgcaccgcaaccgcacctacgccggcgccgtcgacaggaacctaggtagcagcagctcgtgggtgtgcatgctgctgcagcacacggccctgttcggctacggcatcgcctacaccatcacggcctccatcagctgcagggcgatcctgaaggccaactgctaccacaagcacgggtacaatgcgccctgcagctacgacggcagctactacatgctcgtcttcggcgccgcgcagctcttcctctccttcataccggacttccacgacatggcgtggctctccgtcgtcgccgccgtcatgtccttctcctacgccttcatcggcctcgggctcggcctcgccaccaccattactaacgggacgatcaaaggaagcacaacaggtgttccgatgaggacgcctgtgcagaagatttggcgcgtctcgcaggccatcggcgacatcgcgttcgcatacccgtactccctaatcctcctggaaatacaggacaccctgaagtcaccgccagccgagaacaagacgatgaagagggcgtcgatgatctcgatcctcgtcacgacgttcttctacctctgctgcggctgcttcggctacgccgccttcgggagcgacgcgccgggcaacctcctcaccggcttcggcttctacgagccctactggctcatcgactttgccaacgcctgcatcatcctccacctcctgggcgggtatcaggtgtacagccagcccatcttccagttcgcggacaggttcttcgcggagcggttcccggacagcgggttcgtgaacgacttccacaccgtgcgggtcccgtgcctgccgccgtggcggctgaacctgctccgggtgtgcttccggacgctgtacgtggcgtccacgacggcagtggccgtggccttcccctacttcaacgaggtgctggccctgctgggcgcgctcaacttctggccactggccatctacttccccgtggagatgtacttcatccagaggaacgtggcccgctggtctgcccggtggctcgtcctgcaggccttcagcgtcgtctgcctcctcgtcagcgccttcgcgctcgtcggctccatcgaggggctcgtcacccagaagctgggataggagcactcgtgtgtgcgcccttccttcgtctgtgttttgctttgcattgcttctcttcctgctgtagcggtgatggagaacgcagtgagcagtagcagcagccagcagcagcggcagcataccagtagcaggtcatctgcattctgcaggaccagggagtgccaggttgcgcagtgttctttgatgccttcttgcagcattagagacatgtacacagtgtcgcattgcatccatgtcgtattgcccaggatacttcagaagttcagaagaactaatgtgaggaaccctgtgacggcccagatttttgaataaccaatttaggataattagcaccaaatcatacatcagtaaataggaaaccttgaattaatacatgtgtatgcatgaatgtctctatgtatgtgtgtttatgtgtatttgaactcaagtgagaaaacttaaataacttttaaaatgatgcaagtttgcatctgaaattgaattgacatatcactaacatcatggtaaaccaaagtttagttgatgtcaagggaagaaaataattttttttcacatgaaatgacgagttcttcaaatcacagtttttaaacatttaagttatttttttctaatcgtaacgagcaggttttaaaaatgaattttaaactgttgctcaaatgaatttttgcccaaaaccaatgttataggttttcgaatgacgaacaacttttgtgttcaaatatttttgagttgctacacaaaaatggaagaaaaagttgattttcgaagcgtatacgatattttcaaatgtactcaagtttcaaatttttatcttttaaacaaagcttcaaatgaacttttgcctaaaacgaaggagaaaagctgagtttacgaactggactttggaacttcgagttatttacagctttgccatcacctccatctctctctcctccctctctgtttttcactgtgacaacgccgttcgtcgccggcgaacgtcggggacggcgtcccgtccactggtcggccacgcaccgtgccccggttcctccccgaagcttctcgacatcaccacgcggcaccatctcccggtgcgcacgccgaggacggctgcccgaagcgcc

SEQ ID NO: 2894 - DNA, 2049 bp, Pennisetum glaucum
gcttggagcagcttcctagtcccatgcgaaagctgtgatcgttctgtgcactgctgaagaggatgatggtggaatggttgctactttgagcagctggcctcttacccactctaccctggcaagtagagtcagggtgtgtgaataatcatggatagaagagctggggcaatcctagtgtgcctgctcttcgtcctaatccaggacgtgtcggccgtcgccgagactgaggttggcaatgtgcgtttagtacaggaggcgcccgttaggaagctggagggcacagggaggcaggatggtggtaaggtggggagggtgtcggtctcgacagttgcatggtctacactcatcatggctgcggcaactgggttgggagcagtgcccttcttcttcatggagctggaagctcagtgggcaggcctttgcaatgggctagcagctggggtgatgctcgctgcaagctttgacctcgtgcaggaagggcaggtgtatggcagtgggagctgggttgttttcggaattctgagcggaggaatattcatctggctttgcaagaagtttcttgaacaatatggagaagtaagcatgttggatataaaaggtgcagatgcaagtaaagttatccttgttgtcggaataatgactctccattcttttggggaaggctctggtgtgggtgtttcctttgctggctcaaaaggattttctcagggtcttctagttactatagctatagcagtgcacaacataccggaaggcttagctgtaagcatggtactgtcatctaggggtgtgaccccccaaaaggcaatgatatggagtatcataacatctctaccacagcctattgttgctgttcctgctttcctttgtgccgatgcattccagaaggtgctccccttctgtactggttttgctgcaggatgcatgatatggattgttatagcagaggttcttcctgatgcttttaaggaagcaactccgtcacaagttgcttctgctggaacacttgctgttgctttcatggaaacattaagtactgtgcttctgggatttactgatggcaacaactcagaagatgcatcaggtttcttggtatcacttgtatttggactcggtccacttgttggaggaattatactagtcacattctctcttgccttcagcatgccacaccctctacttactggtgtggcatctggcattgctttccgtcttgcagcatggagacccgtacagcttttaatgtcctcaaaaatgggtctctttaccaccctatttctcctcattgttggtttccttgtctgccatgctgccacatcaagcatccttagggttgttaatcgcaaaagatcttctgttaacatcattacatcatcccctggtttctctcttagtgtcctcacactgcaatctctccttgcctgtggttctatattccttcatgcatacacagaaggacttgtacttggtgtcgcggcacgcaaggcttatggccttggtcgttacatggttctcccagcctccctacatggtctgccacgaggcgctgctgtcgcgagctgtgtctatggtgccacagatagctggcgtggagccctggcagctgctgctctaactgggctggcaggacctagcgcggccatcagtgcgatccttgcgaggatcgactacgatggattagactactggatggtgatagcatgtggggctctgatccccagctttggccgtgttttcaggcggtcattgcgattggacatgcggaagagcattgtggggttgctgataggtgtcgccttcgcctccgtgtgcttgatgtcgactagattcatttgcttgcacaccccttactgcaactcagctccagaagcagtcacatgagttgtgtacttgtgttgtacactgtaaaacacctgtaataccagtgtgatgacttttgactatacaaagaaaggaaggttatattagtattgcaccttaatgcggaggccttgtatagttaatgtgcggtgaaatctgtagaattgttttccaataataaagctggaa

SEQ ID NO: 2895 - DNA, 2301 bp, Setaria italica
ccgcctccccccggggtcgccggtttccattaccccccaaatccgcgtgcgccgccgccctgaatccgcctcgccggcagtattctcgtcgcctggccgcgcctccgagcctccaattcttccatccgcgcctggcgccctcgtcatcgcttctgctggcgcgggagggggtcgatccctccctcctcctgttgctgggttggagcatcttcccagttccacgcgaaagctgtgatcattatgttgtgctgctgaacaagacaatgaggatgttgtaacagccccttgcttctttgagcagcaggcctcctgcccacgctaccctgacaagcaaagtcagggggtgtggaaataaccaggtgcgctgaataaccatggacagaagagccggagcaatcctattgtgcctgctcttcgtcctagtagtccgggacgtgtcggccgtcgccgagaccgaggccggcaatgtgcgtttagtgcaggaggcgccccatagggagctggagggcacagggaggcaggatggtgctaaggtggggagggtgtcagtgtcgacggttgcatggtctacgctcgtcatggctgcggcgactgggttgggagcagtgcccttcttcttcatggagctggaagctcagtgggcgggcatttgcaatgggctagcggccggggtgatgctggctgcaagctttgacctcgtgcaggaagggcaggtctatggcagtgggagctgggttgttttcggaattttgagcggaggaatatttatttggctttgcaagaagtttcttgagcaatatggagaagtaagcatgctggatataaaaggtgccgatgcaagtaaagttatccttgttgtgggaataatgactctccattcttttggggaaggctctggtgtcggtgtttcctttgctggctcaaaaggattttctcagggtcttctagttactatagctatagcagtgcacaacataccagaaggcttggctgtaagcatggtactgtcatctaggggtgtctccccccaaaaggcaatgatatggagtataataacatctttaccacagccaattgttgctgttccttctttcctttgtgccgacgcattccagaaggtgctccccttttgtactggttttgctgcaggatgcatgatatggattgttatagcagaggttcttcctgatgcttttaaggaagcgactccatcacaagttgcttctgctggaacacttgctgttgctttcatggaaacattaagtactgtgcttctgggatttactgatggcaacaactcagaggatgcatcgggtttcttggtatcacttgtatttggactcggtccacttatcggaggaattatacttgtcacattctctcttgccttcagcatgccacacccgctgcttactggtgtggcatctggcattgctttccgtcttgcggcatggagacctgtacagcttctaatgtcctcaaaaatgggtctctttaccaccctctttctcatcattggtggttcccttgtctaccatgctgccacatcaagcatccttagggtggttaatcgcaaaagatcctccgttaacgtcattacatcatcctccggcttctctcttagtgtccttacactgcaatcgctccttgcctgcggtgctgtattcctccatgcatatgccgaaggacttgtacttggtgtcgcggctcgcaaggcttatggccttggccgttacatggttcttccagcctccctccatggcctgccacgaggtgctgctgtggccagctgtgtgtatggcgccacagatagctggcgcggagccctggcagccgctgctctgaccgggtttgcagggcctagcgccgccatcagcgcgatccttgcgaggatcgactacgatggactcgactactggatggtgatagcatgcggggctctgatccccagctttggccgcgttttcaggcggtctttgcggttggacatgcggaagagcatcgcggggttgctgataggtatcggcttcgcctccgtgtgcttgatgtcaactagattcatttgcttgcacactccttactgcaactcagctcccgaagctgtcacatagagacttgtggtgtacgatgctgttgcaacttgtttaacacatgtaataccagtgtaatggactatgactgtaatacaaagaatggaagaggttatatgttgcagtgaggagcctcttgtatgagtaacgtgcggtgaaatctcaagtccaaggctgtaaaagtttttccaacaccaaggccaataccaag

SEQ ID NO: 2896 - DNA, 2773 bp, Panicum virgatum
cttccagctcgatcgatctcaaggggcccggccgcgcatctggtcctcctcggagccccctcccctgccgacgagtcccgtgaccgcccccggggtcgccgctggaaccggatccggtgcagttacctctctgtagttgggtcactgccacgtgagccccacgcgtgcagaccccacgcgcagtgactcaactgcacgacggccaactgcagcggagcctcgtccgtcgcggcgacccccgaatccgcgtgcgccgccggccggctccaacccccgcctaaatccgccccgccccccaagggaaagggactctccaattcttccatcggcgtcctcgtcgtcccttgtgcccgcgccggaggcgcagatccatcccgacccgggggttgattcctccactcctcctcttcctcctcctcctgctgctgctgcagggttggactttggagcatcttcccagttccacgcgaaagctgtgagggattggatccttctgttgcgctgctgctcaataagatagcaacaatgcggatgtcggaacagttgcttctttgagcagcaggcctcctgcccacgctaccctggaagtcaagtcagggtgtgtgtgggaaataaccggacgccgtgaataaccatggacagaagagccggggcaatcctggtgtgcctgctcttcgtcctagtccgggacgcgtcggccgtcgccgagaccgaggccggcaatgcgcggttagtgcaggaggcgccgcacaggaagctggatggcacgggtaaggtggggagggtgtccgtgtccacggtcgcatggtctacgctcctcatggctgcggcgactgggctgggagcagtgcccttctttttcatggagctcgaagctcagtgggcgggcctctgcaatggtatggcggccggggtcatgctggctgcaagctttgacctcgtgcaggaagggcaggtgtatggcagtgggagctgggttgttttcggaattttgagtggaggactatttatttggctctgcaagaagtttcttgagcaatatggagaagtaagcatgctggatattaaaggtgcagatgcaagtaaagttatccttgttgttggaataatgactctccattcttttggggaaggctctggtgtgggggtttcctttgctggctccaaaggattttctcagggtcttctagttactatagctatagcagtgcacaatataccagaaggcttggctgtaagcatggtactgtcatccaggggtgtgtccccccaaaaggcaatgatatggagtatcataacgtctttaccacagccaattgttgctgttcctgctttcctttgtgctgatgcgttccagaaggtgctccccttttgtactggttttgctgcgggatgcatgatatggattgttatagcagaggttcttcctgatgcttttaaggaagcgactccatcgcaagttgcttctgctggaacgcttgctgttgctttcatggaaacattaagtactatgcttctgggatttactgatggcaacaacccggaggatgcatcaggcttcttggtatcacttgtatttggacttggtccacttatcggaggaattatacttgtcacattctctcttgccttcagcatgccacaccctctacttactggtgtggcatcaggcattgctttccgtcttgcagcatggagacctgtacagcttctcatgtcctcaaaaatgggtctctttaccacactctttctcctcattggtggttcccttgtctaccatgttgccacatcaagcatccttagggtggttaatcgcaagaaatcctccattaatgtcattacatcatcctccggcttctctcttagtgtcctcacactgcaatcactcctttcttgtggtgctgtgttccttcatgcatatgcggaaggacttgtacttggtgtcgcggctcgcaaggcttatggccttggccgttatatggttctaccagcctccctccatggtctgccacgaggtgtggctgttgctagctgtgtatatggtgccacagatagctggcgcggagccctggcggcggctgttctgactgggtttgcaggacctagcgccgccatcagcgcgatccttgcgaggattgactacgatggactcgattactggatggtgattgcatgtggggctctgatccccagctttggccgtgttttcaggcggtccttgcggttggacatgcggaagagcatcgcgggtttgctgataggcatcgcctttgcatctgtgtgcttgatgtcgaataggttcatttgcctgcacactccttactgcaactcagctccagaagcggtcacataacttgtgctgtacggggctgctgtgtaaaacacatgtaacaccagtgtaatgacttgcgactatacaaggaatggaagaggttaggtatattgcagtgaggagtggaggcatcttgtatgattgatttgcggtgaaaccaaggctgtaaaagtttttccaaccgggtggaaatattaaagctggaacaacattgattttgtgcgccggagttgagaagaagtttttcttggtttgtggccggtgttggtgagtgctgacttgtgttgggttggaggcagcgacccagcaacaaagagtcgctgtattggagtgtggcatacgacctggaaatgcagctaatggagattgaggaatgttccagcggacggcgacctacctgacatgtttttgtgtcctccctagtcttggactcttgggcac

SEQ ID NO: 2897 - DNA, 3481 bp, Panicum virgatum
aattttgttaattatataaatacagaaagatcatgtaccgaccgtcaccattttccatactgtactgtgatacggattccgacttccgaccgttttcatccagttgtacgtgtcgccgtccatccgcagcgtacggtttggttcgttgcggtccgcatagccccaacgccacgccacgatagatttccagctcgatctctaggggcccggcccaccgaaccgcgtcccgcgggaaccggaggccgcacggcacgtgcgcggcgcatctgctgctggtcctcctcccgagtgccccctcgccccccggggtcgccggtttcccaaatccgcgtgcgccgccggccggccggccccatcccccgcctaaatccgccccccgaggggaagggactctcgtcgcctggtcacgcctccgaagcctcccattcttccatcggcgccctcgtcgtcccttgtgcccgcgcgggaggcgcagatccatcccgacccggccggggggtcgattcctcccctcctcctcctcctcctgctgctgctgctggtaagggccccctggcttggctttcttcgatgagaggaacgagattatatataaccagcagttagatccaaatctttctgcttcattcagtctgtctgttgcgtattcgtgtcctttgctgcgtgttgggggcagcaatgccaacttttatgtccatccactatgataaactgctgggatggggtctcaactgaatgtctgaatccctgtgcttgcttgcgccgctcaattcgtgccgccttctctttgcggcagggttggatcatcttcccagtcccacgcgaaagctgtgatcattccgttgcgccgttcaacaagataacgacgacatgttggagtagttgcttctctgagccgcaggcctcccgcccacgctaccctggcaagtgaagtcagggggtgtggggaataacccggcgcgctgaataaccatggacacaagagctggggcaatcctagtgtgcctgctcttcgtcctggtccgggacgtgtcggctgtcgccgagaccgagcccggcaatgcgcggttagtgcaggaggcgccccacaggaagctggatggcgcggggaggcaggatggcggtagggtggggagggtgtccgtgtcaacggtcgcatggtctacgctcgtcatggccgcggcaactgggctgggagcggtgcccttctttttcatggagctggaagctcagtgggcgggcctctgcaatgggatggcggctggggtgatgctggctgcaagctttgaccttgtgcaggaagggcaggtgtatggcagtgggagctgggttgtttttggaattttgagtggaggagtatttatttggctctgcaagaagttgcttgagcaatatggagaagtaagcatgctggatattaaaggtgcagatgcaagtaaagttatccttgttgttggaataatgactctccattcttttggggaaggctctggtgtgggggtatcctttgctggctccaaaggattttctcagggtcttctagttactatagctatagcagtgcacaacataccagaaggcttggctgtaagcatggtactgtcatctaggggtgtgtccccccaaaaggcaatgatatggagtatcataacatctttaccacagccaattgttgctgttcctgctttcctttgtgccgatgcgttccagaaggtgctccccttttgtactggttttgctgcgggatgcatgatatggattgttatagcagaggttcttcctgatgcttttaaggaagcgactccatcacaagttgcttctgctggaacacttgctgttgctttcatggaaacattaagtactgtgcttctgggatttactgatggcaacaacctggaggatgcatcaggtttcttggtatcacttgtatttggactgggtccacttatcggaggaattatacttgtcacattctctcttgccttcagcatgccacaccctctacttactggtgtggcatcaggcattgctttccgtcttgcagcatggagacctgtacagcttctcatgtcctcaaaaatgggtctctttaccacactctttctcctcattggtggttcccttgtctaccatgttgccacatcaagcatccttagggtggttaatcgcaagaaatcctccgtcaatgtcattacatcatcctccggcttctctcttagtgtcctcacagtgcaatcactcctttcatgcggtgccgtattcattcatgcatacacggaaggacttgtacttggtgtcgcggctcgcaaggcttatggccttggccgttatatggttcttccagcctccctccatggtctgccacgaggtgcggctgtcgcaagctgtgtttttggtgccacagatagctggcgcggtgccctggcagcggctgttctgaccggggttgcaggacctagtgccgccatcagcgcgatccttgcgaggatcgactacgatgggctcgaccactggatggtgatcgcgtgtggggctctgatccccagctttggccgtgttttcaggcggtccttgcggttggacatgcggaagagcatcgtgggtttgctgattggcatcgcctttgcctccgtgtgcttgatgtcgaataggttcatttgcttgcacactccttactgcaactcagctccagaagcggtcacataaccggtgttgtacgggggctgctgtgtaaaacacatgtaacaccagtgtaatgacttctgactatacaaggaatggaagaggctagttatattgcagtgaggagcggaggcatcttgtatgattgatttgcggtgaaaccaaggctgtaaaagtttttccaacctggtggaaatattaaagctggaacaacattgattttgtgagccggagttgaaaacaagtctcttcgtttaaggctggtgttggtagagtgctgacttgctgttgggagcagctagcgacccagcaacaaagagttttgtgcgtcggagtgtggcatacgacctgctggaaatgtagtagtggtggagattgaagaatgttccagtggaccgcgacctgacatggtgtttttccgtctagtcttgggcacaaccattatattttttttagaaaaaagattaccaatccggcctctacttccatggacgtacacagccaaacacaatcagagctttgacgtcaaggcaacttgttgctttgttctgctcctactggatgcatgtgaacacagtacaattattaagccacttggttctatacatgtatatgatgtctcgtaatcgcacgccgatgtgcagtagcaatcagaggtgctacggtagtaaacagtgtaacaaagaagctgtttctttaatttgtaggtgtgttaggttgagattgtatttgtatagatagaaagttagagtgcaggaacactctgcatcgatcattctgctttggtgcgtgttagctt

SEQ ID NO: 2898 - DNA, 2486 bp, Sorghum bicolor
agtctatggccaggccaggcacgtaaagccactcttgcccaggaaacaaaaaggtccatgtccatggatcggaaacgcggatggcgcacaccgccatcgagcgcaccgggcacggcacgggcgaacccgactgtcgacgcgtcgcccgcccgttgccgcatcatcgcggtcgcccgactcgagggctccacctccactccgctccgctcccaaacggtgaagtgagccggggcccgtgcgtgcctgccgtcccgtgaagccgtgctcgtgaccgcccgcttcttctccctctcgccatcccttctgctagcgccgcggcggaggcgcagatccatcgggggaactcgattccgccaccgccccccctttcctaggctgggattggattggagcgtagcctcttcccagcaccacgcgaaagccatgaccattaagttgctccgctgacgactcctcggacgacagcacggctgctctgaccctctcgcccacgctgctgccctgacaggtaaaagtcaggggtcaataatcatggacagaagatccggggcgatcctagcgtgcctgctcgtcgtcgtcgtcctggtccgggacgcggcggcggtcgccgagactgagcctggcagtgtccggctagtgcaggaggcgccccataggaaggtggtggaggatgggtccgccaaggcggggagggtgccggtgtcgaccgtcgcgtggtcgacgctcgccatggccgcggcgacggggctgggagctgtgcccttctttttcatggagctcgaagcgcagtgggcggggctctgcaatgggatggcggctggggtgatgctggcggccagctttgatcttgtgcaggaagggcaggtgtatggcagtgggagctgggttgtgtttggaatactcggtggaggtatatttatttggctttgtaagaagtttcttgagcaatacggagaagtaagcatgctggatataaaaggtgcagatgcaagtaaagttattcttgttgttggaataatgactcttcattcttttggagaaggctctggtgtgggtgtttcctttgctggctcaaaagggatctctcagggccttctagttactatagctatagcagtgcacaacataccagaaggcttagcagtaagcatggttcttgcatctaggggggtgtccccccaaaaggcaatgatatggagtatcattacatctttaccacagccaattgttgctgttcctgcattcctttgtgctgatgcattccagaaggtgcttcccttctgtactggtttcgcagcaggatgcatgatatggattgttatagctgaggttcttcctgatgcttttaaggaagcaactccatctcaagttgcttctgctggaacacttgctgttgctttcatggaaacattaagtacggtgcttctgggatttacagatggcaacaactcggaagatgcatcaggcttcttagtatcacttgtgtttggacttggtccactgatcggtggaattatactagtcacattctctcttggcttcagcatgccacaccctcttcttactggtgttgcatctggtattgctttccgtcttgcggcatggagacctgtgcagcttctaatgtcctcaaaaatgggtctctttaccaccctcttcctcctcattggaggttccctggtctatcatgctgctacatcaagcatccttagagtgtttaatcgcaaaagatcttccgcaaatgtgatcacgtcatcctctggcctctctcttagtgtcctcacaatacaatcactccttgcttgtggtgctgtattccttcacgcatatgcagaagggcttgcacttggtgtagcggctcgcaaggcttatggccttggccgttacatggttctcccagcctccctccatggtcttccgcggggtgctgctgctgcaagctgtgtgtatggtgctacagatagctggcgtggagcccttgcagctgctgctttgacagggtttgcagcaccaagcgctgccatcagcgcaatccttgcaaagattgactatgatggacttgactactggatggtaatagcatgtggggcactaatccccagctttggccgtgtcttcaggcgctcactgcggttggacatgcggaagagcattgttggcctgctgataggtattgcatttgcctccgtgtgcttgatgtcgactagattcatctgtttgcacactccttactgtaactcggctccagaagcagtcacataactcatgctggcctgtgctgttgtaaaacacatgtaatactagtgtaatgacaatacaaaggatgtggaaggttatatatattgcatcgaagagatctcttacatcggtaaatcaaagggaaacgtacattgaacagaatgtgcctttttctcgctgccacttttgtctgtcatggaaggtccatgtgaattattcccaatgtcgtatgcattatttcatctaca

SEQ ID NO: 2899 - DNA, 2443 bp, Zea mays
gtttccatcccaaggtgtacggcagattccccgcgcaccgcgcacgccacggccgaacccgactggcgacgcgtcgcccgttgttcggtggagtgagccggggcccgtgcttgccgtcccgtgaggcccctgcccctgcccgtgaccgccccgcaccccccacagccgggggtcgccggtttccgcgactccaaatccgcgtgcgccgcccgccctctaaatctgcctcgccggcagccgggcgggggccaccacgtcacacccagcctctcctctccgcccgcggcccgcccgcttcttcttcctcgccatcccttcttctagcgcggaggcgcagatccatcgggcttcgggggctcggttccatccctctgccagctgggattggattggagcatcttcccagcaccacccacgcggaagccatgaccattcagttgctccgctgacgactcctctgacgacagcacggctgcgctgacctgcaggcctctcgcccacgctgccctgacagggtaaagtcagggggtggcgtgtgtgggtgggggggggggacaatcaggtgaataatcatggacagaagagctggggcgatcctagtgttcctgctcgtcgtcctggtctgggatgtggcggcggtcgccgagaccgagcctggcagcgtgcggctagtacaggaggcgccacataggaaggtggtggaggatggggccaaggcggggagggtgccggtgtcgaccgtcgcgtggtccacgcttgccatggccgcggcgacggggttgggagcggtgcccttctttttcatggagctcgaagcgcagtgggctggcctttgcaatgggctggcggccggggtgatgctggccgccagctttgaccttgtgcaggaagggcaggtgtatggcagtgggagctgggttgtgttcggaattctgagtggaggtatatttatttggctttgtaagaagtttcttgagcaatatggagaagtaagcatgttagatataaaaggggcagatgcaagtaaagttattcttgttgttggaataatgactcttcattcttttggagaaggctctggtgtgggtgtttcctttgctggctcaaaagggttctctcagggtcttctagttactatagctatagcagtgcacaacataccagaaggcttagcagtaagcatggttctcgcgtctagaggggtgtccccccaaaaggcaatgatgtggagtatcattacatctttaccacagccaattgttgctgttcctgcattcctctgtgccgatgcattccagaaggtgcttcccttttgtactggtttcgcagcagggtgcatgatatggattgttatagcggaggttcttcctgacgcttttaaggaagcaactccatctcaagtagcttctgctggaacactcgctgttgctttcatggaaacattaagtacggtgcttctgggatttacagatggcaacaatgtggaagacgcatcaggcttcttagtatcacttgtgtttggactcggtccacttatcggtggaattatactcgtcacattctctcttgggttcagcatgccgcaccctcttctcaccggtgtcgcatccggcatagctttccgtctcgcggcatggagacctgtgcagctcctaatgacctcaaaaatgggtctcttcaccaccctcttcctcctcatcggaggttccctggcctaccacgccgccacatcaagcatcctccggttgttcaatcgcaaaaggtcttccgtgaacgtgatcgcgtcatcctccggcctctctctcagtgccctcacagtgcagtcccttcttgcctgtggcgccgtattccttcacgcatatgctgaagggcttgcgctcggtgtcgcggctcgcaaggcctatggcctcggccgctacatggttctcccagcctccctccacggtcttccacgtggcgctgccgcggcgagctgcgtgtatggtgccacagatagctggcgtggagcccttgccgctgccgctttgacagggctcgcagcgccgagcgccgccatcagtgcaatccttgcgaagatcgactatgatgggcttgactactggatggtcatagcgtgcggggctctgatccccagctttggccgcgtcttcaggcgctcactgcggttggacgtgcggaagagcgtcgttggcctgctggtaggtgttgccttcgcctccgtgtgcttgatgtcgactagattcatctgtctgcacactccttactgtaactcggctccagaagccgtcacataactttgttgctgccccgtgctgttgtaaaacacatgtaatactagtgtaatggcgatacaaaaggaggatgtggaagggttacgttgcgtcgaagagatctcttacggcgatacaacaaagggaaatggatgttgaacagaatttgcctt

SEQ ID NO: 2900 - DNA, 3141 bp, Oryza sativa
ccctggaccaaatcaacatctctaccagtatcgttctctcgtctgttccaggcgtgaagacacagatcgaggagaggaagaacagatggcgacgacgccggcgcccggctggcgcgccgccgcatccactagctagcgcgccgccgtcttcccccacgtcggccgccgctcttcttccccacctcgccggcgcagcttctcccaccgcgccgcctctcctctccaccacccagtgaactccgccgccatggaaggctctctctctcatccttccaatcgatctcctcgacctgctatgctcatcccgtcgaaaagttcgattcttttgctccgatcgtttcgctgtagatttggttttgttttatttgtgttttgcttttcttttggtctctcttttttgttggatcgatcttgtctccgacgatgtaaatttatactttcgttcttctgaagttggcaatgtggaagaactatatggagacctgaactgggggttcccatcgatcaaatcttatcattttttttggtttttttagttgagatttggtcaggggcaaaacggtccgagaaaaagttatttttatggaaaatgtaagcgagcgaaaccagcttttaacagtggcacatatacaattctcccctccgcccgtgacggtttcggcgacaaaacgaaacccgcccccacccccacacccaaaatccgtgtgcgccgccccgcacggccgcgccccccgtcctcgcccccgtcgccgcctatatcaccgacgaccctgctttgctttcctcctcctcctccttctcagcgcgagttagatctccacaggagagaatcccaatcgggcccctcctccgcccctctccctctcccccctcaccgtcggcctgccggcgacggtatatcgaatcgagtgctggagcagctctccatgcaggaatcgtgaactgctggtctgttttgctggaccgagacgattgctttgcttcatgattcttgccgatgctgaccgtgttgcattgattggaccggggcatgggaatctctgaatctgaatgagtgccttccattagagtgaacatggactcaagagttggagtggtcctattcttcctgctctttgtccttgtccgcgatgtctcagcggtcgctgagacagaggttggcgttgtgcgcgtcgtgcaggaagcgcctgataggaagcttgagggcgcaggcgggcaggatgggttcaagagcgggaaggtgccggtgtctacggtcgcgtggtcgacgcttgcaatggccgctgccaccggtttgggtgctctgccattctttttcctggagctagaggcccagtgggcgggactttgcaatggactcgcggcaggggtgatgttagcggcgagctttgatcttgtgcaggaagggcaaatgtatggcagtgggagctgggttgtgtttgggattttgagcggagggtttttcatctggctttgcaagaagtttcttgagcaatatggagaagtaagcatgctcgatataaaaggtgcagatgcaagtaaagttattcttgttgtcggaataatgacactccattcttttggggagggctctggtgtgggtgtttcctttgctggctcaaaaggattctctcaaggtcttttagttactatagccattgctgtacacaacatacctgaaggcttagctgtaagcatgttgctatcatccaggggtgtatccccacaaaaggcaatgatatggagtatcataacatctttaccacagccaattgttgctgtccctgcattcctttgtgccgatgcatttcaaaaggtgcttcccttttgtactggttttgctgctggatgcatgatatggattgtaattgctgaggttcttcctgatgcttttaaggaagctgctccatctcaagttgcttctgccggaacgcttgctgttgctttcatggaaacattgggtacagtgcttcagggatttactgatggccacaactcagaagatacagcaggctttttggtatcacttgtatttggactaggtcctctttttggaggaattgtacttgttgcattctctcttactttcagcatgccacaccctcttttgactggtgtagcatcaggcatagccttccgtctcgcagcatggagacctttacaacttctaatgtcatcgaagatgggtctatttaccaccttattcctcctaattggaggttctctcatttaccatgtcgccacatcaaacatccttcagctagttaaccgcaagaaatcttctgttaatgtaattacatcatcctcaggcctctcacttagtgtcctcacactgcaatcgctccttgcttgcggttctgtcttccttcacgcatatgctgaaggtcttcaacttggtgtggctgcgcgcaaggcttatggtctagggcgctacatggttcttccagtttcccttcatggtctaccacgaggtgctgctgttgcgagctgcatatatggtgccactgatagttggcgggcagccttggcagccgctgctttgaccggctttgcagggccaagcgctgccatcagtgcaatcctcgcgaagattgactacagtggactagactactggatggtcattgcctgtggtgctttgattccaagctttggccgagtcttcaaacgctcgctaaggttggacatgcggaagagcatctgtgggcttttgataggtttcgcctttgcctctgtatgcctgatgtcgaccagattcatttgcttgcacactccctactgcaactcagctccagaagcagtcacataacctttcttttctttgctggtacagttgtagaacatgtaatatcagtgtaatgatgatacaggaatggaaaaattattaccgttcaggttgaggaattcccttgtatgaacaaatcaaagggaaataggcatggaatatataccggtttaatttttgtcttttcacctgttcgtcctgaaaccgtggattgttgccaaccttgaaagaaaaaaaaggtggtgtgcaagttctggtttactcaactttttatggtgccaggtggtactatactggattactggcaaagttattgtaagatctgctttattgattgatggatatctactttaggg

SEQ ID NO: 2901 - DNA, 2050 bp, Brachypodium distachyon
gttgggagcttctgcagttgcgtgcaggcatcgtgaatatttttttgctggactgggccgggtgttgagatgatttgttcgtgaatttggcactcccgccagtgccctgattaagcccggggctcaggaacgtgccgaccatctaaagtacgagtaaccatgggaagacgtgccggagtggttttagttttcctgctcttcatcctcattggggaagtgtcggccgttgctgagaccgagattggtgatgtgcgcttagcacgagaggcaccgcatgggaagctagaggctgctgctaggaaggatggattgaagagtggcagggtgtcagtgtctactattgcatggtctacgcttgcgatggccgcggcaaccgggttgggagcattgccattctttttcctggagctagaagcccaatgggcgggcctttgcaatgggctggcagccggggtgatgatggctgcaagcttcgatcttgtgcaggaagggcagatgtatggcagtgggagctgggttgttttcgggattttgagtggagggatctttatttggctttgcaagaagcttcttgagcaatatggagaagtaagcatgctggatataaaaggtgcagatgcaagtaaagttattcttgttgttggaataatgacacttcattcttttggtgagggctctggtgtgggtgtttcctttgctggctcaaaaggattctctcaaggtctcctagttactatagctatagcagtgcacaacatacctgagggcctagctgtaagcatggtactgtcatctaggggtgtgtcaccccagaaggcaatgctatggagtatcataacatctttaccacagccaattgttgctgttcctgcattcctttgtgctgatgcatttcaaaaggtgcttcccttctgtactggttttgctgcggggtgcatgatatggattgttattgcagaggttcttcctgatgcttttaaggaagccactccatctcaagttgcctccgccggaacgcttgctgttgcttttatggaaacattaggtactgtgcttcagggattcactgatggccaaggatacatcaggctttttggtatcacttgtatttggacttggtccactttttggaggaattatacttgttgcattctcgcttgccttcagcatgccgcaccctcttcttactggtgtagcatctggcatagccttccgtcttgctgcatggaggccattacaactaataatatcaacaaagatgggtatattcaccactttaatcctcctgataggaggttccatcttctaccatgtcgccacagcaagcatccttagggttgttaaccgcaagagatcctctgttaatgtcattacatcgtcctctggactctctgttagtgtcctgacactacagtcgctccttgcgtgtggctccgtcatccttcatgcctatgccgaagggcttgcactcggtgtcgcagcacgcaaggcatatggtctaggccgttacatggttcttccagtctccttgcacggtctaccacgtggtgctgctgtcgcgagctgtgtatacggcaccactgatagctggcgtggagccttggcagctgcagctctgactgggctcgcaggaccaagcgccgccatcagtgcgatccttgcgaagatggactacgatggactggactactggatggtaattgcatgcggagctttgatcccaggttttggtcgtgtcttgagacgatcaatgcggctagacatgcggaagagtgtatgtgggctcctgataggttttggttttgcatctgtatgtttgatgtcaaccagattcatctgcttgcacactccttactgcaactcagctccagaagctgtcacatgattcttatgctgctgttgaagtaacaaatgtaacatcaatgtaatgacatggcaatacagatcagatgtaagattattgccttgaggctgagggatctccttgcatgaacaaagtcaaaggacaaccggcattatacagaaaaaacccctgcaatagtcttataaa

SEQ ID NO: 2902 - DNA, 2384 bp, Hordeum vulgare
ggtcgaggtgctcttagacccgtgtgcgccgaaacctgccaggcttccctatatcccctcttccctctccgctcttgggatccatcttccattagatcccaccgattccacgctccactgatcctgctgctccggcggcccgccgcaactgattgaacactccaattcgggcccctccattcggtcgaattgggaggttctttggaagcgcatccacccacgaatcgaggattggagccttcttgcagttgcatccaggaatcgtgaataatttgttgccagactgaggcgggtgttgagataactacttgatggatttgttattatgaccaatgccctgattccgcccggggcttatgagcttgctgaatatctgaagcacaagtaaccatggatagaaaagccggagtggttttagtctgcctgctcttcctactcattggggaagtttcggcggttgcccagaccgagattggtcatgtgcgtgtaacacgggaggcaccagatgtgaagctagaggatgctggtagacaggatgcgtccaaaggtggaagggtgtcggtgtatgttgttgcatggtctacgcttgccatggctgcggcaacagggttgggagcagtccccttctttttcctggagctagaggccgaatgggcaggcctttgcaatggattggcagccggggtgatgttggcagcgagtttcgatcttgtgcaagaaggtcagatgtacggcagtgggaggtgggttgtttttgggattttgagtggtgggatctttatttggctttgcaagaagattcttgagcaacatggagaagtaagtatgttggatataaaaggtgctgatgcaagtaaagttattcttgttgttggaataatgacactccattcttttggcgagggttctggtgttggtgtttcctttgttgggtcaaaaggattatctcaaggtcttttagttactatagctatagcagtgcacaacatacctgaaggcctagctgtaagcatggtactatcatctaggggtgtctccccacaaaaggcaatgctatggagtatcataacatctttaccacagccaattgttgctgtgcctgcattcctttgtgccgatgcatttcagaaggtgcttcctttctgtactggttttgctgcggggtgcatgatatggattgttattgcagaggttcttcctgatgcttttaaggaagccactccatctcaagtagcctctgctggaacacttgctgttgcttttatggaaacattaagtaccgtgcttcagggattcactgatggccacggcttggaagatacatcaggttttttggtatcacttgtatttggtcttggtccactttttggaggaattatacttgtcgcattctcgcttgccttcaacatgccacaccctcttcttactggtgtagcatctggcattgccttccgtcttgcttcatggaggccattacaacttgtgatgtccttaaagatgggtctctttactaccctgttcctcctactaggaggttcggtcttctaccatcttgcggaagcaagcatccttatggttgttaaacacaagaaatcatctgtcaatgtcattacatcgtccagcgggctctctcttagtgtcctcacacagcaatcactccttgcttgcgtctgcgtcttccttcatgcctacgccgaagggcttgcacttggtgtggcggcacgcaaggcatatggtctaggccgctacatggttcttccagtctcccttcacggtctaccacggggtgctgctgttgctagttgtgtatatggtgccactgatagctggcgaggagccttggcagctgcagctctgactgggcttgcaggaccaagcgcggccatcagtgcaatccttgcgaagattggctatgatggactggactactggatggtgattgcatgcggggctttgatcccgagctttggccgtgtcttcagacgctcgctgcggctggacgtgaggaagagtatctgcgggctcctgataggttttggttttgcttgggtgtgcttgatgtccaccagattcatctgcttgcacacgccttactgcaattcagctccagaagcggtcacatgatgtgttcctgtcagatagtcacatgtaacatcaatgtaacgataacactgaaaccgtaagagagggtctcctttccttgtatgaacaaaatgatgaaagggaaacaaacattatacaatgattttgcctggaataatcttgcacattgtgccaccacaacagaaaggaaaataatgcttgatactttggtgaatattctttaggtgtaactagcaaaaggacctgcgcgttgcaacgggaataagaaaactacatattag

SEQ ID NO: 2903 - DNA, 2233 bp, Brachypodium distachyon
caggggaattaccggttttccgatccctttcttcctttttcttccttccggacctaccaacgcgccccctacagcggccgtgccgtgccttaagcgtaaccgccgacgggccgtgccgtgccgccgacgctccccgccccatccgcagtctctggctattggttttcgagttatgaggttccagcgatgagataaatcccactggccttctcaatttctgggtgtgccggtgcacaatctagatccgctccctgaggtctgtgagatctgaaatacaagtaaccatgggcagcagagtcgggttggttctagtctgcttgctcttcctgctcatctgggaagtttcggcgattgccgagaccgaggttggtgatgtgcgcttagcacgagaagcaccccatggcaagccggaggttgctggtaaaagggtgtcggtgtacacggtcgcatggtctacgcttgcgatggccgcggcgaccgggctgggagcattgccattcttcttcctggagcttgaagcccaatgggcgggcctctgcaatgggatggcagccggggtcatgctggccgcaagctttgatcttgtgcaggaagggcagatgtatggcagtggggggagctgggttgttttcgggattttgagtggagggatctttatctggctttgcaagaagcttcttgagcaatatggagaagtaagcatgctggatataaaaggtgcagatgcaagtaaagttattcttgttgttggaataatgacgctccattcttttggcgagggctctggtgtgggtgtttcctttgctggctctaaaggattttctcaaggtctcctagttactatagctatagcagtgcacaacatacctgaaggcttagctgtaagcatggtactttcatccaggggtgtgtccccccaaaaggcaatgctatggagtatcataacatctttaccacagccaattgttgctgttccttcatttctttgtgctgatgcatttcaaaaagtgcttcccttctgtactggtttcgctgcgggatgtatgatatggattgttattgcagaggttcttcctgatgcttttaaggaagccactccagctcaagttgcctctgctggaacacttgccgttgctttcatggaaacattaagtaccgttctacagggattgactgatggccaaggctcggaagatacatcaggctttttggtatcacttgtatttggacttggtccactttttggaggaattatacttgttgcattctcgtttgccttcagcatgccacactctcttcttactggtgtcgcgtctggcatcgccttccgtcttgccacatggaggccattacaacttgtaatgtcttcaaagatgggtctatttaccaccttaatcctgctgataggaggttctgtattctaccatgtcgccacatcaagcatccttagggttgttaaccgcaagaaatcttctgtgagtgtcattacatcatcctctggcctctctcttagtttcctcacactgcaatcactccttgcttgcggttctgtcttccttcatgcctacgccgaagggcttgcacttggtgtggcggcacgaaaggcatatggtctaggccgttacatggttcttccggtctcccttcacggtctaccacgtggtgctgctgttgcaagctgcgtatatggtgccacagatagctggcgaggagccttggcagctgcagctctgaccgggcttgcaggaccaagtgccgccatcagtgcaatccttgcaaaaattgactatgatggactggactattggatggtcattgcatgcggggctttgatccctagctttggccgcgtcttcagacgctcgctgcgtctggacatccggaagagtgtctgtgggctcctgataggttttggttttgcctctttatgcttgatgtcaaccagattcatctgcctgcacactccttactgcaattcagctccagaagctgtcacatgatttctttttcctgtcagatgctgctgttgtagaacacatgtaacatcaatgtaacaagtgacagtacagagaatgtaaagattatttccttgaggctgagggatctgattgtatgaacaaaaaatcgaagggaaacagtcattagacagtaatgatttggccggaatagttatgtaaattagtaatattataatatcacaaaaaaaagatactgtgcttctttgatgttgagt

SEQ ID NO: 2904 - DNA, 2551 bp, Secale cereale
gagatgcccttagacgcgtgtgcgccgcaaccagccagccttccctaatatcccctgttccctctccgctctcgggtttcttcaccattagatcccaccggttccacgctccactgatcctgctggtccggcggctcgccgctaccgattgaacaccccaattcgggcctctccattcggtcgaattgggaggttctttggaagcgcatccacccacgaattgaggattggagctttcttgcagttgcattcaggaatcatgaataatttgttgcaagactgaggcgggtgttgagataactactcgatgaatttgttattatggccaatgccctgattctgccaggggcttatgagcttgctgaatatctgaagcacaggtaaccatggatagaaaggtcggagtgggtttagtctgcctgctcttcctactcattgggaaagtttcggcggttgcccagacagagattggtcatgtgcgtgtagcacaggaggcaccagatgtgaagctagaggatgctggtacaaatgatgcgtccaaaggtggaattgtgtcggtgtatgttgttgcatggtctacgcttgcgatggctgcggcaacagggttgggagcagtccccttctttttcctggagctagagacccaatgggcgggcctttgcaatggattggcagccggggtgatgttggcagcaagcttcgatcttgtgcaggaagggcagatgtacggcagtgggagttgggttgttttcggaattttgagtggtgggatctttatttggctttgcaagaagattcttgagcaacatggagaagtaagcatgttggatataaaaggtgcagatgcaagtaaagttattcttgttgttggaataatgacactccattcttttggcgagggctctggtgttggtgtttcctttgttgggtcaaaaggattatctcagggtcttttagttactatagctatagcagtgcacaacatacctgaaggcctagctgtaagcatggtactatcatctaggggtgtctccccacaaaaggcaatgctatggagtatcataacatctttaccacagccaattgttgctgtgcctgcattcctttgtgctgatgcatttcagaaggtgcttcctttctgtactggttttgctgcggggtgcatgatatggattgttatcgcagaggttcttcctgatgcttttaaggaagccactccatctcaagtagcctctgccggaacacttgctgtagcttttatggaaacattaagtactgtgcttcagggattcactgacggccacggcctggaagatacatcaggctttttggtatcacttgtatttggtcttggtccactttttggaggaattatacttgtcgcgttctcgcttgccttcaacatgccacaccctcttcttactggtgtagcatctggcattgccttccgtcttgcttcatggaggccattgcaacttgtgatgtccttaagatgggtctcttcaccaccttgttcctcctgctaggaggttccatcttttaccatctcgtggaagcaagcatccttatggttgctaaacacaagaaatcatccgtcaatgtcattacatcttccagcgggctctctcttagtgtcctcacacagcaatcgctccttgcttgcggttgcgtcttccttcacgcctacgccgaagggcttgcacttggtgtggcggcacgcaaggcatatggtctaggccgctacatggttcttccagtctcccttcacggcctaccacgtggtgccgctgttgctagttgtgtatatggtgctactgatagctggcgaggagccttggcagctgcagctctgaccgggcttgcaggaccaagcgcagccatcagtgcaatccttgccaagattggctatgatggactggactattggatggtgattgcatgcggggctttgatcccgagctttggccgtgtcttcagacgctcgctgcggctggacgtgaggaagagcgtctgtgggctcctgataggttttggttttgcttgggtgtgcttgatgtccaccagattcatctgcttgcacaccccttactgcaattcggctccagaagcggtcacatgatgtgttcctgtcagatagtcacatgtaacatcaatgtaacgataatactgaaattgtaagaggggtctcctatggttgtatgaacaaattgatgaaagggaaacgaacattagacagtgattttgcctggaataatcttgcaaattgtaccaccacaacacaagagaaaagatcgccagctgctttggtgagtattcttttaggtctactatttatccctttgcatcattatgctggttgggcgtgagatcgagttcatgagggcagggatggggattctgctcatcacgagcaaaagagcaggtgtgagcttcggggacaagaaagcatacgagagagatgattcgaaagtactcttctgctcttgatgaattggaaaaaagatcaaagaaacaaaaagatcctgatagttttgtggcgaactttactttc

SEQ ID NO: 2905 - DNA, 2393 bp, Triticum aestivum
agctgtggcatgaaacgtgccgtcgcagcacatctcaactgcgaacgcatcgcacatctccctgcggcgaccgaccgtcacgtagttagacccgtgtgcgccgcaagctgccagccctccctatatcctctcttccctctccgctctcgggtttcttcaccattagatcccaccgattccacgctccactgatcctgctggtccggcggctcgccgctaccgattgaacaccccaattcgggcccctccattcggtcgaattgggaggttctttggaagcgcatccacccacgaatcgaggattggagctttcttgcagttgcatttaggaatcatgaataatttgttgcaagactgaaacgggtgttgaggtaactactggaggaatttgttattatggccaatgccctgattctgtccggggcttatgagcttgctgaatatctgaagcacaagtaaccatggatagaaaagtcggagtggttttagtctgcctgctcttcctactcattggggaagtttcggcggttgcccagaccgaggttggtcatgtgcgtgtaacacaggaggcaccagatctgaagctagaggatgctggtagacatgatgtgtcccaaagtggaagggtgtcggtgtatgttgttgcatggtccacgcttgcgatggctgcagcaacagggctgggagcagttcccttctttttcctggagctagaggcccaatgggcgggcctttgcaatgggttggcagctggggtgatgttggcagcaagttttgatcttgtgcaggaagggcagatgtatggcagtgggagttgggttgtttttgggattttgagtggagggatctttatttggctttgcaagaagattcttgagcaacatggagaagtaagtatgttggatataaaaggtgcagatgcaagtaaagttattcttgttgttggaataatgacactccattcttttggcgagggttctggtgttggtgtttcctttgttgggtcaaaaggattatctcaaggtcttttagttactatagctatagcagtgcacaacatacctgaaggcctggctgtaagcatggtactatcatctaggggtgtctccccacaaaaagcaatgttatggagtatcataacatctttaccacagccaattgttgctgtgcctgcattcctttgtgccgatgcatttcagaaggtgcttcctttctgtactggttttgctgcagggtgcatgatatggattgttattgcagaggttcttcctgatgcttttaaggaagcgactccatctcaagtagcctctgctggaacacttgctgttgcttttatggaaacattaagtaccgtgcttcagggattcacggatggccacggcttggaagatacatcaggctttttggtatcacttgtatttggtcttggtccactttttggaggaattatacttgtcgcgttctcgcttgccttcaacatgccacaccctcttcttactggtgtagcatctggcattgccttccgtcttgcttcatggaggccattgcaacttgtgatgtccttaaagatgggtctcttcaccaccttgttcctcctgctaggaggttccgtcttctaccatctcgtggaagcaagcatccttatggttgctaaacacaagaaatcatccgtcaatgtcattacatcttccagcgggctctctcttagtgtcctcacacagcaatcgctccttgcttgcggttgcgtcttccttcacgcctacgccgaagggcttgcacttggtgtggcggcacgcaaggcatctggtctaggccgctacatggttcttccagtctctcttcacggcctaccacggggtgctgctgttgctagttgtgtatatggtgccactgatagctggcgaggagccttggcagctgcagctctgaccgggtttgcgggaccaagcgcggccattggtgcaatccttgcgaagattggctatgatggactggactattggatggtgattgcatgcggggctttgatcccgagctttggccgtgtcttcagacgctcgctgcggctggacgcgaggaacagcgtctgcgggctcctgataggttttggttttgcttgggtgtgcttgatgtccaccagattcatctgcttgcacaccccttactgcaattcagctccagaagcggtcacatgatgtgttcctgtcagatagtcacatgtaacatcaatgtaacgataatactgaaattataagagggatatcctttccttgtatgaacaaagtgatgaaagggaaacgaacattagacagtgattttgcctggaataatcttgcaaattgtgccaccacaacacaaaagaaaagaccgcctgctactttggtgaatgttca

SEQ ID NO: 2906 - DNA, 2529 bp, Triticum aestivum
cgacagtacgctacagctgtggcatgaaacgtgccgtcgcagcacatctcaactgcgaacgcatcgcacatctccctgccgcgaccgaccgtcacggtagttagacccgtgtgcgccgcaagctgccagccttccctagagtttcctatatcctctctttcctctccgctctcgggtttcttcaccattagatcccaccgattccacgctccactgatcctgctggtccggcggctcgccgctaccgattgaacaccccaattcggccccctccattcggtcgaattgggaggttctttggaagcgcatccacccacgaatcgaggattggagctttcttgcagttgcatttaggaatcatgaataatttgttgcaagactgaaacgggtgttgaggtaactactggaggaatttgttattatggccaatgccctgattctgtccggggcttatgagcttgctgaatatctgaagcacaagtaaccatggatagaaaagtcggagtggttttagtctgcctgctcttcctactcattggggaagtttcggcggttgcccagaccgaggttggtcatgtgcgtgtaacacaggaggcaccagatctgaagctagaggatgctggtagacatgatgtgtcccaaagtggaagggtgtcggtgtatgttgttgcatggtcgacgcttgcgatggctgcagcaacagggttgggagcacttcccttctttttcctggagctagaggcccaatgggcaggcctttgcaatgggttggcagctggggtgatgttggcagcaagttttgatcttgtgcaggaagggcagatgtacggcagtgggagttgggttgtttttgggattttgagtggagggatctttatttggctttgcaagaagattcttgagcaacatggagaagtaagtatgttggatataaaaggtgcagatgcaagtaaagttattcttgttgttggaataatgacactccattcgtttggcgagggttccggtgttggtgtttcctttgttgggtcaaaaggattatctcaaggtcttttagttactatagctatagcagtgcacaacatacctgaaggcctggctgtaagcatggtactatcatctaggggtgtctccccacaaaaagcaatgctatggagtatcataacatctttaccacagccaattgttgctgtgcctgcattcctttgtgccgatgcatttcagaaggtgcttcctttctgtactggttttgctgcagggtgcatgatatggattgttattgcagaggttcttcctgatgcttttaaggaagcgactccatctcaagtagcctctgctggaacacttgctgttgcttttatggaaacattaagtaccgtgcttcagggattcacggatggccacggcttggaagatacatcaggctttttggtatcacttgtatttggtcttggtccactttttggaggaattatacttgtcgcgttctcgcttgccttcaacatgccacaccctcttcttactggtgtagcatctggcattgccttccgtcttgcttcatggaggccattgcaacttgtgatgtccttaaagatgggtctcttcaccaccttgttcctcctgctaggaggttccgtcttctaccatctcgtggaagcaagcatccttatggttgctaaacacaataaatcatccgtcaatgtcattacatcttccagcaggctctctcttagtgtcctcacacagcaatcgctccttgcttgcggttgcgtcttccttcacgcctacgccgaagggcttgcacttggtgtggcggcacgcaaggcatctggtctaggccgctacatggttcttccagtctctcttcacggcctaccacggggtgctgctgttgctagttgtgtatatggtgccactgatagctggcgaggagccttggcagctgcagctctgaccgggtttgcgggaccaagcgcggccatcggtgcaatccttgcgaagattggctatgatggactggactattggatggtgattgcatgcggggctttgatcccaagctttggccgtgtcttcagacgctcgttgcggctggacgcgaggaagagcgtctgcgggatcctgataggttttggttttgcttgggtgtgtttgatgtccaccagattcatctgcttgcacaccccttactgcaattcagctccagaagcggtcacatgatgtgttcctgtcagatagtcacatgtaacatcaatgtaacgataatactgaaattataagagggacatcctttccttgtatgaacaaagtgatgaaagggaaacgaacattagacagtgattttgctaatcttgcaaattgtgccactacaacacaaaagaaaagaccgcctgctactttggtgaatattcatttaggtgtaatatcccttggcctcaatatgttggctgagcacgaggagagagctgattcgaaagtcctcttgatgaacaataaaagtaaataaataatttttctaaaagaaagtaa

SEQ ID NO: 2907 - DNA, 1699 bp, Saccharum officinarum
ctgggagcggtgcccttctttttcatggagctcgaagcgcagtgggcaggcctctgcaatgggatggcggccggggtaatgctggcggccagctttgacctcgtgcaggaagggcaggtgtatggcagtgggagctgggttgtgttcggaattctgggtggaggtatatttatttggctttgtaagaagtttcttgagcaatatggagaagtaagcatgatggatataaaaggtgcagatgcaagtaaagttattcttgttgttggaataatgactcttcattcttttggagaaggctctggtgtgggtgtttcctttgctggctcaaaagggttttctcagggtcttctagttactatagctatagcagtgcacaacataccagaaggcttagcagtaagcatggttctcgcatctaggggtgtgtccccccaaaaggcaatgatatggagtataattacatctttaccacagccacttgttgctgttcctgcattcctttgtgccgatgcattccagaaggtgcttcctttttgtactggtttcgcagcaggatgcatgatatggattgttatagcggaggttcttcctgatgcttttaaggaagcaactccatctcaagttgcttctgctggaacacttgctgttgctttcatggaaacattaagtactgtgcttctgggatttacagatggcaacaactcggaagatgcatcaggattcttagtatcacttgtgtttggacttggtccacttattggtggaattatactagtcacattctctcttggcttcagcatgcctcaccctcttcttactggtgttgcatctggcattgctttccgtcttgcggcatggagacctgtgcagcttctaatgtcctcaaaaatgggtctctttaccaccctcggcctcctccttggaggttccatggtctaccatgctgccacatcaagcatccttagggtgtttaatcgcaaaagatcttccgcaaatgtgatcatgtcatcctccggtgtctctcttagtgtcctcacaatgcaatcgctccttgcttgtggtgctgtattccttcacgcatacgcggaagggcttgcacttggtgtcgcagctcgcaaggcttatggccttggccgttacatggttctcccagcctccctccatggtcttccacggggagctgctgctgcaagctgtgtgtatggtgctacggatagctggcgtggagcccttgcagctgctgctttgacagggtttgcagcaccaagcgctgccatcagtgcaatccttgcaaagattgactatgatggccttgactactggatggtcatagcgtgtggggctctaatccccagctttggccgagtcttcaggcgctcactgcggttggacatgcggaagagcattgttggcctgctgataggtattgcctttgcctccgtgtgcttgatgtcgactagattcatctgtttgcacactccttactgcaactcggctccagaagcagtcacataacctatgctgccctgtgctgttgtaaaacacatgtaatactagtgtaatgacaatacaaaggatgtggaaggttatatatattgcatcggagagatatcttacatcggtaaatcaaagggaaacggacattgaacagaatgtgcctttttctcgctgtcatggaaggtccatgtaaatcattccc

SEQ ID NO: 2908 - DNA, 2147 bp, Triticum aestivum
cggggcggcgaccgaccgtcacggtagttagacccgtgtgcgccgcaagctgccagccttccctatatcctctcttccctctccgctctcgggtttcttcaccattagatcccaccgattccactctccactgatcctgctggtccggcggctcgccgctaccgattgaacaccccaattcgggcccctccattcggtcgaattgggaggttctttggaagcgcatccacccacgaatcgaggattggagctttcttgcagttgcattcaggaatcatgaataatttgttgcaagactgaggcgggtgttgaggtaactactggatgaatttgttattatggccaatgccctgattctgcgcggggcttatgagcttgctgaatatctgaagcacaagtaaccatggatagaaaagtcggagtggttttagtctgcctgctcttcctactcattggggaagtttcagcggttgcccagaccgaggttggtcatgtgcgtgtaacacaggaggcaccagatctgaagctagaggatgctggtagacatgatgtgtcccaaagtggaagggtgtcggtgtatgttgttgcatggtcgacgcttgcgatggctgcagcaacagggttgggagcagttcccttctttttcctggagctagaggcccaatgggcgggcctttgcaatgggttggcagctggggtgatgttggcagcaagttttgatcttgtgcaggaagggcagatgtacggcagtgggagttgggttgtttttgggattttgagtggagggatctttatttggctttgcaagaagattcttgagcaacatggagaagtaagtatgttggatataaaaggtgcagatgcaagtaaagttattcttgttgttggaataatgacactccattcttttggcgagggttctggtgttggtgtttcctttgttgggtcaaaaggattatctcaaggtcttttagttactgtagctatagcagtgcacaacatacctgaaggcctggctgtaagcatggtactatcatctaggggtgtctccccacaaaaagcaatgctatggagtatcataacatctttaccacagccaattgttgctgtgcctgcattcctttgtgccgatgcatttcagaaggtgcttcctttctgtactggttttgctgcagggtgcatgatatggattgttattgcagaggttcttcctgatgcttttaaggaagcaactccatctcaagtagcctctgctggaacacttgctgttgcttttatggaaacattaagtaccgtgcttcagggattcacggatggccacggcttggaagatacatcaggctttttggtatcacttgtatttggtcttggtccactttttggaggaattatacttgtcgcgttctcgcttgccttcaacatgccacaccctcttcttactggtgtagcatctggcattgccttccgtcttgcttcatggaggccattgcaacttgtgatgtccttaaagatgggtctcttcaccaccttgttcctcctgctaggaggttccgtcttctaccatctcgtggaagcaagcatccttatggttgctaaacacaagaaatcatccgtcaatgtcattacatcttccagcgggctctctcttagtgtcctcacacagcaatcgctccttgcttgcggttgcgtcttccttcacgcctacgccgaagggcttgcacttggtgtggcggcacgcaaggcatctggtctaggccgctacatggttcttccagtctctcttcacggcctaccacggggtgctgctgttgctagttgtgtatatggtgccactgatagctggcgaggagccttggcagctgcagctctgaccgggtttgcgggaccaagcgcggccatcggtgcaatccttgcgaagattggctatgatggactggactattggatggtgattgcatgcggggctttgatcccaagctttggccgtgtcttcagacgctcgttgcggctggacgcgaggaagagcgtctgcgggatcctgataggttttggttttgctctgggtgtgtttgatgtccaccagattcatctgcttgcacaccccttactgcaattcagctccagaagcggtcacatgatgtgttcct

SEQ ID NO: 2909 - DNA, 2517 bp, Panicum virgatum
gagggcctcctcacataaaacacgcgacagcaaccaccagcctccccaacctccaattccagttgtcttccccgcccggccgcggccgtgccaggtcggaccccgtcccctccgctccctccgatccccaattttaaacgacgccccccttcttcttcttctctctcctgcgccccactcgcctcccccctacccctcccacgccgcgagcgaatccggacggctcgctgccccggctcccctctcctgtcccgcgatggcggcgtccatggcgtcgccgcgggggcggtcgatccgggagacggtgctggagaccgtcgcggcgtaccacaaccagcagcggatgaggcgcaagctgcgcaagagcctcacctacgccggcgagctctcctccgcgggccgggcacgcggggacggcgcgtcctcgtccgcctcggtatcctcgctctgcgggcccgaggacgacgacgagcccttctgggaggaggaggagggcaccgtcgagctcgtccagctcggggccaaccgcgccaagaacgtcctcatcctcatgagcgacaccggcggcggccaccgcgcatccgcggaggccatcaaggacgccttccggatcgagttcggcgacgagtaccgggtcttcgtcaaggatctgtgcaaggatcacgccggctggccgctcaacaacatggagagctcatacaagttcatggtgaagcatgtgcagctctggaaagtggccttccataccacctctcctagatggatccattgcttctacctcgctgctctcgcctcattctatgccaagaaggtggaggctggactgaagaagtacaagccagacatcataattagtgtccaccccctcatgcaacacattcctctgtgggtgctcaaatggcaaggcctgcaaaacagggtagtctttgtaaccgtcatcacagacctcaacacttgccaccctacatggttccatgccaatgtgaatagatgttactgcccctcagaagaagttgccaagagggctgcattggatgacctacaaccttctcaaatccgtgtgttcggtcttccaattcgaccatcattttgccgtgcagttcttgttaaggatgaattgagaaaggaacttgaattggatcctgagcttcctgcagtgctgctcatgggaggtggggagggcatgggtcctgtcaagaagactgcaaaagccctgggagaatcattgtttgacaaagaacaaggaaaaccaattgggcagcttattgtcatttgtggtcggaacaaaacactaagctcctccctacaggcacttgaatggaaaataccagtaaagattagaggatttgagacccaaatggagaagtggatgggtgcttgtgattgtattataacaaaggctggaccaggtaccattgctgaagccttgataaggggtcttcctataatccttaatgatttcatacctggacaggaagttggcaatgtcccttatgttgtggacaatggtgcaggcgtgttctccaaaagccccaaggaaactgctagtcttgttgcccgttggtttggtccagactcagaggaattgaaaaaaatgtcagaaaatgcactgaaattggctcagccggaagctgtctttgacattgtcagagacatacatgagctctctcgggagcaaggcgtgatatctcagatctctagttccttgacgtcatctttcttcataccatcacctgaaaccacacctctccaacttatctgaaatcatcaagctgtgtatagctagaactgcaatctctgaccttgtgaacttggcattgtctcctacatggaaatggaacttcagggagccaagtgttggtactgctattcacaacttttcagttcatgcgctcccgtggtagatatgtgtgggactggtttgactaacaggtcgtcgtgtgtattgttggcttcatgttaactttgcagaaatcattcattcatatcatgtttgctcccctcatcatcaacgagggcgatttggtggtggtggcttgtaaaatacacacaattttgtgcatgcaaaagtcagaaccttgtcatgtgctaacccatgtgatccgttcatgtaagtggaagatctgtataatatgatgacagattgtttgagcggaaattttgtttgaggagatatattgaggtgtcatgggtgaactgtattctaatcccctcgttgctaaaagaatgcaacttaattttcctgataaatcaaataatattgagttcatttatacaaaatagtattaatatttatattataaataaatattattagattaatcatgtccaacgactaggcagacgaccagcgtgagtgcgagggccggggctcgccctgacactgatgaagccaccctttaaaagcaaaagggccatgtatagctgcaccgatccaccacaaccaggctgctccgtcgcaacttgcttctctttcccgagcagaacgtcgcagctcaaagcagcagatggcgttgc

SEQ ID NO: 2910 - DNA, 1777 bp, Panicum virgatum
agcgaatccggacggctcgctgccccggctcccctctcctgtcccgcgatggcggcgtccatggcgtcgccgcgggggcggtcgatccgggagacggtgctggagaccgtcgcggcgtaccacaaccagcagcggatgaggcgcaagctgcgcaagagcctcacctacgccggcgagctctcctccgcgggccgggcacgcggggacggcgcgtcctcgtccgccttggtatcctcgctctgcgggcccgaggacgacgacgagcccttctgggaggaggaggagggcaccgtcgagctcgtccagctcggggccaaccgcgccaagaacgtcctcattctcatgagcgacaccggcggcggccaccgcgcatccgcggaggccatcaaggacgccttccggatcgagttcggcgacgagtaccgggtcttcgtcaaggatctgtgcaaggatcacgccggctggccgctcaacaacatggagagctcatacaagttcatggtgaagcatgtgcagctctggaaagtggccttccataccacctctcctagatgggtccattgcttctacctcgctgctctcgcctcattctatgccaagaaggtggaggctggactgaagaagtacaagccagacatcataattagtgtccaccccctcatgcaacacattcctctgtgggtgctcaaatggcaaggcctgcaaaacagggtagtctttgtaaccgtcatcacagacctcaacacttgccaccctacatggttccatgccaatgtgaatagatgttactgcccctcagaagaagttgccaagagggctgcattggatgacctacaaccttctcaaatccgtgtgttcggtcttccaattcgaccatcattttgccgtgcagttcttgttaaggatgaattgagaaaggaacttgaattggatcctgagcttcctgcagtgctgctcatgggaggtggggagggcatgggtcctgtcaagaagactgcaaaagctctgggagaatcattgtttgacaaagaacaaggaaaaccaattgggcagcttattgtaatttgtggtcggaacaaaacactaagctcctccctacaggcacttgaatggaaaataccagtaaagattagaggatttgagacccaaatggagaagtggatgggtgcttgtgattgtattataacaaaggctggaccaggtaccattgctgaagccttgataaggggtcttcctataatccttaatgatttcattcctggacaggaagttggcaatgtcccttatgttgtggacaatggtgcaggcgtgttctccaaaagccccaaggaaattgctagtcttgttgcccgttggtttggtccagactcggaggaattgaaaaaaatgtcagaaaatgcactgaaattggcgcagccagaagctgtctttgacattgtcagagacatacatgagctctctcgggagcaaggcgtgatgtcacagatctctagttccttgacgtcatctttcttcatatcatcacctgaaaccacacctctccaacttatctgaagccatcaagctgtgtatagctagaactgcaatctctgaccttgtgaacttggcattgccccctacatggaaatggaacttcagggagccagatgttgtactgcatttcacaacttttcagttcatgctctcccgtggtagatatgggcggggctggtttgactaaaaggtcgtgtctattgttggcttcatgttaactttgcagaaatcattcattcatatc

SEQ ID NO: 2911 - DNA, 2437 bp, Panicum virgatum
aaacacgcgacagcaaccaccaccctccccaacctccaattccagttgtcttccccgccccgccgaggcctccctccgatccccaattttaaacgcccccttcttcttcttctctctcttgcggcccccctccctccccacctcctcccacgccgcgagcgaatccggacggctcgctgccccggctccccctctcctgtcccgcgatggcggcgtccatggcgtcgccgcgggggcggtcgatccgggaggcggtgctggagaccgtcgcggcgtaccacaaccagcagcggatgaggcgcaagctgcgcaagagcctcacctacgccggcgagctctcctccgcgggccggccacgcggggacggcgcctcatcgtccgcctcggtatcctcgctttgcggggccgaggacgacgacgagcccttctgggaggaggaggagggcaccgtcgagctcgtccagctcggggccaaccgcgccaagaacgtcctcatcctcatgagcgacaccggcggcggccaccgcgcatccgcggaggccatcaaggacgccttccggatcgagttcggcgacgagtaccgggtcttcgtccaggatctgtgcaaggatcacgccggctggccgctcaacaacatggagagctcatacaagttcatggtgaagcatgtgcagctctggaaagtggccttccacagcacctctcctagatgggtccattgcttctacctcgctgctctcgcctcattctatgccaagaaggtggaggctggactgaagaagtacaagccagacatcataattagtgtccaccccctcatgcaacacattcctctgtgggtgctcaaatggcaaggcctgcaaaacagggtagtctttgtaaccgtcatcacagacctcaacacttgccaccctacatggttccatgccaatgtgaatagatgttactgcccctcagaagaagttgccaagagggcagcattggatgacctacaaccttctcaaatccgtgtgttcggtcttccgattcgaccatcattttgccgtgcagttcttgtaaaggatgaattgagaaaggaacttgaattggatcccgagcttcctgcagtgctgctcatgggaggtggagagggcatgggtcctgtcaagaagactgcaaaagctcttggagaatcattgtttgacaaagaacaaggaaaaccaattgggcagcttattgtaatttgtggtcggaacaaaacactaagctcctccctacaggcacttgaatggaaaataccagtaaagattagaggatttgagacccaaatggagaagtggatgggtgcttgtgattgtattataacaaaggctggaccaggtaccattgctgaagccttgataaggggtcttcctataatccttaatgatttcattcctggacaggaagttggcaatgtcccttatgttgtggacaatggtgcaggcgtgttctccaaaagccccaaggaaattgctagtcttgttgcccgttggtttggtccagactcggaggaattgaaaaaaatgtcagaaaatgcactgaaattggcgcagccagaagctgtctttgacattgtcagagacatacatgagctctctcgggagcaaggcgtgatgtcacagatctctagttccttgacgtcatctttcttcatatcatcacctgaaaccacacctctccaacttatctgaagccatcaagctgtgtatagctagaactgcaatctctgaccttgtgaacttggcattgccccctacatggaaatggaacttcagggagccagatgttgtactgcatttcacaacttttcagttcatgctctcccgtggtagatatgggcggggctggtttgactaaaaggtcgtgtctattgttggcttcatgttaactttgcagaaatcattcattcatatcatgtttgctcccttcatcatcaatggggggagatttggtggtggtggtggcttgtaaatacactcaggccgtgtttagttccctggcgtgtaaacacaaattttttttgcaacggaatcttgctaatttgaagtactaaatgaagtttatttataaaacttttttgcacagatgtgttgtaaatcgtgagacgaatctaatgatgctaattaatctatgattaatcaataattagtggatggctactgtagcatcactgttacaaatcatggattaagtaggctcattagattcgtttcgcgatttacggctatctatgaaaaaagttttgtaaatagactttatttagtatttcaaattagcaagattttttcgtaaaattttgcgtttacgggtgggaactaaacatggcctcagttttgtgcatggaaaagtcaactttgtcatgtgctaacccatgtgatccgttcatgtaagatatgatgacagattgtttgagcgg

SEQ ID NO: 2912 - DNA, 2633 bp, Sorghum bicolor
actgaaacccctcgagttcctgcaatcatcaagggcaacatggaacaggcgaacccggtccatcaccagaaagcaagcaaacaacaacgcaggcgaggcgagcatccgagcacgcataaaacacgcgacaacaaccaccaccatcccccgcctttcaattccagttgtcttcctcccccgtccccggtcgtgccagctcagctcggagccccccgcgcaccctccgccgctctcccgatccccaattttaaacttccccttctctctcctgcccactcgcctccctcccctcccctcccggccccgccccgccccgcctctcctctcctcccacacatccggcgcttcccctccccccgcgcgcgcctcggctcctccgctccgcgaccgcgatggcggcgtccatggcgtcgccacgggggcggtcgatccgggagacggtgctggagaccgtggcggcgtaccaccaccagcagagggccaggaggaagctgcgcaagagcctcacctacgccggcggcgagctctcctccgcgggccgggcccgcggggacgcctccgcatccacctccgtctcctcgttctgcgggcccgacgacgacgacgagcccttctgggaggaggaggagggcaccgtcgagctcgtccagcttggggccaaccgcgccaagaacgtcctcatcctcatgagcgacaccggcggcggacaccgcgcctccgccgaggccatcaaggacgccttccggatcgagttcggcgatgagtaccgggtcttcgtcaaggatctgtgcaaggatcacgccgggtggccgctcaacaacatggagagctcgtacaagttcatggtgaagcacgtgcagctctggaaggtggccttccacagcacctcgccgagatgggtccataacttctacctcgccgcactcgcctcattctatgccaagaaggtggaggctggactgaagaaatacaagccagacatcataattagcgtccatcctctcatgcaacacattcctctgtgggttctcaaatggcaaggcctacagaacagagtagtctttgtaactgtgatcacggacctcaacacatgccaccctacatggttccatgctgatgtgaacagatgttactgcccctcagaagaagttgccaagcgggcagcactggatgatctacaaccttctcaaattcgcgtgttcggtcttccaattcgaccatcattctgccgtgcagttcttgttaaggatgatttgaggagggagcttgaattggatcctgagcttcctgcagtgctgctcatgggaggtggagagggcatgggtcctgtcaagaagactgccagagctctaggagaatcattgtttgacaaagagcttggaaaaccaattgggcagcttattgtcatttgtggccggaacaaaacgctaagctcctcactgcaggcacttgaatggaaaataccagtaaaggttaggggatttgaaacccaaatggagaagtggatgggagcttgtgattgcattataacaaaggctggaccgggaaccattgctgaagcgttgataaggggtcttcctataatccttaatgacttcatacctggacaggaagttggcaacgtcccttatgttgtggacaatggtgcaggtgtgttctcgaaaagccctaaggaaactgctaaccttgttgcccgctggtttggtccagattcagaggaactgaaaaaaatgtcagaaaatgcactgaaattggctcagccagaagctgtctttgacattgtcagagacattcatgggctctctcaggagcaaggcgtgatatcacagatctctagttccttgacttcatccttcttcataccatcacctgaaaccacacctctccaacttatctgaaaccatcaagctgtgtctagctaggattctattcttgcaactgtgaacttggcattctcccaacagcgtgacctgaaaaatggaacttcatgcagtctttctcatcagctgttggtactgggattccacaactttcggttcatgtgctcccatggtagttatgggcaggctcgtttgactgacaggttctcgtgtgtgatgatgctggcttcattttaactttgtaaaaaaaaaggaacacattcattcatatcatgtttctggcttcccccgtcatgaaaggggaattggtggtggtggcttgtaaaatacactcaaattttgtgcatggagatgtcagacccttattgtgtatactaactgacgtgatccgttcgtgtaagtggaagatgtgtataatatgatgacagattgttcgagtggaagtttttttctttttctttttgtctgcagattgatcagaattgtacctccctatgttttttttggtgtatgagtttggtggtgaactgaatgtgcctaaggaaccaaacatgccttgaatttctatctgtacagcgcttttaggtcttgtttggtttgttgcctaggcaactttgcctggccaggtagaaatccaggccctcggtttcaagtgccttgtgacctgaatttgttgccctgggcagcaaccaaacatgccttcttctatttgtacagctacatcaggtcttcaaactggatcaggtgttgata

SEQ ID NO: 2913 - DNA, 2162 bp, Saccharum officinarum
ccccttcccccacatccgacgcctcggctcctccgcgaccgcgatggcggcgtccatggcgtcgccgcgggggcggtcgatccgggagacggtgctggagaccgtggcggcgtaccaccagcagcagcgggccaggcggaggctgcgcaagagcctcacctacgccggcggcgagctctcctccgcgggccgggcccgcggggacggccccgcctccacctccgtctcctcgctctgcgggcccgacgacgacgacgagcccttctgggaggaggaggagggcaccgtcgagctcgtccagctcggggccaaccgcgccaagaacgtcctcatcctcatgagcgacaccggcggcggacaccgcgcctccgccgaggccatcaaggacgccttccggatcgagttcggcgacgagtaccgggtcttcgtcaaggatctgtgcaaggatcacgccgggtggccgctcaacaacatggagagctcctacaagttcatggtgaagcacgtgcagctctggaaggtggccttccacaccacctcgccgagatgggtccataacttctacctcgccgctctcgcctcattctacgccaagaaggtggaggcaggactgaagaagtacaagccagacatcataattagtgtccatcccctcatgcaacacattcctctgtgggttctaaaatggcaaggcctacagaacagagtagtctttgtaactgtgatcacagacctcaacacttgccaccctacatggttccatgctgatgtgaacagatgttactgcccctcagaagaagttgccaagcgggcagcactggatgatctacaaccttctcaaatccgtgtgttcggtcttccaattcgaccatcattctgccgtgcagttcttgttaaagatgatttgaggagggaacttgaattggatcctgagcttcctgcagtgctgctcatgggaggtggagagggcatgggtcctgtcaagaagactgccagagccctaggagaatcattgtttgacaaagagcttggaaaaccaattgggcagcttattgtcatttgtggccggaacaaaacactcagctcctcactgcaggcacttgaatggaaaataccagtaaaggttaggggatttgaaacccaaatggagaagtggatgggagcttgtgattgcattataacaaaggctggaccaggaaccattgctgaagcgttgataaggggccttcctataatccttaatgacttcatacctggacaggaagttggcaacgtaccttatgttgtggacaatggtgcaggtgtgttctcgaaaagccctaaggaaactgctaatcttgttgcccgctggtttggtccagattcagcggaattgaaaaaaatgtcagaaaatgcactgaaattggctcagccagaagctgtctttgacattgtcagagacattcatggtctctctcaggagcaaggcgtgatatcgcagatctctagttcgttgacttcatccttcttcataccatcacctgaaacaacacctctccaacttatatgaaaccatcaagctgtgtctagctaggatcgcagttgttgacactgtgaacttggcattctcccacagtgtcacctgaaaaatgaacttcatacagtctttctcatcagtggttggtattgggattccacagcttccggttcatctgctcccatggtagttatgggcaggctcatttgactgacaggttctcgtgtgtgatgacgttctcttcatgttaactttgtaaaaaaaaaacattcattcatatcacgtttctggcttcccccgtcatcaaaggggaattggtggtgatggcttgtaaaatacactcaaattttgtgcatggagatgtcaaacccttgtcatgtatactaactgatgtgatccattcgtgtgagtggaagatgtgtataatatgatgacatatcggctcgccttatttggacattgtaaaacaaaactgcttctctccattgactgactgaatgtattgagtgtggagcgcctttctacccggatccaaggctttacgtgccggggcctttctaaaaggattccaatctttacatacggcctcgccttgcgaacggatcttaaccgggccccctattttttgacaaccgtaaatgtcctt

SEQ ID NO: 2914 - DNA, 2201 bp, Zea mays
gaacaaacgagcaaatgcttttatccccgggaaaaacaagcaagtcaagcaacaaacaacagcgcaggcgagcatccgagcaccacccgcctcccaattccagttgtcttccttccccgtccccggacgtgccagctcagctcgaggccccgcctcctccgccgttctctccgatccccaattttaaacgcccccccttctctctcctgcccactcgcctccctcccggtcccggtcccggcctcccccctccccctccgctccccccaaccccagaacatccggcgctttcaccccccttcccctcccctcccctcgtcctccgcgatggcggcgtccatggcgtcgccgcgggggcggtcgatccgggagacggtgctggagaccgtggcggcgtaccaccagcagcagcgggccaaggggaagctgcgcaagagcctcacctacgccggaggcgagctctcgtccgcgggccgggcccgcggggacggccccgcctccacctccgtctcctcgctctgcgggcccgacgacgacgacgagcccttctgggaggaggaggagggcaccgtcgagctcgtccagctcggggccaaccgcgctaagaacgtcctcatcctcatgagcgacaccggcggaggccaccgcgcctccgccgaggccatcaaggacgccttccgcatcgagtttggcgacgagtaccgggtcttcgtcaaggatctgtgcaaggaccacgccggctggccgctcaacaacatggagagctcctacaagttcatggtcaagcacgtgcagctctggaaggtggcattccacagcacctcgcctagatgggtccataacttctacctcgccgctctcgcctcattctacgccaagaaggtggaggctggactgaagaagtacaagccagacatcataattagtgtccatcccctcatgcaacacattcctctgtgggttctcaaatggcaaggcctacagaacagggtagtctttgtaactgtgatcacagacctcaacacatgccaccctacatggtttcatgctgatgtgaatagatgttactgcccttcagaagaagttgccaagcgggcagcactggatgatctacaaccatctcaaatccgcgtgttcggtcttccgattcgaccatctttctgccgtgcagttcttgttaaggatgatttgaggagggaacttgaattggatcctgagcttcctgcagtactgctcatgggaggtggagagggcatgggtcctgtcaaaaagactgccagagccctaggagaatcattgtttgacaaagagcttggaaaaccaattgggcagcttattgtcatttgtggccggaacaaaacgctaagctcctcactgcaggcagttgaatggaaaataccagtaaaggttaggggatttgaaacccaaatggagaagtggatgggagcttgtgattgcattataacaaaggctggaccaggtaccattgctgaagccttgataaggggtcttcctataatccttaatgacttcatacctggacaggaagttggcaacgtaccttatgttgtggacaatggtgcaggtgtgttctcgaaaagccccaaggaaactgctagtcttgttgcccgctggtttggtccagattcagaggaattgaaaaaaatgtcagaaaaggcactgaaattggcccaaccagaagctgtctttgacattgtcaaagacatgcatgagctctcccaggagcaaggtgtcatatcacagatatctagttccttgacttcatccttcttcttaccatcgcctgaaagcacccctctccaacttatctgaaaccatcaagctaggattgatattgttgacatcgtgaacttggcattgtccctacagtgtgggcgtgctttcggctgatccgctcacatggtagttatgggcagggtcgtttgactgacaggttctcgcgtgtgatgatgtttgccttcatgttaacttttgtaaaaaaaacattcattcatattatgtttctggctcccttcgtcatcaaaggggaattggtggtggtggtggcttgtaaaatacactcaaattttgtgcatggacatgtcagacccttatcatgtatactagctgatgtgatccgttcatgtaagtggaagatgtgtataatatgattacagattgttggagtggaaatttatctc

SEQ ID NO: 2915 - DNA, 1771 bp, Pennisetum glaucum
gagacggtgctggagaccgtcgcggcgtaccacaaccagcagcgggcgaggcgcaagctccgcaagagcctcacctacgcgggggagctctcctccgcgggccgccggggggcgcgcgggggcggcggcggcggcgcgtcctcgtcctcgtccgcctccgtctcttccctctgcgggcccgaggacgacgacgagcccttctgggaggaggaggagggcaccgtcgagctcgtccagctcggggccaaccgcgccaagaacgtcctcatcctcatgagcgacaccggcggcggccaccgggcctccgcggaggccatcaaggacgccttccggatcgagttcggcgacgagtacagggtcttcgtcaaggatctgtgcaaggatcacgccggctggccgctcaacaacatggagagctcatacaagttcatggtcaagcatgtgcagctctggaaagtggctttccacaccacctcgcctagatgggtccattgcttctacctcgctggtctcgcctctttctacgccaagaaggtggaggctggactgaagaagtacaagccagacatcataatcagtgtccaccccctcatgcaacacattcctctgtgggtgctcaaatggcaaggcctgcaaaacagagttgtcttcgtaactgtcatcacagacctcaacacttgccaccctacatggttccatgccaatgtgaacagatgttactgcccctcagaagaagttgccaagagggcggcagtggatggcctacaaccttctcaaatccgcgtgtttggtcttccaattcgaccatcattctgccgtgcagttcttgttaaggatgagttgagaaaggaacttgaattggatcctgagcttcctgcagtgctgctcatgggaggtggagagggcatgggtcctgtcaagaagactgcaaaagcccttggagaatcactgtttgacaaagaacacggaaaaccaattgggcagcttatcgtcatttgtggtcggaacaaaacactgagctcctccctgcaggcacttgaatggagaataccagtaaaggttagaggatttgagacccaaatggagaagtggatgggtgcttgtgattgtattataacaaaggctggaccaggtactatcgctgaagccttgataaggggtcttcctataatccttaatgatttcatacctggacaggaagttggcaacgtcccttatgttgtggacaatggtgcaggtgtgttctccaaaagtcccaaggagactgctagtcttgttgcccgttggtttggtgaagactcggaggaattgaaaaggatgtcagaaaatgcgctgaagttggctcagccggaagctgtctttgacattgtgagagacatccacgagctctctcgggagcaaggcgtgatatcacagatatctagttccttgacgtcatccttcttcataccatcacccgaaaccacacctctccaacttatgtgaaaaccttggagctgtgcatagctagaattgcaatctctgaccttgtggagttggcgtcccctcccctccagcgtgacttgggaaacggaacttgagggagcctttctcatcagctgtcggtacgggggattccgcaactttttcagtacttgagctcccatggtagttgtggatgggctcgtttgactaacagattgttgtgtgaattgttgggttcatgttaactctgtgaaaaccattcattcatatcatgttgtccccccttccatcatcagggggacagggg

SEQ ID NO: 2916 - DNA, 2477 bp, Oryza sativa
aaatcaacaaaaaaatcaggtccccgttgaagaaaccaacaaaagaacagaaaaaccccacacataaaacacgcgacaaccaccaccaccaccttcccccaacctccgatttccaaatccagttgtcttcttcttcccccgagccgcggccgcgttgccagctcagcttcgaacccccccccatttctctccgcttctccttctcctcccctcgcactcgcctccccaattttaaactcccttctctctctctctcgtcgtcgtcgtccaccgccgcaaaggggtctcgtctctctcgggggcgatggcggcgtcgtcgtcgtcgtcgtcgtcgatggcgtcgccgagggggaggtcgatccgggagacggtgctggagacggtggcggcgtaccaccagcagcagaggatgaggcgcaagttcaggaagagcctctcctacgcgggggagctgtcgtcggcggggcgcgcgcgaggggagggcggggcgtcctcgtcggcgtccaccacctcgctgtgtggccccgacgaggacgacgagcccttctgggaggaggaggagggcaccgtcgagctcgtccagctcggcgccaaccgggctaagaacgtgctcatcctcatgagcgacaccggcggcggccaccgcgcctccgccgaggctatcaaggacgccttccgcatcgagttcggcgacgattaccgggtcttcgtcaaggatctgtgcaaggatcacgcggggtggccgctgaacaacatggagagctcgtacaagttcatggtgaagcatgtgcagctatggaaggtggccttccacaccacatcgccgagatgggtccattgcttctacctcgccgcgctcgcctcattctatgccaagaaggttgaggctggactcaagaagtacaaaccagatattataattagtgtccaccccctcatgcaacacattcctctatgggtactcaaatggcaagggctacaaaatagagtggtctttgtcactgtcatcacagacctcaacacttgtcaccctacatggttccatgctgatgtcaatagatgttactgcccatcggaagaagttgccaagagagcagcactggatgacctacaaccttctcaaatccgtgtgtttggccttccgattcggccatcattctgccgagccgttcttgttaaggatgatttgaggaaggaacttgaattggatcctgagctgcctgcagtattgctgatgggaggtggagagggcatgggtcctgtcaagaagaccgcaaaagcccttggagagtcgttgtttgacaaggagcttggaaaaccaattggacagttaattgtcatttgtggtcggaacaaaacgctgagctcctcattgcaggctcttgaatggaaaataccaattaaggttaggggatttgagacccagatggagaaatggatgggggcttgtgattgcattataacaaaggctggaccaggtaccatcgccgaagccttgattagagggttgcctatcatccttaatgacttcatacctggacaggaagttggcaatgtcccttatgttgtggacaatggtgctggtgtcttctccaaaagttctagggaaactgctaaacttgttgcccgctggtttggtccagattctgatgaactgaagaggatgtcagaaaaagcgttaaaactggctcagccagaagcggtgtttgatattgtcagagacatccatgagctatctcgggagcaaggggtgatttcacagatatccagttccttgacatcatcctttttcataccatcgccagaaaccacacctatacaacttatgtgaaaaatccgtgtatagctagaactgcattctttgacctcgtgaaatttgcctttgtcctacaatgtcctgaaaaagaaaaatatgtcaatggatttagctggtttgtttcatctgtctcacggcgttgggatgaggtaagcaggatttcgactgcttttcagtttgtggtctctcatggtagttatgggcttgtttgactgacagctgctcttgtgtaatatccatattcggtttttgttaaaatcattcgttcatatgattttttttaaaaaatcctgtcgtcctttgttcagagggaccagcgatgggctgcaaattgtacactgttagttgatgttggaaagtttaaacctctcgacttgtaacatatccattcatgtaagatccatcgtgactgtaaagtgtatgagacaatgacaaattgtgctagtgagagagtcatgtgcttgttgaaggacagtgagtgatctatcaattgagaattcttacctgcaccgtaaggagctaatgctggcctgcaacaatagaatgttcttttttttttgtctggccggccgcagttctgctttgctcactgagccatcagccatgccaaaacaattgttcgcagtgcttaccccatttaaaccaaaaaaaaaaaaacaat

SEQ ID NO: 2917 - DNA, 2365 bp, Brachypodium distachyon
ctcctcaatcatcgcagcaacaacgaactcctccccaattcccagatcagaaattcagaaaccaacaaaagagcagagcacacgcataaaacacgcgacgacaaccaccgccgttccaaacctccaaaattccagttgtgtcttccggccgcggcggccttgccagctcggagcccttccttccccccatctctctcctccgtccctccattgaatccattcccccggccccctagccaattttaaacaacaagccctcctctctctgcgctgccccccaccaccaccgaaggagagattgagggagagagggaggaggaggacagccggcgcgcccgtgtggcccgcgcgcgaccgatcggatggcggcgtcgatggcgtcgccgcgggggcggtcgatccgggagacggtgctggagagcgtggcggcgtaccagcagcagcagcggatgcgccgcaggttccgcaagagcctctcctacgccggggagctctcctcggcgggccgcgccggcggcggggacggcccgtcctcgtcttcgtccgcgtccgtctcctcgctctgcgggcccgaggaggacgacgagcccttctgggaggaggaggagggcaccgtcgagctcgtgcagctcggcgccaaccgcgccaaaaacgtcctcatcctcatgagcgacaccggcggcgggcaccgcgcatccgccgaggccatcaaggacgccttccgcatcgagttcggcgacgactaccgggtcttcgtgaaggatctgtgcaaggatcacgcggggtggccgctcaacaacatggagagctcgtacaagttcatggtgaagcatgtgcagctctggaaggtggccttccacaccacatcgcctagatgggtccattgcctctacctcggctccctcgcctcattctatgccaagaaggttgaggctggattgaagaagtacaagccagacataataattagtgtccaccccctcatgcaacacattcctctatgggtactcaaatggcaaggtctgcagaacagagtagtattcaccaccgtcatcaccgacctcaacacttgccaccctacttggttccatgctgatgtgaatagatgttactgcccatcagaagaagttgccaagagggcagaaatggatgaactgaaaccttctcagatccgtgtgtttggtcttcccatccgaccatcattctgccgtgctgttcttgttaaggatgatctacgaagggaacttgaaatggatcctgagttaccagcagttttgctgatgggaggtggggagggcatgggtcctgtaaagaagaccgcgaaagcccttggagaggcattgtttgacaaagagctcggaaaacctattgggcagcttgttgtcatttgtggtcggaacaaaacactgagctcctcattgcaatctcttgaatggaaaatgccagtaaagattaggggatttgagacccaaatggagaagtggatgggggcttgtgattgcattataacaaaggctggaccaggtaccatcgctgaagccttgattagggggcttcctatcatccttaatgacttcatacctggacaggaagttggcaatgtcccttatgttgtggacaatggtgctggcgtattctccaaaagtcccaaggaaactgctgcactcgtcgccagttggtttggtccaggcttggaggagcgcaagagaatgtcagaaaatgctttgaagttggcccaaccggaagctgtgtttgacattgtcagggatatccatgcgctctctcaggagcaaggtgtgatatcacagatctccagctccttgacatcatcgtttttcatacaatctcctgaaaccacccccatccaacttatgtgaagtctcaaactgtgtacataggtagaattgcaatacatctcttgcaccttgcatatgccctacagtatatcctagattgcctgtttgtttcatttgttgacggggttccactgttttctgttcatggcttcttgtgatagtttttatgggctcgtttgactgactgacaactgctcctttgtaatattgtgttcatgtaagatttgtgaaaaatcattcattgacatcattctttcatgtctgtcgttaccgaatggggggccgtggttggcttgtaaagtatgctcagttttgtggattgaaggtcttagattcccttttcgtgtaatccatgttaggattactgtaaagaagtgcacaatatgatacaaaatttgagagtggaagtcttgtatttgttgaagataatgagtgatattcatatatgcattctcttgactggaagatactgtgagagttgtagaccggagactaccagccaaagttgt

SEQ ID NO: 2918 - DNA, 2552 bp, Hordeum vulgare
caccaaccaacgtcgacaatccccaatccccaaatcatcagaatcagaagccaccaaaagagcgagcgagcgagcgagggcacacgcacaaaacacgcgacaaccaccaccaccgccgttcccgtccccgtccccgtcccgtcccgtccccaacctccaaaattccagttgtctctcccggccgcggccgcgccagctccccctctcctccgcccctccgccattccctcctgccccctcgccaattttaaacgcggccgcaccccttcctgcgcctgcaccctcggcggcgatccggggccaggcgggcgggcgcgatggaggcgtcgacggcgtcgccgcgggtgcggtcgatccgggagacggtgctggagagcgtggcggcgtaccaccaccagcagcggatgcgccgcaggttccgcaagagcctctcctacgcgggggagctctcctccgcgggccgcgcctcctcctcctcctcctccccgtccgcctccctcgcctcgctcgccgggcccgaggacgacgacgagcccttctgggaggaggaggagggcaccgtcgagctcgtccagctcggcgccaaccgcgccaagaacgtcctcatcctcatgagcgacaccggcggcggccaccgcgcctccgccgaggccatcaaggacgccttccgcatcgagttcggcgacgactaccgggtcttcgtcaaggacctctgcaaggaccacgccggctggccgctcaacaacatggagagctcctacaagttcatggtgaagcacgtgcagctctggaaggtggccttccacggcacatcgccccgatgggtccacaacttctacctcgccgccctcgcctccttctacgctaagaaggttgaggctggattgaagaagtacaagccagatataataattagtgttcaccccctcatgcaacacattcctctatgggtactcaaatggcaaggtctgcagaacagagtagtcttcgctactgtcatcactgacctcaacacttgccaccctacatggttccatgctgacgtgaataggtgttactgcccatcagaggaagtagccaagagggcagaactggatgacctgaaaacttctcagatccgtgtgttcggtcttcccattcgaccatcgttctgccgtgctgttctagttaaggatgatttgcggaaggaacttgaattggatcctgagctaccggcagtgttgctgatgggaggtggagagggcatgggtcctgtaaagaagactgcaaaagcccttggagatgtattgtttgacaaagagcttggaaagccgattgggcagcttgttgtcatttgtggtcggaacaaaacactgagctcttcattgcaggctcttgaatggaaaatgccaataaagattaggggattcgagacccaaatggaaaagtggatgggggcttgtgattgcattataacaaaggctggaccaggcaccattgctgaagccttgattaggggtcttcctatcatccttaatgacttcatacctggacaggaagtcggcaacgtcccttatgtcgtggacaacggcgcaggcgtgttctccaagagccccaaggaaaccgccgaacttgtcgcccactggttcggtccaggctcagaggaccgcaagagaatgtcggagaacgcgttgaaattggcccagccggaagccgtgttcgacatcgtcagggacatccacgagctctcccaggagcaaggggtgaaggcgcagatctccagctccctgacatcgtctttcttcataccatcccctgaagccagcagccattgccccagccccatcccgctggtgtgaagccttggaagatgtgtacatagctagagagaaccgcaacacctctttgcacctttcatatccatgcaaagaaaagaaaagaaagaaagatctggcaagtgatttggcccggtttgtttcatctcttgtcgcggggatttcaatgttgtctgttcatgggggattccactgttgcggaagattttatgggcttgttttgactgaaaagcgctcttgtgcaatattgtgttgctgtaaagtttgtgagaaaaaatatcattcgttgaacatcattcttttacggttccctacttgcacattggggggtaaccggtggttggcttgtcagctacactcaattttgtggattggatttttttgtcatgtaaattatgctagttgccactgggccactgtaagaagtgtacattatgatagacgtgatggtgaaagtgtgagtggaaattgtttgattttgttgaagataatgggtgatgcacatacatgttgccttgtttggtagttctcagtcgttgaagggctggtagcatcttttggtgtcctaccattccagatttgtttgactgcttgccatgcactcctatcttccgcactgaaggccgtaacaatgcatatagctgcagcaattcttgctgttgccattttgtctaaacaaactgatggagcatggagctaacggatgttggatcttgttgtcgtagaaggtttcagaaa

SEQ ID NO: 2919 - DNA, 2168 bp, Secale cereale
cgcccacacccgcccgtcccgtcccccaacctcccaaaaaattccacgttcgtacgtccgccctccggcctccctccctccctccctcgccacgccacgctccccccgcccctcccctccgcccctccgccattccctcccgcccgctcgccaatttcaaacgctctcccgccgccagcggcgatccggggccgggcgcgatggaggcgccggcggcgtcgtcgccgcgggtgcggtcgatccgggagacggtgctggagagcgtggcggcgtaccaccagcagcagcggatgcggcgccggttccgcaagagcctctcctacgcgggggagctctcctccgcgggccgcgcctcctcctcctccccgtccgcctccctcgcctcgctcgccgggcccgaggacaacgacgacgagcccttctgggaggaggaggagggcaccgtggagctcgtgcagctcggcgccaaccgcgccaagaacgtcctcatcctcatgagcgacaccggcggcggccaccgcgcctccgccgaggccatcaaggacgccttccgcatcgagttcgccgacgactaccgggtgttcgtcaaggacctgtgcaaggaccacgccggctggccgctcaacaacatggagagctcctacaagttcatggtgaagcacgtgcagctctggaaggtggccttccacggcacatcgccccgatgggtccacaacttctacctcgccgccctcgcctccttctacgccaagaaggttgaggctggattgaagaagtacaagccagacataataattagtgttcaccccctcatgcaacacattcctctatgggtactcaaatggcaaggtctgcagaacagagtagtctttgccactgtcatcactgacctcaacacttgccaccctacatggttccatgctgatgtgaataggtgttactgcccgtcagaggtagtagccaagagggcagaactggatgacctcaaaagttctcagatccgtgtgttcggtcttcccattcgaccatcattctgccgtgctgttcttgttaaggatgatttgcggaaggaacttgaattggatcctgagctaccagcagtgttgctgatgggaggtggagagggcatgggtcctgtaaagaagaccgcgaaagcccttggtgatgcattgtttgacaaagagcttggaaaaccaattgggcagcttgttgtcatttgtggtcggaacaaaacactgagctcctcattgcaggctcttgaatggaaaatgccaataaagattaggggattcgagacccaaatggagaaatggatgggggcttgtgattgcattataacaaaggctggaccaggcaccattgctgaagccttgattaggggtcttcctatcatccttaatgacttcatacctggacaggaagttgggaacgtcccttatgtcgtggacaacggcgcaggcgtgttctccaagagcccgaaggaaaccgccgaacttgtcgcccgctggttcggtccaggggcggaggaacgcaagaggatgtcggagaacgcgttgaaattggcccagccagaagccgtgttcgacatcgtcagagatatccacgagctctcccaggagcaaggggtgaaggcgcagatctccagctccctgacatcgtccttcttcataccatcccccgaagccagccattgccccagccccatcccgctcgtatgaagccttggaagatgtgtacatagctagagcaccgcaacacctctctgcgcctttcatacatccttgaaaagaaaagaaaagaaaaaaaaaggaagggaaaacgtggcacgcgatttgtcctggtttgtttcatctgttgtcgtcgcggtcgggggatcttgatgttttctgttcatggcctcccgccgtacttcttacggggcttgtttgaccgacgacaggtgctcttgtgcgatgctgtgttggtggtgtaaagtttgtgaaaaaatcattggttgaacatcattcttttgccgttccctcttcacatgcggatggggggatcactggttggctggcttgttagctgcggtcatttttgtggattggagtttttttgtttgttcgtgtaaattatgcttgttgccactgggccgctgtaagaagtgtacattatgacaaaagcgtgag

SEQ ID NO: 2920 - DNA, 1696 bp, Triticum aestivum
ccgccccgccccgcccctccgccattccctcctgcccgctcgccaattttaaacgctttccccagccgccagccgctcgctcgcccggcggcgatccggggcggggcgcgatggaggcgccgacggcggcgccgcgggtgcggtcgatccgggagaggtgctggagagcgtggcggcgtaccaccagcagcagcggatgcgccgcaggttccgcaagagcctctcgtacgccggggagctctcctccgcgggccgggccggcgcctcgtcctccccgtccgcctccctcgcctcgctcgccgggcccgaggacgacgacgagcccttctgggaggaggaggagggcaccgtggagctcgtccagctcggcgccaaccgcgccaagaacgtcctcgtcctcatgagcgacaccggcggcggccaccgcgcctccgccgaggccatcaaggacgccttccgcatcgaattcggcgacgactaccgggtgttcgtcaaggacctgtgcaaggaccacgccggctggccgctcaacaacatggagagctcctacaagttcatggtgaagcacgtgcagctctggaaggtggccttccacggcacatcgccccgatgggtccacaacttctacctcgccgccctcgcctccttctacgccaagaaggttgaggctggattgaagaagtacaagccagacataataattagtgttcaccccctcatgcaacacattcctctatgggtactcaaatggcaaggtctgcagaacagagtagtcttcgccactgtcatcactgatcttaacacttgccaccctacatggttccatgctgatgtgaataggtgttactgcccatcggaggaagtagccaagagggcagaactggatgacctaaaaagttctcagatccgtgtgttcggtcttcccattcgaccatcattctgccgtgctgtccttgtcaaggatgatttgcggaaggaacttgaattggatcctgacctaccggcagtgttgctgatgggaggtggagagggcatgggtcctgtaaagaagaccgcaaaagcccttggagatgcattgtttgacaaagagctcggaaaaccaatcgggcagcttgttgtcatttgtggtcggaacaaaacactgagctcctcattgcaggctcttgaatggaaaatgccaataaagattaggggattcgagacccaaatggagaaatggatgggggcttgtgattgcattataacaaaggctggaccaggcaccattgctgaagccttgattaggggtcttcctatcatccttaatgacttcatacctggacaggaagttggcaacgtcccttatgtcgtggacaacggcgcgggcgtgttctccaagagccctaaggaaacggccgaacttgtcgcccgctggttcggtccaggcgcggaggaacgcaagaggatgtcggagaacgcgttgaaattggcccagccggaagctgtgttcgacattgtcagagacatccacgagctgtcccaggagcaaggggtgaaggcgcagatctccagctccctgacgtcgtccttcttcataccatctcctgaagccagccattgcccaagccccatcccgctcgtgtgaagccttggaagacgtgtacatagctagagcaccgcaacacctctttgcacctttcatatccttgaaaagaaa

SEQ ID NO: 2921 - DNA, 1321 bp, Panicum virgatum
ctctccaaatgaatttttttcaccacagtagatcgtacgggacccagacagtattcactatggttcctttcttcttcttatttattttgaagaattgccactatgatatcaaggctgtgtgaactgaaaacccaattgacgccacatgtaagtctagtacgtacagcaggtgaaatggccctatccgccatgaatttctcctttgaaaaatccacaaatctctcgatggatcggacaaatgggcagacaaaaaccacgatcagatcagacagagacagacctgcgccaccgtgatcgatgggccccacgaatacatcaactacacttccggcctatatgatgatcttgatccgcatccactcccctgtgtgcctttccccgcagctcagtcagtcacccagtcgccccataccttgatcggattcgcctccatggccaagctcgccgtcctcctcctccttgccgtggcggcctccgccaccacgctggcgcgccccctcgagaccccgactcggatcaagctgatccgaggcgcggacgccggcggcgtgtccggcgacagcatggagtgcgtgtacacggtgttcatcaggacggggtcgatctggaaggcggggacggaatcgaacatcacgctggagctggcggcggcggacggcaacggcgtggggatctcggacctgccctcctggggcgggctcatggggccgggccactcctacttcgagcgcggcaacctggacatcttcagcggccgcgggccctgcatggccaagacgccgtgctggatgcgggtggcctccgacggcacggggccgcaccacggctggtactgcaactacgtcgaggtcaccgtcacgggcccgcacaaggggtgcgcgcagcagctgttcaccgtcgagcagtggctcgccactgacgccccgccgtacaagctcgaggccgtcgtcgacacctgccccgccgccgccgccgcaggcgccgccgtcgcgtgagcccgtccgaccggccgaggagggagcgttcggtgacgcgtcgtaataagctgcgtggggccgtgtcacctcgtgattaactgcgccacgacacgaggtgctttgctggggtcgtgcagcgagtcgaataatcgggagccgtctcgcgagggacggatcgatgtgtagtgatgactagtgagtaggcttgatggttttgttgataccttttgtggtaaagcggatcttgatccgtgttttgatctttgaggaatggtgatccgcgttttcgtgcgtgtttcctgctgagactgcctacgattttgcatagcgatccaagtttcgcg

SEQ ID NO: 2922 - DNA, 935 bp, Panicum virgatum
cccgttccccgcagctcagttcaccacacccagtcgctccatacctcgatcggattcggatccatggccaagctcgccgtcctcctcctcgccgtggcggcctccgccaccacactggcgcacgccctcgagcccccgactcggatcaagctgatccggggcgcggacgccggcggcgtgtccggcgacagcatggagtgcgtgtacacggtgttcatccggacggggtcgatctggaaggcggggacggactcgaacatcacgctggagctggtggcggcggacggcaacggcgtggggatctcggacctgccctcctggggcgggctcatggggcccggccactcctacttcgagcgcggcaacctggacatcttcagtggccgcgggccctgcatggcgaagacgccgtgctggatgcgcgtggcctccgacggcacggggccgcaccacggctggtactgcaactacgtcgaggtcaccgtcaccggcccgcaccaggggtgcgcgcagcagctgttcaccgtcgagcagtggctcgccaccgacgccccgccgtacaagctcgaggccgtcgtcgacaactgctccgccgcggctggcgccgccgcggcgtgagcccgtccgtccgggtccggccggccgaggagggagccgccgtttggtgacgcgtcgtaataagctgcgtggggccgttgtgtcacctcgtgattagcgtgcgccacgacacgatgtaatggccggcgatagatgtgcttgctggggtcgtgcagcgagtcgaataatcgggagccgtctcgcgagggacgatcgatgtgtagtgagtaggcttggtgttcttgttgatgcccttttttttgtggtaaaaagcggatcttgatccgtgttttgatctttgtggaatggtgatccgcgttatcgtgcgtgtttcctgc

SEQ ID NO: 2923 - DNA, 1305 bp, Oryza sativa
aacagttgccgccagatgtatgaagcaggtggagtagccatggcatatggcccatggggcctatccagcatgattttctcgttagaataatgcgcgttcatgtccgatcgagacgaatgcggccgaagaaattttccgcaccatcaacactgtgacagcgaggcccccaccgccacgagcccacgactcatcaactgcttccatttttatactgatccacatccactccccccgatctccgcagctcacacaccgaaacaacacacatcgccactagctccctcgatccgattcggatcggatccatggctaacctcgccgcctccctcctcttcctcctcgccgtcgcgtcgtccgccaccgtgccagcgcatgggcgccgcgacctcctcccgactcgcatcaagctggtgaggggagccgacgccggcgccggcgccgtggccggcggggacaagatggagtgcgtgtacacggtgtacatccggacggggtcgatctggaaggccgggacggacgcgaacatcacgctggagcttgccggcgcggacggcaacggggtggggatcacggacctgccgtcgtggggcggcctgatgggggagggccactcctacttcgagcgcggcaacctcgacatcttcagcggccgcggcccgtgcatggccgcgccgccgtgctggatgcgggtggcgtccgacggcaccggcccgcaccacggatggtactgcaactacgtcgaggtcaccgtcacgggcgcgcacaaggggtgcgcgcagcagctgttcaccgtcgagcagtggctggccaccgacgccgcgccctacaagctcgaggccatccgcgacaaatgctccgccgcaggagcgggcgccgccgcggcgtgagcgagtgacgcggccacgccgtgggaaataagctcgtacgttatctgtggtgagtggcatctgtagactgtgggggggtgttcatgttttgatttgtaaagatggtaatccgcgtgcgttatcatgtacggtggatgctacagactatccgactaataactttgcgagtcgccggtgatgaaccggcgttgtgtttcctcggttacgcatcgtcgtgccgcctcgtcatacagaacaaaatggaggaaaaatcgcctaagacagcaacgtaaagtgaaataaatccagctcaatgacaacaatggaaaactaaataattaatcggtattgctaaaaatatgtcgccacaaattatgatggatttcagtcggttgtttcaaccatcagatgcggatgcagaaatcaccgcatgtgtacg

SEQ ID NO: 2924 - DNA, 650 bp, Pennisetum glaucum
gacctgcgcgcgccaccgtgacgcgtgggaaccacaaacccatcaactacgcgtctgtcctatatgatatgatccgcaccccactccccattccccgcagctcatcagtcacccagtcgacccaaaccctgatcggattcgcatccatggcaaagctcgccgtcgttctcctcctcctcgccgtggcggcctccgccaccgttctggcgcacggccgcgacctcccgactcaaatcaagctgacgagaggcgcggtcgccgccagcggcgggggcgagggcggcgacagcatggagtgcgtgtacacggtgttcatccggacggggtcgatctggaaggccggcacgaactccaacatcacgctgcagctggcggcggcggacggcaacggcgtggggatcacggacctgccgtcctggggcgggctgatggggccgggccactcctacttcgagcgcggcaacctggacatcttcagcggccgcgggccgtgcatggcgaggccgccgtgctggatgcgggtggcctccgacggcacggggccccaccacgggtggtactgcaactacgtcgaggtcaccgtcaccggcccgcacaaggggtgcgcgcaggagctcttcaccgtcgagcagtggctcgccaccgacgcc

SEQ ID NO: 2925 - DNA, 1410 bp, Sorghum bicolor
aaaactgcgatcggatcggatcagcgccacagtggcaagtgggccccacaaatgcataaacaacacttccgtcctataagatccacaccgcatccgctcctgcattccccgaagctcagactcatccagtcgccccacacgccgattggattcggatcccaatggccaagctcgccgtcttcctcctcctcctcgccgtggccgcatccgccaccgtgccggcgcacggccgcgatcccccgactgagatcaagctcatccgaggcgcggacgccagcggcgtgggcggcgacagcatggagtgcgtgtacacggtgttcatccggacggggtcgatctggaaggccgggacggacgcgaacatcacgctgcagctggccggcgcggacggcaacggcgtggggatctcggacctgccctcctggggcgggctcatggggcagggccacgcctacttcgagcgcggcaacctggacatcttcagcggccgcgggccctgcatggcgaagccgccgtgctggatgcggctcatctccgacggcaccggcgagcaccatggctggtactgcaactacgtcgaggtcaccgtcacgggcccgcacaaggggtgcacgcagcagctcttcaccgtcgagcagtggctcgccaccgacgccgcgccctacaagctcgaggccgttcgcgacctctgcagcgccgatggcaagagcgtcgcggcggcgtgacgtggccggcggccggcagaggagagagagtacacgcgcctggatcgacctgggtggcttggttggttggtggcaagtcgtaataagttgtgggccgcgacacgacgcgctcgtgattagagtgcggcacgatgcatgtatgatgatgatgacgatgatgaactggagtcgtgcgcggcgagtcgaataatcgggagccacctcgcgtgatgtggtcatgtggagcgtgcaggtttggttgtttttgtagatgaacgtgttggatcttgatccatgtgtttgggaaatggtaatccgcgttatcatccctgcttcttgcagctgccaatgcttggatttggatactagctgaagtttcttctccaagatccatgtctttatcattgacagctccgaccttgattttcatcctagttgaagaattattaagcacatcgatggtacaaggatctggatggcaaaaatgcgaggtttatcaagtaaatttgggtatagacatctagtatagtattcggaaatggcacagcagcatccttggatcaggagattgatttttctttttccttataagaggtataggagtgggcacaaaacttgatactcgaatcagtagcacattagcagcatttttggtaactcgaaattctcaaaacccttattttttcggataacccgaatacccaag

SEQ ID NO: 2926 - DNA, 4688 bp, Brachypodium distachyon
cgccccgattcccgttcgctaatggaagagtggaaagcaaacaaaccatcaccaaaccccagccccgtcgcccccctcggcgtctccggcgatcgccgccgccgcgccgaccttaatccgaaccccgccggctcccttttcaccaacccttggcgctcgtagtctgatgcttcccaccccatgggcccccacattccgcttccccttcgccgccgcctccacctcctcctccttgccctcctcgccgtcgcatcggggaaccctagccgtggggtttacgatcggggggacgaggaggcggatgcgtactcgatcctgacgttccacgactacacgacgccgccgccgcccccagctctgccgcccccgccggccgccccggcggcgacctgcgccggcgacctcggcggcgtgggagacttcgacacgcgctgcgtcgtccccacgtccgtgcggctcggtggcgccggcgtctacgtcagcggaaatggcagcctcttgctcgtcgatggcgtcgctctcacctgcgagaggccagggtgcgtcttctccggcaatttgtccggagaaatccgctttggtcgtggtgcccatgttgtggctgcttgggtctcccttgctgctagcaaaatcattctgagtaacgatgccctcatcaacaccactgcactggctggagacccgccggataagaccagtggtgtacccactgggacgtatggagatggtggggggcatggcggccgtggcgccagctgctatgtcaagaagggtcaagcacaggaggactcgtggggcggcgatacctacgcatggcctaatctcaagaccccagacagctatggaagcaaaggggggtctactagcgtcgaaaaggattatggtggtgggggtggcggagtagtgtggttgtttgcagaggagattgtcatgaatggaacggttcttgctgatggcggagatggtggtaccaagggtggaggtggatccgggggaagcatctatctaaaggctgcaaccatgcaaggaggcggcaaaataagtgcctgtggaggcaatggtttgtcggggggaggtggaggacgtgtatctattgatgttttcagtaggcatgatgacacccatttttttgttaatggggggaggagttcaggatgtttggacaatgcaggagcagctggaacactttatgaagaagtacctaagagtattactgttaacaacaataacttgagcacacaaactgatacagttttcctagaccccccatacgagccactctggacaaatgtttttatcaagaatcatgcaaaagtttctcttcccttgcgttggagtcgtcttcaggctcaaggacaaattagtcttctaactcaggctactctaacttttgggttgacacattatccatattcagagtttgaactgttggctgaggaacttcttatgagtgattccacagtacaggtctttggtgctctacgaatgtccgtaaagatgctcctcatgtggaactctagcatgctgattgatggtggccgagattcaggagttgcaacttctttactggaaggtagcaatttgatagttttaaggcaatcatcggtgatacattctaatgccaatcttggaattcacggtcaaggcgttctgaatttatctggaaatggagacacaatcggggcacaacgtcttattttgtcactgttttacaacatacggatatgccgtgttgaagatattgatgttcatggtcatttgcatggaactgtcattaatttcaatagagcaagacgcgtcactgtgaagccaaacgggaccattagtgcaacaggattaggctgccgaggtggaattggacgaggaggaatgttaagcagtggtcttagtggtgggggtgggcatggtggtaaaggcggggacggaatttacagtggcagtcatgcaggaggtggagctgcatatggtagtgctgatttaccttgtgaacttggcagtggcagtggtaatgtcagtacaaaatcttcaacggctggtggtggtataatagtgatgggttctctggagcaatctctgcctagtctctttgtctctggttcagtggaggcaaatggtggcactttcactggtctggcaactaaagctgcaaatggaggacctggtggtggttctgggggcacaattcttctatttgtgcggactttatccctagagaagggctctgtactttctactgttggtgggattggaaacaatggtagcggtggaggtggaggtggtcgcattcatttccactggtctgacattccaactggagatgactatgttccttttgcaactattaaaggatcaatacttacgagaggaggggttgttgaaggccaaggttttcctggtgagaatggcacagttacaggaaaagattgcccgaaaggtctttatggtatattttgcaaggagtgtcctttaggaacatacaagaacgttactggatcttcgaaatccttgtgttctccatgccctccaaatgagctccctcatcgggctgtatacttaaacatccgaggaggtgttgctgaaaccccatgtccatacaaatgtgtgtcggacagataccgcatgcctcactgttttactgcccttgaagagctgatatacacttttggtggaccttggtgttttggcctgcttctttcaggcctccttgtaatattagctcttgttttgagtattgctcggatgaagtttgttggcactgaagagtttcctggaccagcaccaactcaacatggctcccaaattgatcattcttttcccttcctagaatcactgaatgaggtattggaaacaaatcgggccgaagaatctcactgtcatgtgcacaggatgttcttcatgggtccaaacaccttcagtgaaccttggcatctccctcacacgccgccagagcaaattacagagattgtatatgaggatgcatttaacaagtttgtcgatgagatcaacgttctggcagcttatcagtggtgggagggatcaatttgtagtatcctgtgtatactttcctaccccttggcatggtcctggcaacagtggcgcagaagaaaaatgctacagagactacgcgagtttgttcggtctgaatatgaccattcatgcttaaggtcctgccggtcacgtgcactttatgaagggcttaaggtggctgctactccagatttgatgctgggttatttggattttttccttggcggggatgagaaaaggcccgatctccccactcgtcttcatcaacggtttccgatgtccttgatttttggcggagatggaagttacatggctccattttcacttcacagtgatagtgtggtcacaagtcttataagtcaggctgtaccatcatcaatctggcaccgtcttgttgctggattgaatgcccagttgcgtttggttcgtcgtggaaatctgaaagcaacttttgttcctgtgctcaaatggcttgaaactcatgcaaatcctggcttgaacacataccatgtgcgtgttgaccttgcatggttccaagctacagcattagggtattgtcaattcggtcttgtcattcatgctgtaggggcagaagaagtgtctgctgaacttcaaggtggctccagaattaaaatcgatcaacatttactaaaccagaatgcacatgctgattctcaactaggctactcaaggaacaatgatgcatatatgtgtaaaagaataaccggtggagttctcaatgttgacaacttggtgatgctcaaagacaggagagatttgtttcaccctttctctctgattttgcacaatactaaaccggttggacatcaggatcttgttggtttggtcatctcaatattgcttcttgcggactttagcttagtgttacttacttttctccagctatattcatattccatgatagatgttttgttggtcttgtttgttcttcctcttgggatcctggcaccatttcctgctgggataaatgctctctttagccatggcccacgccgctcagcaggccttgctcgtgtgtatgcgttgtggaacattacgtcgctcgttaatgttattgtggcatttgtatgcggacttgtgcattataagtcgtcaacgaaaaggcatccaagcatgcagccatggaatttgggcggggatgaaactagctggtggttattcccaactgggcttgtgttgtgtaagtgcatccaagcaaggcttgtcgattggcatgtctccattttagagatccaggatcgcgcggtatatagcaaagacccaaatatgttttggcaatgatgcatttggttcactggagtgctgatggagctttttgcaactcgagtttttgggagttgataaaaggaaggctagaaaattagtccattctttgtcgaccaggcagaggaagcaagtacaaagtagaatgcttacagatgcatgcttatagtttactcttaatcttgtcgaaacacttttttttttcttgtacataaaaaggtttaattgatagattctttgtaggatgtagaaaccatagtcttggaattttttctggactaatcactgaaagatagtgggaaaaatatttcttttgtttttagctttgtttctttctcattctttgccttgattttttcatgctcgggattaacata

SEQ ID NO: 2927 - DNA, 4714 bp, Oryza sativa
caccgccccgcttcgattcccattagcgacggaagcggaaaccgagcaaccaccaccaaaccccaaccccccctcgccgtctccggcgatctccgccgccgccgccgccaatccgaaacctcgtcgagtaccccccacctaccctccgggcgctgggtcctctgatgcttcccaccccatggccacccacattcccctcgcccgcctccgcctccgcctccgcctcccccacctcgccctcgccctcctcgccgtcgcatcggggaaccctagcctcgggggtttcgatcggggggacgcggaggcggaggcgtactcgatcctgaccttccacgactacaccccgccgccgcccccctcgctgccgccgccgccgcccgccccgtcggcgacctgcgccggggacctccgcggcgtgggcgacctcgacacccgctgcgtggtccctgcctccgtgaggctccgtggccccggcgtctacatcagcgggaatgggacgctggtgctcgtcgacggcgtcgccctcacctgcgagaggcctgggtgcgtcgtctccgccaatttgtccggcggcatcttcttcggccgtgaggcccgtgtcgtggccgggtgggtttctctttcagctaccaacatcacgctctccagtgatgctgtaatcgacaccaccgcgctcgctggcgacccgcctgataagaccagcggcgtgcctactgggtcgtatggtgatggcggtggccatggcggccgtggtgctagctgctacgtcaaggaggggcaggcgcaggaggattcgtggggcggcgatatgtacgcttgggctgaactcaagacccccaatagctacgggagcaaaggcggttctaccagcgtcgagaaggactatggtggtggtggtgggggtgtagtgtggttgttcgccaaggatattatgatgaatggaacaattcttgctaatggaggagatggtggcaccaaaggtgggggtggctctgggggaagcatctatctcaaggctaaaaccatgcaaggaggtggcacaataagtgcttgcggaggggatggtttggctgggggaggtggtgggcgtgtttctgttgatgttttcagtaggcatgatgactcccaattttttgttcatggtgggaggagctcaggttgtctggacaatgcaggtgcagctgggactctttatgaagaagtgcctaagagtattactgttagcaacaataacttgagcacacaaactgatacagtttttctagaacccccatatgatccactctggacaaatgtttttatcaagaatcatgccaaagtttctcttcccttgcgttggagtcgtattcaggctcaaggacaaattagccttctatctcgcgctacattaacttttggcttgacacactatccatattcagagtttgaattgttggctgaggaacttcttatgagtgattctacaattaaggtgtttggtgctttacgaatgtctgtaaagatgcttcttatgtggaactctagaatgttgattgatggtggcagagagtcaggagttgcgacttctttactagagggtagcaatttgatagtgttgaaggaatcatcagttatacattctattggcaatcttggaattcatggtcaaggcatcctgaatttatctggagatggagatacgattcaggcgcaacgtcttattttatcacttttctacaacatagtgatatgccgtgttgaagacattgttgtttctggccttgtgcaaggaactgttattaatttcaacagagcaagaaatgtcactgtgagatcatctgggaccattagtgcaacaggattaggctgccgaggtggaattggacgaggaagaatgttaagcagtggccttagtggtgggggtgggcatggtggtaaaggaggggatgctttctacagtggcagtcatgcagggggtggaactgcatatggtagtgctgatttaccatgtgaacttggcagtggtagtggtaatgtaagtacatcatcttcaacagctggtggtggtataatagtaatgggttctttggagcaatctcttccactactctcccttgctggttcaatagaggcgaatggtggcagttttgctggtgcggtgactcatgctgcaaatgaaggacctggtggtggttccgggggcacaattcttctatttgtgagggcattgtccttggaggagggctctgtactttctagcgctggtggggttggaagtaatggtagtggcggaggtggaggtggccggattcacttccactggtctgacattcccactggagatgattatattccctttgcaacagttaatggatcaatacttgcaagaggaggaaccgttgatggccaaggttttccgggtgaaaatggaacagtgacaggaaaagattgcccaaaaggtctttatggcacattttgcaaggcctgtcctttaggaacatataagaacattactgggtctttgaagtccttgtgttctccatgccctacaaatgagctccctcatcgtgctgtctacataagcatccgaggaggtgttactgaaaccccgtgcccatacaaatgtgtgtccgatagataccgcatgcctcactgttttactgctcttgaagagttaatatacacttttggtggaccttggttgtttggtctgtttctctcaggccttctttttttattagcccttgttttgagtatcgctcggatgaagtttgttggcactgatgagttgcctggaccagcaccaactcaacatagctcccaaattgatcactcttttcccttcctcgaatcactcaatgaggtactggaaaccaatagggccgaagaatctcactgtcatgtgcacaggatgtatttcatgggtcccaacaccttcagtgaaccttggcatctaccacacaccccacctgagcagatttctgagattgtgtatgaggatgcatttaacaagtttgtcgatgagataaatgctctcgcagcatatcagtggtgggaaggatcaatttatagtatcctgtgtatactttcataccccttggcatggtcttggcaacagtggcgcagaagaagaaaattacaaagattacgtgaatttgttcgatctgaatatgatcattcatgtttacggtcttgccgttcacgtgctctttatgaagggctgaaggttgctgctacaccagatttaatgctgggttatttagatttctttcttggtggggatgaaaaaaggcctgacctcccccctcgtcttcatcaaaggttgccaatgtcattaatctttggaggcgatggaagttacatggctccattttcacttcacagtgacagtgtggtcacaagtcttattagtcagggtgtaccttcatcaatatggcaccgccttgttgctggattgaacgcccagttgcgtttggctcgtcgtggaaatctaaaagccacatttcttcctgtactcaaatggcttgaaactcatgcaaatcctgctttgaacacataccgcgtgcgtgttgaccttgcatggttccaagctacagcactaggttactatcaatttggtctagttattcattctgtgggaccattcagtagtggccttcaaggtggctctagaatgaaatttgattatcatgcgcaatttcagaacacagatgttgattctcaactagaccactcaaggaacaatgatgctgttatgcttaaaagaataactggcagagttctcgacattgacaacttaaggacactcaaggacaagagagatttattttaccctctttctcttatattgcacaataccaaaccagttgggcatcaggatcttgttggtttggtgatctctatattgcttcttgcagatttcagcttagtattgcttacttttctccagctatattcatattctatgatcgatgtgttgttagtgctgtttgttcttcctcttgggatactggcaccctttcctgctgggataaatgctctatttagtcatggaccacggcggtcagcaggtcttgctcgtgtgtatgcgctgtggaatattacatcattggttaatgttatcgtggcctttgcgtgtggacttgtgcattacaagtcttcagccaaaaggcatccaagcatgcaaccttggaatttgggcggggatgatactagctggtggctgttcccaacaggacttgtgttatgtaaatgcatccaagcaagacttgtcgattggcatgtctctatcttagagatccaggatcgtgcagtttatagcaatgacccaaccatattttggcagtgatggcatttgtatcactgaattgatcatcagaggttttggcaactcgagtttttgggagttgataaaaaggaaggctaggggatgagttgattctttttcggcccgtcagaggaagcgaagtacacaaagtacattgcttcttacagatgcatgcttatagtccatttgttaaccttgtgcagtctcagatttggtttccttgtacataaaaaggttttattgatccattctttgtaggatctggacaccatagaattataaacttacctgagctaatcatagagatgagatggtggggaaagaatgtctcttgttcagaacttttccgagtctcctgccttcatgttgacgtggaaaagagcgagttatcagatttctactccctcc

SEQ ID NO: 2928 - DNA, 5248 bp, Sorghum bicolor
cggaagaagagtggaaagcaaacaagagcggagcggaggccgaacaatcaccaaacccgagccccgaccgcccacctcgccgtcgccggcgatcagccgccgccgccgccgcactaatccctgccttgtccttatcacaaacccgcggcactggagctctgatgcttcccaccccatggccttccacattcccctccctcaccactggcttcctcctcctccttgccctcctcgccgtcgcatcgggggccccagcccctagcctaggaggtttcgatcggggggagccccccggcgcggacgaatactcgatccttacgttccacgactacatgccgcccccgccccccgcgctgccgcctccgccggcggccccggcggcgacctgcgccggggacctccacggcgtgggagaccttgacacccagtgcgtggtccgtgagtcggtgaggctgggcggcggggtgttcatcagcggcaacggcagcctcgtaatcctcgacggcgtcgcggtcacctgcgagcggcccgggtgcgtcgtctctgccaacctctccggtgatctcttgctcgggaacagggcccgcgtcgtggccgggtgggtctcccttgcagcggccaacatcacgctcggcgacgacgcagctatcgacaccaccgcgctcggcggtgacccgcccgaccagaccagtggcgtacccaccgggacgtatggggatggcggtggacatggcggccgtggcgccagctgcttcgttaagaaggggcaggcgcaggaggactcatggggtggtgattcctacgcttggtctgcactgaagactccaaataactatgggagcaaagggggatccactaccgtcgagaaggactatggtggtgggggtggcggtgtcgtgtggttgtttgctgaagagattgtgatgaatggaacagttcttgctgatggtggagacggtggcaccaagggtgggggtggctctggggggagcatctatctgaaggcttccacaatgcgaggaggtggcaaagtaagtgcttgtggaggcaatggtttagctggtggaggtggaggacgtgtttccatcgatgttttcagtaggcatgatgatgcacaaatttttgttcatgtttttctagatcccccatatgagccactgtggacaaatgtttttatcagaaatcgtgccaaagtttctcttcccttgcgctggagccgtattcaggctcaaggacagattcttttagctggtgctactctaacttttggcctgacccattatccatattcagaatttgagctgttggctgaggaacttcttatgagtgattccacaatcaaggtctttggtgctttacgaatgtcggtaaagatgctccttatgtggaactcaagaatgactattgatggtggccgagaatttgctgtgggaacttcattattagaaggtagcaatttgatagttctgaaggaagcatctgtgatacattcaaatgctaatctagggattcatggtcaaggagttctaaatttatctggtcaaggagatacaatagaggcacagcgccttattttatcactgttttacaacatattgatatgccgtgttgaagatattgacgtttctggccttgtgcaaggaactgtaattaattttaacagagcaagaagtgtcactgtgcagacttctgggaccataagtgcaactggattaggttgccgaggtggaattgggcaaggaaaaatgttaagcagtgggcttagtggtgggggtgggcatggtggtaaaggcggcgatggcatttataatggtggtcatgcagagggtggaactgtgtatggtcatgctgatttaccatgtgaacttggcagtggcagtggtaatgtcagtggatcttcaactgctggtggtggtataatagtgatgggttcttgggaacaatctctgccaaacctctccctgtctggctcaattgaggcaaatggtggtaactttactggtttgatatctcatgccacaattggaggacctggtggtggttctggtggtacaattcttctttttgtgcggactttactcctaaagaaggattctgtactttctagtgttgggggagttggaagcaatggcagtggtggaggtggaggcggtcggattcacttccactggtctgatattcccactggagatgattatattccttttgcaactgttaaaggaacaatacttacaagaggaggagtcagtgaagggcaaggtttatctggtgagaatggaaccgtcacaggaaaggattgcccaaaaggtctttatggaacattttgcaaggaatgcccttcaggaacatacaagaatattactggatcatctaagtccatgtgctcaccatgccctccaaatgagctacctcgccgtgctgtatatataagcgtccgaggaggtgttgctgaaaccccatgcccatacaaatgtgtgtctgatagatatcgcatgcctcactgttttactgcccttgaagagctgatatacacgtttggtggaccttggttgtttggtctgcttctttctggccttctcgttttattagctcttgttttgagtattgctcggatgaagtttgttggtactgatgagttgcctgggccagcaccaactcagcacagctcccaaattgatcactcatttcccttccttgaatcactgaacgaggtattggaaactaacagggcagaagaatctcactgtcatgtgcacaggatgtatttcatgggcccaaacaccttcagtgaaccttggcatctcccacacaccccgccagagcagatttcagagattgtgtatgaggatgcatttaacaaatttgttgatgagatcaatgctcttgcagcctatcagtggtgggaaggttcagtttatagcatcctatgtatactttcatatcccctggcatggtcgtggcaacagtggcgcaggagaaagaaactgcaaaaactccgtgaatttgttcgttccgaatatgatcattcatgcttacggtcctgccgttcgcgcgcactttatgaggggctgaaggtagctgctactccagatttaatgctgggttatctagatttcttccttggtggggatgaaaaaaggattgatcttccccctcggcttcatcaaaggtttccaatgtccctgatctttggaggtgatggaagttatatggctccattttcacttcatagcgacagagtgatcacaacacttataagtcaggctgtaccatcatcaatatggcatcgtcttgtagctggattgaatgcccagttgcgtttggttcgtcatggaaatctaaacacatcatttgttcctgtgttcaaatggcttgaaagtcatgcaaatcctgcattgaacacgtaccgtgtgcgtgttgaccttgcatggttccaagctacagcattaggttactgtcagtttggtcttgttcttcatgctgttgggggagcagtgactgctgaacttcaagatggctctataattaaaaccgatcaatattcagtaaaccaaaatacatattctgactctcaaacgggccactcaaggaccagtgatgctctgcgtaaaaggataactggcaccattctcaatgctgacaatttaaggatgcttaatgacaggagagatttgttttaccctctctctcttatcttgcacaatacaaaaccagttggacatcaggaccttgtcggcttagtcatctcaatactgcttcttacagatttcagcttagtcttgcttactttcctccaactatattcatattctatggtgggtgttttattagtcttgttcattcttcctcttgggatactggcaccattccccgctgggataaatgctctttttagtcatggacagcggcggaatcatgtttttatgtacttgcctccgccgccacccctccctgactccgcctgccttgccatcgcagcatcgcttgagcacaccgccagaagcctgtgcgtccgcaaggacagcagcggcagggccttttaccctcttcccatctgtttcctcccatacagcttgacggcaaccatggtgaagtttggtggcagccttccagcccacagcttggtggctagatctgttgccttcttgactggatctggtgtccaaccctggttctggtgctgttcctcgtagatcggttttggggttcctgttgtggtttcctggccgtgaatggtgtgctgcgggcgtgacgactggaggggaggctggagtctgacatagcccctgcagtgtcgtctgcgttggtggacccaagggcggtggctcctctccgtccattggcttccatggctggggcggtggccgagggcggggattctgctggggtggcactggctctggacgctactcagcgcgatcatctcccatcgcttctccgctccctatctccatctcctaggtgtggagaacacagtggggatgctcgtggtgggcgtagtgatagggaaagcccatgccattagtgtctggactttggatgggctttcccacaatcaaggtttccattgacggctagcattgtcagcgtctttgatgccgttaccttcctgaaggcgttgctaggcatttccagtgcttgccgtttggctctgccactgctcctttgttatttttacaggatgtagtctctctctctctctcggtagcttgagatagcctgttgtaggtgtcctcgtcttgatgctttcatcgatggctttcaacaacgtatattttcttgtttcttgacctgctagatagtgttaggtctgagggaggttatacgttttggccattggcaagaggataactaggttgagaatgtttatttgatggagttctttcttatcaagcatcgatgtgatgctctgagtgctgctgtttgcactggaggaatacagtcgcttaatggaggcaatgaggttgaagctcttcagcatgttgtgtgtcgaagaatgaataggataaggacttgctctcttttatctgctccgtgttttgtaccccatttagtggagtgtaatctaagtactacaaatctgttgtaattggctgcacacattcacttgtgaatgttggaggctggaatgtatatcccttttttctaaaagaaaagcaggaatcaggctggaatgttatatcccctttttctaaaaacaggaatgatgttttatgttttttacatacaagtgctctatcactcgcag

SEQ ID NO: 2929 - DNA, 4360 bp, Panicum virgatum
gggaccgtctcgctcgctgctacaacctacaactcgcccaattccccaatccaaacatattcccttctctcacaccccccttccgcgtccgcgctcgccgccgccgccgccgccgccgcgagcacgctactgccgccgccgccgccgcggcagctgcgaataaggctgtccggagccgttgcgggttttgcggatggccggttctgcagttacagatgattccgcggcaagcacaactgggatgagggatgacgaacgcagcctctccggcgattccttgtccgagtggaggtcctgcgaccgggcggactgtgacagcccttcgacgtccccgcccttctgggactccgacggcgaggatgatgaccctggccccaagccttcaggtttattcggacattacacttggaggattgaaaacttctcaaaggagaagaagagagaaatgaaaagcgagccgtttgaagctggtggttacaaatggtatattcttgtataccctcaaggatgtgatgtctctaatcatctttcattgttcctttgcgttgctaatcatgacaaacttctcccaggatggagccattttgcacagttcactatagctgtaggcaatgtagatcctaaaaagatgaaatactcagatactttgcataggttctggaaaaaggagcatgattggggatggaaaaagtttatggagttgtcaaaaattcaggatggttttcttgttgatgatgttcttgaaatcatagctcaagttcaagttatcagggagaaagtggatagaccttttcgttgccttgaccgtccttatcgtagagaattgctccgtgtctatatgacacaagtggagcaaatataccggcgttttgttgaggagcgacgaaataaacttagcaaactcattgaggacacgatgagatggtccagtttttgtggattctggtcagcaattgacccaagcaccaggcatcgcatgtccagggaaaagactgacactatattgaaattcttggtgaagcatttctttgtagaaaaagaagtaacttccacattagtgatggactctttgtatacgagtctgaaggcacttgaataccagatgaatggcaagaaaggcagtacaaaagcagcagacttggaggaattacctgcacctatggtccatattgatatggacatgtttgttttggctggtgatgttataactttgattaaaagagcagcttcagaacccttgccttgtcaacctctagctctcaaggatgacaaaacttcccaaagccgcatgaaggatggaactgctggtgaggtttataaagtttctatggagcgcgaggaaagacgcctaactgagcttggccagaagatacttgagacatttgtgctatctcatatatttagtggaattgaagttgcataccaagaagctgttgctttgaaaagacaagaggagcttattcgtgaggaggaggaggaggcagggcttctcgaaaatcagatgaaggggaagcgtggtggtggaacaaatgagaaggagaagcgtgcgaaaaaaaagcaggccaaacaaaagaagaacaatcgtaaggttaaagacaaggaaagagatgagaaatgtgaaattaaaattctggaaagacttcatgatgaaattgcagtggacagtagtgatggcttaccagcagtggaagtgacagcaagggttgatgccttggaagaaggttcctcagatggatcagacatgtcaaatagagggaaaaatcagcgtaacaagggcctaagcattgttggctttgctgaagaaggtgatggtcttccctccacctctagtgttgctggtggttcaggccgcaatagttctggcttcagcacagttccaaaattggaccaggatactgttctacttaccttgagagataaacttcgtatgctagggcagcgactgcatgagaagaacattgaggggcaaaaacttcttaaagctcattttgaagctagggatgcgaaagcgaaggaagcagaatcttccaactcatcaagttctttggagaagccacctgatgttccagagagcccaaagcatttgtcggaagctgcagttgatctgaaagctaatggaacaccaaataaggatgtctctgtggtcaatagcatgcgagagggagctgtttcaggcataccagcctctataaatactgaacctgtgactgctgccacatcaaaagttgacctagtttctgacagagataacagattgagttcgaaaatgaaagccaacatagcatctccttgttgctcaaaaccgcctggagttgatttggataaagatgcccctcttccttctaaatccccacgaatcaatagagctgcttcagctccccaaaaactgcctgccgctgataaagcgactccagttcctcccaaatctccacccgtaaacaaagtaccagcagttcaccccaaatctccagtagttgacaaaactccagttcgtgcaaaatctccagcagcagacagagtagctccagttcgtccccagtctccagcagttgacaaagcaacacccgttcgccccaaatcgccagcagttgacaaagcacctccagctggccccaaatcttcagccagtgaaaaagcaactacacttcttcccaaatctacaccagttgacaaagcttctccagctctgctgaaatcaccaacagggggtaaagatgcttacgttccttcaagatcagtgcatgataaatctattcctgctcccccaagactaccgcaagttgacaaagctgccccgccatcctcagaattgcgacaaacttctccaggcactaattctgaaactcaagaagcagctatttccaggaaggtcacagccaccttagtttccgaggttacagcatcaaggccttcgagtgcacctgtgttccccacaccaagatcaactgcaccagctacttcacacgttcacattccttcactgctttctcgctctatgagtgaagcagctgaacgatcagccagtggtccctccccttctgccccatcttatgctcctcagacataccgcaatgccattgttggtaaggctggcctgggtacaacctccacaagccctgcatatcagtcttctctgagccaagataccacccctccacagcctctgtcggcatatgcatcaagtacagcagtcatgatgcctcctgcaggaagatctgatcagttgtcaactaggcatgtattgaagtctgggctgggcaagttagaagcacatgacagctggcagcagtggaaaggtgatagtaacgttgataagcatgtctggagggatcaggctccttaccaacagatgaccaacggtcaagcatatgaacaaccacggagggatgatagttatcagcaagcaagcagcagaggaacagaaaagctcagcaggtatggaggacagcaatctaggcagttccaatctgggacaagcgatggccatgtctggcacccacagcagggcccagtaccagaagaatttccacaccttgacatcataaacgatttgcttgaggaggaccacatcaacggcagtataccagattcattctgtcaagattaccatgtgttcggtcggccattttcgccaagaggcaacttgacagatatggagatggcttctgttagtagtcccggtcggttcaattcaaccgaccgttactatgatgacggattctcaaggtcctatgacatgagtgctatccatgggctgagggaaaggcaatttccctcaatgggttcttattctaacggcctgtccgaaatgagtgtttcaaagccttggctgaatggctctccaaatccagctgtgagccttggtgttggcacaaatggataccaccaccaggttggggactacactaatctggggggcggggtgaacggagtgtccgtgtggcgccgccatgccaacggccgctggtaatgtgatgccctgtacaatcttacagtcggaataatgcttgttgtaacagatgttgggttccgggcctgagctggtgtgccatgtaatttaaaagcttaaagttttaaaaagggaaagaaaagagatacatcctgtaaagtccccgccgtgattaagctaattcgagtgctttttttttctgggtagatgctgtattgtcgttctgctgttattcaaagttaaactgggaactgtaagaaggttaagcggtcggcgattattatgctcttctcaggctagcagaggtactcctcgagtctggtcgcagaggaaactgacctgcgaattgcaattgtggctggccgctggccggtgcgctggataggtaatcaactatatattatcaagaaa

SEQ ID NO: 2930 - DNA, 4183 bp, Panicum virgatum
aggccccaagccttcaggattatttggacgttacacttggaggattgaaaacttctcaaaggagaagaagagagaaatgaaaagtgagccatttgaagctggcggttacaaatggtatattcttgtataccctcaaggatgtgatgtctctaatcatctttcattgttcctttgcgttgctaatcatgacaaacttctcccaggatggagccattttgcacagttcactatagctgtaggcaatgtagatcctaaaaagatgaaatactcagatactttgcataggttttggaaaaaggagcatgattggggatggaaaaagtttatggaattgtcaaagattcaggatggttttcttgttgatgatgttcttgaaatcatagctcaagttcaggttatcagggagaaagtggatagaccttttcgttgccttgaccgtccgtatcgtagagaattgctccgtgtctatatgacacaagtggagcaaatataccggcgttttgttgaggagcgacgaaataaacttagcaaactcattgaggacacgatgcgatggtccagcttttgtggattctggtcagctattgacccaagcaccaggcatcgcatgtccagggaaaagactgacactattttgaaagtcttggtgaagcatttctttgtagagaaagaagtaacttccacattagtgatggactctttgtatacgagtctgaaggcacttgaataccagatgaatggcaagaaaggcagtacaaaagcagcagacttggaagaactacctgcacctatggtccatattgacatggacatgtttgttttggctggtgatgttatagctttgattaaaagagcagcttcagaacccttaccttgtcaacctctagctctcaaggatgacaaaacttcccaaagccgcttgaaggatggaactgctggtgaggtttacaaagtttctatggagcacgaggaaagacgcctaactgagcttggccagaagatacttgaaacatttgtgctatctcatatatttagtggaattgaagttgcataccaagaagccgttgctttgaaaagacaagaggagctcattcgtgaggaggaggaggaggcagggcttctcgaaaatcagatgaaggggaagcgtggtggtggagcaaatgagaaggagaagcgtgcgaaaaaaaagcaggctaaacaaaagaagaacaatcgtaaggttaaagacaaggaaagagatgagaaatgtgaagttaaaattctggaaagacttcatgatgaaattgcagtcgataatagtgatggcttaccagcagtggaagtgacagcaaaggttgatgccttggaagaaggttcctcagatggatcagacatgtcaaatagagggaaaaatcagcgtaacaagggcttaagcattgttggctttgctgaagaaggtgatggtcttccctccacctctagtgttgctggtggttcaggccgcaatagttctggcttcagcacagttccaaaattggaccaggatactgttctacttaccttgagagataaacttcgtaagctagggcagcgtctgcacgagaagaacattgaggggcaaaaacttcttaaagctcattttgaagctagggatgcgaaagcgaaggaagcagagtcttccaactcatcaagttctttggagaagccacctgatgttccagagagcccaaaacatttgtcagaagctgcagttgatctaaaagctaatggaacaccaaataaggatgtctctgtggtcaatagcatgcgagagggagctgttttgggcacaccagcctctataaatactgaacctgcgactgctcctgccacagcaaaagttgacctagtttcagacaaagataatggattgagttcgaaaatgaaagccaacatagcatctccttgttgctcaaaaccgcctggagttaatttggataaagatgcccctcttccttctaaatccctacgaatcaatagagttgcttcatctccccaaaagctgccttccgctgataaagggactccagttcctcccaaatctccacccataaacaaagcaccggcagttcaccccaaatctgcagtagttgacaaaactctagttcatgcaaaatctccagcagtagacagagcagctccagttcgcccccagtctccagcagttgacaaagcaacacccgtttgccccaaatctccagcagttgacaaagcacctccagctggccccaaatcttcagccagtgacaaagcaactgcagttcttcccaaatctataccagttgacaaagcttctccagctctgctgaaatcaccaacagggggtaaagatgcttatgttccttcaagattgaatgataaatctattccttctcccccaagactaccacaagttgataaagctgccctggcatcctcagaattgcgacaaacttctcctggcactaattctgaagctcaagaagcaactacttccaggaaggtcacagccaccttagtttccgaggttacagcatcaaggccttcaagtgcacctgtgttccccacgccaagatcaactgcaccagctacttcacacgttcacatttcttcactgctttctcgctctatgagtgaagcagctggacgatcagccaatggtccctccccttctgccccatcttatgctcctcagacatatcgcaatgccattgttggtaaggctggtctgggtacaacctccacaagccctgcatatcagtcttctctgagccaggataccaccccttcgcagcctctgtctgcatatgcatcaagtacagcggtcatgatgcctcctgcaggaagatctgatcagttgtcaactaggcatgtattaaagtctgggctgggcaagttagaagcacatgacagctggcagcagtggaaaggtgataataacgttgataagcatgtctggagggatcaggctccttaccaacagatgaccaacggtcaagcatatgaacaaccacggagggatgatagttatcagcaagcaagcagtagaggaacagaaaagctcagcaggtatggtggacagcaatctaggcagttccaatctgggacaagcgatggccatgtctggcacccacagcaggggccagtaccagaagaatttccacaccttgacatcataaacgatttgcttgaggaggaccatgtaaacggcagtatgccagattcattctgtcaagcttaccatgtgttcggtcggccgttctcgccaagaggcaacttgacagatatagagatggcttctgttagtagttctggtcggttcaattcaaccgatcgttactatgatgacggattctcaaggtccgatgacatgagtgctattcatgggctgagggaaaggcaatttccctcaatgggttcttattctaacggcctgtctgaaatgagtgtttcaaagccttggttgaatggctctcctaatccagcggtgagccttggtgttggcacaaatggataccaccaccaggttggggactacactaatctggggggcggggtgaacggagtgtcagtgtggcgccgccatgctaatggccgctggtaatgtgatgtcctgtacaatcttacagtgtcggaataatgcttgtagcagatgttgggttccgggcctgagctggtgtgccatgtaatttaaaagttcaaagttttaaaaagggaaagaaaagagatacatcctgtaaagtccccgccgtgattaagctaattcgagtgccttttctggttaaacgctgtattgtcgttctgctgttattcaaagttatactgggaagtggaagagtggcgaccgtaagcgttcggcgattattatgctcttctcaggctagcagaggtactcctcgagtttgtcgcagaggaagctggcctgcgaattgtaattgtggcaggccggtgcgctggagattggtagacaactatacgtatcaagaaaactggattcgttattctcaagcgaggaaaaaagagaggatacttcagtgccatgagtcctttctttagaaagaaaaagcacgcccgagtaattctaaaacgagtaaaaagagaggaattaccctggtccattgttttaaaagggagggcattaagcactccataaacattctagtctctagttactaaaataggaccg

SEQ ID NO: 2931 - DNA, 1778 bp, Panicum virgatum
tccaaatcacatggggatggggtggattggttgattgatcatccaaggacgaagcaacgcaagaagtcaatcacgatcatcacatgcgttttgtcatttcgtctgactagttgaagagtcctgctcgcttctctctccctcgggtcagtccaatccggaggagttgggtgggagagtggccatccgcgagaagaaggatggcgagcagcaacggcaagccggcacaggcggaggaggggaaggcggcggcggaggggtcgatcggcgggtatgagtccctgcacagcctgctggaggccaacctctcccccgagctcttccaggaagcaagccggttgctgttggggctgaattgtgcacgccctcttgaggctatcgcactgcctgaagccacaatgactcttgcagaaacgcataattttgatgtgcaggccttccgttttagtgcagataaagagtttcttaggcagccacgagttgttcgagttggtctaattcagaactcaattgctgttcccactacttgtcattttgctgagcaaaagaaggctatcatggataaaattagacccatcgttgatgcagctggtgcttctggtgtcaatattttgtgcttacaagaagcctggacaatgccttttgcattctgcacacgtgagaaaagatggtgtgagtttgctgaaccggttgatggagaatctactcagttccttcaagaacttgcacaaaagtataacatggtaattgtgaacccaatcctcgaaagggatgtaaaccatggggagactatttggaatactgctgtcgtaattgggaataatggcaacataattggcattcatcgaaagaatcatatcccaagagttggtgatttcaatgagagtacatactacatggagggtaacactgggcatccagtgtttgaaacagcttatggcaaaataggagtcaacatttgttatggaagacatcatccacttaattggcttgcatttggcctcaacggagctgaaatagtgttcaacccatctgcaactgttggtgaactcagcgaaccaatgtggcctattgaggcaaggaatgccgcaattgcaaacagctacttcgttggatcaattaaccgggttggcacagaagtgttcccaaatcctttcacatctggtgatgggaaacctcagcatgcagacttcggccatttctatggatctagccatttctcagcaccggacgcttcttgctccccatcactatcacgctaccgagatggcttggccatctccgatatggatctcaacctatgccgccagataaaagacaagtgggccttccgcatgactgctcgttatgatatgtatgcttccttgctatcagagtacttgaaaccagattttaaacctcaagtcattgtcgatcccttgattaacaagagggcataaaactgaggttacctggatttaaaaggaggccatttgtgctgggacttcaacagtacgtgtttacagtttggcagaataatctctttgaaggtgcaaatggaagtctctgttttcctttcctttttcacatcttgtaaaaaagcatttggtgtacattccctgaagtttgtccaacctgactttactcaatattggaaacatgaatgtctgcattgttttgcattgccatttgcaaggggttgctctgtgaagaaattcaacaaacttttaaaccacctaaaataactaagaaactccaccaaacataatgttggactaattggtgaagcttattggtcataa

SEQ ID NO: 2932 - DNA, 1640 bp, Panicum virgatum
ggtggattggttggttgatcatccaacgatgaagcaaagcaagaagccaatcaagatcatcacatgcgttttatcatttcgtctcactagttgaagagtcctgctcgcttctctctccctcgagtcagtccaatccggaggagttgggtgggagagtggccatccgcgagaggagaagatggcgagcagcaacggcaagccggcgcaggcggaggaggggaagggggcggcggaggggtcgatcggcgggtacgagtccctgcacaggctcctggaggccaacctctcccccgagctcttccaggaagcaagccggttgctgttggggctgaattgtgcacgacctcttgaggctatcgcactgcctgaagccacaatgactcttgcagaaacacataattttgatgtgcaggccttccgttttagtgcagataaagagtttcttaggcaaccacgagttgttcgagttggtctaattcagaactcaattgctgttcccactacttgtcattttgctgagcaaaagaaggctatcatggataaaattagacccatcgttgatgcagctggtgcttctggtgtcaatattttgtgcttacaagaagcctggacaatgccttttgcattctgcacacgtgagaaaagatggtgtgagtttgctgaaccggttgatggagaatctactcagttccttcaagaacttgcacaaaagtataacatggtaattgtgaacccaatcctcgaaagggatgtaaaccatggggagactatttggaatactgctgtcataattgggaaataatggcaacataattggcattcatcgaaagaatcatatcccaagagttggtgatttcaatgagagtacatactacatggagggtaacactgggcatccagtgtttgaaacaacttatggcaaaataggagtcaacatttgttatggaagacatcatccacttaattggcttgcatttggcctcaacggagctgaaatagtgttcaacccatctgcaactgttggtgaactcagcgaaccaatgtggcctattgaggcaaggaatgccgcaattgcaaacagctacttcgttggatcagttaaccgggttggcacagaagtgttcccaaatcctttcacatctggtgatgggaaacctcagcatgcagacttcggccatttctatggatctagccatttttcagcaccggacgcttcttgcaccccatcactatcacgctaccgagatggcttggccatttctgatatggatctcaacctatgccgccagatcaaagacaagtgggccttccgcatgactgctcgttacgatatgtatgcttccttgctatcagagtacttgaaaccagattttaaacctcaagtcattgtcgatcccttgactaacaagagggcataaaacagaggttacctgggtttaaaaggaggtcatttgtgctgggacttcaacagcacgtgtttacagtttagcagaataatctctttgaagctgcagatggaaggaagtttctgttttcctttccttcttcacatcttgtaaaaaagcatttggtgtacattcgctgaagtttgtccaacctgactttactcaatattggaaacatgaatgtctgcattgttt

SEQ ID NO: 2933 - DNA, 1836 bp, Sorghum bicolor
cacatgggtttatctattcttcaatctaattcccattttaatttgaagccaatccaatcttccaacgaaaaagcatgcaagaagccaatcaagatcatcacatcacatgtgtttcgtcgtcacgtctcactactagtagtggttgattgaaaaagaagaagagacctgctcgcttctccctctcccccggcgccccgagacggtccaatccgagggagtaaggaagctcccggcacgcgcgcaacgcaagcgagaggatatggcgaccagcaacggcaaggcggcgcagggggaggaggggaagacgccaccgccggcggggtcgatcggcgggtacgagtccctgcacaggctcctggaggccaacctctccccggagctattccaggaagcaagccggttgctgttgggactgaattgtgcacagccgcttgaggctatctcactgcctgacgccacaaccactcttgcagaaacacacaattttgatgtgcaggcattccgttttagtgcagacaaagagtttctaaggcaaccacgagttgttcgagttggtctagttcagaactcaatcgccgttcccactacttgtcactttgctgaccaaaagaaggcaatcatggacaaaataaaacctgtaattgatgcagctggtgcttctggtgtcaatattttgtgcctacaagaagcctggactatgccttttgctttctgcacacgcgagaaaagatggtgtgaatttgctgaaccagttgatggagaatctactcaattccttcaggaacttgcacagaaatataacatggtaatagtgagcccaatccttgaaagggatgtaaaccatggggagactatttggaatactgctgtcattattggaaacaatggcaacataattgggattcatcgaaagaatcacattccaagagttggtgatttcaatgagagcacatactacatggagggtaacactgggcatccagtgtttgaaacagcttatggcaaaataggagtgaacatttgctatggaagacatcatccccttaattggcttgcatttggcctcaatggagctgaaatagtgttcaacccatctgcgactgttggtgaactcagtgaaccaatgtggcccattgaggcaaggaacgccgcaattgcaaacagctactttgttggatcaattaaccgggttggcacagaagtgttcccaaatccattcacatctggtgatgggaaacctcaacatgcagacttcggccatttctatggatctagccatttctcagcacctgatgcctcttgcaccccgtcactatcacgctatcgagatggcttgatcatctccgatatggacctcaacctatgccgccagatcaaagacaagtgggccttccgcatgactgctcgttatgagatgtatgcttccttgctctcagagtacttgaaaccagatttcaaacctcaagtcattgttgatcccttgattaataagaaggcataaaactgaggtatgctggatacttgggcttaaaaggaggccactttgtgctttgacttgaacaggaaaggtttaccatttagcagaataatgcctatgttgaaggtgcaaattagaggaagtttcttttttttcctcatcctgtaaaaatgtgtttggtgtagtttgagctacttttactcaatagtcgaaacaataatgcttgttttgttttcattgtataatttgcaaggtatttttctgtgaagacattcaacaatcttgaaaccactgagaataacttagaaactccataaaacataatgcttaactaattgatggttgtcgttcatatcact

SEQ ID NO: 2934 - DNA, 1694 bp, Panicum virgatum
attctaaagtctaattttaatgaaaaccaatccaaatcacatggggatggggtggtggattggttgattgatcatccaacgatgaagcaaagcaagaagccaatcaagatcatcacatgcgttttgtcatttcgtctcactagttgaagagtcctgctcgcttctctctccctcgagtcagtccaatccggaggagttgggtgggagagtggccatccgcgagaggagaagatggcgagcagcaacggcaagccggcgcaggcggaggaggggtcgatcggcgggtacgagtccctgcacaggctcctggaggccaacctctcccccgagctcttccaggaagcaagccggttgctgttggggctgaattgtgcacgacctcttgaggttatcgcactgcctgaagccacaatgactcttgcagaaacacataattttgatgtgcaggccttccgttttagtgcagataaagagtttcttaggcaaccacgagttgttcgagttggtctaattcagaactcaattgctgttcccactacttgtcattttgctgagcaaaagaaggctatcatggataaaattggacccatcgttgatgcagctggtgcttctggtgtcaatattttgtgcttacaagaagcctggacaatgccttttgcattctgcacacgtgagaaaaggtggtgtgagtttgctgaaccggttgatggagaatctactcagttccttcaagaacttgcacaaaagtataacatggtaattgtgaacccaatcctcgaaagggatgtaaaccatggggagactatttggaatactgctgtcataattggaaataatggcaacataattggcattcatcgaaagaatcatatcccaagagttggtgatttcaatgagagtacatactacatggagggtaacactgggcatccagtgtttgaaacaacttatggcaaaataggagtcaacatttgttatggaagacatcatccacttaattggcttgcatttggcctcaacggagctgaaatagtgttcaacccatctgcaactgttggtgaactcagcgaaccaatgtggcctattgaggcaaggaatgccgcaattgcaaacagctacttcgttggatcagttaaccgggttggcacagaagtgttcccaaatcctttcacatctggtgatgggaaacctcagcatgcagacttcggccatttctatggatctagccatttttcagcaccggacgcttcttgcaccccatcactatcacgctaccgagatggcttggccatttctgatatggatctcaatctatgccgccagatcaaagacaagtgggccttccgcatgactgctcgttacgatatgtatgcttccttgctatcagagtacttgaaaccagattttaaacctcaagtcattgtcgatcccttgactaacaagagggcataaaacagaggttacctgggtttaaaaggaggtcatttgtgctgggacttcaacagcacgtgtttacagtttagcagaataatctctttgaagctgcagatggaaggaagtttctgttttcctttccttcttcacatcttgtaaaaaagcatttggtgtacattcgctgaagtttgtccaacttgactttactcaatattggaaacatgaatgtctgcattgtttgcattgccatttgcaagggg

SEQ ID NO: 2935 - DNA, 2148 bp, Saccharum officinarum
cacatgtgtttcgtcgtcacgtctcactagttgattgaagtagaagagacctgctcgcttctccctctcccccgagtcggtccaatcccaaggagtgaagaagctcccggcgcgcgcgcaacgcaagcgagagggtatggcgaccagcaacggcaaggcggcgcagggggaggaggggaagacgccaccgccggcggggtcgatcggcgggtacgagtccctgcacaggctcctggaggcaaacctctcccccgagctattccaggaagcaagccgattgctgctgggactgaattgtgcacgacctcttgaggccatctcactgtctgacgccacaacagctcttgcggaaacacacaattttgatgtgcaggcattccgttttagtgcagacaaagagtttctaaggcaaccacgagttgttcgagttggtctaattcagaactcaattgccgttcccactacttgtcactttgctgaccaaaagaaggcaatcatggacaaaataaaacctgtaattgatgcagctggtgcttctggtgtcaatattttgtgcctacaagaagcctggacaatgccttttgccttctgcacacgcgagaaaagatggtgtgaatttgctgaaccaattgatggagaatctactcaattccttcaagaacttgcacagaagtataacatggtaatagtgagcccaatccttgaaagggatgtaaaccatggggagactatttggaatactgctgttgttattggaaacaatggcaacataattggcattcatcgaaagaatcacattccaagagttggtgatttcaatgagagcacatactacatggagggtaacactgggcatccagtgtttgaaacagcttatggcaaaataggagtgaacatttgttatggaagacatcatccccttaattggcttgcatttggcctcaatggagctgaaatagtgttcaacccatctgcgacggttggtgaactcagtgaaccaatgtggccaattgaggcaaggaatgccgcaattgcaaacagctacttcgttggatcaattaaccgggttggcacagaagtgttcccaaatccattcacatctggtgatgggaaacctcaacacgcagactttggccatttctatggatctagccatttctcggcacctaatgcctcttgcaccccatctctatcacactaccgggatggcttgatcatctccgatatggacctcaacctatgccgccagatcaaagacaagtgggccttccgcatgactgctcgatatgagatgtatgcttccttgctctcagagtacttgaaaccagatttcaaacctcaagtcattgttgatcccttggttaataagaaggcataaaactgaggtatgctggatacttgggccttaaaggaggccgttttgtgctttgacgtggacaggaaaggtttgccatttaccagaataatgtcttgacgaatgtgcaaattggaagaaagttctttttttcccttaactttttcacatcctgtaaaaatgtattgggtgtagtttggagcaacttttaactcaattattcaaaaacaataaatgcctggtaatgtttcccatgtgaattattttggcaaagggaattctttccttgtgaaaccaataacacgacgctaataatacaaacaagtctttgggggcggcgaagctcaaaaaaaggactcgcacggcttcacgctttatcgcatcgtactatgcgcgaaccgtcacaaaacccccgcctcaatctagtagatcggagcgtaaaaatgccaacatcatcaccgggcccgcactcctatattacaccacccgatgttctggaattgtgagaggaacacccacggtgcgtgttacgcacacatagttagtatcccgtgtaggaagaagaccacacccaccttataagccaaccgctgtgttgatatcataaataagaaggacagtcgagctaaacatgcactccgccactgcgtggctactccctcttaatgtgcggaaatgggagaccgccaattattggccgcgcataacaccccacagaacttcgtagtgtaccccacgaggcgatcactcacaaaatctccactgaacaagacaccaccgccacagacatatga

SEQ ID NO: 2936 - DNA, 1579 bp, Pseudoroegneria spicata
  misc_feature (1442)..(1442): n is a, c, g, or t
gcaaggagaagtcaatcgctcgtcgtggtctctctcgtggagtgcgatttctaatccccagagagaagagagagagtcctgcccgctcctctctcctcctgctagtccaatcgcgaggatagggatggagagctccaacggcaagccgccgcagggagaggaagaggggaaggcggcggggtcgatcggaggctacgagtcgctgcacaggctcctcgagtccaacctcccccccgagctcttcaaggaggcaagccgtttgcttttggggctgaattgtgcacgccctcttgaggctatttccctgcctggggccaccactaatcttgccgaagcgcataatttcgatgtgcaggcatttcgttttagtgctgacaaagagcatatgaggcagccgcggattgttcgagttggcttaattcagaactcaattgctgttccaacaacttgtcattttgctgatcaaaagaagtctatcatggagaaagtaaaacccatcatagatgcagctggtgcttctggtgtcaatattttgtgcttacaggaagcctggacaatgccatttgccttctgcacgcgtgaaaaacgatggtgtgagtttgctgagcctgttgatggagaatctactcagtttcttcaagagcttgcacagaaatataacatggtaattgttagccctatccttgaaagggatataaaccatggagagactatatggaataccgttgttgtaattggaaataatggcaacataatcggcattcatcgaaagaatcacatcccaagagttggcgacttcaatgagagcacatactatatggaaggtaacactgggcatccggtgtttgaaacagcttatggcaaaattgctgtaaatatctgctacggcaggcatcatcctctgaattggcttgcatttggcctcaatggagctgaaatagttttcaatccatctgcaactgtcggtgaacttagtgaaccaatgtggcctattgaggcaaggaatgctgcaattgcaaatagctactttgtcggatcaattaaccgggtaggcacagaggtattcccgaacccattcacttctggtgatgggaaacctcagcatgccgactttggtcatttctatggatccagccatttctcagcgcctgatgcttcctgcaccccatcgctatcgcgctaccgagatggcttgatgatatctgacatggacctgaacttatgccgccagatcaaagacaagtgggccttccgcatgactgctcggtatgacatgtatgctaacttgctttcagagtacttgaagccagattttaagcctcaggtcatcgccgatcccttgataaataagagggcttaattctggatcagctgggtctaagcagacgaagtcgatgtcctttcccttttttctgtatatatgttgtataaacataaaaatnaatcagtaggcatcttttgattaagtttccatggtctgactttacccaatgttgaagtcatccatattcactctttttatgttttgaatttccaagcaaatgttctttgaataaaatacaccgcacaatggcccata

SEQ ID NO: 2937 - DNA, 1531 bp, Secale cereale
agagagagagagagagagtcctacccgctcctctctcctcttgcgagtccaatcgcgaggacagagatggagagctccaacggcaagccgccgcagggagaggaagaggggaaggcggcggggtcgatcggaggccacgagtcgctgcacaggctcctcgagtccaacctctcccccgagctcttcaaggaggcaagccggttgcttttggggctaaattgtgcacaccctcttgaggctatttccctgcctggggccaccactgatcttgccgaagcgcataattttgatgtgcaggcattccgttttaacgctgacaaagagcatatgaggcaaccacggattgttcgagttggcctaattcagaactcaattgctgttccaacgacttgtcattttgctgatcaaaagaagtctatcatggagaaagtaaaacccatcatagatgcagctggtgcctctggtgtcaatattttgtgcttacaggaagcctggacaatgccatttgcattctgcacgcgtgaaaaacggtggtgtgagtttgctgagcctgttgatggagaatctactcagtttcttcaagagcttgcacagaaatataacatggtaattgttagccctatccttgaaagggatataaaccatggagagactatatggaataccgttgttgtaattggaaataatggcaacataattggcattcatcgaaagaatcacatcccaagagtcggcgacttcaatgagagcacgtactatatggaaggtaacactgggcatccggtgtttgaaacagcttatggcaaaattgctgtaaacatctgctacggcaggcatcatcctctgaattggcttgcatttggcctcaatggagctgaaatagttttcaacccatctgcaactgtcggtgaacttagtgaaccaatgtggcctattgaggcaaggaatgctgcaattgcaaatagctactttgtcggatcaattaaccgggtaggcacagaggtattcccgaacccattcacttctggtgatgggaaacctcagcatgcggactttggtcatttctatggatccagccatttctcagcgcctgatgcttcctgcaccccatcgctatcgcgctaccgagatggcttgatgatatctgacatggacctgaacttatgccgccagatcaaagacaagtgggccttccgcatgactgctcggtatgacatgtatgctaacttgctttcagagtacttgaagccggattttaagcctcaagtcatcgccgatcccttgataaacaagagggcttagttctggatcagctgggtctaagccgatgaattagatgtcctttcctttttcccttccgtatatgttgtataaacataaaaataaaatcagtaaacatcttttgattaagtttccatgctctgactttacccaatgttgaagtcatccatattcattcttcatatgttgtgaatttccaagcaaattttcatgaattaatacacaccacacaatttcccgtaaaaaaaaa

SEQ ID NO: 2938 - DNA, 1487 bp, Secale cereale
cccccctcctactcgtgtccgtcgtccgtccaccgtactacgttatactagtagagtagagagagagagagagagagagagtcctacccgctcctctctcctcttgcgagtccaatcgcgaggatagggatggagagctccaacggcaagccgcagcagggagacgaagaggggaaggcggcggggtcgatcggaggctacgagtcgctgcacaggctcctcgagtcaagcctctcccccgagctcttcaaggaggcaagccggttgcttttggggctgaattgtgcacactctcttgaggctgtttccctgcctggggccaccactgatcttgccgaagcgcataatttcgatttgcaggcattccgttttaacgctgacaaagagcatatgaggcaaccacggattgttcgagttggcctaattcagaactcaattgctgttccaacgacttgtcattttgctgatcaaaagaagtctatcatggagaaagtaaaacccatcatagatgcagctggtgcttctggtgtcaatattttgtgcttacaggaagcctggacaatgccatttgcattctgcacgcgtgaaaaacgatggtgtgagtttgctgagcccgttgatggagaatctactcagtttcttcaagagcttgcacagaaatataacatggtaattgttagccctatccttgaaagggatataaaccatggagagactatatggaataccgttgttgtaattggaaataatggcaacataattggcattcatcgaaagaatcacatcccaagagtcggcgacttcaatgagagcacgtactatatggaaggtaacactgggcatccggtgtttgaaacagcttatggcaaaattgctgtaaacatctgctacggcaggcatcatcctctgaattggcttgcatttggcctcaatggagctgaaatagttttcaacccatctgcaactgtcggtgaacttagtgaaccaatgtggcctattgaggcaaggaatgctgcaattgcaaatagctactttgtcggatcaattaaccgggtaggcacagaggtattcccgaacccattcacttctggtgatgggaaacctcagcatgcggactttggtcatttctatggatccagccatttctcagcgcctgatgcttcctgcaccccatcgctatcgcgctaccgagatggcttgatgatatctgacatggacctgaacttatgccgccagatcaaagacaagtgggccttccgcatgactgctcggtatgacatgtatgctaacttgctttcagagtacttgaagccggattttaagcctcaagtcatcgccgatcccttgataaacaagagggcttaattctggatcagctgggtctaagccgacgaattagatgtcctttccttttttcccttccgtatatgttgtataaacataaaaataaaatcagtaaacatcttttgattaagtttccatgctct

SEQ ID NO: 2939 - DNA, 1537 bp, Secale cereale
ggccccatccccgctgcagtccccgtcaccggcctttgttttctaatccccgccagatccattaagcaaggagaaatctgctcgtcgtggtctctctcgtggagtgcggtttctaaattcgagagcgagagagagagtcctacccgctcctctctcctcttgcgagtccaatcgcgaggatagggatggagagctccaacggcaagccgccgcagggagaggaagaggggaaggcggcggggtcgatcggaggctacgagtcgctgcacaggctcctcgagtcaagcctctcccccgagctcttcaaggaggcaagccggttgcttttggggctgaattgtgcacaccctcttgaggctgtttccctgcctggggccaccactgatcttgcccaagcgcataatttcgatttgcaggcattccgttttaacgctgacaaagagcatatgaggcaaccacggattgttcgagttggcctaattcagaactcaattgctgttccaacgactagtcattttgctgatcaaaagaagtctatcatggagaaagtaaaacccatcatagatgcagctggtgcttctggtgtcaatattttgtgcttacaggaagcctggacaatgccatttgcattctgcacgcgtgaaaaacgatggtgtgagtttgctgagcccgttgatggagaatctactcagtttcttcaagagcttgcacagaaatataacatggtaattgttagccctatccttgaaagggatataaaccatggagagactatatggaataccgttgttgtaattggaaataatggcaacataattggcattcatcgaaagaatcacatcccaagagtcggcgacttcaatgagagcacgtactatatggaaggtaacactgggcatccggtgtttgaaacagcttatggcaaaattgctgtaaacatctgctacggcaggcatcatcctctgaattggcttgcatttggcctcaatggagctgaaatagttttcaacccatctgcaactgtcggtgaacttagtgaaccaatgtggcctattgaggcaaggaatgctgcaattgcaaatagctactttgtcggatcaattaaccgggtaggcacagaggtatttccgaacccattcacttctggtgatgggaaacctcagcatgcggactttggtcatttctatggatccagccatttctcagcgcctgatgcttcctgcaccccatcgctatcacgataccgagatggcttgatgatatctgacatggacctgaacttatgccgccagatcaaagacaagtgggccttccgcatgactgctcggtatgacatgtatgctaacttgctttcagagtacttgaagccggattttaagcctcaagtcatcgccgatcccttgataaacaagagggcttaattctggatcagctgggtctaagccgacgaagtagatgtcctttccttttttttttcttccgtatatgttgtataaacataaaaataaaatcagtaaacatcttttgattaagtttt

SEQ ID NO: 2940 - DNA, 1431 bp, Pennisetum glaucum
ccctgcacaggctcctggaggccaacctctccccggagctcttccaggaagcaagccgattgttgttgggtatgaattgtgcacgacctcttgagaccatatcactgcctgaagccaccaccactcttgcggcatcacacaattttgatgtgcaggccttccgttttagtgcagataaagagtttctgaggcaacagcgagttgttcgagttggtctaattcaaaactcaattgctgttcccactacttatcattttgctgaccaaaagaaggctatcatggacaaaattagacacatcgttgatgctgctggtgcttctggtgtcaatattttgtgcttacaggaagcctggacaatgccttttgccttctgcactcgtgagaaaagatggtgcgagtttgctgaaccagttgatggagaatctactcagttccttcaagaacttgcacaaaagtataacatggtaattgtgagcccaatccttgaaagggatgtaaaccatggggagactatttggaatactgctgttgtaattggaaataatggcaacataattggcattcatcgaaagaatcacatcccaagagttggtgatttcaatgagagtacatactacatggagggtgacactgggcatccagtgtttgaaacagcgtatggtaaaataggagtgaacatttgttatggaagacatcatccccttaattggcttgcatttggcctcaacggagctgaaatagtgttcaacccatctgcaactgttggtgaactcagcgaaccaatgtggccaattgaggcaaggaacgctgcaattgcaaacagctactttgttggatcaattaatcgggttggcacagaagtgttcccaaatccattcacttctggtgatgggaagcctcagcatgcagacttcggccatttctatggatctagccatttctctgcacctgacgcttcttgcaccccatcactatcacgctaccgagatggcttgatcatctctgatatggacctcaacctatgccgccagatcaaagacaagtgggccttccgcatgactgcgcgttatgagatgtatgcttcctttctatcagaatacttgaaaccagattttaaacctcaagtcattgttgatcccttgattaacaagagggcataaaactgaggttgcatggatttaaaaggaggccatttgtgctggggcttaaacagaacgtgtttacagtttagcagaataatctctttgaaggtgcagatggaacgtgtttacagtttagcagaataatctctttgaaggtgcagatggaaaggaattccttttctttttcacatcctgtaaaaaacatttgctgtacacctcgctgaagtttgtccaacctgactttactcaaaattggaaacaatgaatttctgttttgttctaccttgcg

SEQ ID NO: 2941 - DNA, 1575 bp, Hordeum vulgare
attgttttctaatccgcgccggatgcactaaacaagggggaatctgctcgtcgtggtctctctcgtggagtgcggcttctaaattcgagagtcctacccgctcctctctcctctcctctcgcgagtccaatcgaatcgctcctctcgggatggagagctccaacggcaagccgccgcagggagaggaggaggggaaggcggcggggtcgatcggaggctacgagtcgctgcacaggctcctcgagtccaacctctcccccgagctcttcaaggaggcaagccggttgcttttggggctgaattgtgcacatcctcttgagcctatttccctgcctggggccaccactgatcttgcccaagcgcatagttttgatgtgcaggcattccgttttaacgctgacaaagagcacatgaggcaaccgcggattgttcgagttggcctaattcagaactcaattgctgttccaacaacttgtcattttgctgatcaaaagaagtctatcatggagaaagtaaaacccatcatagatgcagctggtgcttctggtgtcaatattttgtgcttacaggaagcctggacaatgccatttgccttctgcacgcgtgaaaaacgttggtgtgagtttgctgagcctgtcgatggagaatctactcagtttcttcaagagcttgcacagaaatataacatggtaattgttagccctatccttgaaagggatataaaccatggagagactatatggaataccgttgttgtaattggaaataatggcaacataattggcattcatcgaaagaatcacatcccaagagttggcgacttcaatgagagcacgtactatatggaaggtaacactgggcatccggtgtttgaaacagcttatggcaaaattgctgtaaacatctgctacggcaggcatcatcctctgaattggcttgcatttggcctcaatggagctgaaatagttttcaacccatctgcaactgtcggtgaacttagtgaaccaatgtggcctattgaggcaaggaatgctgcaattgcaaatagctactttgtcggatcaattaaccgggtaggcacagaggtattcccgaacccattcacttctggtgatgggaaacctcagcacgcggactttggtcatttctatggatccagtcatttctcagcgcctgatgcttcctgcaccccatcgctatcgcgctaccgagatggcttgatggtatctgacatggacctgaacttatgccgccagatcaaagacaagtgggccttccgcatgactgctcggtatgacatgtatgctaacttgctttcagagtacttgaagccagattttaagcctcagatcatcgcggatcccttgataaataagagggcttaattggctcagttggttcccttcttttctgtatatgttgtataaatatataaacaaatcagtacatcttttgatcaagtttccatggtctgactttgcccaatgttgaaaccatacatattcactcttttatgttgtgaattttcaagtaaacgttctttgaataaaatacaccacacaatggcccatagat

SEQ ID NO: 2942 - DNA, 1639 bp, Triticum aestivum
gccgcccccatcccgctgtcgtgtgccgtccccgtcaccggcccttgttttctaatccccgccggatccgttaagcaaggagaaatctgctcgtcgtggtctctctcgtggagtgcggtttctaaattcgagagagagagagagtcctacccgctcctctctcctcctgcgagtccaatcgcgaggatagggatggagagctccaacggcaagccgccgcagggagaggaagaggggaaggcggcggggtcgatcggaggccacgagtcgctgcacaggctcctcgagtccaatctcccccccgagctcttcaaggaggcaagccggttgcttttggggctgaattgtgcacaccctcttgaggctgtttccctgcccggggccaccactgatcttgccaaagcgcataatttcgatgtgcaggcattccgtttcaacgctgacaaagagcatatgaggcaaccgcggattgttcgagttggcctaattcagaactcaattgctgttccaacgacttgtcattttgctgatcaaaagaagtctatcatggagaaagtaaaacccatcatagatgcagctggtgcttctggtgtcaatattttgtgcttacaggaagcctggacaatgccatttgccttctgcacgcgtgaaaaacgatggtgtgagtttgctgagcctgttgatggagaatcgactcagtttcttcaagagctcgcacagaaatataatatggtaattgttagccctatccttgaaagggatataaaccatggagagactatatggaataccgttgttgtaattggaaataatggcaacataattggcattcatcgaaagaatcacatcccaagagttggcgacttcaatgagagcacatactatatggaaggtaacactgggcatccagtgtttgaaacagcttatggcaaaattgctgtaaacatctgctacggcaggcatcatcctctgaattggcttgcatttggcctcaatggagctgaaatagttttcaacccatctgcaactgtcggtgaacttagtgaaccaatgtggcctattgaggcaaggaatgctgcaattgcaaatagctactttgtcggatcaattaaccgggtaggcacagaggtattcccgaacccattcacttctggtgatgggaaacctcagcatgccgactttggtcatttctatggatccagccatttctcagcgcctgatgcttcctgcaccccatcgctatcgcgctaccgagatggcttgatgatatctgacatggacctgaacttatgccgccagatcaaagacaagtgggccttccgcatgactgctcggtatgacatgtatgctaacttgctttcagagtacttgaagccagattttaagcctcagatcatcgcggatcccttgataaataagagggcttaattctggatcagttgggtctaagcagacgaagtcgatgccctttcccttcttttctgtatatgttgtataaatataaaaataaatcagtaaacatcttttgatcaagtttccatggtctgactttacccaatgttgaaatcatacatattcacccttttatgttgtgaatttccaagtaaatgttctttgaataaaatacaccacacaatgg

SEQ ID NO: 2943 - DNA, 1612 bp, Leymus cinereus x Leymus triticoides
  misc_feature (386)..(386): n is a, c, g, or t
  misc_feature (413)..(413): n is a, c, g, or t
  misc_feature (455)..(456): n is a, c, g, or t
  misc_feature (461)..(461): n is a, c, g, or t
  misc_feature (467)..(467): n is a, c, g, or t
  misc_feature (482)..(482): n is a, c, g, or t
  misc_feature (494)..(494): n is a, c, g, or t
  misc_feature (525)..(525): n is a, c, g, or t
  misc_feature (540)..(540): n is a, c, g, or t
  misc_feature (561)..(562): n is a, c, g, or t
  misc_feature (614)..(614): n is a, c, g, or t
  misc_feature (644)..(644): n is a, c, g, or t
  misc_feature (1082)..(1082): n is a, c, g, or t
  misc_feature (1127)..(1127): n is a, c, g, or t
  misc_feature (1265)..(1265): n is a, c, g, or t
  misc_feature (1295)..(1295): n is a, c, g, or t
  misc_feature (1305)..(1305): n is a, c, g, or t
  misc_feature (1418)..(1418): n is a, c, g, or t
  misc_feature (1460)..(1460): n is a, c, g, or t
  misc_feature (1498)..(1498): n is a, c, g, or t
  misc_feature (1508)..(1508): n is a, c, g, or t
  misc_feature (1511)..(1511): n is a, c, g, or t
  misc_feature (1517)..(1517): n is a, c, g, or t
  misc_feature (1561)..(1561): n is a, c, g, or t
  misc_feature (1581)..(1581): n is a, c, g, or t
  misc_feature (1602)..(1602): n is a, c, g, or t
ccaaaccctagtccccaatccgcggtccaaatcaggccgccggcaaggacgttacacctcgccgccgcccccgtcactggccttgtttcctaatccccgccggatccattaagacgaggcgagcaaggagaaaccaatcgctcgtcgtggtctccctcgtggagtgcggtttttaatcccgagagagagagaagagggagaatcctactcgctcctctcctcttgcgagtccaatcgcgaggcttgggatggagagctccaacggcaagccgccgcagggagaggaagaggggaaggcggcggggtcgatcggaggctacgagtcgctgcacaggctcctcgagtccaacctcccccccgagctcttcaaggaggcaagccggttncttttggggctgaattgtgcacacccncttgaggctatttccctgcctggggccaccactgatcttgcnnaagcncataantttgatgtgcaggcnttccgttttaangctgacaaagagcatatgaggcaaccgcggnttgttcgagttggcntaattcagaactcaattgctnntccaacgacttgtcattttgctgatcaaaagaagtctatcatggagaaagtnaaacccatcatagatgcagctggtgcttcnggtgtcaatattttgtgcttacaggaagcctggacaatgccatttgccttctgcacgcgtgaaaaacgatggtgtgagtttgctgagcccgttgatggagaatctactcagtttcttcaagagcttgcacagaaatataacatggtaattgttagcccgatccttgaaagggatataaaccatggagagattatatggaataccgttgttgtaattggaaataatggcaacataattggcattcatcgaaagaatcacatcccaagagttggcgacttcaatgagagcacgtactatatggaaggtaacactgggcatccggtgtttgaaacagcttatggcaaaattgctgtaaacatctgctacggcaggcatcatcctctgaattggcttgcatttggcctcaatggagctgaaatagttttcaacccatctgcnactgtcggtgaacttagtgaaccaatgtggcctattgaggcaagnaatgctgcaattgcaaatagctactttgtcggatcaattaaccgggtaggcacagaggtattcccgaacccattcacttctggtgatgggaaacctcagcatgccgactttggtcatttctatggatccagccatttntcagcgcctgatgcttcctgcaccccatcnctatcgcgcnaccgagatggcttgatgatatctgacatggacctgaacttatgccgccagatcaaagacaagtgggccttccgcatgactgctcggtatgacatgtatgctaacttgctttcngagtacttgaagccagattttaagcctcaagtcatcgccgancccttgataaataagagggcttaattctggatcagctnggtctaagcngangaagtngatgtcctttccctttttttcgtatatgttgtataaacataaantaaaatcagtaaacatcttntgattaagtttccatggtctnactttaccca

SEQ ID NO: 2944 - DNA, 1439 bp, Festuca arundinacea
ggcacgaggaagaaatcaatctctcatttctaatccctagagagagagagagagagagactcctactcgcttctctcacctcaaccaccaaggacaggatggagagctccaacggcaagccaccgcacggcaaggaggaggggaaggcggcggcggcggaggggtcgatcggagggtacgagtcgctgcacaggctcctcgagtccaacctctcccccgagctcttcaaggaggcaagccggttgcttttggggctgaattgtgcacgccctcttgaggccatttcgctgcctggggccacaacagctctcgcagaagcgcatgatttcgatgtgcaggcattccgttttaatgctgacaaagaacagatgaggcaaccacgaattgttcgggttggtctggttcagaactcaattgctgttccaacgacttgtcattttgctgatcaaaagaaggctatcatggagaaagtaaaactcatcgtagatgcagctggtgcttctggtgtcaatgtcttgtgcttacaggaagcctggacgatgccttttgccttctgcacgcgtgaaaaacggtggtgtgagtttgccgagcctgttgatggagagtctactcaattccttcaagaccttgcacagaaatataacatggtaattgttagcccgatccttgaaagagatattaaccatggagagattatatggaataccgttgttgtaattggaaataatggcaacataattggcattcatcggaagaatcacatcccaagagttggcgacttcaatgagagcacatattatatggaaggtaacatggggcatccggtgtttgaaacagcttatggcaaaattgctgtaaacatctgctatggcaggcatcatcccctcaattggcttgcattcggcctcaacggagctgaaatagttttcaacccatctgcaactgttggtgaactcagtgaaccaatgtggcctgttgaggcaaggaatgctgcaattgcgaatagctactttgtcggatcaattaaccgggtaggcacagaggtattcccgaacgcattcacctctggtgatgggaaacctcagcatgccgactttggtcatttttatggatccagccatttctcggcgcctgatgcttcttgcaccccgtcgctttctcgctaccgagatggcttgatgatatctgacatggacctcaacttatgccgccagataaaagacaagtgggccttccgcatgactgctcgatatgacatgtatgctaacttgctttcagagtacatgaagccagattataagccccaagtcatctccgatccattgattaataagaggaaggcataattctggatcagttgggtctacagacatgcatattctcttttttcacatatgttgtataaaaataaagtgtacacattttgattaagtttcctt

SEQ ID NO: 2945 - DNA, 1954 bp, Oryza sativa
agttaaaaaaagaaaagagagagagccctactcgcctctctaacacgagcccaatcacgaggagggcgggcaagtgcggcaaccgcatcgcatcacactaaccgcaccaccggcagccggcagtcgagaggatggacagcagcaacggcgagcggccgccgcagggagaggatgcgccggcggcggcggcggggtcgatcggagggtacgagtccctgcacaggctcctccagtccaacctctccccggagctcttcaaggaagcaagccggctgctattgggactgaattgtgggcgtgctctagaggccatctcattgcccgaagccacatctgctcttgcaaaagctcataactttgatgtgcaggccttccgttttgatgcagataaagagtatctcaggcaaccacgggttattcgagttggcctgattcagaactcaattgctattcctaccaccagtcattttgcagatcagaagaaggctatcatggagaaagtcaagcctatgattgatgcagctggtgatgctggtgttaatattttgtgtttacaggaagcttggacaatgccttttgccttctgcacacgtgagaaaaggtggtgtgagtttgctgagcctgttgatggagaatctactcaatttcttcaacaacttgctaagaaatataacatggtaattgtgagcccaatcctcgaaagagatgtaaaccacggagagattgtatggaatacagctgttgtcataggtaatcatgggaacataattggtatacatcgaaagaatcacatcccaagagtcggtgatttcaatgagagcacatactatatggagggtaacactgggcatccagtgtttgaaacagcatatgggaaaatcggagtaaacatttgttatggaaggcatcatccccttaattggcttgcttttggcctcaatggagctgaaatagtattcaacccatccgcaactgttggtgaactcagtgaaccaatgtggcccattgaggccagaaatgctgcaattgcaaatagctactttgtcgggtcaattaaccgggttggcacagaggtcttcccaaacccattcacttctggtgacgggaaacctcagcatgccgactttggtcatttctatggatccagccatttctcagcacctgatgcttcttgcaccccatcactatctcgctaccgagatggcttgatgatatctgatatggacctcaacttatgtcgccagatcaaagacaagtggggcttccgcatgactgcccgttatgacacgtatgcttccttgctttcagagtacttgaagccagattttaaacctcaagtcattgttgaccccttgatcaataagagtgcgtaatggtgagaaacttggtgccaaaggagagcactcaattctggaacttacacatttagagcattcagtttgagggaactcttcaaaatctgccattggggaatcgatttcttttttcaattttcgtatgtaaagaaaaatttgtatacatgtttacctcaaattgccttttacttggagttggaaacattgatactcattttgctttctgctgtaaatttgcaaggtatgtatgatctgtaaagataatgcacaccaaacaatatgccatattaatgatttagcccaaaaatttatatcacagttcattaacaagttacaccattctacaactgagaccattattcaaagaactggacttgtgcagaatgcttcgcattcttgtacaacatggcaattacttttattttgccacttgctaggctaagaaaatggattaactatatgatgtacaactgtccactatgtccaagttaattctgttgcccttctgcttattctctttgtcagaattcagaaatctaccctagagtaaacatcagatatatttataatctacttattatgtgatgcttcttcgttct

SEQ ID NO: 2946 - DNA, 1858 bp, Brachypodium distachyon
ccgtggtgccgtggtgccgtggtgctaatcttacgaggatcacatgatcacgtcacatgcgattacctccaaatcaaacaagacgccaaccgaatcacacatgggaggaggaattgtataagaggagggagaaatcaatcgctcgtggtctcgtggattgcgatttctcatcggtggagagagagagagtcctgctcgcttctctctcctctcgcaagtccaaatccccagccccaggacagaatggagagctccaacggcaagccgccgcagggggaggaggaggcgaaggcggcggcggcggtggcggaggggtcgattggagggtacgagtcgctgcacaggctgctagagtccaacctctcccccgagctcttcaaggaagcaagccggttgctgttggggctgaattgtgcactccctcttcagactatttcactgcctggggtcacaacagctcttgcagaagagcatgattttgatgtgcaggcataccgttttaatgctgacaaagagtatataaggcaaccacgaattgttcgagttggtctaattcagaactcaatagctgttccaacgacttgccattttgctgatcaaaagaaggctatcatggagaaagtaaaactcatcatagatgcagctggtgcttctggtgtcaatattctgtgcttgcaggaagcgtggacaatgccttttgcgttctgcacgcgtgagaaacgatggtgtgagtttgccgagcccgttgaaggagagtctactcagttccttcaagagcttgcacagaaatataacatggtaattattagccctatccttgaaagggatataaaccatggagagattatatggaatactgttgttgtaattggaaataatggcaatattattggcattcatcgaaagaatcacatcccgagagttggtgacttcaatgagagcacatactatatggaaggcaacactgggcatccggtgtttgaaacagcatacggaaaaattgctgtgaacatctgctacggaaggcatcatccccttaattggcttgcatttggcctcaatggagctgaaatagttttcaacccctctgcaaccgtcggtgaactcagtgaaccaatgtggcctattgaggcaaggaatgcggcaattgcaaatagctactttgtcggatcaattaaccgggtaggcacagaggtattcccgaacccattcacctctggtgatgggaaacctcagcatgccgactttggacatttctatggatccagccatttctctgcacctgatgcttcgtgcaccccatcactatctcgctaccgagatggcttgatgatatctgacatggatctcaacttatgccgccagatcaaagacaagtgggccttccgcatgactgctcgttatgacatctatgcttccttgctttcagagtacttgaagttagattttaagcctcaagtcatcgctgatcccttaatcaataagaggagggcataatgctgagatgatgctggatcagctggatctacaagtagggcagcctggcacttgtgcagttagcactttggaggaattatctttcaaaggtgcgatttggaagaattcgatgccttttctgtttttcacttaatgtataaaaataaaaataaatataaatcagtgtacattcttgcttaaggttcttcaagctgactttactcaatgttgggaacgctgaacatccataatcatttcttttatgttgtaaatttgtaagcaaatgttcggtgaagaaaatgcaccacgtaatctcccatagttcaaacgaatctcagttgcatttacatctatgacatatacacaactgaggatcattgtt

SEQ ID NO: 2947 - DNA, 1613 bp, Avena sativa
cagacgaggatcacatgatcacgtcacatgcgattacctccaatcaaacaagacgccaaccgaatcaaatcacatgcgggcagcgaggaggaattgtataagacgagcaaggaggagtgcgatttagaaaaaatagagagagactcctactcgcttctctcacctcaacccccaaagacaagatggagagctccaacggcaagccaccgcacgaagagaaggaggggaaggcggcggaggggtcgatcggaggttacgagtcgctgcacaggctcctcgagtccaacctctcccccgagctcttcaaggaggcaagccggttgcttttagggctgaattgtgcacgccctcttggggccatttcactgcctggggccacaaaagctcttgcagatgcgcatgattttgatgtgcaggcattccgttttaatgctgacaacgaatatatgaggcaaccacgaattgttcgagttggtctgattcagaactcaattgctgttccaacgacttgtcattttgctgaccaaaagaaggctatcatggagaaagtaaaactcatcatagatgcagctggtgcctctggtgtcaatgtcttgtgcttacaggaagcctggacaatgccttttgccttctgtacgcgtgaaaaacggtggtgtgagtttgccgagcccgctgatggagagtctactcaattccttcaagaccttgcacagaaatataacatggtaattgttagcccgatcctcgaaagggatataaaccatggagagattatatggaataccgttgttgtgattggaaataatggcaacatgattggcattcatcggaagaatcacatcccaagagttggggacttcaacgagagcacatactatatggaaggtaacactgggcatccagtgtttgaaacagcttatggcaaaattgctgtaaacatttgctatggcaggcatcatccccttaattggcttgcattcggcctcaatggagctgaaatagttttcaacccatctgcaaccgttggtgaactcagtgagccaatgtggcctattgaggcaaggaatgctgcaattgcaaatagctactttgtcggatcaattaacagggtaggcacagaggtattcccgaacgctttcacctctggtgatgggaaacctcagcatgcggactttggtcatttttatggatccagccatttctcagcgcctgatgcttcttgcaccccgtcactatctcgctaccgagatggcttgatgatatctgacatggacctcaacttatgccgccagataaaagacaagtggggtttccgcatgactgctcggtatgacatgtatgctaacttgctttcagagtacttgaagccagattttaagcctcaagtgatcgcagatcccttgattaataagaggaaggcataactctggatcggctgtgtctacacagtcatgcattttctcctttttctttcacatatgttgtataaaaataaagtgtacatcttttggttaagtttcctcggtactcaatgttcgaaacatccatattcatttttttttaaatttccaagaatatattccttgaataaaatacaccacacaatgtcccgt

SEQ ID NO: 2948 - DNA, 1631 bp, Musa acuminata
gaccgatcttagttcatccgaggatggcaagccatcagcggagagacgagaacggaagggcggcggcggaggaggaggacggatcgactacaggatccatccatggcttcgaatccctccatcgcctcctggaggctaatctgaagccccagatcttccaggaagtgagccgcttgctgctgggactgaattgtgggcgccatctcgagcgggtttctttacctcaggctgccacctctctatctgcagaacatgattttgatttgcaggccttttgttttcatgctgataaagagttactgaggcaaccacgaattgttcgtgttggccttatccagaatgcgatcggtcttcctactactgcacactttgtggaccagaagaatgctattaggcaaaaagtggaacccatgattgatgcagctggagcttctggtgtcaatatcttatgcttacaagaggcatggatgatgccattttgtttctgcactcgggagaagaaatggtgtgaatttgcagagccttttgatggagaatcgactcaatttcttcaagaatttgcaaggaaatataacatggtcattgtgaattctattcttgaaagggatatacaccatggggagaccatttggaatactgctgttgtgatcggaaaccatggcaacataattggcattcataggaagaatcacataccgagagttggggatttcaatgagagcacatattatatggaaggaaacactggacatcctgtgtttgaaacagcttatgggaagatcgcagtaaacatctgttatggaaggcaccatcccttaaactggttagcatttgggctaaatggagctgagattgtcttcaacccttctgcaactgtcggagaactcagtgaaccaatgtggcctattgaggctcggaatgctgccattgcaaacagttactttgttgggtcgattaatcgtgttggcacagaaatctttcctaatccatttacttctggtgatgggaaacctcaacactcagacttcggtcacttctatgggtctagtcatttctcagcaccagatgcttcatgcactccctccctttcacgctacagggatggattaatggtttcagacatggatctcaacctctgcagacaactgaaagataaatggggtttccgcatgacggcacgatacgaattgtattctgaaatgctcgctaagtacctaaagccggactttactccgcaggtcattgtcgatcccatgttgcagaagagaaatccactttgatgaaggaaatgatttaggtacttcagctcgattgttcctgatgtttcattgacatgggaagctgcaacaggtatcaaatggcacatgaataaacattggcactgaggtttgtgatcgatgctgtgattaaattgtttctttggtgatgttaatggtgctttgttgactgtaaacctggaataatgtgagtagttaatgttccaactaaagtgcttagaagtgggacttgacaacatgatcatggaacaacagagaaatagcatgttggttttgggtgcagagattggactgttgaagtagggaattggctgttcgattacatttctgtgtgctcgcaaaggataagttgtg

SEQ ID NO: 2949 - DNA, 1519 bp, Carpinus betulus
aaagaaagaaatggagaaaaccaggaggttgaagctgaaaatggagaaggcgtagaagaaagcaagtccctgaaagacggttccatttgtgggtacgagtcacttcactccctcctgagcgcaaatctcaagcctgagatcttccaggaagtcagccgcttgctaattgggcttaattgtggaagggctattgatgcaatagttctcccagaatccactaaagctctctcttcagaacatgattttgaccttcaggctttctgctttcgtgctgacaaagaattattgagagcacctagagttgttagagttggtcttattcagaactctatatctcttccaacaactgccccctttctggaccaaaagagggctatctttcagaaactaaaaccaatcattgaggctgccggttcttcaggagtcaacatattatgcctgcaagaagcatggatgatgccatttgccttttgtacgcgagagaagaggtggtgtgaatttgcagagcctgttgatgggaatcaacacaatttcttcaagatcttgcacttaaatataatatggtcattataagttcaattcttgagagggatgtcaatcatggagagactctttggaacactgctgttataattggaaatcatggcaacataattggcaagcatcggaaaaaccatataccaagagttggcgacttcaatgagagcacatattatatggaaggcaacacagggcatcctgtttttgagacagcttatggaaagatcggtgttaatatctgttatgggaggcaccatcctttgaattggttagctttcggcttgaatggtgcagaaattgttttcaacccttctgctactgttggcgaactcagcgaaccaatgtggcccatcgaggcccgaaatgctgcaatagcaaacagttactttgttgggtcaatcaaccgagttgggactgagatattccccaatccattcacttcgggtgatggaaagccacaacatgcagattttgggcacttttatggatccagccattttagtgccccagatgcttcttgcactccatctctttcccgcaacagggatggcttgttgatctcagacatggatcttaacctttgcaggcagctaaaagacaagtggggcttccgaatgactgcgcggtacgaggtgtatgcagagttgcttgctaattatttgaagccagatttcgagccccaagtcattactgaccctttgttacataagaagactctgtaaatttcaggtactaggaggacgagttcatgtgaaaagaaaaagaaaggttaaaaactgtgttggaataatacttcaagttgaagtatctgtaaaaaataaatgcactcagtgttgacttgagaactttcattgtttttaagatctagttgtacagttagatagccagtattgcccggtgctattaaataaatactcagttagaaaaaaaaaaaacaaaaaaaagtaaaactctgcgttgtataaccactgctagttgt

SEQ ID NO: 2950 - DNA, 1440 bp, Zea mays
tcgatgttcagcttgattcgtataataaattgccatttttcattactgtgcttgtagagatgttgtgattgcagagacgtagcatgttttttctagacaccagcagctatcatacagaaactaattatattggttgatggatttaaatctacttgtgctacaggcattccgttttagtgcagacaaagagtttctgaggcaatcaagagttgttcgagtaggtctaattcagaactcaattgctgttcccactacttgtcactttgctgaccaaaagaaggcaatcatggacaaaataaaacctctaattgatgcagccggcgcttctggtgtcaatattatgtgcttacaagaagcctggacaatgccttttgccttctgcacacgcgagaaaagatggtgtgaatttgctgaaccagttgatggagaatctactcaattccttcaggaacttgcacagaagtataacatggtaatagtgagcccaatccttgaaagggatataaaccatggggagactatttggaatactgctgttgttattggaaacaacggcaacataattggcattcatcgaaagaatcacattccaagagttggtgatttcaatgagagcacatactacatggagggtaacactgggcatccagtgtttgaaacagcttatggcaaaataggagtgaacatttgttatggaagacatcatccccttaattggcttgcgtttggtctcaatggagctgaaatagtgttcaacccatctgcgactgttggtgaactgagtgaaccaatgtggcccattgaggcaaggaacgccgcaattgcaaacagctacttcgttggatcaattaatcgggttggcacagaagtgttccctaatcctttcacatccggtgatgggaaaccgcaacacgcagactttggccatttctatggatctagccatttctcagcacctgatgcctcctgcaccccatctctatcacgctaccgagatggcttgatcatctccgatatggacctcaacctatgccgccagatcaaagacaagtgggccttccgcatgactgctcgctatgagatgtatgcatccttgctctcagagtacttgaagccagatttcaaacctcaagtcattgttgatcccttgattaataagaaggcataaaaactgaggtatgctggatacttgggcttaaaaggaggtcatttgtgtattgacatgaacaggaaaaggtttaccatttagcagaataatgtctacgatgaagatgcaaaatggaggaagtttctttctttttttttcctttacatttccacatactgtaaaaatgtgtttggtgtagtttgagcttcttttactcaatattcgaaacagtaatgcttgttttgttgtataatttgctagagatttttcgatgaagaaattcaacaatcttt

SEQ ID NO: 2951 - DNA, 1503 bp, Theobroma cacao
gccagatttattctgatcaacggtcagtaatttgacggttcatagttaaactgaaaccttaccttgctgtccattatcaataaataaggattaaggaagagaaagaaacaatcagagtagtaataattcaggcatggagaaaagtgaaggaattgagaaagaaaatggaactgtagaagagaagcaaagctttaaagatggatcaatttgtgggtatgactcccttcaacgcctcttgagcgcaaatctcaaacctcaaatctttcaggaagtcagccggttgcttctgggcctgaattgtggaagaccccttgaaactattgttccccccgaatcagctatagctctctcttcaaaacatgattttgacctccaggctttcagcttttctgctgataaagagttgttgagagaacctcgggtagtaagggttggtcttattcagaactctatagctcttccaactactgctccctttttggaccagaaaaaagctatcttcaagaaattgagaccaataattgatgctgcaggtgcttcaggtgtcaacatactatgcttgcaggaagcatggatgatgccatttgccttctgtactcgggaaaagaggtggtgtgaatttgcagagcctgacaatggggaatctacacaatttcttcaggaatttgcatgcaagtacaacatggtcattataaacccaattcttgagagggatgtaaatcatggggagactctctggaatactgctattataattggaaatcatggcaacataataggcaaacatcgtaagaaccatattcctagagttggggactttaatgagagcacgtattatatggaaggaaataccgggcatcctgtgtttgagactgcttatgggaagattgctgttaatatatgttatggaaggcaccatcctttaaattggctagcttttggtttgaatggtgcagagattgttttcaacccatcagccacagttggtgaacttagtgaaccgatgtggcccatagaggcacgtaatgcggcaatagcaaatagttactttgttgggtcaatcaatcgtgtagggactgagatattccctaaccccttcacttcaggggatgggaagccagaacatccagattttgggcatttctatggatctagtcatttttcagcaccagatgcttcctgcacaccatcactctcccgttataaggacgggctgctgatctcagacatggatcttaacctctgtaggcaattgaaagacaaatgggggttcagaatgactgcgcgatatgagttatatgcagacatacttgcccgttatctgaaaccagactttgaaccgcaagtcatccctgatcccttattacataagaagtcttcttaagttctaggtactagtttcagctccaatctgaagggaataaatggaggtgaaaatggaaactgtattcaaacaacatatgtaatcatcagtgcagaataagttcttcgtgtttgtgtttg

SEQ ID NO: 2952 - DNA, 1506 bp, Gossypium hirsutum
tccttgacacctgatcttctgcttgcccatcagccaacaccgattcttgacaccagacaccagcattctattcaactttttttcttatgttttgatttcggagcaataattgagggaatcagaaaatggagaaaactgatggaattgggaaagaaaatggaagcacagaagaaaagcaaagtttcaaagatggatcaatttgtgggtataattcgcttcaccacctcttgagcgcaaatctcaagcctcaactctaccaggaagtcagccggttgcttctggggctgaattgcggaaaagcacttgaaactattgttccacctgaatcagctaaagccctctcttcaaaacatgattttgatcttcaggctttcaaattttctgctgacaaagagttgttaagagaaccccgggtagtaagggtcggtcttattcagaactccattgctctcccaaccactgctcccttttcagaccagaaaaaagctatctttgagaaattgggaccaataattgatgctgctggtgcttcaggagtcaacatactatgcttgcaggaagcatggatgatgccatttgccttctgtacacgagaaaagaggtggtgtgaatttgcagaacctgttaacggggaatctacacaatttcttcaggaatttgcactcaagtataacatggtcattataagctcaattcttgagagggatataaatcatggagagactctctggaatactgctgttataattggaaatcatggcaacataataggcaagcaccgtaagaaccatattcctagagttggggacttcaatgagagcacgtattatatggaaggaaataccgggcatcctgtatttgagactgcttatgggaagattgctgttaatatatgttacggaaggcaccatcctttgaattggctagcttttggtttgaatggtgctgagatcgttttcaacccatcagccacggttggtgaacttagtgaaccgatgtggcccattgaggcacgtaacgctgcaatagcaaacagttactttgttgggtcaatcaatcgtgtagggactgagattttccccaacccattcacctcaggggatggaaagccaccacatccagattttggccatttctatggatctagtcatttttcagcacctgatgcttcctgcacaccatcactctcccgttataaggatggactgatgatctcagatatggatcttaacctctgtaggcaactgaaagacaaatgggggttccgaatgactgcaagatatgagttatatgcagatacgcttgccagttatctgaaaccagactttgaaccccaagtcatctctgatcccttgttacataagaagtctttttaagtacctgtcttcttaagttccaggtactaattgcagcttaatgtatgaagttaataaatggagatgaaaatagaaactgtattgatttatcatattgaatcatccacaagaacaagttcgttgtgtttgt

SEQ ID NO: 2953 - DNA, 2254 bp, Ipomoea nil
accgtcaccctcatcttctccagctgagaattgagatgaactgatcgcgcaggaagaaatggagaacaggaaagaggacagtaacgatgtatcaggcaactgtaatgcacaaccaacaacagagacctccaaaaacgcttccatctgtggcttcgactctcttcatcgcctccttcaagcttccctcaccccccaactctttcaggaagtcagccgcttgcttcttgggctaaattgtgggagagcagttgaggccattgaagttcctgagcctgccaaagctctgtcagcaaaacatgacttcgatcttcaggcattttcgtttcatgctgacaaagagtcactgagacaacctcggattgtcagggttggcctcattcagaattctattgctcttcctacaaccgcgcctttcttggaacagaagagggccatatttcagaagttgaagcccatcatcgatgctgctggaactgcaggagtaaatatcctgtgtttgcaagaggcctggacgatgccatttgcattctgtactcgtgagaaaagatggtgtgaatttgctgagccagtagatggagaatctacgctgtttcttcaagagtttgctaggaagtataacatggtcataatcagtcccattctcgagagggatgtgaaacatggagagacgctctggaatacgtgtgtagtaattggaaatcatggtaacataattggaatacaccggaagaatcatatacctagagtcggggactttaatgagagtacatactacatggaaggaaacactggccatcctgtctttgagacggcttatggcaagattggtgttaatatatgttatggaaggcatcatcctctcaactggttagctttcgggctaaatggagctgagattgttttcaacccttcagctactgtcggtgagctcagtgaaccaatgtggcccatcgaggctcgtaatgcagcaatagcaaatagttactttgtagcttcaataaatcgagttggaaccgaagttttccccaatgcattcacatctggagatgggaagcccgagcacacggattttgggcatttctatggttccagccatttctcgtcaccagatgcttcgtgcacgccatctttatcccgttacagagacgggttgatcatatcagacatggatcttaacctctgcagacaactcaaggacaagtggggattcaggatgactgcacgatacgagatgtatgcagacttgctttctcgctatgtaaaaccagatttcgagccacaagtcatctccgatcccttgttacataagaatgcctcttgagttatcatggcaggtcttagaaactaagaaaagaatggccattgaactatctgtttgttctgcattatttggatgaaatacatactagaatgtattctagtacattaaactacagtactttggttgaataaagaaaaccctttttcctagatcacatgatctttagttcaaacttgagaaatagatacatctttagctatctttgctcctctttgtttggccatgtaaagtcccatgtgatgcatgagctcctggggatgaggcatgatatctttggtgttgtttgccatggagggtgggaagtcaaaagtggcacatccctttgagcaaacaacaacatcctccaaaggatcaagaaaacctcggtttctagccgatatggttgagcaaacaaaatccagaacacaaatgtctgtgcaaactccaaccaccagtaaaacttgaatcttgttgtcttttacccaatcaacaagcgttagagccgtcttcctcagctgatccgatgtagccatcatagcaatctttgtgcctgatcctcacatttggttcattctctagccatctcagagcaggaacaagattggatccatcagagccagagatgcagtgaggaggataagggtgttcaagcttgtcaggactgtgtgaatcaagaaaggcaagaacaggccaacccttttcacagaacaaccttgccagcctagcagattcatcaatcatttctgaaatctgcctgttgggttctcttggagccagatttccagctccaacagtgcagaagccattgatgatatctacaagaactagaccagtcttggcagcctctgatataaccactgattcctcatttagaggaatttcattcttaatcagatcaattgtctttagtaccatcttatcaacaaactttctgatttaaggatatggtttctc

SEQ ID NO: 2954 - DNA, 1730 bp, Musa acuminata
ctttacccttgacgcaattgaagcctttgcgtcgaacgacgcgggacccaccagcagacggctgtagaaaacgtaccggactgccgatatcttccccgacggaggacttccatccggcgatgggaagccaccaggaaagagaggagaacggaggggcggcggcggaggggcaagagatctcggcgccaggatccatccatggcttcgagtccctccatcgcctcctcgaggcgaatctgaagcccccgatcttccaggaagttagccgcttgctgctgggactgaactcttggagccctctccagcggatttctttgcccatggctgcgaccactctatctgaagcatataattttgatttgcaggctttttgcttccatgctgatgcagagtatttgagggaaccacaaattgtacgtgttggcctcatccagaattctatcgctcttccaactactgcacacattgcagaccaaaagaatgctctcatgcaaaaggtgaaacccatgattgatgcagctggagcatctgatgtcaatatattatgcttacaagaggcttggatgatgccatttgctttctgtactagggagaagaaatggtgtgaatttgcagagcctgttaatggagaatcgactcagtttctccaaaaacttgcgaggaaatataatatggtcatcgtgaatcccattcttgaaagggatgtaaaccacggggaaaccatttggaacactgctattgtaattggaaaccatggcaatatcattggcattcatagaaagaatcacattcctagagttggggattttaacgagagcacgtattatatggaaggaaacaccggacaccctgtgtttgaaacagcttatggaaagattgcaataaacatctgttatggaaggcaccatcccttaaattggttagcttttgggcttaatggagctgagattgtcttcaacccttctgcaactgttggggaactcagtgaaccaatgtggcctattgaggctcggaatgctgccatcgcaaatagttattttgttgggtcaattaatcgtgttggtactgaaatatttcctaatgcattcacttctggtgatgggaagcctgaacattcggattttggtcatttctatggttctagccatttttcagcaccagatgcttcttgcaccccatccctttcacgctacagagatggattaatggtttcagacatggatctgaacctgtgcagacagttaaaagacaaatggggtttccgcatgactgcacgatatgaactatatgctgaaatgctttctaagtacctaaagcctgatttcactccacaggtcatcgttgatcccatgttgcagaagagaaaataaatttgacaaaagaaatgatttggctgcttcggaacagttattcctgctgtttcattgatcaggaaggctaaaacagatatcaagtggcacggaaaataaacatcggcactgaggctagtgatcggtggcaagggcattcatattgttctttgatgatgcctagtaaagtgtaaaccggaaacaatgtaagtggttcatctcccaaccaaggtgcttgcaagaggactttgactaacttgagtaatcatgagtcatcttacacatgcatgggttgttcatccaaataagttattcaaagtatacgtttagaactacattataatgaaaaatataaaattgcattggcttagcagttcagag

SEQ ID NO: 2955 - DNA, 1702 bp, Gossypium hirsutum
tgatacgttagctaatatcaatttaaagaaaagaaggttcaaccatttttcaatgttttgatttcggagcaataattgagggaatccgaaaatggagaaaactgatggaattgggaaagaaaatggaagcacagaagaaaagcaaagtttcaaagatggatcaatttgtgggtataattcgcttcaccacctcttgagcgcaaatcttaagcctcaaatctaccaggaagtcagccggttgcttctggggctgaattgcgggaaaacacttgaaactattgttctacctgaatcagctaaagccctctcttcaaaacatgattttgatcttcaggctttcaaattttctgctgaccaagagttgttaagagaaccccgggtagtaagggtcggtcttattcagaactccattgctctcccaaccactgctcccttttcagaccagaaaaatgctatctttgagaaattgggaccaataattgatgctgctggtgcttcaggagtcaacatactatgcttgcaggaagcatggatgatgccatttgccttctgtacacgagaaaagaggtggtgtgaatttgcagaacctgttaatggggaatctacacagtttcttcaggaatttgcacgcaagtataacatggtcattataagctcaattcttgagagggatataaatcatggagagactctctggaatactgctgttataattggaaatcatggcaacataataggcaagcaccgtaagaaccatattcctagagttggggacttcaatgagagcacgtattatatggaaggaaataccgggcatcctgtatttgagactgcttatgggaagattgctgttaatatatgttatggaaggcaccatcctttgaattggctagcttttggtttgaatggtgctgagatcgttttcaacccatcagccacggtcggtgaacttagtgaaccgatgtggcccattgaggcacgtaacgctgcaatagcaaacagttattttgttgggtcaatcaatcgtgtagggactgagattttccccaacccattcacctcaggggatggaaagccacaacatccagattttggccatttctatggatctagtcatttttcggcacctgatgcttcctgcacaccatcactctcccgttataaggatggactgatgatctcagatatggatcttaacctctgtaggcaactgaaagacaaatgggggttccgaatgactgcaagatatgagttatatgcagatacgcttgccagttatctgaaaccagactttgaaccccaagtcatctctgatcccttgttacataagaagtcttcttaagtacctgtcttcttaagttccaggtactaattgcagctcaatgtatgaagctgataaatggagatgaaaatagaaactgtattgatttatcatattgaatcatccacaagaacaagttcgttgtgtttgtgtttgcaagtatttgtgcccttttctgttagcaatttctgatcactccaccagcttccatttttattaagatgaagaaaaaggaatcttggtgtctgcatttggtgaaaaaatataaaatgaagtggaatgaatgttgacaagctcaccgactctcgttttccctcttttttctgtctgtttctataaaaattttcaagtctcatcatctaagcttatccacaattaaaa

SEQ ID NO: 2956 - DNA, 1354 bp, Flaveria ramosissima
tcctcctaaagtgcattagtgcaagacgcaatcggcacttctgcagagaaaaatggagacgaaagaagaagctgttaatgaaaatggaaatttagaagaatcatcaagaaccctaaaagatggatcaatttgtgggtttgaatctcttcatcgcctccttgaatcgtctctttctccccaagctttcaaggaagtcagccgcttgcttactggactgaattgtggaaaagcacttgagcccttgacaatagtagaaaccgccaaagggttgtcctcacaacatgattttgatatccaggcattcagatttaatgctgacaaggaattactgagagaaccctgtatagtgcgagttggactaattcaaaactccattgctctaccaacaactgcaccctttcttgaccagaagaaagccatctttcagaaactaaagcccataatcgatgcagcaggtgcttcaggggtcaatatattatgtttacaagaggcatggatgatgccttttgccttttgcacccgtgagaaaaggtggtgtgaatttgctgagcctgcagatggagaatcaacacagtttcttcaaggctttgcaaggaaatataatatggtcatagtaaacccaatactcgagagagatttgaaacatggggaaactatttggaatactgcagttattattgggaataacggtaacataattggcaagcacaggaagaatcatataccccgagttggggattttaatgagagtacatattacatggagggcaatacggggcaccctgtatttgagactgcctatggaaagattggtgtcaacatatgctatggaaggcaccatcctttaaactggttagcctttgggttaaatggtgcagaaattgtgttcaatccatcagccactgttggtgaactcagtgagccaatgtggcccatcgaggcacgaaatgcagcaatagcaaatagttactttgtggggtccatcaatcgggtcgggaccgaggtgtttccaaacccgttcacatcaggcgatggaaagccgcaacatgcggactttggtcatttctacggctcaagccatgtttcagcaccagatgcttcatgcacgccatcactttcgaggaacagagacgggttgttgatatcagacatggatcttaacctctgcagacagctaaaggacaaatggggattccgtatgacggccagatacgagttatatgctgacatgctttcccgatatgtgaagcctgatttcgagccccaggtgatttctgatcccttgttgcctaaaatcatttgtaaaaggttggaaatacttttattcatgctctatgttgatttatgccaactc

SEQ ID NO: 2957 - DNA, 1970 bp, Fragaria vesca
tcctcaagcaatttgagatactggacccggccggcctgacaaattggggcccaaagtcctcaatcatatagttcgatttgaccaacagaagaggcaaggaagaagagagaaatggaagagaaaaatgggcaagtcgaaaaatcaagcgatggctccgtctgtggctacgactcacttcaccacctcctgagtgcaaatctcaaaccccatctcttccaggaagtcaaccgtattctgttaggtctgaattgtggcaagccactagaaacaatttctgttccagaatctgctaaagggctctcgtcgcaacatgattttgacctccaggctttctgctttcatgcggacaaagagttgttaagggaacctcgaattgtgagggttggtctcattcaaaactctatagctgttccaactactgcccactttatggaccagaagagggaaatatttgggaaattaaagccaataattgatgctgcaggtgtttcaggagtaaacattttatgcttgcaggaagcatggacaatgccgtttgccttttgtacgcgggagaagaggtggtgtgaatttgcggagcctgtagatggggaatcaacacgatttcttcaggatcttgcacggaaatataacatggtcatcataagtccaattcttgagagggatgtcaatcatggggagactctctggaatactgctgtcataataggaaatcatggcaacataattggcaagcatcgaaagaaccatataccaagagttggggacttcaatgagagtacttattatatggaaggaaataccgggcatccagtttttgagactgcatatggaaaaattgcggtaaatatatgttacggaaggcatcatcctttgaattggttggcatttggcttgaatggtgcagagattgtcttcaacccatctgccactgttggtgaactcagtgaaccaatgtggcccattgaggctcgtaatgctgcaattgcaaatagtttcttcgttggatcaatcaaccgtgtggggacagaggttttcccaaatccatttacttctggtgatggcaagccacaacattcagactttggccatttctacgggtcaagttatttttctgccccagatgcctcatgcaccccttctctttcacgccattgtgatgggttgttgatgtcagacatggacctcaacctctgtagacagataaaagacaagtggggattccgaatgactgctcgttatgagttgtacgccgatctgcttgaccgttatttgaagccagattttgagccccaagtcatttctgatcccatgttacataagaagactgcataatggtttagtcacgggttattgcaccagaagattgcacaatgcaagatatagctcgaataaatctgtgcgcagaacttactgtttcagatatatgtcggtataataatattcatgcaaaagaaacgttttgtagataaaattacgtaaaatgtgcaagcaagaaaagttatgaagaatgcgaaccaaggtgtccagaaacctgtgctgaattctacagaccttatacacttgaggaccaggagctagtcttattgttcttcatctccttgctcttgatttacttcagagtatgaccaactgatacagttgttgaggtaaattgcgcttttaaaaaagaaaaataataataatttgttcgaggttggcaatctagtcctacatggtcatggtctgctgctctgaaatactacaaaagaaaagtctgaaaaactacggtagagttggatagatcccttcccaaagtttccatccctcctcagtatgcttgttggtgagagcatggcgtttttatttgtgcttcagtctccaaatgttgtaaattcaactctcgtttgtagtatagttgtataactaataaaaaattacaagaatgggagtaatcgagtaggaagccattttgaggatcggacttatat

SEQ ID NO: 2958 - DNA, 1775 bp, Pennisetum glaucum
tcagcaccgccggagccaccgtccctgcccgctttgtttggccctacggtggcaagagggtcttcgtgtcaggctccttcaccaggtggtcggaacatttgcaaatgtcccccgttgaaggctgcccctctgtgtttcaggctacctgcagcctgtctccgggaatgtaccagtacaagttctttgtggacggggagtggcggcacgatgagcgccaacctactgtatcaggagaatatggcatagttaacactctatacctgacaagggaaattaatcaaataaactcagtattaagcccaagcacacctggaaccaggatgaacatggaagtggatagtgaaaattttcaacgtacggtcacagtgtcagatgggaataatcaagaaggtcctcttagagtttcagaggctgctatacaaatctctaggtgccgtgtcattgaatatctgagtttgcatacgggctatgatttgcttccagactcgggcaaggttattgctctggacgttaatttgcctgtgaagcaatctttccatatcctgcatgaacagggaatccctgtagctcctctgtgggattcgttcagaggtcagtttgttggccttctgagcccgttggatttcatactcatattgaaagagctagaaactcatggctcgaacttgacagaggagcagcttgaaacacacactatatctgcatggaaagaggctaagcggcaaacttacggaagatatgaggggcgaccacatcagcctctagtgcatgtcaccccttatgagtccttgagggacattgctctaaagatattgcaaaatggcatttctacagtgccaatcatttattcatcatcgtcagatgggtcattcccgcagctgttgcatcttgcatccctgtctggaattttgaaatgtatatgtagatatttcaaaaactcaactggtaatttgcctattctaaaccaaccggtgtgcacgattcctctgggttcctgggttccgagaattggtgatccaaacggccgtccattggctatgttgcggcgtactgcatctcttagctctgcccttaacatgttgattcaagctggagtcagctcaataccaattgtggatgataacgattcgctggttgacacttattccagaagtgacatcacagctctagcgaaagacaaggtctacacacatattcgcctggaggagatggccattcagcaggctttgcaacttggacaggatgccaatacaccttttggtcatttcaacgggcagaggtgccagatgtgcctccggtctgatcctttgctgaaagtgatggagcggctgtctaatcctggggtgcggcgggtgttcatcgtggaagctgggagcaagcgcgtggaaggcataatatcactgagtgacatcttcaggttcttgctgagcttgtgagagaaggtgtttcgtcgtgacagagtgagtgcccgagtcttcttaactgtgtagcaaaaccgaagctgctgccgccgccttcttgtggcaatctatccctgtgtctgtctgtctgtggccggcctggaaggattaacttttggcggcagagataatggggcattcactattcagttcagggtctgtaaagttcctctctctttttttttccttttaattttgtgcccccatgttacacaaaaatatgtggtgatttttatttattggattgcttactaaataaaaaaaaagtaaaaaactctgcgtgtataccacctagtcttaagtacagtggtagtc

SEQ ID NO: 2959 - DNA, 1987 bp, Panicum virgatum
cgggccgggccgggccgggccctttgttttttaccatctcctcttcctttcctctccgtctccgtgtccatccccatctcctccgccttccccttgccctcccctcccctccccacgccgcattcgcatctccggatccccgccgccgccctcccccactccgcgtccctcgccattgccgccgctagcctcgatctcccctcgattccccgcgccccgattcttactctcgcgtgggtaggatatggcttggagcgggggctgctcggcccggcgcgggtgatctatcctcgcgcggggagccctctcgcgcaccacgcggaggatcccgtcgcggctggtgcgcccttctccctcctcctcctccacctctgcccccgcgcgcgcggctctagggtttgctctccttcctcgctagcgggttccatctcctcccctcccctcccgctgctctgccatcatgttctcgcacggcgctgattccgcccacgacgccgggggcgtcggcgtcagcagcgccggagccaccgtcccggcccgctttgtctggccctatggtggcaagagggtcttcgtatcaggctcctttaccaggtggtcagagcatttgcaaatgtctcctgttgaaggctgtccgaccgtatttcaggctatttgcagcctgtctccaggaatgcaccagtacaagttctttgtggacggggagtggcggcacgatgagcgccaacctactatatcaggagagtatggcatagttaacactgtatacttgacaagggaaataaactcagtattgagtccaagcacacctggaaccaggatggatgtggacaatgaaaattttcaacgtacagttacgttgtcggatggtaatattcaggacggtggtcctagagtttcagaggctgctatacaaatctctaggtgtcgtgtttctgagtatctgagtttgcatactggctatgatttgcttccagattcgggcaaggttattgctctggacattaatttacctgtgaagcaatctttccatatcctgcatgaacagggaattcctgtagctcctttgtgggactcattcagaggtcagtttgttggccttctgagcccattggattttatactcatattgaaagagctggaaactcatggctcgaacttgacagaggagcaacttgaaacacacaccatatctgcatggaaagaggctaaacggcaaacttatggaagacacgatggtcagtggcgaccacatcagcctctagtgcatgccaccccttacgagtccttgagggacattgctctaaagatattgcaaaatggcatttctacagtgccggttatttattcatcatcgtcagatggatcattcccgcagctgttgcatctcgcatccctttccggaattttgaaatgtatttgtagatatttcaagaactcaactggtaatttgcctattctaaatcaaccagtatgcacaattccactgggttcctgggttccaaaaattggtgatccaaacagtcgtccattggctatgttgcggcctcatgcatcacttagctctgcccttaacatgctggttcaagctggagtcagctcaataccaattgtggatgaaaacgattcgctgcttgacacttattcgagaagtgacatcacagccctagcaaaagacaaggtctacacacatgttcgtttggaggagatgaccattcatcaggctttgcaacttggacaagatgccaatacacgttttggttttttcaatgggcagaggtgccagatgtgcctccggtccgatcctttgctgaaagtgatggagcgactgtctaatcctggggtgcggcgagtgttcattgtggaagctggcagcaaacgtgtggaaggcataatatcactgagtgatattttcaagttcttgttgagcttgtgataatggcatggatgttttgttgtgacaagtgccggagttttaactgtagca

SEQ ID NO: 2960 - DNA, 1939 bp, Panicum virgatum
ctggtgcgcccttctccctcctcctcctcctcctccgccttccccttgccctcccctcccctccccacgccgcattcgcatctccggatccccgccgccgccctcccccactccgcgtccctcgccattgccgccgctagcctcgatctcccctcgattccccgcgccccgattcttactctcgcgtgggtaggatatggcttggagcgggggctgctcggcccggcgcgggtgatctatcctcgcgcggggagccctctcgcgcaccacgcggaggatcccgtcgcggctggtgcgcccttctccctcctcctcctccacctctgcccccgcgcgcgcggctctagggtttgctctccttcctcgctagcgggttccatctcctcccctcccctcccgctgctctgccatcatgttctcgcacggcgctgattccgcccacgacgccgggggcgtcggcgtcagcagcgccggagccaccgtcccggcccgctttgtctggccctatggtggcaagagggtcttcgtatcaggctcctttaccaggtggtcagagcatttgcaaatgtctcctgttgaaggctgtccgaccgtatttcaggctatttgcagcctgtctccaggaatgcaccagtacaagttctttgtggacggggagtggcggcacgatgagcgccaacctactatatcaggagagtatggcatagttaacactgtatacttgacaagggaaataaactcagtattgagtccaagcacacctggaaccaggatggatgtggacaatgaaaattttcaacgtacagttacgttgtcggatggtaatattcaggacggtggtcctagagtttcagaggctgctatacaaatctctaggtgtcgtgtttctgagtatctgagtttgcatactggctatgatttgcttccagattcgggcaaggttattgctctggacattaatttacctgtgaagcaatctttccatatcctgcatgaacagggaattcctgtagctcctttgtgggactcattcagaggtcagtttgttggccttctgagcccattggattttatactcatattgaaagagctggaaactcatggctcgaacttgacagaggagcaacttgaaacacacaccatatctgcatggaaagaggctaaacggcaaacttatggaagacacgatggtcagtggcgaccacatcagcctctagtgcatgccaccccttacgagtccttgagggacattgctctaaagatattgcaaaatggcatttctacagtgccggttatttattcatcatcgtcagatggatcattcccgcagctgttgcatctcgcatccctttccggaattttgaaatgtatttgtagatatttcaagaactcaactggtaattttcctattctaaatcaaccagtatgcacaattccactgggttcctgggttccaaaaattggtgatccaaacagtcgtccattggctatgttgcggcctcatgcatcacttagctctgcccttaacatgctggttcaagctggagtcagctcaataccaattgtggatgaaaacgattcgctgcttgacacttattcgagaagtgacatcacagccctagcaaaagacaaggtctacacacatgttcgtttggaggagatgaccattcatcaggctttgcaacttggacaagatgccaatacacgttttggttttttcaatgggcagaggtgccagatgtgcctccggtccgatcctttgctgaaagtgatggagcgactgtctaatcctggggtgcggcgagtgttcattgtggaagctggcagcaaacgtgtggaaggcataatatcactgagtgatattttcaagttcttgctaagcttgtgagaagagcatggatgttttgttgtgataagtgctggagttttaactgtagca

SEQ ID NO: 2961 - DNA, 2616 bp, Zea mays
aactcttcccctctcttgcctgcctccctccctccctccctccttctccatctccgctttccctcctcgcctaggcctagccgcccccgcacgccacgccacgccacgccacattcgcatctctggatccccctcccttcgccctctcccattacccgccgccgccgcctcgcgcccgcgacccacccggcctcccacttcgatcccgccccgttcgctgcccccgccccgattccgattcgtcactgtatcgcgcgcgcgcggtggtaagacagcgatggctcgtggcgggggcctctcgccccgccgcgggtgatctctcctctagcggggagccttcccgcgtgcccaagcggaggatcccgtcgcagctggtgcctcacctatccctctccttcgcatctccgccgtgctctctcgcgcaccccctcgaccctaggtttgctccttccctcccttcctcgccacccgattcgatctcgctccctccggcctccggctaggctgctccgtctctcctccgccatgttctcgcacggcgctgattccgcccacgacgccggggccgtcggcgtcagcagcggcggggctaccgtccccacccgcttcgtctggccctatggtgggaagagggtcttcgtctcaggctccttcaccaggtggtcggaacatttgccgatgtctcctatcgaaggctgccccactgtatttcaggctatttgcagtctgtctcctgggattcacgagtacaaattctttgtggacggggaatggcggcatgatgagcgtcaacctaccatatctggggagtttggcatagttaacacactttacttgacaagggaatataaccaaataaataccttatcaagtccaagcacacctggaagcaggatgaacatggatgtggataatgaaaattttcaacgtacggttacgttgtcagatggtaccgtttcagaaggtactctgagagtttcagaggctgcaatacaaatatctaggtgtcgtgtttctgaatatctgagtttgcatacatgctatgatttactcccagattctggcaaggttattgccctagacattaatttacctgtgaagcaatcattccatattctccatgaacaggggattcctgtagctcctctctgggactcattcagaggtcaatttgttggtctccttagcccattggatttcatactcatattgcgggagctagaaactcatggctcgaacttgacagaagagcagcttgaaacacacactatatctgcatggaaagaggctaagcggcaaactaatggaagaaatgatggtcagtggcgaccgcaacagcatctagtgcatgccaccccttatgagtccttgagggacattgcagtaaagcttttgcaaaatggcatttctacagtgccagttatttattcatcatcatcagatggatcattcccgcagttattgcatcttgcatcactttctggaattttgaaatgtatttgtagatacttcaaaaactcaactggtaatttgcctattctgaaccaaccagtgtgctccattccgctgggttcctgggttccgaaaattggtgatctgaacagtcgtccattggctatgttgcgacctaatgcatcacttagctctgcccttaacatgttggttcaagctggagtaagctcaataccaattgtggatgacaacgactccctgcttgacacttactctagaagtgacatcacagccctagcaaaagacaaggtctacacacatgttcggctggatgagatgaccattcaccaggctttgcagcttggacaagatgccaatacaccttttggattctttaacggccagagatgccagatgtgcctccggtctgatcctttgctgaaggtgatggagcgactggctaatcctggggtgcggcgggtgttcattgtggaagctgggagcaaacgtgtggagggcatcatatcactaagtgacattttcaagttcttgctgagcttgtgaggagaggaggagcatggcggagtttttttaacagtagcaaccctctgggcctttgggtccttgcggataattggctatcgtcagggttcatggtctgtaaagttccttttttttttgtttcgttttttaccatttggcccctcccgcttgtataacctcaattaatataatggcaaccttcatttaatatgaggttacttgagggttacttgaaaaattacaagagatgttctttgcgaatagtctctttatacagagccttatacttgtaatatgcggttttttagctgtcccttgtatttagaaaattaatccgatgtctttggattgtatatgctcttagaacaattttaataatagcccacaacggattttataatgttgccatgtcacatatagttaaataaaagtctactcacataattttatgactaaacaacattttttttttgtcttcggtccgccatttacgttttggtctccatagtacggtaaggcatttttggtcatccgtgagtttttctgatcgattaggcattttaagtcttcggtctgccacccatgctttcatctcttaagggcggtgaggctacttttgtc

SEQ ID NO: 2962 - DNA, 2990 bp, Sorghum bicolor
gcaaggtgagtgaagggagaagacggcgtaggcgtagaagatccctcggggtcgggggcggaggactcgttttcaacccttggaagaggagagagggagggagggaggcgggccgagaccgagagacggacgggcacggccaggcctttgcttcccttgtcttgcttgcctaccttcttcctcccctactactactacaactagttctctcgtggaatcccctgcccttttttcctttcctctcctctctctctctctctctctcctccgtctcggcgtcgtcttcatctccatctccgccttccccctcgccacgccacgccacgccgcattcgcatctccggatccccattccccgccgccgccgccgccgcctcacgcgctcgcgacccacccggcctcccgcttcgatctcgcctcgattccccgtgcccgcccccccccacccgattcgtccctgtcacgcgcgcgcgcgcgggtgggaagacagcgatggctcggggccggggcctctcgcctcgccgcgggtgacctctcctcacgcggggagccctcccgcgtgccccacgcggaggatcccgtcgcggctggtgccccacttcctcctctcctgacgccctcttcccgtgagcgcgccctccgctcctagggtttgctccctctccttcctcaccacccgatttgatttcgtcccatccgcggctaggcttctcctcctcctccgccatgttctcgcacggcgctgattccgcccacgacgccggggccgtcggcgtcagcaccggcggggccaccgtccccacccgcttcgtttggccctacggtgggaagagggtcttcgtctcaggctcctttaccaggtggtcggaacatttgccgatgtctcctgtcgaaggctgccccactgtatttcaggctatttgcagcctgtctccagggattcacgagtacaagttctttgtggatggggagtggcggcatgatgagcgccaacctactatatctggggagtttggaatagttaacacattatacttgacaagggaatttaaccaactaaacgccttattaagtccaagcacacctggaagcaggatgaacatggatgtggataatgaaaattttcaacgtacggttacgttgtcggatggtaccgttccggaaggtactccgagagtttcagaggctgcaatacaaatctctaggtgccgcgtttctgaatatctgaatttgcatacatgctatgatttactcccggattcgggcaaggttattgctctggacattaatttacctgtgaagcaatcttttcatattctgcatgaacaggggattcctgtagctcctctctgggactcatttagaggtcaatttgttggtcttctgagcccattggatttcatacttatattgcgggagctagaaactcatggctcgaacttgacagaagagcagcttgaaacacatacgatatctgcatggaaagaggctaagcggcaaacttatggaagaaatgatggtcaatggcgaccacatcagcatctagtgcatgctaccccttatgagtctttgagggacattgcagtaaaacttttgcaaaatggcatttctacagtgccagttatttattcatcatcatcggatggatcattcccgcagttgttgcatcttgcatccctctctggaattttgaaatgtatttgtagatatttcaaaaactcgacttgtaatttgcctattctgaaccaaccagtgtgctccattccactgggttcctgggttccgaaaattggtgatcctaacagtcgtccattggctatgttgcgacctaatgcatcacttagctctgcccttaacatgttggttcaagctggagtgagctcagtaccaattgtagatgaaaatgacgccctgcttgacacttattctagaagtgacatcacagccctagcaaaagacaaggtctacacacatgttcggctggatgagatgaccattcatcaggctttgcagcttggacaagatgccaatacaccttttggattttttaacggtcagagatgccagatgtgcctccgatctgatcctttgctaaaggtgatggagcgactggctaatcctggggtgaggcgggtgttcattgtggaagctgggagcaaacgagtggagggcattatatcactgagtgatattttcaagttcttgctgagcttgtgagaagagagaagaggagcatggacatttgtttgtgacaaagtgactggagggagttttaacagtagcaaacagcagtgtatgtgaagcaagccgccatgctaactctggcactctccctctctttggcctttgggcaagtaagacaggattgaaggtggcgggcttgtctttgcggataatggctgtccgggttcatggtctgtaaagttccttttttttttggtttcaagttttaaccattttgtgcctcccgttgttaccaaaatatctggtgatttttatttattggattgtttccttgcgttgctttgtcgctgagaggaccgaccgccggagctcccaaggagacaaactcttacatgcattctagtttttagggattgaacatggcattgctttcgcgggggcatttaccatgtagtgctggtgtccattaaaagatagaccgtttgtgtttgttttgctggttccatcagagcgatcaatcctgatgcctggctggatgttgtgtatttaattgatgctaataaatactaggctggtgtatcttcgtcgctggtacggtagcattcagtctttgtggtatgaaaacgaagacatgaatctagaggcgccgttgctgtcgctgctggatgaggaggagaatgtggaccgggcgactggcaccggggggatgcatccgtttccactatcccttacgcggcgggcgggcgggctggccagttggtagcggtagtaaggccttgtttagttccaaaattttttgaaaaaat

SEQ ID NO: 2963 - DNA, 2354 bp, Zea mays
gttgagtttcctgcctttggcttcccccatctcctttcctcttccgtctcggcgtttccgtctccacctccgcctccgccttccctcctcgcctcgccacgccgcatttgcatttccggatcccctcctctcgcactccccattcccctccgccgccgtctcacgcgcccgcgacccacccggactcccgcttcgatctcgccccgattcccccgctcgcgcccccaacccgattcgtccctctcacgcgcgcgcgggtgggaagacagcgatggcttggggcgggggcctctctccccgccgcgggtgacctctcctcgcgcggggagccctcccgcgtgcccacgcggaggatcccgtcgcggctggtgcactaccacctcctctccattcgccactcccccgtgctctctcgcgcgtcccctcgaccatagatagggtttgctcccttccttcctcgccgcccgatttgatctcgtcccttccgggctccggctaggctgctccgtctctcctcctccgccatgttctcgcacggcgctgattccgcccacgacgccgggaccgttggcgtcagcagcggcgtcggggccaccgtccccgcccgcttcgtctggccctacggtgggaagagggtcttcgtctcaggctccttcaccaggtggtcggaacatttgccgatgtctcctgtcgaaggctgccccactgtatttcaggctatttgcagcctgtctccagggattcatgagtacaagttctatgtggacggggagtggcgtcatgatgagcgccaacctactatatctggggagttcggcatagttaacacactatacttgacaagggaatttaatcaaataaacgccttattaaatccaagcacacctggaagcaggatgaacatggatgtggataatgaaaattttcaacatacggttacattgtcggatggtaccattccagaaggtactgtgagagtttcagaggctgcaatacaaatctcaaggtgccgcgtttctgagtatctcaatttgcatacatgctatgatttactcccggattcgggcaaggttattgctctggacattaatttacctgtgaagcaatcttttcatattctgcatgaacaggggattcctgtagctcctctctgggactcattcagaggtcaatttgtcggccttctgagcccattggatttcatacttatattgcgggagctagaaactcatggctcgaacttgacagaagatcagcttgaaacacacactatatctgcatggaaagaggctaagcggcaaacttgtggaagaaatgatggtcagtggcgagcacatcagcatctagtgcatgccaccccttatgagtccttgagggacattgcagtaaagcttttgcaaaatgacatttctacagtgccagttatttattcatcatcatcagatggatcattccctcagttattgcaccttgcatccctttctggaattttgaaatgtatttttaggtattttaaaaactcaactggtaatttgcctattctgaaccaaccggtgtgctccattccgctgggttcctgggttccgaaaatcggtgatccaaacagtcgtccattggctatgttgcgacctaatgcatcacttagctctgcccttaacatgttggttcaagctggagtgagctcaataccaattgtggatgaaaacgactccctgcttgacacttactctagaagtgacatcacagccctagctaaagacaaggtctacacacatgttcgcctggatgagatgaccattcatcaggctttacagcttggacaagatgccaatacgccttttggtttttttaacggtcagagatgccagatgtgcctccggtctgatcctttgctgaaggtgatggagcgactggctaatccgggggtgcggcgggtgttcatagtagaagctgggagcaaacgtgtggagggtattatatcactgagtgatattttcaagttcttgctgagcttgtgataagagaagaggagcatgacggacatttgtttgtgatcaatagtaagaaaacagcagggtatgtgaagcaagctgccatggatctcgcatttcccctccccctccggcctttggtcaagtaaggcaggattgaaggtggcgggctttgtctttgctgataatggctgttggaattcatggtctgtaaagttcttttttttcctttgtttttcgttttaaccattttgtgcctcccgttgttaccaaaaatatctggtgatttttattattatttttggattgtttccgccctacatacactagatgtttgcatcccatttttcaattttttacccc

SEQ ID NO: 2964 - DNA, 2621 bp, Brachypodium distachyon
gggctaggtctccttttcaaccctcgctcgctcggaacggaacacacacgagaacgagacccccttcttcctcaccgcattcgcatctccctccggatccccccctccccccaccgcctcgccgccggcccgtcgacgcccgcccctccttccttcctccccctcgttcgccattccaccccctcgatccctcgcgcccgattcgtgacggacgacgcagccgcggggagtgatgccggtgggcggggccgtcctgctgctgctcctgctcctgcgccggtgatctctctctatctctctcacgcccgcccgcccgccctcgcacgcgcccacgccgcggcagccgcgcgcccgtcccacctccgtagtcgcagcagcagcccccccgcagcagcagcagctccccccgttctagggtttgctcccccgatctcgccccccggctggtctcctttgcttggaccccgcgctcgtcgcctcgacggctagccgggcgcagatgttctcccacggcgccgattccgcccgtgacgccgccggggccgccgtcggcgtcagcgccgccgtccccacccgcttcgtctggccctatggaggcaagagggtcttcctcactggctccttcaccaggtggtcagagcatttgccgatgtctcccgttgaaggttgccccgccgtatttcaagcaatctgcagtttgtctccaggaatttatcagtacaagttctttgtggatggggagtggaagcatgatgagcggcaacctactataacaggagactatggggtagtaaacactctatacttgacaagggaatatgaccacataaataacgtactgagccctagtacacctggaagcagggcgaacatggatgtggacaatgacagttttcatcggacagtttcattgtcagatggcgcccttcaggaaggtcctccaagaatttcagaggctgctatacagatctctaggtgtcgtgtttctgagtatctgaatgcgcatactggctatgacttgctgccggattcgggcaaggtcattgctctggatattaatctacccgtgaagcaatctttccatattctccatgaacagggcattcctgtggctcctttatgggattcattcaggggtcagtttgttggccttctgagcccgctggattttatacttatattgagagagctggaaacacatggctcaaacctgacagaggaacagcttgaaacacacaccatatctgcgtggaaagaggctaagcggcaaacttatggaagaaacgatgggcaatggaggtcaaaccagcatctagtgcatgctactccttttgaatccttgagggatattgcattgaaaatacttcaaactggtgtttctacagttccaattatctattcaacagtgtcagatggatcatttccacagctgttgcatcttgcatccctttcaggaatcttgaaatgtatttgtagatattttaagaactccactggtagtttgcctatattaaaccaaccagtgtgcacaattccgctgggtacctgggttccaaaaattggtgatcccaatggtcatcccttggctatgttgcgacctaatacatcacttagctctgctcttaacttgttggttcaagctggagttagttcaataccaattgtggatgacagtgactcgctgcttgacacatattccagaagtgacatcacagctctagcaaaagacaaggtctacacacatattcgcctagatgagatgaccatccatcaggctttgcagcttggacaagatgcgaattcacctttcggactttttaacgggcaaagatgccagatgtgtcttcgttctgatcctttgctgaaggttatggagagattggctaatcctggggtgcgacgtgtgttcattgtggaagccggtagcaagcgtgtggaaggcatcatatcgctgagcgatgtattcaagctgttgctgagctagagagaaggtgtcatgtcaatattgtcgcggcaaccgccagagctaacagggtagcgaaaagagattgtgattgtcgcggcaactgccagagttaacagggtagcaaaaaagagagagttgtgaagcctgacagtttgatctcttgcatttggacaagatgggatttcagtttgaggcctgccctttgctgctgctgataatggccattcagggtctgtaaagtttttttctttttcttgtgccatacctggtgatttttatttattggattgtcgttgctgtcctggacccggaggagagctaggtcgtcatcattctgtgtcctgtccattctagagacatgttagacttgaactagagggaggggagggggttgggaaggagagggatgttcctgagactgaatgaatggtccaccatgtgttgtttttgcccaacaagccttttcggcgggcagtcatgcaaccatgtgaagatggtgtgttatatttccttttgaacatcttggcgacgaatgcgtcgtctttgggtgggtcgtctgagtgatgtaaaaattgtaaacaccgttttatgtctgaaatcatttgacatttccctgtcccttgtttaccgtcaattaatctttgtatgttctttc

SEQ ID NO: 2965 - DNA, 4540 bp, Oryza sativa
cagcagagcacacaggatgggggtgttgcgggcgcagaagatccgtagatagataggcctcccctcattttcaaccctcggaagggaagcctcctttgtttttttttttcccttcttgttcatttctctcttgctccggctcgcctcgcatcgcctcttcctcctcttccctcatcgcgttcgcgtttccatccccatctccatctcctcctcctcgccgcattcgcatctccctcctctcgccgccgccgccaccgccaccgccgccgctcccttcctgccattaccgcccgtgcccctcacccccctttgcccctcgatctctcccccctagggtagggtaggggcttgcctccgattccgtacggacacaccctacctagggtagggtaggggtaggggtagggttgatagagagaggttccgggatgacggccggcgagggctgcgcggcccgacgcgggtgatccgctctcacgcggggagcccctctcgcgcgcgcttgcttcacgtgggggatcccgtcgcggctatccctcctctcctctcttcttcccccttctagtctagtttagggttttctatctatccatctagattttgatcttcccctcctcgctgcttcccctcgcccttctgacctggcgcagatgttttcccacggcgctgattccgcccacgacgccggcgccgtcagcaccggtgcctccggcgtccccacgcgcttcgtctggccctacggtggcaagagggtctacctcaccggctcctttaccaggtggacagaacatttgccaatgtctcctgttgaaggttgtcccaccgtttttcaggccatatgcagtttgtcccctgggattcatcagtacaagttttgtgtggatggggaatggcggcacgatgagcggcaacctaccataacaggagactatggtgtggttaacactttatgcttgactagggactttgaccagataaatacaatattgagccctagtacacctggaagtaggatgaacatggatgtggacaacgacaattttcaacgtactgtttctttgtctgatggcattattcaggaaggtcctcagagaatttcagaggcagctatacagatctctaggtgtcgtgtagcggattttctgaatggacaaactgggtatgatttactcccagattctggcaaggtcattgctctagacgttaatttgcctgtgaagcaatcttttcatattcttcatgaacagggaattcctgtggcacctctatgggattcattcaggggccagtttgttggccttttgagcccactggattttatactcatattgagagagctggaaactcatggctccaatctgacagaagagcagcttgaaacacatactatatctgcgtggaaggaggccaagcgtcaaacttatgccagaaacgagggttcttggagggcaaatcaccatttagttcatgccaccccttatgaatccctgagggaaattgctatgaagatactgcaaaacggtgtttctaccgttccaattatgttttcctcatcaccagatggctcatatccacaattgttgcatcttgcttccctttctggaattttgaaatgtatttgtagatattttaaaaattctcaaggtaatttacctattttgagccaacctgtatgcacaattcctctgggtacctgggttccaaaaattggtgatcctaatggccgtccattggctatgttgcggcctaacacatctcttagcgctgccctgaatttgctggttcaagctggtgtgagctcaataccaattgtggatgacaatgactcactgcttgacacatattccagaagtgacatcacagctcttgcaaaagacaaggtgtacacacacattcgcctagatgagatgaccattcatcaggctctgcagcttggacaggatgcaaattcgccctttggattctttaacgggcaaagatgtcagatgtgtctccggtctgacactttgttgaaagtgatggagcgattagctaatcctggggtgcgccgtgttttcattgtggaagctggtagcaaacgtgtggagggcataatatcactgagtgatattttcaagttcttgctgagctaagtgaaaatgcccgagccatctgtgttttgttctcacaactgccggagttaacaatagcagaaaaaaattgtgaatctccaacatcgatctctctggcttttggatcagacaggtgtcttttcccgataatggccaaccagagtctgtaaagtcttttttttttcccttgccccttcgttaccaaaatgtctggtgatttttatttattggattgttttgctgcttgctcggtttctgagccccccaaggagttagtagctctgttgaaagggtgggatgggcgcttagagacatattttagcatgaatcatcatcacagggaagtaagaattgaaggaaagaggggatgctctgaagcaagaaggatgaattcaatgtgttgtttttgctcaacaaccgtttttttggcgggcagtgttgcaaccatgaaaggagaaattacagtcggctccttgcttgttagacaaaaaaaaaaaagaaaaaaaagaagagaaaaactattggatatctgatgatgtagtgactgagaagcaggagtggagttgtgtaaaacctgtaccacctgatttttatgtctaaaccgcagcttactcattttccttgtctatgattcttgcttgcttgtgtagtgaatagtagtttttcttgtctggtatctctctctggtagcggcgccgacgtgcggaggctgtttgtacaagttgagccgcatgcaatgcatgttgaggagcaactggaaatcgatttggaacttcattgatgcgtgcaggtgaaggtgaaggtgaaggtgcaggtgcagcgtgcggtgcgtccttggtccctgtcgagtaacggcgacgggcttggcgtcgagcggaaagatctagagagggtgggttacgtcgacagacactggataagatcaatccacatcgccacattactccgcccttttagacgcttgtctgctgctgctcatcagtagttcatcagtagtagtggtaggggagataattcgtcgttcgttttgtgcatccatccagaattcgttccagatccagccagccagccatctcaagcttctctcttctcttgttattaagagcaagcaaacagtagtctagcgaagcgagactgcgagagcagagcattgttcttcttctctagctattagtggtggggaataatggctcccgccaccaccgcagcaatggccctcgcgccgcctccttcccatcaccatcaccatcaccatgtcaagcagctgcagctccctccgtctgtctccgtctccgtgcccctccgctccggtttccttggccgcgcactgcctgctgctgcccacccacagccgctgctcgccgccgagagccgccgcagcagcgccgtgtccgtgcggatgtcgtgggacgggcccctctcctcggtccgcctcattatgcagggccgcaacgtcaagctgaatgagaaggtgaaggagcacatcgaggagaaggcggggagagcagtggcgaagcacagccagcttgtgaaggaggtggacgtgcgcctctccgcccgcggtggcgagctcagccgaggtcccaagatttgcaggtgcgagatcactctcttcaccaagcgccacggcgtcatccgcgccgaggaggacgccgagtccacctacgccagcatcgacctcgcctcctccatcatcaagaggaagctcaggaagatcaaggagaaggagaccgacgtccgccacctcaaggggaccaagccccccgtctccgactggccgccatcattgctcgacaacaacgacgacgacgcccaggcccagctcaaggatctggaggaggccgtcggcgccgaggacgaggacacggtgctcaccaaggtggtgcgcaccaaggtgttcgagatgccgccgctgtcggtggaggaggcgatggagcagctagtgaatgtggaccacaacttctacgccttcagagacgagaagaccggggagatgaacgtcctgtacaagaggaaggaaggaggcttcggtctcatcgtccccaagggagacggtcatctccacaaggagaccatccccaactctgaccaccaccacccctcccttgctgcctagcctctacacctcctgcatcaccatcctcatttgctaattatttctatgcttgcccaagagtctctaaatattactagtattaattaatccaagtgatgagagaggtctttgattttgtctccgtgtacatcgatcgatcgactcttgactactctgtttaaccaactgttttcgatatatttatattattaatgatttttccaaggtttttactctgctttatttctggaagctgcatgtatagcttgtgcttttgctgtattattgcaaattttaaaaaatatatcctacatcttagccactcgatcgagaa

SEQ ID NO: 2966 - DNA, 2346 bp, Triticum aestivum
gtggcggcggcggcagcggcagcagctccgccgctctagggtttgctcgctcggccgatctccttcccccacccgctcgtcgccccgaggcgcgacggctagcaggagacggatgttttcgcacggcgcggatcccgcccacgacgcctccgccgccggcggcggcgtcagcgtcagcgccggcggcccgctcgtccacacccgcttcgtctggccacatggcggcaagagggtcttcctcagcggttccttcaccaggtggtcagagcatttgccgatgtctccagtcgaaggttgccccactgtatttcaagctatctgcagcttacctccagggatttatcagtacaagttcaatgtggacgggcagtggaggcatgacgaggggcaacctactataacgggagagtatggggtggtaaacactttgtacttgacaagggaatttgaccacataaatactgtactgagccccactacacctgggagcaggatggatgtggacaatgatagttttcaacgaatgggttcgttgttggatggtgcccttcaggaaggttctccaagaatttcagaggctgctatacagatctctaggtgtcgtgttgctgagtatctgaatgcgcatacaggctatgacctactaccagattctggaaaggtcattgctctggacattaatttacctgtgaagcaatctttccatattctccatgaacaggggattcctgtggctcctctgtgggattcattcaggggtcagtttgttggccttctgagcccactggattttatacttatattgagagagctggaaacgcatggctcaaacctgacagaggaacagcttgaaacacacactatatctgcgtggaaagaggctaagcggcaaacttatggaagaaatgacggacaacttagatcaaatcagcatctagtgcatgccaccccttatgaatcattgaggggtattgccatgaaaatactcgaaactggtatttctacagtgccaatcatctattcatcgtcaacagatggatcgtttccgcagctgttgcatcttgcatccctttcaggaattttgaaatgtatctgtagatacttcaagaactccactggtagtttaccgattctaaaccaaccagtatgctcaattccgctgggtacatgggttccaaaaattggtgaaccaaatggtcatccattggctatgttgcggcctaatacatctcttagctctgcccttaacttgttggttcaagctggagttagttcaatacccattgtggatgataacgactcgctgatcgacacatactccagaagtgacatcacagctctagcaaaagacaaggtctacacccatattcgcctagatgagatgaccattcatcaggccttgcagcttgggcaagacgcgaattcacctttcggacttttcaacggtcaaagatgccagatgtgtctccggtctgaccctttgctgaaggttatggagaggttggctaatcctggggtgcgtcgcgtgttcatcgtggaggctggcagcaagcgagtggaaggcgtaatatcgctgagcgacatattcaagttgctgctgagctagcgagagccctgttttcgttggttcccgggcaagtggtgccagaagagctagcatgcaagaaagagattgtggagccaacatggagttctctctctggcttgctcttggacaagagtagcaaaacagattgtaaagtttttttccctttcgttgtgccaacccaaccctcaccgtccgtctgtccgtctgtcgtaaccgaaactacctggtgacttttttctctttaaattttattggattgattccgctgcttggcgagattagtctccaaggagccagagatggccgtctgtctgtctgcgttggtcggtgtcggtccgttctgtgcctagtttactagcgagagaccctttcctttttcagcatgaaagaggagagggggaagatgatgatggtccggttcaagtgtcaccatgtcttgtttttgctcaacattggcagccatgcaaccatggaagaaggatttagaggaaaaatcaatcaatcgagcatgagtcaagagtcatgtgtggcccgggtggagtcagtggggtgtacaattgcaaacctcattttatgttgaactgccgtttgatttctctctggctgtagaaacttcttcacccattgtatattctctccagtggcgcagctggtatccatccatccatcctcttgatttatctgccttccctggctggcctcatggaaaacataccaacagtcagtttgctgaataaaaagaaaaagtactgactgcg

SEQ ID NO: 2967 - DNA, 2286 bp, Triticum aestivum
ccacgcgtccgcgaccttgccgcatctccggatcccccgccgcgctgcgccgccccaccgtcgtcgccgccgacccgagatcccctcctcgccccccgatttgcacggacggacggacagaccgagggagatgccggtgggagcgggcctgcgcgggtgatctctctccctccgtcgacagcacgcgcgtggggaggggagccgtcgcgtgggcaagcccgcgtggaggggtcccgtccgtcccgcgcccgcccgacctgcccgacctagggtagaagcagcagcggcggcggtggcagcggcagcagctccgccgctctagggtttgctcgctcggccgatctccttcccccacccgctcgtcgccccgaggcgcgacggctagcaggagacggatgttttcgcacggcgcggatcccgcccaagacgcctccgccgccggcggcggcgtcggcgtcagcgccggcggcccggccgtccccacccgcttcgtctggccccatggcggcaagagggtcttcctcagcggttccttcaccaggtggtcagagcatttcccgatgtctccagtcgaaggttgccccactgtatttcaagctatctgcaacttacctccagggatttatcagtacaagttcaatgtggacgggcagtggaggcatgacgaggggcaacctactataactggagagtatggggtggtaaacactttatacttgacaagggaatttgaccacataaatactgtactgagccccactacacctgggagcaggatggatgtggacagtgacagttttcaacgaatgggttcgttgtcggatggtgcccttcaggaaggttctccaagaatctcagaggctgctatacagatctctaggtgtcgtgttgctgagtatctgaatgcgcatacaggctatgacctactaccagattctggaaaggtcattgctctggacattaatttacctgtgaagcaatctttccatattctccatgaacaggggattcctgtggctcctctgtgggattcattcaggggtcagtttgttggccttctgagcccactggattttatacttatattgagagagctggaaactcatggctcaaacctgacagaggaacagcttgaaacacacactatatctgcgtggaaagaggctaagcggcaaacttatggaagaaatgatggacaacttagatcaaatcagcatctagtgcatgccaccccttatgaatccttgaggggtattgccatgaaaatactcgaaactggcatttctacagtcccaatcatctattcatcgtcatcagatggatcgtttccgcagctgttgcatcttgcatccctttcaggaattttgaaatgtatctgtagatacttcaagaactccactggtagtttgccgattctaaaccaaccagtatgctcaattccgctgggtacctgggttccaaaaattggtgaaccaaatggtcatccattggctatgttgcggcctaatacatctcttagctctgcccttaacttgttggttcaagctggagttagttcaatacccattgtggatgataacgactcgctgatcgacacatactccagaagtgacatcacagctctagcgaaagacaaggtctacacccatatccgcctagatgagatgaccattcatcaggccttgcagctcgggcaagacgcgaattcaccttttggacttttcaatggtcaaagatgccagatgtgtctccagtctgaccctttgctgaaggttatggagagattggctaatcctggggtgcgtcgcgtgttcatcgtggaggctggcagcaagcgagtggaaggcgtaatatcgctgagcgacatattcaagttgctgctgagctagcgaaaggcctgttttcgttagttccggggcaagcggtgccagaagagctagcatgcaagaaagagattgtggagccaacatggagttctctctctggcttgctcttggacaagagagtagcaaaacagattgtaaagttttttccctttcgttgtgccaacccaacccaacccccaccgtccgtccgtccgactgtcgtaactgaaactacctggtgacttttctctttaaattttattggattgattccgctgcttggcgaggttagtctccaaggagccagagatggtcgtctgtctgtctgcgttggtcggtcggtgtcggtccgttctgtgcctagttactagagagagacgtacccttttccttttcgtcatgaaaggaggaggagggggag

SEQ ID NO: 2968 - DNA, 2002 bp, Secale cereale
gcgagcaggcaggcaaccgccggcggcgggccagcggcaagccacggtccgacccgctccagggttttgggtcccctcggcccgatctcgtcgcgacggctagcaggagcggagttttcgcacggcgcggatcccgcccacgacgctccgcgccggcggcggcgtcggcgtcagcgccggcggcccggccgtccccacccgcttcgtctggccccacggcggcaagcgggtcttcctcagcggttccttcaccatgtggtcagagcatttgccgatgtctccagtcgaaggttgccccactgtatttcaagctatctgcaacttacctccagggatttatcagtacaagttcaatgtggacgggcagtggaggcatgacgaggggcaacctactataacaggagagtatggggtggtaaacactttatacttgacaagggaatttgaccacataaatactgtactgagccccactacacctgggagcaggatggatgtggacaatgacagctttcaacgaatgggttcgttgtcggatggtgcccttcaggaaggttctccaagaatttcagaggctgctatacagatctctaggtgtcgtgttgctgagtatctgaatgcgcatacaggctatgacctactaccagattctggaaaggtcattgctctggacattaatttacctgtgaagcaatctttccatattctccatgaacaggggattcctgtggctcctctgtgggattcattcaggggtcagtttgttggccttctgagcccactggattttatacttatattgagagagctggaaacacatggctcaaacctgacagaggaacagcttgaaacacacactatatctgcgtggaaagaggctaagcggcagacttatggaagaaatgatggacaacttagatcaaatcagcatctagtgcatgccaccccttacgaatccttgaggggtattgccatgaaaatactcgaaactggtatttctacagtcccaatcatctattcatcgtcatcagatggatcgtttccgcagctgttgcatcttgcatccctttcaggaattttgaaatgtatctgtagatactttaagaactcaactggtagtttgccgattctaaaccaaccagtatgctcaattccgctgggtacatgggttccaaaaattggtgaaccaactggtcatccattggctatgttgcggcctaatacatctcttagctctgcccttaacttgttggttcaagctggagttagttcaatacccattgtggatgataacgactcgctgatcgacacatactccagaagtgacatcacagctctagcaaaagacaaggtctacacccatattcgcctagatgagatgaccattcatcaggccttgcagcttgggcaagacgtgaattcacccttcggacttttcaacggtcaaagatgccagatgtgtctccggtctgaccctttgctgaaggttatggagagattggctaatcctggggtgcgtcgcgtgttcatcgtggaggctggcagcaagcgagtggaaggcgtaatatcgctgagcgacgtattcaagttgctgctgagctagcgggagccctgttctcgttggctcccggacaaagtggcgccagaagagcgagctagcatgcaagaaagagattgtggagccaacatggagttctctctctggcttgctcttggacaagagtagcaaaacagattgtaaagttttttttcttcctttcgttgtgccgacccaacccaaccctcaccgtccgtccgtctgtcgtaaccgaaactacctggtgactttttttctcttcaaattttattggattgattctgctgcttggcgagattagtctccaaggagccagagattggtcgtctgtctgcgttggtcggtgtcggtccgttctgtgcctagttcactagagagggaccctttactttttcggctatgaaagaggggaggggagatgatgat

SEQ ID NO: 2969 - DNA, 1983 bp, Secale cereale
cacgcacgcacggacggacagaccgagggagatgccggtgggagcgggcctgcgcgggtgatctctctccctcgtcgacagcacgcgcgcggggaggggagccgtcgcgtgggcaagcccgcgtggaggggtcccgtccgtcccgcgcccgcctgcccggcccgtcctagggcagaagaagcagcaccggcggcggcagcggcagcggcagcagctccgccgctctagggtttgctccctcggccgatctcgtcgcgacggctagcaggagacggatgttttcgcacggcgcggatcccgcccacgacgcctccgccgccggcggcggcgtcggcgtcagcgccggcggcccggccgtccccacccgcttcgtctggccccacggcggcaagcgggtcttcctcagcggttccttcaccatgtggtcagagcatttgccgatgtctccagttgaaggttgccccactgtatttcaagctatctgcaacttacctccagggatttatcagtacaagttcaatgtggacgggcagtggaggcatgacgaggggcaacctactataacaggagagtatggggtggtaaacactttatacttgacaagggaatttgaccacataaatactgtcctgagccccactacacctgggagcaggatggatgtggacaatgacagctttcaacgaatgggttcgttgtcggatggtgcccttcaggaaggttctccaagaatttcagaggctgctatacagatctctaggtgtcgtgttgctgagtatctgaatgcacatacaggctatgacctactaccagattctggaaaggtcattgctctggacattaatttacctgtgaagcaatctttccatattctccatgaacaggggattcctgtggctcctctgtgggattcattcaggggtcagtttgttggccttctgagcccactggattttatacttatattgagagagctggaaacacatggctcaaacctgacagaggaacagcttgaaacacacactatatctgcgtggaaagaggctaagcggcagacttatggaagaaatgatggacaacttagatcaaatcagcatctagtgcatgtcaccccttatgaatccttgaggggtattgccatgaaaatactcgaaactggtatttctacagtcccaatcatctattcatcgtcatcagatggatcgtttccgcagctgttgcatcttgcatccctttcaggaattttgaaatgtatctgtagatactttaagaactcaactggtagtttgccgattctaaaccaaccagtatgctcaattccgctgggtacatgggttccaaaaattggtgaaccaactggtcatccattggctatgttgcggcctaatacatctcttagctctgcccttaacttgttggttcaagctggagttagttcaatacccattgtggatgataacgactcgctgatcgacacttactccagaagtgacatcacagctctagcaaaagacaaggtttacacccatattcgcctagatgagatgaccattcatcaggccttgcagcttgggcaagacgtgaattcacccttcggacttttcaacggtcaaagatgccagatgtgtctccggtctgaccctttgctgaaggttatggagagattggctaatcctggggtgcgtcgcgtgttcatcgtggaggctggcagcaagcgagtggaaggcgtaatatcgctgagcgacgtattcaagttgctgctgagctagcgggagccctgttctcgttggctcccgggcaaagtggcgccagaagagcgagctagcatgcaagaaagagattgtggagccaacatggagttctctctctggcttgctcttggacaagagtagcaaaacagattgtaaagttttttttcttcctttcgttgtgccaacccaacccaacccaaccctcaccgtccgtccgtctgtcgtaaccgaa

SEQ ID NO: 2970 - DNA, 2832 bp, Hordeum vulgare
cggggaggagcttgcgagaaatcgacaggttagattaggcggaaggtgggggaagaaggtaagggagaggagggaagaaggtaagggagggagggtgtgagctggaccttgcgtggagtgagggcaggagcgcgcagaagatcctcgtgcccgcccgctaggtctccttttcaacctttcctctcctcctccgtccccatctcctcctcctcctcctcctccgccctcaccgcatctccggatcccccgccgcgccgccccaccgccatcgccgccgccccgagatcccgacccgccgcccccgattcgcacggacggacagaccgagggagatgccggtgggagcgggcctgcgcgggtgatctctgtccctccctccatccctccctccctctctctctcgcccgcacgcgcttggggaggggagccgtcgcgtgggcgagcccgcgtggaggggccccgtccgtctcgcgcccgtcctagggtagaagcagcagcggcagctcagccgctctagggtttgctcgctcggccgatctagtcgtcgcgtggcgcgacggccagcaggagacggatgttttcgcacggcgcggatcccgcccacgacgcctccgccgccggcggcggcgtcggtgtcagcgccggcggcccggccgtccccacccgcttcgtgtggccccatggcggtaagagggtcttcctctccggctccttcaccaggtggtcagagcatttgccgatgtctccagtcgaaggttgccccactgtatttcaagctatctgcagcttacctccagggatttatcagtacaagttcaacgtggacgggcagtggaggcatgacgaggggcaacctactataacaggagagtatggggtggtaaacactttatacttgacaagggaatttgaccacataaatactgtactgagccccattacacctgggagcaggatggatgtggacggtgaaagttctcaacgaatgggttcgttgtcggatggtgcccttcaggaaggttctccaagaatctcagaggctgctatacagatctctaggtgtcgtgttgctgagtatctgaatgcgcatataggctatgacctactaccagattctggaaaggtcattgctctggacattaatttacctgtgaagcaatctttccatattctccatgaacaggggattcctgtggctcctctgtgggattcaatcaggggtcagtttgttggccttctgagcccactggattttatacttatattgagagagctggaaacgcatggttccaacctgacagaggaacagcttgaaacacacactatatctgcgtggaaagaggctaagcggcaaacttatggaagaaatgatggacaacttagatcaaatcagcatctggtgcatgccaccccttatgaatccttgaggggtattgccatgaaaatacttgaaactggtatttctacagtcccgatcatctattcatcgtcatcagatggatcatttccgcagctgttgcatcttgcatccctttcaggaattttgaaatgtatctgtagatactttaagaactccactggtagtttgccgattctaaaccaaccagtttgctcaattccgctgggtacctgggctccaaaatctggtgaacccaatggtcatccattggctatgttgcggcctaatacatctcttagctctgcccttaacttgttggttcaagctggagttagttcaatacccattgtggatgataacgactcgctgatcgacacatactccagaagtgacatcacagctctagcaaaagacaaggtctacacccatatacgcctagatgagatgaccattcatcaggccttgcagcttgggcaagatgcgaattcaccttttggacttttcaacgggcaaagatgccagatgtgtctccgttccgacactttgatgaaggttatggagagattggctaatcctggggtgcgtcgcgtgttcatcgtggaggctggcagcaagcgagtggaaggcgtaatatcgctgagcgacatattcaagttgctgctgagctagcgaaaggcgtattttcgttgattgcagggcaagtgctgccagaagagctagcatgcaagaaagagattgtggagccaacatggagttctctctctggcttgctcttggacaagagtagcaaaacagattgtaaagtttttttcctttcattgtgccaacccaaccctaccctcaccgtccgtctgtcgtaaccgagaaaatacctggtgacttcttttttgttctttttaaattttattggattgatctccgctgcttggcgagactagtctccaaggagctagagatggtcgtctgtccgccgagttggtcggtgtcggtccgttctgtgcctagtttacttactagagggaggcccttttccttttttagcatgaaagaggggaagggggaagatgatgatgatggcccagtttcaagatgtttaccatgcgttgtttttgctcaacattggcagccatgcaaccatggaagaagaaggattagaggaaaaatcattctggcatgagtcgtgagtagccttgggggtgtgtacaattgcaaacctcattttatgtttcaactgccgttgtgaactcattttgctttctctctcttgctgtagaaacttgacccattgtatatcctctttctctcctagcggcgcagctggtgtggtgtccctggccttatgggaaaacataccagcagtcacttattcagacaccgtcttttcctgctatttgttattgacctaccttccctacttttagggcaattccaat

SEQ ID NO: 2971 - DNA, 2203 bp, Triticum aestivum
gcgtcagcgccggcggcccggccgtccacacccgcttcgtctggccccatggcggcaagagggtcttcctcagcggttccttcaccaggtggtcagagcatttcccgatgtctccagtcgaaggttgccccactgtatttcaagctatctgcagcttacctccagggatttatcagtacaagttcaatgtggacgggcagtggaggcatgacgaggggcaacctactataacgggagagtatggggtggtaaacactttgtacttgacaagggaatttgaccacataaatactgtactgagccccactacacctgggagcaggatggatgtggacaatgatagttttcaacgaatgggttcgttgtcggatggtgcccttcaggaaggttctccaagaatttcagaggctgctatacagatctctaggtgtcgtgttgctgagtatctgaatgcgcatacaggctatgacctactaccagattctggaaaggtcattgctctggacattaatttacctgtgaagcaatctttccatattctccatgaacaggggattcctgtggctcctctgtgggattcattcaggggtcagtttgttggccttctgagcccactggattttatacttatattgagagagctggaaacgcatggctcaaacctgacagaggaacagcttgaaacacacactatatctgcgtggaaagaggctaagcggcaaacttatggaagaaatgatggacaacttagatcaaatcagcatctagtgcatgccaccccttatgaatccttgaggggtattgccatgaaaatacttgaaactggtatttctacagtaccaatcatctattcatcgtcatcagatggatcgtttccgcagctgttgcatcttgcatccctttcaggaattttgaaatgtatctgtagatactttaagaactccactggtagtttgccgattctaaaccaaccagtatgctcaattccgctgggtacatgggttccaaaaattggtgaaccaaatggtcatccattggctatgttgcggcctaatacatctcttagctctgcccttaacttgttggttcaagctggagttagttcaatacccattgtggatgataatgactcgctgatcgacacatactccagaagtgacatcacagctctagcaaaagacaaggtctacacccatattcgcctagatgagatgaccattcatcaggccttgcaacttgggcaagacgcgaattcaccttttggacttttcaacggtcaaagatgccagatgtgtcttcggtctgaccctttgctgaaggttatggagagattggctaatcctggggtgcgtcgcgtgttcatcgtggaggctggcagcaagcgagtggaaggcgtaatatcgctgagcgacatattcaagttgctgctgagctagcgagagccctgtttccgttggttcccgggcaagtggtgccagaagagctagcatgcaagaaagagatagcatggagttctctctctggcttgctcttggacaagagagtagcaaaacagattgtaaagtttttttcctttggttgtgccaacccaacccaacccaacccaaccctcaccgtccgtctgtctgtctgtcgtaaccgaaactacctggtgacttttttctctttaaattttattggattgattccgctgcttggcgagattagtctccaaggagccagagaatggtcgtctgtctgtctgcgttggtcggtgtcgttggtccgttctgtgcctagtttactagagagagggacccgttccttgtttcggcatgaaagaggagagggggaagatgatgatggtccggttcaagtgtgaccatgtgttgtttttgctcaacattggcagccatgcaaccatggaagaaggaaggatttagaggaaaaatcaatcaatcgagcatgagtcaagagtcatgtgtggcccgggtggagtcagtggggtgtacaattgcaaacctcattttatgttgaactgccattctggactcattttgctttctctctctggctgtagaaacttcacccattgtatattctctcctagtggcgcagctgctatccatccattcatcctcttgagttatctgccttccctggctggcctggtggagagcataccagcagtcagtttgctgaataagatgctgtcttctaaacc

SEQ ID NO: 2972 - DNA, 1555 bp, Pennisetum glaucum
ctcgcgccgctccgcctgcgcgcgggccggggcgccattgcgacgccgtcgccccccgcggcgctctccgccgcggcgctgccgaggcgcgggcccgccgcggccgcgtccatccaccgcgactgggcgctccgcgtctccgcgccgtcgcgcctcacctccaccgtcgagggggaggacgccgcgggcggggtgttcgaccccggggcgccgccgccgttcgggctggcggagatccgcgcggccatccccaagcactgctgggtcaaggacccctggcgctccatgagctacgtgctgcgcgatgttgtcatcgtcctggggctggccgccgccgccgcgcgcctcgacagctggctcgtctggccgctctactgggccgcgcaggggaccatgttctgggcgctcttcgtcctcggtcacgactgtggacacgggagcttctcaaacaacgccaagctgaacagcgtggtcggccacattctccattcctccattcttgtcccataccacggatggaggattagccacaggacgcaccatcagaaccacggccacgtcgagaaggacgagtcctggcacccactaccagagaggctgtacaacagcctggacttcatgactcggaagctgaggttcaccatgccattccccttgctcgcattcccgttatacttgtttaaaaggagtccagggaagaaaggatcacacttcaatccgagcagtgagttgttccaacctaatgaaaagaaggacatcataacatcaacgacttcctggctcgccatggttggtattttggctggtctcacctttgtgatggggcctattcagatgctaaagctctacgctgtcccgtacttggtatttgttgcttggctggatatggtcacatacttgcaccatcatggccatgaagacaagcttccttggtaccgtggaaaggaatggagttatctgcgtggaggattgacaacactcgatcgggattacgggttgattaataatatccatcatgacattggaactcacgtcatccatcaccttttccctcaaatcccgcattaccatctcattgaggcgactgaggcagcaaaaccagtgcttggcaaatactacaaggaaccaaagaagtcaggtcctctcccgttgcatctatttggggtgctatcggaaagcttaaagcaagatcactatgttagcgatacaggagatgtactctactaccaaactgataagaaaatgacataaaccatagcgaagtagcaaaattttcatttttctcaggggggctgtgcctgaagacttgaccaccttcctgggatttctgatcggtgtacctgagtcccttgatatgttgattcaaaaatgtaagttggcaaagtattatcatgtaaaagagggtaaatgcggttctttccaaagatggtaaaacggaggccacctccgatgtaacagaaatgtaattctttggacaagagaggtatatcagagtaaaaagcgaattaagagcttagttcgaaaaaaaaaaaaaaaaaaaaaaaagtaactacta

SEQ ID NO: 2973 - DNA, 1676 bp, Panicum virgatum
attccatccagccaggcctctccacccgtatcctcctccccacttcccgccgccggcaatggcccggctcgtgctctccgagtgctgcggactcgcgccgctccgcctgcgctccggccggggcgccattgcggcgccggccccgcccgccgcgctctccgccgcggcggtgccgcgcgggcccgccgccgcggccatccaccgcgactgggcgctccgcgtctccgcgcccacgcgcctcgcgtcggccgtcgacgaggggggcaggaggagcgccccgctcggggaggaggagaaggccgccgcgggcggggacttcgaccccggggcgccgccgccgttcgggctggcggagatccgcgccgccatccccaagcactgctgggtcaaggacccctggcgctccatgagctacgtcctccgcgacgtcgtcgtcgtcctggggctcgccgccgccgccgcgcgcctcgacagctggctcgtctggccgctgtactgggccgcgcagggcaccatgttctgggcgctcttcgtcctcggccacgactgtggacacgggagcttctcaaacaaccccaagctcaacagcgtggtcggccacatactccattcctccattcttgtcccatacaacggatggaggattagccacaggacgcaccatcagaaccacggccacgtcgagaatgacgagtcctggcatccgctaccagagaggctgtacaatagcctggactttatgactaagaagttgcggttcaccatgccgttccccttgctcgcattcccgttatacttgttcaaacggagtccagggaagacaggatcacacttcaacccaagcagtgacttgttccaacctaatgaaaagaaggacatcataacgtcaaccgcatcctggcttgctatggttggtcttctggctggtctcacctttgtgatgggtcctattcagatgctaaagctctacgctgtcccatacttggtatttgttgcttggctggatatggtcacttacttgcaccatcacggccatgaagacaagcttccttggtaccgtggaaaggaatggagttatctgcgtggaggactgacgacgctcgatcgggactatggattgatcaacaatatccatcatgacattggaactcatgtcatccatcaccttttcccccaaatcccgcattaccatctcattgaggcgactgaggcagcaaaaccagtgcttggcaagtactacaaagaaccaaagaagtcaggtcctctaccgttgcatctatttggggtgctgtcagaaagcttaaagcaagaccactatgttagcgatacgggagacgtagtctactaccaaattgacaagatgatgaacacctctgcacaaaattcagattgacataaaccatagctagtagcctattcttcatttttctcagggggctgtgcctgaagacgcgtccagcctcctgggacctctgattggtgtgcccgagtccattgatatttcgattcaagaatgtaagttggcgaaacattaatcatgcagaaaagagggtaaatgtaattctttccaatgatggaagacggaggccgctgcctcctatgtaacaaaacaaacatgtgattctttggacaagaggtatattacagtaaagagcggaaaaagagctttagctacc

SEQ ID NO: 2974 - DNA, 2239 bp, Sorghum bicolor
gaccagacgagttattcccatcacgtacgggaccaaagggagtcaacacgaattaaaaagcaggcttggccgccggcgtcgaagctccctggctggctcccgtccagacccgcaacgattcacacgtgcctcacctcctccccccactctcgactcgcgtccgacccatcatcaacccacattccacagtgctagtcccggtccgagtccaccgcaccgcgtcggcgtcccggtccgccgccacgcgcacatcaatccgtctcgacgggctgcacgcacgggtggccctcgcgcgcggtataaaagtacagggattagctgagcctgccctggcaccgcacacccaaaccccatcccgaacgcagaagatcccgtgcccgtgccagcggcggcgacggtgtgtgtggtgtggactggtagccatcatcaatccaggcatccccgtccacccgtaaccccgccgcccggcccccgcggacgccggcaatggcgcggctcgtgctctccgagtgctgcggcctcgcgccgctgcgcctgcgcgccggccgccggggcgccgccattgcggcgccgtcgcccgccgcgctctccgtggcggcagcggcggtggtcccgggccgccccgcgtccgcggccatccaccgcgactgggcgctccgcgtctccgcgcccacccgcctcacctccgccgtcgaggaggacaagaggagctccccgctcggggaggagggcgtggcggacagcggcgccgcgggcggggacgggttcgacccgggggcgcccccgccgttcgggctggcggagatccgcgcggccatccccaagcactgctgggtcaaggacccctggcgctccatgagctacgtgctgcgtgacgtcgtcgtcgtcctgggactcgccgcggcggccgcgcgcctcgacagctggctcgtctggccgctctactgggccgcgcagggcaccatgttctgggcgctcttcgtccttggccacgactgtggacacgggagcttctcaaacaaccccaagctcaacagcgtggtcggccacatactccattcctccattcttgtcccataccacggatggaggattagccacaggacgcaccatcaaaaccacggccacgttgagaaggacgagtcctggcacccgctaccagagaggctgtacaaaagcctggactttatgactaagaaattgcggttcaccatgccattccccctgctcgcgttcccgttatacttgttcgcaaggagtccagggaagacaggatcacacttcaacccaagcagtgatttgttccaacctaatgaaaagaaggacatcataacatcaacggcctcctggctggccatggttggtgttctggctggtctcacctttatgatgggtcctattccgatgctaaagctctacggagtcccatacttggtatttgttgcttggctggatatggtcacatacttgcaccatcatggccacgaagacaagcttccctggtaccgtggaaaggaatggagttatctgcgtggaggactgacgacactcgaccgggactatggattgatcaacaatatccatcatgacattggaacccatgtcatccatcaccttttccctcaaatcccacattaccatctcattgaggcgactgaggcagcaaaaccggttcttggcaagtactacaaagaaccaaagaagtcgggtgctcttccgtggcacctatttggggtgctagcacaaagcttaaagcaagaccactatgttagcgacaccggagatgtagtctactaccaaactgactcgaaaacgaacacctctgcacaaaaatctgattgacacggactatagaacgtagcgtattcttcatttttctcaggggggctgtgcctgaagacctgcccagcctcccgggacctctgattggtgtgacttggtacacgtcaattcaatcaagaatgtaaggtggcataagaattatcatgtatgggagggtaaatgtagttctttccaatgatggaaaacggatgctgcttccgatgtaacaacatgtgattctttggactagaggtatactatttacagtaaagagtgaaaaaaaaggacttagctacatgaaaggcttacctctgatgtttcagctgccctgagtgcgacatgagcctgatcgtacgacagtgaaatgccgcctttggcatgctcacgccgtcacgcgctaatgcttgctggaaaccag

SEQ ID NO: 2975 - DNA, 1995 bp, Zea mays
tccggtccgagtccaccgcaccgcgtgcggcggcgtgccgatctccggctcgcctgttacggtggcctcgcgcgcccggtataaaagtacttggattctctcagcctgccctgacaagccaggccactctaccaccgcacgctcaactcaaacccccgtcccgaacgcagaagaccggcggcagcggcggggtgtgtgtggtactggactgtaaccaattgccatcaatccaggcatccatccatccacccgccccgctgacggcggcaatggcccggctcgtgctctccgagtgctgcggcctcgcgccgctccgccgcctgcgcgccggccggggcgccattgcggcgccgtcaccccccgcgctctccgcggcgccgcgccgtcgtcccgcgtccgcgtccatccaccgcgactgggcgctccgcgtctccgcgcccacccgcctcgcctccgccgccgtcgaggaggacaagccgagcgccgcgccggggcaggaggagggcgcggcggccggcggggagttcgacccgggggcgccgccgccgttcgggctggcggagatccgcgccgccatccccaagcactgctgggtcaaggacccctggcgctccatgagctacgtgctgcgcgacgtcgccgtcgtcctgggcctcgccgcagcggccgcgcgcctcgacagctggctcgtctggccgctctactgggccgcgcagggcaccatgttctgggcgctcttcgtcctcggccacgactgtggacacgggagcttctcgaacaaccccaagttaaacagcgtcgtcggccacatactccattcctccattcttgtgccataccacggatggaggattagccacaggacgcaccatcaaaaccacggtcacgttgagaaggacgagtcctggcacccgctaccagagaggctgtacaaaagcctggactttatgactaggaaactgcggttcaccatgccgttccccttgctcgcgttcccgttatacttgtttgcgaggagtccagggaagtcaggatcacacttcaacccaggcagtgatctgttccaacctactgaaaagaatgacatcataacatcgacggcgtcctggctggccatggttggtgttctggccggtctcacctttctgatgggtcctgttccgatgctaaagctctacggagtcccatacttggtatttgttgcttggctggatatggtcacatacttgcaccatcatggccacgaagacaagcttccctggtaccgtggaaaggagtggagttatctgcgtggaggactgacgacgctcgaccgggactacggatggatcaacaacatccatcacgacatcggaactcatgtcatccatcacctcttccctcagatcccgcattaccatctcatcgaggcgaccgaggcagcaaagccggttcttggcaagtactacaaagagccgaagaagtcgggtgctctgccgtggcacctattccgggtgctggcacagagcttgaagcaagaccactatgtcagtgataccggagatgtggtctactaccaagctgagtcgaaaacgagcacctctgcactaaaatccgattgacagggagtatagagcgtagcgtgttcttcatttttctcggggaggggctgtgcctgaagacctgaccagcctccacctctgattagcgtgagtgggtacgtcgactgaagaatgtaagctggcgaagtagtaccatgtatgtatggagagggttaaatgtaattctttccaatggtccaaggcggatgctgcttccgatgtagcagcatgcgattctttggacaagaggtatactattacagtgaagagtgaaaaaaagagagagttagctacatagaaagctttctgagctctatacgtactacctccgttctcagatatttttgtcgtcagctcggtcatttttgaactaaacggcgataaataaataaaaagaacggaggagtatatctta

SEQ ID NO: 2976 - DNA, 2433 bp, Panicum virgatum
gccgccgcggccatccaccgcgactgggcgctccgcgtctccgcgcccacgcgcctcgcgtcggccgtcgacgagggggacaggaggagcgccccgctcgtggaggaggaggaggccgcgggcgcggacttcgaccccggggcgccgccgccgttcgggctggcggagatccgcgcggccatccccaagcactgctgggtcaaggacccctggcgctccattagctacgtgctccgcgacgtcgtcgtcgtcctggggctcgccgccgccgccgcgcgcctcgacagctggctcgtctggccgctctactgggccgcgcagggcaccatgttctgggcgctcttcgtcctcggccacgactgtggacacgggagcttctcaaacaaccccaagctcaacagcgtagtcggccacatactccattcctccattcttgtcccataccacggatggaggattagccacaggacgcaccatcagaaccacggccacgtcgagaaggacgagtcctggcacccgctgccagagaggctgtacaaaagcctggactttatgactaagaagttgcggttcaccatgccgttccccttgctcgcattcccgttatacttgttcaaaaggagtccagggaagacaggatcacacttcaacccaagcagtgagttgttccaacctaatgaaaagaaggacattataacgtcgaccgcatcctggctggctatggttggtcttctggctggtctgacctttgtgatggggcctattcagatgctaaagctctacgctgtcccatacttggtatttgttgcttggctggatatggtcacatacttgcaccatcatggccacgaagacaagcttccttggtaccgtggaaaggaatggagttatcttcgtggaggactgacgacgctcgatcgggactatggattgatcaacaatatccatcatgacattggaactcatgtcatccaccaccttttcccccaaatcccgcattaccatctcattgaggcgactgaggcagcaaaaccagtgcttggcaagtactacaaagaaccaaagaagtcaggtcctctaccgttgcatctatttggggtgctgtcggaaagcttaaagcaagaccactatgttagcgataccggagacgtagtctactaccaaactgacaagatgataacacctctgcacaaaattcagattgacatataaaccatagctagtagcatattcttcatttttctcagggggctgtgcctgaagacgtgaccagcctcctgggacctctgattggtgtgcccgagtccaatgatatgtcgattcaagaatgtaagttggcaaaatattgttcatgcagaaaagagggtaaatgtaattctttccaatgatggaagacggaggcggcctcctatgtaacaaaacaaacatgtgattctttggacaagaggtatattacagtaaagagcggaaaaagagcttatacctgaaggctttctgagtgtctgtatgtatcttttgtaaaaaggcttctgtgcctctgatgtttcagctgtcccgagcgcgacatgagcctgattatgcgatagcgaggtgccttgcttggcatactcaagacgctaatacttgctgggaaccagtaacactgtattccgatggcaagaggggaagagagcggacgcgcctcctctgcagccatcgttttccagcatttggaaaaggccccccatcgctgtcacggttttgctgtcctcgtgagcagtgaggttgagtagtggtggcagttgctgttgagtcccggtgggatccatcccaatccaagtgggttcctgtcgtttgtgaccagtgaccactggccaggatccaatccagcgcgcgctcctctggcccttgaaaaatctgcaccctatcttgtggtggtgtggctgccgttcggttcaggcaccagttcaaagcgacgcgcacgacggcggccagaaatagagcgctccctccgaaacaagaagcgcgcgaagtgctccatgtcgaatcggaaacgaagggatggcgaccagttttgggtggacacgcctctcgcgtgatccgcgagccgtgcgccgggccgaccatttctgggtcaaggaacaaccactatccgaacatggaaaggcgatggtagaaagaagcaattcttcgttgaatcgctgcaatcctatagaaatagtaggtactccgtatatttgaacctcgtcacctcaccgtacctttggtaagtttgtgtacctgaattctgagctccgtatacgtctcgacagcgactgcctttatgtagtcctcatttctttcacgcaatagaaaatgaaaagggaaaagcctactgcctacatctcacacacatctatcgttcaatacctttcttgttcagccgcggaaaaccttaggcccaccacggcaccg

SEQ ID NO: 2977 - DNA, 1969 bp, Oryza sativa
ccgtcttctcgtctgacccgagtccgagtcgaccgcaccgcgtcgtccccttcggttcaccggcgcgcgaacccccccacgcgcttcacggcggcccggtccggtccgtggctggcaatggcagtataaaaatcgtggacttctcttaatcccatcaccaccactacccgcacagcaaggcccatccgcgaacgcagagcagaaaaatcagaaaggaaatccgtgtaagccgtcaggggcagcggctgctaccgtcggtggcggcggaggcgatggcacggctcgtcctctccgagtgctgcggcctcacgccgctccgcctgcgcgggcgcggcgccattgcgctgccggcgcctcccagcctcgccgcggggccgcgccgccccgtgtccgccgccgccgcggggggagccatccaccgcgagtgggcgctccgcgtctccgcccccacccgcctcacctccgtcgtcgaggaggataatagaggggaggaggtggtggaggaggaggccaggggttcgttggcggcggccgaggcggcggcgggggaggtaggaggggacggagacgggttcgaccccggggcgccgccgccgttcgggctcgcggagatccgcgcggccatccccaagcactgctgggtgaaggacccctggaggtccatgagctacgtgctgcgcgacgtcgtcgtggtgctcggcctcgccgccgccgccgcgcgcgtcgacagctggctcgtctggccgctctactgggccgcgcagggcaccatgttctgggcgctcttcgtgctgggtcacgactgtggccatgggagcttctcaagcaacgccaagttgaacagcgtggttggacacatactccactcctccatccttgtcccataccacggctggaggattagccacaggacgcaccaccagaaccacggtcatgtcgagaaagacgagtcctggcaaccgctgtctgagaggctgtacaatagcctggactatatgacgaagaaattgaggttcaccatgccgtttcccatgctggcattcccattatacttgtttgcaaggagtccagggaaaaaaggttcacacttcaacccaagcagtgatctgttccaaccaaatgagaagaaggatgtgataacatcaactgcatcctggctggcaatggttgggattcttgctggtctgacctttgtgatggggcccctcaaaatgttaaagctctatgctgttccatacgtgatatttgttatgtggcttgattttgtcacatatttgcaccatcatggccatgaggacaagcttccttggtaccgtggaaaggagtggagctatctgcgcggaggattgacaacacttgatcgggactacgggtggatcaacaacgtacaccatgacattggaacccatgtcattcatcatcttttcccacaaatcccacattaccatcttgttgaggcgactgaggcagcaaaaccagtgctgggaaaatactacaaagagccagagaaatcagctcccctcccattccacttacttggtgtgctagcaaagagcttaaacagcgaccactatgttagtgacaccggagacgtagtgtactaccaaactgacttgaaaactagttcttctgcacaaagctcggattgacagaacattagtctctagcttatttttcgatttctcaggagcctgggcttaacatctgaccagcctcctgggcgttgagcctagaatttcaaagcattatcattgtaaaggagcatacatgtgtaattctttcgaatgattgaagacggagatcacctctgatgtaacaaacatgtgattctttcgacaagatatataatacagtaaagagcgagaaaaattgcttactgatgccattctcccggagtatgtacactgcacaggccagtgtgccgctgacgtctcagctgtcatgaccgtgacatgatcctgatagtaca

SEQ ID NO: 2978 - DNA, 1497 bp, Panicum virgatum
accgcgactgggcgctccgcgtctccgcgcccacgcgcctcgcgtcggccgtcgacgaggggggcaggaggagcgccccgctcggggaggaggagaaggccgccgcgggcggggacttcgaccccggggcgccgccgccgttcgggctggcggagatccgcgccgccatccccaagcactgctgggtcaaggacccctggcgctccatgagctacgtcctccgcgacgtcgtcgtcgtcctggggctcgccgccgccgccgcgcgcctcgacagctggctcgtctggccgctgtactgggccgcgcagggcaccatgttctgggcgctcttcgtcctaggccacgactgtggacacgggagcttctcaaacaaccccaagctcaacagcgtggtcggccacatactccattcctccattcttgtcccatacaacggatggaggattagccacaggacgcaccatcagaaccacggccacgtcgagaatgacgagtcctggcatccgctaccagagaggctgtacaatagcctggactttatgactaagaagttgcggttcaccatgccgttccccttgctcgcattcccgttatacttgttcaaacggagtccagggaagacaggatcacacttcaacccaagcagtgacttgttccaacctaatgaaaagaaggacatcataacgtcaaccgcatcctggcttgctatggttggtcttctggctggtctcacctttgtgatgggtcctattcagatgctaaagctctacgctgtcccatacttggtatttgttgcttggctggatatggtcacttacttgcaccatcacggccatgaagacaagcttccttggtaccgtggaaaggaatggagttatctgcgtggaggactgacgacgctcgatcgggactatggattgatcaacaatatccatcatgacattggaactcatgtcatccatcaccttttcccccaaatcccgcattaccatctcattgaggcgactgaggcagcaaaaccagtgcttggcaagtactacaaagaaccaaagaagtcaggtcctctaccgttgcatctatttggggtgctgtcagaaagcttaaagcaagaccactatgttagcgatacgggagacgtagtctactaccaaattgacaagatgatgaacacctctgcacaaaattcagattgacataaaccatagctagtagcctattcttcatttttctcaggggactgtgcctgaagacgcgtccagcctcctgggacctctgattggtgtgcgagtccattgatatttcgattcaagaatgtaagttggcgaaacattaatcatgcagaaaagagggtaaatgtaattctttccaatgatggaagacggaggctgctgcctcctatgtaacaaaacaaacatgtgattctttggacaagaggtatattacagtaaagagcggaaaaagagctttagctacctgaaggctttctgagtgtcttta

SEQ ID NO: 2979 - DNA, 2094 bp, Brachypodium distachyon
gccagcgcgcgcgcccggacacgcaacgagctcgcatatataggaagagcctctccttagccgatcccgaccaccaccaccagtcaccagacgtcgaaacccatccgccgcccggtcgcaaaagatcctgggctggggtccgtggtggactggtgcggtggtagccgactagccatccatccatccgtggcgcggtgcgcccactgctgtcgcccaatgacccggctcgtcctctccgagtcctgcggcggcctcgcgccgctccgcgcgcgcggcggccgccgctgcgccattgcgctgccgccgcctctccacctcgccgcggggccgcgtcgccccttttcggccgccgccgccttccaccgcggctgggcgctccgcgtctcctcgcccacccgcctcgcctccgtcatccaggacgaggaggacgacaagaggagctccccctcccagggagaggacgcggagttcaacccgggggcgccgccgccgttcgggctggcggagatccgcgcggccatccccaagcactgctgggtcaaggatccctggcggtccatgagctacgtgctgcgcgacgtcctcgtcgtgctcggcctcgccgccgccgccgcgcgcgtcgacagctggctcgtctggccgctctactgggccgcccagggcaccatgttctgggcgctcttcgtcctgggtcacgactgtgggcatgggagcttctcaagcaaccccaaactgaacagcgtcgtcggccacatactccactcctccattctcgttccgtacaacggctggaggattagccacaggacgcatcaccagaaccacggccatgttgagaaggacgagtcttggcacccgctgccccagaggctgtacaatagcctggacaccatgacaaagaagttgaggttcagcatgccatttcccatgctcgcattcccattatacttgtttgcaaggagtccagggaaggcaggctcacacttcgacccaaacagcgatttgttccaacctaatgagaagaaggatgtgctaacatcaaccgcatcctggctggcaatggctgggattctcgctggtctgacctttgtgatggggcctcttcaaatgctaaagttgtatgctatcccatatgtggtatttgttatgtggctggattttgttacatacttgcatcatcatggtcatgaggacaagcttccctggtatcgtggaaaggaatggagctatctgcgtggaggactcacaacacttgatcgggactacgggttgatcaacaacgtccaccatgacattggaactcatgtcattcatcatcttttcccgcagatcccacattaccatcttgttgaggcgactgaggcagcgaaaccggtgctcggcaagtactacaaagaaccagaaaaatcaggtcctctcccattccacctactggaggcgctatcacggagtttaaagagcgaccactatgttagcgacactggagacgtagtttattaccaaagcgagtcagaaacgagtacttctgcacagagctctgattgactcgaaacattagcctataggttatttttcaactccacaggaggttgtgccttggcacctgaccagcttcctgggacctcgggttggccagtttcatgcacgtacaccacgaagcaagaatgtaagttgtgaagcgttagtattaccacggtaaaatagcagaaatgtaattggtttcaatgatggaaggttgaggccacctctgatgtaacagatgcgggagcctttgcacacaaaatactaaaaatgaattgactgtgatgtcccagctgtctttgactgtgacacggccttgtaaaacaaaacagtgatggtatcatctgcaactggcgtaaataatggtcatagaaaatcagcctgtgaactaaatttgcaaatgtgccgctttccagtggcttgggtgatagtgatgtcgacggttggaaacgtcctcgatcaagtgtaactatttttagctgtgctcttcctgctcttgaaaaatctcctcgctcatgcatatggctgctggcctgctgctcttggcgacataatatagcagctgacaatatg

SEQ ID NO: 2980 - DNA, 1934 bp, Hordeum vulgare
ggctcgccagcgcgcgctccctcgcacgcgcctgcgatctctctccctctccctctccctctccctctcgcgcgtatatagaaacctcgcgtttgccgatcccgaccaccgcaaatcccactcccttccacccgcccggacgcacaagatcctgggcgaccggcgcggccgtggtggtacacgactgggctagctagccatcgctgccgttgcccaatggcccggctcgccctctccgactgccgcggcctcacgccgctccgcgcgcgcagcgccattgcgctgccgtcgcctccccacctcgccgcggggccgcgtcgccccgcgcctgccgccatccatcgcgattgggcgctccgcgtctccgcgccaacccgcctcgcgtccgtcctcgaggaggataaaaggggcctcgggggagcggaggaggccgggagctcttcggccgggttcaacccgggggcgccgccgccgttcggcctggcggagatccgcgcggccatcccgaagcactgctgggtcaaggacccgtggcggtccatgagctacgtgctgcgcgacgtcctggtcgtgctcggcctcgccgccgccgccgcgcgggccgacagctggctcgtctggccgctctactgggccgcgcagggcaccatgttctgggcgctcttcgtcctgggacacgactgtgggcatgggagcttctcgagcaacccaaagctaaacagcgtggtcggccacatactccattcctccatcctcgttccatacaacggctggaggattagccacaggacgcaccaccagaaccacggccatgtggagaaagacgaatcctggcacccgctaccccagaggctgtacaatagcctggacagtatgacaaagaagttgcggttcagcatgccatttcccatgcttgcattccccttatacttgtttgcgaggagtcctggcaaggaaggctcacacttcaacccaaacagcgatttattccaacctaatgagaaaaaggatgtgctaacatccactgcatcctggctggcaatgattggggttctcgcaggtctgacctttgtgatggggcctcttaagatgctaaagctctatgcaatcccatatgtgatatttgttatgtggctggattttgtcacatacttgcatcatcatggtcacgaagacaaggtcccctggtatcgtggaaaggaatggagctatctgcgtggaggattgacaacacttgatcgggactacgggttgatcaacaagatacaccatgacattggcactcatgtcattcatcatcttttcccacaaatcccgcattatcatcttgtcgaggcgactgaggcagcaaaaccagtgcttggcaagtactacaaagaaccagagaagtcggctcctctcccattccacctactccaggtgctatcgcggagtttgaagaaggatcactatgttagcgacaccggagacatagtttactaccaaagtgagtcagaaacgagtacatctggacagaggtctgattaagatgaaacattagcatatataggtcatccttaaactcctcaggaggttgtggcttaagtaaagagttaaacacccttactaggctcctgggatctcggattggcgagtccatgaatgtacatcatgaagcacgaatgtagtaactagtgaattattaccattgtaaaagagcaattgctgctcgcttctgctcgcttcaacgcttgccttgatctgctggtatagcccccttggagtacatcttatatatatatatatatttttttttctcttctcattcagtaaagtctcggtgcctcccctagggagttatgggttccaaatttctgtttgtaaaacaccagaaatttatctctttgcgatgactgaaggaggagaccatgctttgtacaagagtactacttata

SEQ ID NO: 2981 - DNA, 2458 bp, Triticum aestivum
cccggacgcacaagatcctcggcgaccggcgcggccgtggtggtacacgactggactagctagccatccatcgctgcggcgccgtcgcccaatggcccggctcgccctctccgactgccgcggtctcacgccgctccgcgcgcgcagccgcggcagcgccattgcgctgccgtcgccgccccacctcgccgcggggccgcgtcgcgccgcgcccgccgccatccaccgcgactgggcgctccgcgtcgccgcgcccacccgcctcgcctccgtcttcgaggaggatagaaggggtctcgggggagcggaggaggccgggagctcttcggccgggtttaacccgggggcgccgccgccgttcggcctggcggagatccgcgcggccatcccgaagcactgctgggtcaaggacccgtggcggtccatgagctacgtgctgcgcgacgtcctggtcgtgctcggcctcgccgccgccgccgcgcgggccgacagctggctcgtctggccgctctactgggccgcgcagggcaccatgttctgggcgctcttcgtcctggggcacgactgtgggcatgggagcttctcaagcaacccaaagctgaacagcgtggtcggccacatactccattcctcaattctcgttccatacaacggctggaggatcagccacaggacgcaccaccagaaccacggccatgtggagaaggacgaatcctggcacccgctaccccagaggctgtacaatagcctggacaatatgacaaagaagttgcggttcagcatgccatttcccatgcttgcattccccttatacttgtttgcgaggagccctggcaaggaaggctcacacttcaacccgaacagcgatttgttccaacctaatgagaaaaaggatgtgctaacatccactgcgtcctggctagcaatgattggggttcttgcaggtctgacctttgtgatggggcctcttaaaatgctaaagctctatgcagtcccatatgtgatatttgttatgtggctggattttgtcacatacttgcatcatcatggtcacgaagacaaggttccctggtatcgtggaaaggaatggagctatctgcgcggaggattgacaacacttgatcgggactacgggttgatcaacaacatacaccatgacattggcactcatgtcattcaccatcttttcccgcaaatcccgcattacaatcttgtcgaggcgactgaggcagcaaagccagttcttggcaagtactacaaagaaccagagaagtcggctcctctcccattccacctactgcaggtgctatcgcggagtttgaaggaggatcactatgttagcgacacgggtgacatagtttactaccaaagtgagtcagagacgagtacttctgcacagagctctgattgagctgaaacattagcatatactaggtcatacttcaactcctcaggaggttgtgacttaaagagttaaacaccctgaccagcctcctgggatctcggattggtgagtccatgaatgtacatcatgaaacaccaatgtacgtagtaagttgtgaagtataaccattgtaaaagagcaattgcagctccattcaaggcttgccttgatctgcttgctggtatagtccccttgtacatcttatctctatatttttgtcttctcattcagtaaaatctcaactgtcggggcttccctagagaggtggcagttcaaattttctgtttgtaaaaaggcaagaaatttagccctttccaatgactgaaggaggagaccacctctggctccgatgctttggacaagagctactagtacagaacagtaaatgaaatttgtaaaatgtacttgcagagagaaagatcgattgtttcccacagttgggaaggctattatcattgtcattgttttcttatgctcttcctgctcttgaaaaaacaatctttttagtttgtggctctgctgctgctcactgctactcacatctcgtatgctgacctaaaataggagtgcatgtgttccttgttgaacagaaagacgggatttctctcatgtgatgtctgacctgactgccaatatgaacgcacattcaccccctctgaatcgcaccgccggaagaacgaccgtttctacgttctgcacgcacgggaatatacttattaccaccgtagtagactgagtaaagaaagaaagaaaggcattcgcagtttcccacacgacaaaactgctcctctctgactctgaccgcacccttcgaacttcagactttcttctttcttttgatggcatgcacggcagcatcgtcacagcagcatcgcagcctcctctcctcgtcctgacgtcgcaacctccccgtcatatgaacaaccgacccgtgcttactgaattctgacggcgaccctttgtgtcccactctctcttgcacggggaaaggacccaatcaagtaagaatacaaa

SEQ ID NO: 2982 - DNA, 1690 bp, Panicum virgatum
aaaaaaaaagaacggactcgcacggccgcacgcgcacggcagccgaccggccgaccaaccacccaactcgccggcagcggcaaacctgcagatcccggcctgagttccctcatacggaacccgccctctgctgctgttccccgcctcggatcccttccgttccccgttccctgatgcggcccgggccgccgtcgcctctggatccgccgatctagccgctgctacttccgtcgcggcttggttgggttgaggaggacgaggcggaagtgagagatgatgttctggagggacggcggcgggactgggggcgggaacgggcgggactccctcagcggcgggctgccctgcggccaggtgcgcgtgctcgtcgtcggcgactcaggtgtgggcaaatcttcgttggtgcatctattattaaatggttctgcagttgctcgaccagcccaaacaattggatgtgcagttggtgttaaacatattacttacagtagccctgggagttcatcgaatagcatcaaggctgatgctgaaaggaacttctttgtcgagctttgggatgtttcaggacatgagcgctacaaagagtgccgttcactcttctattcacaaattaatggtgtcatatttgtttttgacctctctcagagaaagacaaaaacaaatttgaacaaatgggcagtggaggttgctgaatctgggaccttttcagctcctcttggttctggtggtccaggtggccttccggttccttacctagtgattgccaacaaagtggatattgctccaagagatggtagaagagtgagcagtgggaatcttgttgatgttgctcgtcaatgggttgaaaaacagggcctacttccaccaagtgaagaacttcctctcgcagatagcttccctggcaattctggtctgctcacggctgctaaagaggcaagatatgataaagaagctctgaacaaatttttccgcatgttgataaggagacgatatttttcgaacgagcttccagccccgagcccatggtcactcacacccagagaggataccatccttcctgtagaaaccgtgaatgatgatgacttgttccaaagaaaaagctatgggggccagagctacaaatacaacggagttgctccactgcctgcacagagaaacctaacaccaccccccacactctatccacagcagccaatgtcgtcttcatcagagaactacagataccacagattctcctcttcatcaattcctgattcaggcggtggtagaacaagccgagcggacatcaatatatgattatctgagtccttccccattaccacctgttatgtggaaaagaacatggtgcctggtccttttgaatcccagctttttgatattccgggctgttcacatgtcttaattgttggaaatgcatgttgccagggccctcctctttaacataatctttgtgggatcactagtataaattcttttattcttccatgtatatctttgatcttttatgtataaattcaatagtcattttagagtaacagaatggtgtatggtggtatcctgtaatagcaatttgaatcaacctgttttgccctgtggggcactgcagctgtacatgtgccagcatgcttttatattgaactttttactcttcgtttggagccttcaactcagattatgatggtcaagcaca

SEQ ID NO: 2983 - DNA, 1676 bp, Panicum virgatum
aaacactactagagttagagtccggggacgaagaaatctgggcagctcctcctgcatcgggcggccaactgcagcagcggcaaagggtctcgcacgggcacggcagccgaccggccggccaaccacccagctcgccggcagcggcaaacctgcagatccctccactcccacggaacccgccctctgctgcggctgctgctgttggcccccttggatcccttccgttccccactccctgatgcggcccgggccgccgccgcttccggatccgccgatctagctgctgctacttccgtcgcggcttggttgggttgaggaggacgaggagggagtgagagatgatgttctggagggacggcggcgggactgggggcgggaacgggcgggactccctcagcggcgggctgccctgcggccaggtgcgcgtcctcgtcgtcggcgactcaggtgtgggcaaatcttcattggtgcatctattattaaatggttctgcagttgctcgaccagcccaaacaattggatgtgcagttggtgttaaacatattacttacagtagcccagggagttcatcgaatagcatcaaggctgatgctgaaaggaacttctttgttgagctttgggatgtttcaggacatgagcgctacaaagagtgccgttcactcttttattcacaaattaatggtgtcatatttgtttatgacctctctcagagaaagacaaaaacaaatttgaacaaatgggcagtggaggttgctgaatctgggaccttttcagctcctcttggttctggtggtccaggtggccttccggttccttacctagtgattgccaacaaagtggatattgctccaagagatggtagaagagtgagcagtgggaatcttgttgatgttgctcgtcaatgggttgaaaaacagggcctacttccaccaattgaagaacttcctctcgcagatagcttccctggcaattctggtctgctcacggctgctaaagaggcaagatatgataaagaagctctgatcaaatttttccggatgttgataaggagaaggtatttttcaaatgagcttcccgccccgagcccatggtcactcactcccagagaggataccatccttcctgtagaaaccgttaatgatgatgacttgttccaaagaaaaagctatgggggccagagctacaaatacaacggagttgctccactgccagcacagcgaaacctaactccaccccccacactctatctacagcagccaatgtcgtcttcatcggagaactacagataccacagattctcatcttcctcaattcctgattcaggcggtggtagaacaagccgagcagacatcaatatatgattatctgtgagtccttccccattgccacctgtaatgtggaaaagaacatgatgcctggtctttttgaatcccagccttttgatattccgggttgttcaaatgtcttaattgttggatatgcatgtttctagggccctcctttttaacataatctttgtgggatcactagtgataaattcttttattcttccatgtatatctttgaatttgtgtatgcattcaatagttattttagagtaacagaatggtgtacagtgatatccagtaatagcaatttgaatcaacctgttttgccctgtggggcactgcagctgt

SEQ ID NO: 2984 - DNA, 1835 bp, Sorghum bicolor
ctctacctccatcgccgattcggcggccgccgaactacagcagcgcaagcgactcgcaccgtcgcaggtatagagcgctcgcaggtatacggcagccgaccaaccaaccaactcgccggcagccgcaagccctcagatcctcccgtcgcacggaaaacaaccgtccctctgctgtcgctgctactcaccctctcggatcccttcccaccccacctcccggatgcagccggggacgccaccgccggcgcctctgccaccgaatccgttgatctagttgctgctattgctaccgcttcttgattgggttgaggaggaggtggaagaggagggaataggagatgatgttctggaaggacggcggcgggactgggggcggcaacggacgggacctcagcggtgggccgccctgcggccaggtgcgtgtgctcgtcgttggcgactcaggtgttggtaaatcttcattggtgcatctcttattgaaaggttctgcagtggctcgaccagcccaaacaattgggtgtgcagttggtgttaaacatattacttacagtagtccagggagttcatctaatagcatcaagggcgatgctgaaaggaacttttttgttgagctttgggatgtttctggacatgagcgctacaaagactgtcgttcacttttttattcacaaattaatggtgtcatatttgtttatgacctttcccagaggaaaacaaagacaaatttgaacaagtgggcagtggaagttgctgaatctgggaccttttcagctcctcttgggtctggtggtcctggtggccttccagttccttacctagttattgccaacaaagtggatattgctccaagagatggtagaagagtgagcagtgggaatcttgttgatgttgctcgccaatgggttgaaaagcaaggcctgcttccatccagtgaagaacttccacttgcagatagctttcctggcaattctggtctgctcacggctgccaaagagggaagatatgataaagaagctctaatcaagttcttccgcatgttgataaggaggaggtatttttcgaatgagcttcctgcccctagcccatggtcactcactcccagagaagataccattcttcctgtagaatctgtgaatgatgatgacatgttccaaagaaaaagctacggtggccagagctacaaatacaatggggtggccccactgcctgcacagcggaacctaactccacccccgacactctatccacagcagccaatgtcctcttcatcagaaaactacagataccacagattttcctcctcgtcaatacctgattcaagtggtggtagaacaagccgagcaaacctcaatatatgatgagatatgtgagtcttatccattatcacctggaatgtgggggaaaaaacatgacacctgggttttttgaatcccaggtttttgatctttttgagttgtgcacctgtctttgatttgatatgtgcatgttgacagggcgtttgaacattatgtttgtgggatcactagtgataaattctttgattcttccctgtatatctcctgattttgtgtatgaattcagtatagttatttaggaagacacattacatggtgtacactgatactctgtgcaatggcaaatctgaattgatcgttttcccaagtccttttctttataatgattttaccaagtcccttgaagtcacttggaagaaatcaagtcttgtagcgttctggggtgctgcaactacatatgtatcagcatgcagtctgatgggttttcattctatttggttccatatggacagattatgattgccaagcacatgtgttgtt

SEQ ID NO: 2985 - DNA, 1685 bp, Zea mays
tccctatccctccgtggccgatcggcggccgccgaactactgcactacagcagcggaaggggctcgtaccgtcgcatgtatacggcagccgaccaaccaaccaactccccggcagccgcaaatccttccgtcccaccgggaaacatccctctccctctgacgctgctgctactcaccctctcggatccctttccaccccacctcccagatgcggctggcgacgacagcgccggcgcctccgcctccggatccgttgatctagttgctgctgcttgattggggttaggaggaggtggaagaggagggaataggagatgttgttctggaaggacggcggcggtactggtggcggcaacggacgggaccttagcggcgggccgccctgcggccaggttcgtgtactcgtcgttggcgactcaggtgttggcaaatcttcattggtgcatctcttactgaaagattctgcagtggctcgaccagcccaaacaattgggtgtgcagttggtgttaaacatattacttacagtagcccagggagttcatctaatagcgtcaagggtgatgctgaaaggaacttctttgttgagctttgggatgtttctggacatgagcgctacaaagagtgccgttcacttttttattcacaaattaatggtgtcatatttgtttatgacctctcccagaggaaaacaaagacaaatttgaacaagtgggcagtggaggtttctgaatctgggaccttttcagctcctcttgggtctggtggtcccggtggccttccagttccttacctagttattgccaacaaagtggatattgctccaagagatggtagaagagtgagcagtggtaatcttgttgatgttgctcgtcaatgggttgaaaaacaaggtctgcttccatccagtgaagtgcttccacttgcagataactttcctggcaattctggtttgctcacggctgccaaagaggcaagatatgataaagaagctctaatcaagttcttccgcatgttgataaggagaaggtatttttcgaatgagcttcctgcccctagcccatggtcactcactcccagggaagataccattcttcccgtagaaactgtgaacgatgatgacatgttccaaagaaaaagctacggcggacagagctacaaatacaatggggttaccccactgcctgcacagcggaacctaactccgccccccacactctatccacagcagccaatgtcctcttcatcagaaaactacagataccacagattttcctcttcgtcaatacctgattcaagtggtggttcaaaaagccgagcgaaccttaatatatgatgggatatggcgccagagcattatgtttgtgggatcactagtgataattctttggttcttctctgtatatctcctaattttgtgtatgaattcaatatagttatttaggaaaacacattacatggtcagatggtctacactgtgcaacggcaatctgaatcaatcttttttcctgagtcccttcaagtcacctgggagaaatcaagtctcgtggtgttatggggcacagcaactttatataaatcagcattcagtctgatgggttttcactctatctggttccttatagacagattaaaggcatgtttggttcattacctcaattgccacattttgcctaacttttctacc

SEQ ID NO: 2986 - DNA, 1939 bp, Oryza sativa
caaaatccaaacaacactcaacagcaaccaacctctcatcaaggaagccaagaagaacaacagcagcgcagcaaggcggcagccgatccgaccaactcaccaccacccgcagcgccgccaccggggatcccccaccaccaccaaccacaggatctcttccccccacctcccacaaccccggatccctcctcctcccccttccctcgatgcggccagcgtcgccgcctcaggatccggcgatctagctgcccccgtcgctgcaactgcttgctgctgctgtctggttctttcttgggggggcgcctccggcgaggaggaggaggaggaggaggaggaggtagatgaggttctggagggacagcggcgggggcggcagcggcggaggccgggacctcaacggcggcggcaccccctgcggccaggtgcgcgtgctcgtcgtcggcgactcaggtgtggggaaatcatcattggttcatctcattctgaaaggctctgcaattgctcgaccaccccaaacgattggatgcgcagttgatgttaaacatattacttatggaagtcctggaagttcttctaatagcattaatagcattaagggtgatgctgaaagaaacttttttgttgagctctgggacgtttcaggacacgagcgctacaaagagtgccgatcacttttttattctcaaattaatggtgtcatatttgtttatgacctctctcagaggaaaacaaagacaaatttgaacaagtgggcagtggaggttgctgaatcagggaccttttcagctcctcttgggtctggtggtccaggaggccttccggttccttacttagtgattgcgaacaaggtggatattgctccaagagatggtaaaagagttagcagtggaaatcttgttgatgttgctcgtcaatgggttgagaagcaaggcctacttccatccagtgaagaacttccacttgcagaaagcttccctggcaattctggtttgctcacggctgctaaagtggcaagatatgacaaagaagctttggttaagttcttccgcatgttgataaggagaagatatttttcaaacgagcttcctgctcctagcccatggtccctcactcccagagaggataccattcttcctgtagaaacaacgaatgatgatgacctgtttcaaaggaaaagctacgctggccagagttacaaatacagtggcgttacgccattgcctgctcagcggaatctaactccaccacccactctctacccgcagcaaccaatgtcatcgtcttcagagaactacagatatcacaggttctcctcatcggcaattcctgacgcaagcagtagtagaacgaaccgagcagatatcaatatatgatccaagagctcgcatgcattaccacttccaatgtgaaaaatctcatgctgctatggtattttacttgatcccactttgtgtaatcctgatatgctcacctgtcttgccttgaaatgtgcatgtagtcgaggtgctctttttgattgtcctcatcttggcataccactaatgatcaattcttttatatcttctatattgttgaattgtgttttgtaatgaagatcacacatgtttataaattaattaatagaagcatttagggtggccggagtgtgtgctgttgtcagtgtaacaccgatttatcattttcgatcaagctgagttcttgccaactccctcaaaagtcatctgtaagggcgatttctgggctgcaaatcaacgttgtttgtcagtactgtgttcggtcttcaaagttcaaatgtgttcatcccttgtaaattttgtttgggaggtactttctccgtttcacaatgtaagtcattctagcatttcccacatttatattgagattccttcgtttcacaatgtaagtcattctagcatttctcacattcatattgatatgt

SEQ ID NO: 2987 - DNA, 3460 bp, Brachypodium distachyon
gtccctgcggttgcttccgcactcgagtccatggacggctagttgccccgtcgcgactacaccggcagcaagcgagccaaaacaagccatacatccagcaacgaaggaggagacgaggcagccggccgcgccgatcaggccaccagccgcaaggtcgcagatccaagatccaaaaaccgcccctccctttcccgcctccgatcgttcctactttccccgacgccgccagggccgcctccggatccgcggatctagtcgtcaccactgctacagctgccttcgctgctcgattgattggcttggggcagaggggaagatgaggttctggagggacgggggcgcgagcgggagcggccgggagctcaacggcgggccgccgtgcggccaggtgcgcgtcctcatcgtaggcgactcgggtgtgggaaaatcttcattggcgcatcttattttgaaagattttgcaattgctcgacctccccaaacaattggatgtacagttgatgttaaacatattacttatggaagtccagggagttcatctaataccatcaagggagatgcggaaaggaacttctttgttgagctttgggatgtttccgggcatgagcgatatagagattgccgttcacttttttattcacaaattaatggtgtcatatttgtgtatgacctatctcagaggaagacaaaggcaaatttgagcaagtgggcagttgaggttgctgaatctgggaccttttcagctcctcttggatctggtggtccaggaggccttccagttccttacctagtgattgctaacaaagtggacatagctccaagagatggtagaagagttagcagtggaaatcttgttgatgttgctcgtcaatgggttgagaagcaaggtctacttccatccagtgaagaacttccacttgtggagagcttccctggcaattcgggtctactcacggctgccaaagaggcaagatatgataaagaagctgttgtcaagttcttccgcatgttgataaggagaagatatttctcaaatgaacttcctgcccctagcccatggtctctcactcccagagaggataccattcttcctgttgaaaccgtgaatgatgaggagctgttcaaaaggaaaagctatggtggccagagctacaaatacaatggtgtcgccccacttcctgctcagcggaacctaactcctccactcactccctacccgcagcagccaatgtcttctacctcggagaattacagatatcacagatactcctcatcgtcaattccagacgcaagcagtagcagagcaaaccgactagatctcaatttatgatccatgagttcctaggcactacaatttacaatgtggaaagcacatgctgccagcaaacaaactatcctgagatgttcacctgtcttccttgcaacatgtgcttgttgtcaaagatgcctcctttttattggttgtagtcatctttgtgggatcactagttagtaattcttttatatgttgtcaaatatttgtttgcattggaattgaagacaacttgcatgttatataaaatcatggtagttttttacgcatgaatctgtgtccctactccctgaaagttacctgaatgaattggagaatgatgccactgtgcaactgcatatacaccttgtagaaaccaaatggttgaggtgatacaaatacaataatggcgacgattttatgtctcaatcaagatatactgtatatatctggatatggaagggggtacatgatctgctaacaacatgtatcaccttgacttttatctcatgatctgctaacagaaaagctattttctgaataatttgactaccttgccacgagtgacaaacaacatgtagataatcatggtgtatcaatccaaccgttggcgcttgttgctaggtgagggtcttctatgctgccgtcgagagctcttcaactgatcagaaaacttagcaacgttcagaaacttcttatacggtggtatccgtgattccctggcgactagctcaaactcctcttttggtacaacagcagagccagctatcaggtccccaaacctcaccttaggcagacccctcgtcgaatcatcgtctccgcagtgcggaggcatgagatgaaggggagcagacgtcgaagtcgacacaagctttgttatatcgatgcgacgatctctctccatgcgaagctttggatgttcccggaatgtcgagaggttactggccaccacatttctgtacttgttcaggacgtggagccagaactcaacgttctgattatttctgaagatgtcggcacacacattcgctgtcaccagtgagcctcccatcagcactgcgagctcatttgctaccgatgctagccgggggtgctcctccgggtccgtgcttccgaatgcaaggaccttgaagaggtagctgtattcctccagcgacaagctgtttacgcgcaccggcctcacggttcccagccttgttagtttctcgatcctgcttatgattatgatcttgcttcctctgcccatacgtctggctgatgaactgaatttctgccagctctcatcgtcaatgtctgaagcgaattcaaccacaaccaaagtcctcccaggcccagctggaatggaagcttcgtcatactccattttgcagatgttttcgccgttcaagtgcaggactgaagagaagtgtgatctgactctctcgttgctgcaaacatgcgcgacgagagttttcttaccgactctactgatgccgatgatcgggagcactgctggcgcaaaaggatcaggaagattttcttgcagcaaaacactcatgacttgctgcttttctacttggcggccaaacatgaagttgtcgatgtacaggtgcgtgtcgtaaggaccgcgaaacatgcgctcgcagctgccgagaagcaagacgaactcggtcatgttggagaccatggtttctaagttatccaatgcacttgcaagctcatcacggttcgtagcgttgctccttgtggcaccaaaacagttaactgaatttgtaaatgatgacaaggtattggagctgctgctgctgctaacctcttcatcttccccagagcttatgcaaagggtagtagtcctggacttgatggtgtccaggacatggtacccatggtacatggcatccacaagcctcttgagctcaagcagcatcttggagttgctgatgtatcgcccctcggcctcctcgacgaccatgtgaacccgaagaaggagatgctgtagcctttccaccatcttctgctcaaggttttcttggccctcatacttcttgatcaagaaggatatgaatcgattgactaagtcgcctgtgattgcagacacaactagctccatctttgatcctttcactgcgtgggtgcgtgtgacgtgtacgccggagagagggagaaagaaagaagagaaagaggagaatt

SEQ ID NO: 2988 - DNA, 1697 bp, Secale cereale
tcagctgcggttgcaaccacactgggggagtccatgtacgagttgccccatcgcccatcggccgtcgcgacagagcaccggtagcagagcgagcgaaaggaagccacgacagcaagggaggaggagagacagccgtcacctacgctgatcccaggagcggattagagaactcgcctccgtcgaagatctgaaccccctcctcctgctttcggaactcggatcattctttccttcattcccgatcgatgcggctacagcctcctccggatccgcggatctagccttctgtgcagcagcagcagcttccactgctcgattgattggcgggggagatgaggttctggagggacggcggcgcgagcgggagcgggcgggacctcaacggcgggatgccctacggccaggtgcgcgtcctcgtcgttggcgattcaggtgtggggaaatcttcattggcacgtctcattcttgaaggttctgcgattgctcgaccgacccaaacaattggatgtacagttgatgtaaaacatattacttacggaagcccagggagttcatctaatagcatcgtcggtgatgctgaaaggaacttctttgttgagctttgggatgtttcagggcacgatcgctacagagattgccgttcacttttttattcacaaattaatggtgtcatatttgtttatgacctatctcagaggaagacaaagacaaatttgagcaagtgggcagttgaggttgctgagtctgggaccttttcagctcctcttgggtctggtggtccaggaggccttccagttccttacctagtgattgctaacaaagtagacattgctccaagagatggtagaagagttagcagtggaaatcttattgatgttgctcgtcagtgggttgacaagcaaggcctacttccatcgagtgaagaacttccacttgtggatagcttccctggcaattctggtctgctcacggctgcaaaagaggcaagatatgataaagaagcagtggttaagttcttccgcatgttgataaggaggaggtatttctcgaatgaacttccgccccctagcccatggtctctcactcccagaggggataccattcttcctgtagaaaccacgaacgacgaggagttgttcaaaaggaaaagctatggtgggcagaggtacaaatacaacggtgttgccccactgtctgctcagcagaacgtaactctaccgctcaccccctctccgcaacagccaatgtcctcttccgcggagaactacagataccacagattctcgtcatcatcgattcctgacaaaaacagtagtaggacaagccgactagacatcaatttatgatacacgggctcataatcaccacgatacagcctgcgccgtgggaaagcacacactgccgtggaactatttgaatccgactttctgtattcttgagaagttcaactactgtcttactggctacacgtgcatgtcgtcggatatgcctctttttgtttatttttgtctatcattgtgggatcggtagttagcatttgttttgtatgcccaatatttgttgaactgtgggatagaagacaatgaacatgtataaaatcagtagaaacattttagagatgaccatagcgtcaaattgttctattcatgatctaaagtcacccggaacagtagaaaatgagttgtactatagtgtca

SEQ ID NO: 2989 - DNA, 1116 bp, Saccharum officinarum
caaacccgcagatcctcccgtcccacgggaaaacaaccctccctctgctgttgctgctactcaccctctcggatcccttcccaccccacctcccggatgcggccggggacgccaccgccggcgcctccgcctccggatccgttgatctagttgctgatttctaccgctgcttgattggggtaaggaggaggtggaagaggagggaataggagatgatgttctggaaggacggcggcgggactgggggcggcaacggacgggacctcagcggcgggccgccctgcggccaggtgcgtgtgctcgtcgttggcgactcaggtgtcggcaaatcttcattggtgcatctcttattgaaaggttctgcagtggctcgaccagcccaaacaatcgggtgtgcagttggtgttaaacatattacttacagtagtccagggagttcatctaatagcatcaagggtgatgctgaaaggaacttctttgttgagctttgggatgtttctggacatgagcgctacaaaaactgccgttcacttttttattcacaaattaatggtgtcatatttgtttatgacctctcccagaggaaaacaaagacaaatttgaacaagtgggcagtggaagttgctgaatctgggaccttttcagctcctcttgggtctggtggtcccggtggccttccagttccttacctagttattgccaacaaagtggatattgctccaagagatggtagaagagtgagcagtgggaatcttgttgatgttgctcgtcaatgggttgaaaaacaaggcctgctgccatccagtgaagaactgccacttgcagatagctttcctggcaattctggtctgctcatggctgccaaagaggcaagatatgataaagaagctctaatcaagttcttccgcatgttgataaggaggaggtatttttcgaatgagcttcctgcccctagcccatggtcactcactcccagagaagataccattcttcctgtagaaactgtgaatgatgatgacatgttccaaagaaaaagctacagtggccagagctacaaatacaatggggttgccccactgcctgcacagcggaacctaactccacccccgacactct

SEQ ID NO: 2990 - DNA, 2013 bp, Triticum aestivum
ccccatcggccatcgcgacagagcaccggcagcagagcgagcgaaaggaagccacgacagcaagggaggaggagaggcagccgtcgccgacactgatcccacgagcggattagagaactcgcctccatcgaagatctgaatcccctcctcgtgctttcggaactcggatcattccttccttcattcccgatcgatgcggctacagcctcctccggatccacggatctagccttctgtctgctgcagcagctgccgctgctcgattgattggcgggggagatgaggttctggagggacggcggcgcgagcgggagcgggcgggacctcaacggcgggatgccctacggccaggtgcgcgtcctcgtcgtcggcgattcaggtgtggggaaatcttcattggcacgtctcattcttcaaggttctgcgattgctcgaccgacccaaacaattggatgtacagttgatgtaaaacatattacttacggaagcccagggagttcatctaatagcattgtcggtgatgctgaaaggaacttctttgttgagctttgggatgtttcagggcacgatcgctacagagattgccgttcacttttttattcacaaattaatggtgtcatatttgtttatgacctatctcagaggaagacaaagacaaatttgagcaagtgggcagttgaggttgctgagtctgggaccttttcagctcctcttgggtctggtggtccaggaggtcttccagttccttacctagtgattgctaacaaagtagacattgctccaagagatggtagaagagttagcagtggaaatcttattgatgttgctcgtcaatgggttgacaagcaaggcctacttccatcgagtgaagaacttccacttgtggatagcttccctggcaattctggtctgctcacggctgcaaaagaggcaagatatgataaagaagctgtggttaagttcttccgcatgttgataaggaggaggtatttctcgaatgaacttcctgcccctagcccatggtctctcactcccagaggggataccattcttcctgtagaaaccacgaatgacgaagagttgttcaaaaggaaaagctatggcgggcagaggtacaaatacaacggtgtcgccccactatctgctcagcagaacgtaactctaccgctcactccctctccgcaacagccaatgtcctcttctgcggagaactacagataccacagattctcgtcatcggcaattcctgacaaaaacagtagtaggacaagccggctagacatcaatttatgatacatgggctcataatcaccacgatatacagcttgcgccgtgggaaaagcacatactgccggggaactatttgaatctgactttctgtattcttgagaagttcaactactgtcttactggcaacacgtgcgtagcatgtcgtcggatatgcctctttttgtttatttttgtctatcattatgggattggttgttagcatttgttttgtatcttgtccaatatttgttgaactgtgatcgtattgggattggagacaatgaacatgtataaaatcagtagaaacattttagagatgaccatagtgtcaaattgttctatgcatgatcaaaagtcacctggaacagtaggaaatgagttgtagtataatgtcaaattgttttgttcatgatcttgtccaatatttcacacgactgctataatgaactagaagtcttcctcaagatgacaagaggttgtacaaaagttatgcacgcctttggcatggaggagcacacaatacgggcattcaacttcggctacaccaacgaccatatctttcgcctctttagtgctgccatggttcttgttttaatttggtgttcctgtaatgcttgatcatatgctaccgtgatttgagttatgtaatggtggttgaacctacgtaaattggtaggcatgatggatatggaacatgtgattgcctattttccaatacaaattctgaagaattttcaattatag

SEQ ID NO: 2991 - DNA, 1804 bp, Triticum aestivum
cttctcgtttgatccaacggccgtggaccagccatacccggtgcggttgcaaccgcaccggagtccatgtgcgagttgccccatcggccatcgcgacagagcaccggcagcagagcgagcgaaaggaagccacgacagcaagggaggaggagaggcagccgtcgccgacactgatcccacgagcggattagagaactcgcctccatcgaagatctgaatcccctcctcctgctttcggaactcggatcattccttccttcattcccgatcgatgcggctacagcctcctccggatccgcggatctagccttctctgctgcagcagcagctgccgctgctcgattgattggtgggggagatgaggttctggagggacggcggcgcgagcgggagcgggcgggacctcaacggcgggatgccctacggccaggtgcgcgtcctcgtcgtcggcgattcaggtgtggggaaatcttcattggcacgtctcattcttcatggttctgcgattgctcgaccgacccaaacaattggatgtacagttgatgtaaaacatattacttacggaagcccagggagttcatctaatagcgtcgtcggtgatgctgaaaggaacttctttgttgagctttgggatgtttcagggcacgatcgctacagagattgccgttcacttttttattcacaaattaatggtgtcatatttgtttatgacctatctcagaggaagacaaagacaaatttgagcaagtgggcagttgaggttgctgagtctgggaccttttcagctcctcttgggtctggtggtccaggaggccttccagttccttacctagtaattgctaacaaagtagacattgctccaagagatggtagaagagttagcagtggaaatcttattgatgttgctcgtcaatgggttgacaagcaaggcctacttccatcgagtgaagaacttccacttgtggatagcttccctggcaattctggtctgctcacggctgcaaaagaggcaagatatgataaagaagctgtggttaagttcttccgcatgttgataaggaggaggtatttctcgaatgaacttcctgcccctagcccatggtctctcactcccagaggggataccattcttcctgtagaaaccatgaatgatgaggagttgttcaaaaggaaaagctatggcgggcagaggtacaaatacaacggtgtcgccccactatctgcacagcagaacgtagctctaccgctcactccctctccgcagcagccaatgtcctcttccgcggagaactacagataccacagattctcgtcatcggcaattcctgacaaaaacaatagtaggacaagccgactagacatcaatttatgatacatgggctgataatcaccacgaaatacaacttgcgacatggaaaaagcacatactgccggggaaatatttgaatcttcctttctgtattcctgagaagttctactactgtcttactggcaacacgtgcatgtcgttggatatgcctctttttgtttattttggtctatcattgttggatgagacgatgagtagttagcatttcttttgtatcttgtcaaatatttgttgaaattgtttgggattggagacagtgaacatgtataaaatcagtagaaacaatttagatgactatagtgttgaactgttctattcatgatctaaagtcacctggaacaataggaaatgggacttagatttgactgcaactattattgacattgttctggatcatttttagactgaatgccaagctcataattttgtttagtt

SEQ ID NO: 2992 - DNA, 1658 bp, Hordeum vulgare
tcgcgacagagcaccggcagcagagcgagcgaaaagaagccacgacagcaaggggggaggagcggcagccgtcgccgacactgatcccacgagcagattagagagctcgcctccgtcgaagatctgaactccctcctcccgctttcggaactcggatcattccttccttcattccggatccgcggatctacccttctgtgctgctgcagcagctgtcgctgctcggttgatttggtgggtggagatgaggttctggagggacggcggcgcgagcgcgagcgggcgggacctcaacggcgggatgccctacggccaggtgcgcgtcctcatcgtcggcgattcaggtgtggggaaatcttcattggcacatctcattcttcaaggttctgcgattgctcgaccgacccaaacaattgggtgtacagtcgatgtaaaacatattacttacggaggcctagggagttcatctaatagcatcatcggggatgctgaaaggaacttctttgttgagctttgggatgtttcagggcacgatcgctacagagattgccgttcacttttttattcacaaattaatggtgtcatatttgtttatgacctatctcagaggaagacaaagacaaatttgagcaagtgggcagttgaggttgctgagtctgggaccttttcagctcctcttgggtctggtggtccaggaggccttccagttccttacctagtgattgctaacaaagtagacattgctccaagagatggtagaagagttagcagtggaaatcttattgatgttgctcgtcaatgggttgacaagcaaggtctacttccatcgaatgaagaacttccacttgtggatagcttccctggcaattctggtctgctcacggctgcaaaagaggctagatatgataaagaagctgtggttaagttcttccgcatgttgataaggaggaggtatttctcgaatgaacttcctgcccctagcccatggtctctcactcccagaggggataccattcttcctgtagaaaccacgaatgacgaagagttgttcaaaaggaaaagctatggcgggcagaggtacaaatataacggtgtcgccccactatctgctcagcagaacgtaactctaccgctcagtccctctcctcaacagccgatgtcctcttccgcggagaactacagataccacagattctcgtcatcagcaattcctgacaaaaacagcagcaggacaagccgattagacatcaatttatgatacacgggctcataatcaccacgaataatcaccatgatatacagcttgcgacgtgggaaaagcacatactcccggggaactatttgaatccgactttctgtattcttgagaagttcaactactgtcttactggcaacatgtgcatgtcgtcggatatgcctctttttgtttattttgtctttcattgtgcgatcagtagttagcatttctttcatatcttgtccaatatttattgaactgtgatgtattggaattggagacaatgaacatgtataaaatcagtagaaacattttagagatgactatagtgtcaaattgttctattcatgatctaaagtcacctggaacagtaggaaatgggacttagttttgactgcaactattattaacattgttctgg

SEQ ID NO: 2993 - DNA, 1445 bp, Sorghum bicolor
cggtgccagtccactaccctactccgatctcgagggcgcgacgccaccgtcctctcccctggcgtcgtgcctcgtcccaactcccaactgccgaggggtggaggggcaattccggtgtgcgcgcgcgtgcgtgcgtgcggaagtgaacccccggttgattagtacagcaggtgggtgggagatcgaggtcgcgcccttgccccacacgccactaaacgccgcgccgacgggctcatcaggcgatttggacgggctcgcctcggccgctctgtgcttgtgcggtgggtgggttgcgggtgcgggaagcctcgccaaacctagcggtgccgactgccgagctgggtgggggcgcgaggagtcgacgggaagacaaggaatcatgagtgaaacagggcacactgtacaagtcactaacctctcgagcagagtatctgaaagtgatcttcatgagttcttttcgttctctggtcctattgagcacatagaacttatcagatcagaagattatggtgccactgcttatgtgacattcaaggaacgctttgccttggaaactgcagtattgctcagtggggctactattgtggatcagccagtatgcataacttattggggacaacctgaggagacttttaatttctgggacaggccaacttgggagaccgaagaggaaatcgaatacaggaactaccagacatgccagtacaacactactccgcaggaagcttttacagtggctcaagatatcatgaagacgatgctagcaaagggatacgtgctcagcaaggatgctttggctaaggctagagcctttgatgagtcccatggattaacagctgcagctgcagccagggctgcagagctgagcaagagaatcggtttaactgacagggtcaatgctggtgttggtgcaatgcgatcagtcgatgagacatatcgtgtaagggagacaaccaagacggttgctactgccactggaagaactgcagctaaggtggtaaatggcatcgtcaccagcagctacttctctgcaggagccatgatgctgtctgatgctcttactagggctgccaaggccgcggcagatctggctgctcatggtaggcagagttgaatgaaaagtgaacatacaatccatccttcagttactaaacaggaggaagaacaccttaatacgatatacttcaagtgatgttcgatgtatatttataacagacaacagtgttgtaaattaaaaggagacgaacactgcgtttggaacaaattgtttgctctgataagtttgatgcaaatggagtcaagtgatcgtgcagccatgtttctgactttctgcgcatttcatattcttgcattgctgttgagtactgccttcccttgcatcggtggcctagctccttctcttttgactttattttcctctcggcgtgcctctcatttgtttatca

SEQ ID NO: 2994 - DNA, 1284 bp, Saccharum officinarum
ctccgatctcgaggccgccacgccaccccaccgtcctctcccctggcgtcgtgccccctcgtcccaactcccaactgccgaggggaggaggggcaatccggtgtgcgcgcgcgtgtgcggaagtgaaccccggttgattagtacagtaggttgtaggtgggagatcgaggtcgcgcccttgccccacacgccactaaacgccgcgccgacgggctcatcaggcgatttggacgggccactctgcgcctgtgcggtgggtggagtgcgggtgctggtgcgggaagcctcgccaaacctagcggtgccgagctgggtgggggcgcgaggagtcgacgggaagacaaggaatcatgagtgaaacagggcacactgtacaagtcactaacctctcgagcagagtatctgaaagtgatcttcatgagttcttttcgttctctggtcctattgagcacatagaacttatcagatcagaagaatatggtgccactgcttatgtgacattcaaggaacgctttgccttggaaactgcagtattgctcagtggggctactattgtggatcagccggtatgcataacttattggggacaacctgaggagacttttaatttctgggacaggccaacttgggaggtcgaagaggaaatcgaatacaggaactaccaaacatgccagtacaacactactccgcaggaagtttttacagtggctcaagatatcatgaagacgatgctagcaaaggggtacgtgctcagcaaggatgctctggctaaggctagagcctttgatgagtcccatggattaacagctgcagctgcagccagggctgcagagctgagcaagagaattggtttaactgacagggtcaatgctggtgttggtgcaatgcgatcagtcgatgagacatatcgggtaacggagacaaccaagacggttgctactgccactggtagaactgcagctaaggtggcaaatggcatcgtcaccagcagctacttctctgcaggagccatgatgctgtctgatgctcttactagggctgccaaggctgcggcagatctggccgctcatggtagacagagttaagtgaaaaataaacatacaatccatcctttcggttactgaacaggaggacgaacaccttaatatgatactttaagtgatgttggatgtatatttataacagacaacaatgttgtaaattaaaaggagacgccactgcgtttggaacaaattgtttgctctgagaagtttgattattgcaaatggagtcaagtgatcgtgc

SEQ ID NO: 2995 - DNA, 1272 bp, Zea mays
actaccctattccgatctcgaggacgccacgccacttttaacccccccacccccccttctgtcgtggtgcctcggcccaagtgctaacgcccaactgccaaggcggggaggggggatccggtgcgcgcgcgcgcggaaatgaacaccggctgattagtaggtgggagatcgaggtcgcgcccttgccccacacgccactaaaggccgcgccgacgggctcatcaggcgctctggacgggctcgcttctgccgctccgcgcttgtgcggtgggtgaagtgctgctgctggtgcgggaagcgtcgccaaacgtgcagaccttggtgggggagcgaggagtcgaaacaagggtaagaaccatgagtgaaacagggcacactgtacaagtcactaacctctcgagcagagtatctgaaagtgatctttatgagttcttttcgttctctggccctattgaacatgttgaacttatcagatcaggagaatacggtgctactgcttatgtgacattcaaggagcgctttgccttggaaactgcggtattgctcagtggggctactattgtggatcagccggtatgcataacttattggggacaacctgaggagacttttaatttctgggacaggccaacttgggaggttgaagaggaaattgaatacacgagttatcaatcatgccagtacaacactactccgcaggaagctcttacagtggctcaagatatcgtgaagacgatgctagcaaaggggtacgtgctcagcaaggacgctttggctaaggctagagcctttgatgagtcccgcggattaacagctgcagctgcagccaaggctgcagagctgagcaagagaattggtttaactgacagggtcagtgctggtgtcggtgcaatgcgatcggtcgatgagacatatcgcgtaacggagacgaccaagacggtagctactgccactggaagaactgcagctaaggtggtaaatggtatcgtcaccagcagctacttctctgcaggagccatgatgttgtctgatgctcttactagggctgccaaggccgcggctgatctggccgctcatggcagacagagttaagtgaaaaacaaaacatacaatccatcctttttcagttactaaacatgaggacgaacaccttaataggatgcttgaagtgttgttgttcgatgtatatttataacagacaacattgttgatttgttgtataaattaaaaggagacgtacactgcgtttgcactaataagtttgattattgc

SEQ ID NO: 2996 - DNA, 1122 bp, Panicum virgatum
ggactggctcggcctggccactaccgccccgtctctgcgcttgtgcggtggttggagtgcgggtgctggttgttagaaggatcgtcaagcctacccggattgaggggaagtagggggcgtgtccgagcagggctttccctgttagcaggaagtacaccagtcaagacggtaccaaggtggtgctaataccctttcatagaatcatgagtgaaacagggtacacagtacaagtcactaacctctctagcagggtatctgaaagcgatcttcatgagttcttttcgttctctggtcctattgagcatatagaacttatcagagcgggagaatacggctctactgcttatgtgacattcaaggaacgctatgccctggaaactgcagcattgcttagtggggctactattgtggatcagccagtatgcataacttattggggacaacctgaggagacttttaatttctgggacaggccaagttgggaggttgaggaggaaatcgaatacaggaactaccaagcgtgccagttgaacactactccacaggaagctttgacagtggctcaagatgttgtgaagacgatgctagcaaagggatacgtgctaagcaaggatgctttggctaaggctagagccttcgatgagtcccgtggtttaacagcatcagccgcagccaaggccgcagagctgagtaagagaattggtttaactgatagggtcaatgctggtgttagtgcaatcaatgctggtgttggtgcaatgcgatcagtggacgagacataccgcgtatctgagacgacgaagactgttgcgactgccaccggaagaacagcagttaaggtggcgaacagcatcgtcactagcagctacttctctgcaggagccatgatggtgtctgacgctcttactagggctgccaaggcggcagcagatttggctgctcatggtaggcagagttaagtgaaaataaacaatcaatgcatcctttcagttattaaacatgtggacaacaccgaaatatgatgcttcaaatgttgttcaatgtatattataacagacaacagtattgtaaaaggagacgaacatgtttgtgaccagtcatgtttgtgatcgtgcagtcatg

SEQ ID NO: 2997 - DNA, 1435 bp, Panicum virgatum
ccactactgccagccaatcccctcactccacactggccccaatctcgagaagacgaaaacgccgccgcccttcgacacccttccccgtcacctctccgcccaaccgccgacgtgaatcccggtgcgcgcgcgcgtgggcggaagccgcttgcttcggtttggtgggagatcgaggtcgctcccgtgtcccacacgctaccaaacgccgccccgacgggttccgccgctttggactggctcggcctggccactaccgccccatctctgcgcctgtgcggtgggtggagtgcgggtgctggtgctggttgctacaaggatcgtcaagcctgcccggattgaggggaagtagtaaggggtgtgtccgagcagggctttccctgttagcaggaagtacaacagtcaagacggtaccaaggttgtgctaattcccttcaatagaatcatgagtgaaacagggtacacagtacaagtcactaacctctctagcagggtatctgaaaacgatcttcatgaattcttttcgttctctggtcctattgagcatatagaacttatcagatcgggagaatatggctctactgcttatgtgacattcaaggaacgctatgccttggaaactgcagcattgcttagtggggctactattgtggatcagccagtatgcataacttattggggacaacctgaggagacttttaatttctgggacaggccaagttgggaggttgaggaggaaatcgaatacaggaactaccaagcatgccagttcaacactactccacaggaagctttgacagtggctcaagatgttgtgaagacgatgttagcaaggggatatgtgctaagcaaggatgctttggctaaggctagagccttcgatgagtcccgtgggttaacagcatcagctgcagccaaggccgcagagctgagcaagagatttggtttaactgacagggtcaatgctggtgttagtgcaatcaatgctggtgttggtgcaatgcgatcagtggacgagacataccgcgtatctgagacgacgaagactgttgcgactgccaccggaagaacagcagctaaggtggcaaacagcatcgtcactagcagctacttctctgcaggagccatgatggtgtctgacgcttttactagggctgccaaggcggcagcagatttggctgctcatggtaggcagagttaagtgaaaataaacagtcaatgcatcctttcagttattaaacatgtggacaaacaccaaaatatgatgcttcaaatgttcgatgtatattataacagacaacaatattgtaaaaggagacgaacatgtttgtgaccgtgcagtcatgtttgtgatcgtgcaacatgttagtgacttgtgctcatttcgtattctttctgataagtcctgtctccccttgccttgctggccgaattcctt

SEQ ID NO: 2998 - DNA, 1321 bp, Setaria italica
gtccacactgcccctaatctcgagaacaccactgttctttcttccccaccctccccatcacctctccgcccaaccgccgacgtgaatcccggtgtgcgcgcgcgtgggcggactgttaggtaggagatcgaggtcgcccccttgccccacacgctactaaaggccgccccgacgggctccggcgctttggactggctcggcttggccactaccgtctaccgccgccctctctgcgcttgtgcggtgggtggagtgcggctgctggtgcgagaaggatcgtcaaacctagccgaattgaggggaagcggtgggtgtgtccgatcaggaatcatgagtgaaacagggtacacagtacaagtcactaacctgtcgggcagggtatctgaaagtgatcttcatgagttcttttcgttctctggtcctattgagcatatagaacttatcagatcgggagaatatggtgctactgcttatgtgacattcaaggaacgctatgctttggaaactgcagtattgctcagtggggctactattgtggatcagccggtatgcataacttattggggacaacctgaagagacttttagtttctgggacaggccaacttgggaggtcgaggaggaaattgaatacaggaactaccaatcatgccagttcaatactactccacaggaagctttgacagtggctcaagatgtcgtgaagacgatgctagcaaggggatacgtgctcagcaaggatgctttggctaaggctagagccttcgatgagtcccgtgggtatacagcagcagccgcagccaaggctgcagagctgagcaagagatttggtttaactgacagggtcaatgctggtgttggtgcactcagtgctggtgttggtgcaatgcgatcagtggacgaaacgtacggcatatcagagacgaccaagactgttgcgactgccactggaagaacggcagctaaggtggcgaacagcatcgttaccagcagctacttctctgcaggagccatgatggtatctgacgctcttaatagggctgccaaggcggcagcagatttggctgctcatggtaggcagagttaattgaaaaataaacacccaatgcatcctttcagacatgaaacatgaggacaagcaccgaaatacgatgcttcaaatgttgtttgatgtatatcataacagacaacagtgctgtaaaaggagatgaacacttcgtttagaacaaacacttgtgctcaacagtttatgtgttgcagattgagtcaagtgatcgtgcagtcatgtttctgactttctgctcatttcatattctttgtga

SEQ ID NO: 2999 - DNA, 1297 bp, Panicum virgatum
caaccgccgacgtgaatcctggtgcgcgcgcgcgtgggcggaagccgcttgcttcggttaggtgggagatcgaggtcgctcccgtgtcccacacgctaccaaacgccgccccgacgggttccgccgctttggactggctcggcctggccactaccgccccatctctgcgcctgtgcggtgggtggagtgcgggtgctggtgctggttgctacaaggatcgtcaagcctgcccggattgaggggaagtagtaaggggtgtgtccgagcagggctttccctgttagcaggaagtacaacagtcaagacggtaccaaggttgtgctaattcccttcaatagaatcatgagtgaaacagggtacacagtacaagtcactaacctctctagcagggtatctgaaaacgatcttcatgaattcttttcgttctctggtcctattgagtatatagaacttatcagatcgggagaatatggctctactgcttatgtgacattcaaggaacgctatgccttggaaactgcagcattgcttagtggggctactattgtggatcagccagtatgcataacttattggggacaacctgaggagagttttaatttctgggacaggccaagttgggaggttgaggaggaaatcgaatacaggaactaccaagcatgccagttcaacactactccacaggaagctttgacagtggctcaagatgttgtgaagacgatgttagcaaggggatatgtgctaagcaaggatgctttggctaaggctagagccttcgatgagtcccgtgggttaacagcatcagctgcagccaaggccgcagagctgagcaagagatttggtttaactgacagggtcaatgctggtgttagtgcaatcaatgctggtgttggtgcaatgcgatcagtggacgagacataccgcgtatctgagacgacgaagactgttgcgactgccaccggaagaacagcagctaaggtggcaaacagcatcgtcactagcagctacttctctgcaggagccatgatggtgtctgacgcttttactagggctgccaaggcggcagcagatttggctgctcatggtaggcagagttaagtgaaaataaacagtcaatgcatcctttcagttattaaacatgtggacaaacaccaaaatatgatgcttcaaatgttcgatgtatattataacagacaacaatattgtaaaaggagacgaacttgtttgtgaccgtgcagtcatgtttgtgatcgtgcaacatgttagtgacttgtgctcatttcgtattctttctgat

SEQ ID NO: 3000 - DNA, 1106 bp, Pennisetum glaucum
ggacgtggctcggcttggccactaccgccgctctctctctatctgcgcttgtgcggtgggtggggtgcgactgctggtgcgagaaggatcgatctccgagggggtgtgtccgagcaggaatcatgagtgaaacagggtacacagtacaagtcactaacctgtcgggcagggtatctgaaagtgatcttcatgagttcttttcgttctctggtcctatcgagcatatagaacttatcagatcgggagaatatggtgctactgcttatgtgacattcaaggaacgctatgccttagaaactgcagtattgctcagtggggcaactattgtggatcagccggtatgcataacttattggggacaacctgaagagacttttagtttctgggacaggccaacttgggagtccgaggaggaaatcgaatacaggaactaccaatcatgccagttcaatactactccgcagcaagctttgacagtggctcaagacgtcgtgaagacaatgctagcaaagggatatgtgctcagcaaggatgctttggctaaggctagagccttcgatgagtcccgtgggtatacagcagcagctgcagccaaggccgcagagctgagcatgagatttggtttaactccgcatatcaatactggtgttggtgcactcaatgctggtgttggcgcaatgcgatcagttgacgagacataccgcatattagagacgaccaagactgttgcgactgcaactggaagaactgcagctaaggtggcgaacaacatcgttaccagcagctacttctctgcaggagccatgatggtgtccgacgctcttactagggctgccaaagcggcagcagatttagctgctcatggtaggcagagttaattgaaaaataaacccccaatgcatcctttcagataccaaacatgaggacaagcaccaaaatacgatgcttgaaatgttgttctatgtatattataacagaaaactgtgctgtaaaaggagatgaacacttcatttggaacaaacactagtgctgaacagtttatgtgttgcagattgagtcaaagtgatcgtgcagtcatgttaaacaaaaaaaaaaaaaaccgtaac

SEQ ID NO: 3001 - DNA, 3137 bp, Sorghum bicolor
cagaggaggggagcactagactggtgtggttgtggtgatcctcatccgccgcatcgcacgtgcacattgcccatctcaccatcctccctcctgtggtggtggggctgcagctccactccactccactccactccacgccagcaggctcgccttggtctctcctcctcctcctcctcctcgcgcttctattttgtttctttatctttatttatattatattcccctcccgcaccgatcccccattcccttcccacccactcgcattgtccgtctctttgccggctgccgctgttgtgttgccttccttccttccttccatccatctatccacgtcgtctctgcgctgcgtctgtgttcttgctgcagctggccaaaggccgccgcccggcggcgacacgtacgacattgctcgccctgctctgctcatgcgtcttctttcctggatgtggatgaccaccagaggttaggttagcagcagccagaaggcttctaatcttcatcccgcgcgccgccatggatcccgagttcggcgtcggcacggcgccacgaaagagggaggcatggcggacgacgctgctgctggcgtaccagagccttggcgtggtgtacggcgacctcagcatctcgccgctgtacgtgtacaagagcaccttcgccgaggacatcacgcactcggagggcaacgaggagatctacggcgccctctccttcgtcttctggacgctcaccctcatcccgctcctcaagtacgtcaccatcgtcctgcgcgcccacgacaacggcgaaggtggcaccttcgccctctactccctcatctgccgccacgccaatgtctgcctcctccccaaccgccagctcgccgaccaggacctctccacctacagcctccagcgcccgcacgacgccgccgggacctgtgcaccctcaccagtcaaggcctggctcgagaaccacaccaaactgcacaccgcgctgctcgtcatggtcatgatcggaacatgcatggtcatcggcgacggcgtcctcacccccgccatctccgtcttctccgccgtctcagggctcgagctctccttgtccaaggatcagcatgaatatgccgtcattccgataacatgcgccatactagtattcctgtttgcgctccagcactacggcacccaccgcgtagggttcctcttcgcgcccatcatcctcgcctggctgctctgcatgagcaccatcggcctgtacaacatcatccgctggaatccccagatctacacggcgctcaacccctcctacatgatccgattcctcaggaagaccaagaagtctggctggatgtccctgggaggaattctgctgtgcatgacaggatccgaagcaatgttcgccgatcttggacacttctcctacagctcgatccagcttgccttcacttctttagtgtacccttcactgatcctgggatacatgggccaagctgcttatttgtcccagcaccataaccttgacgcaagctaccaaatcggattctacattgcagttcctgagagtgtaaggtggcctgtgctagtgctggcgatcttggcatctgtggtcggcagccaagcgatcatcagcggcacgttctccatcatcaaccagagccagtctctgagttgcttccccagggtgaaagttgtgcacacgtctgacaaagttcatggccagatatacatcccggaggtcaactggatcctcatgatcctctgcgttgctgtcactgttggtttccgtaacaccaagcacatgggaaatgcatctggcctggccgtgatcacggtgatgctggtgacgacgtgcctcatgtccctggtgatcatgctgtgctgggaccgatccccatggctggcgctcgccttcttcctcttcttcggctccatcgaggcgctctacttctcggcgtcgctgatcaagttcctggaaggcgcgtggctgccgatcttcctggcactcatcctgctcgccatcatgttcgtgtggcactacaccacgatcaggaagtacgagtacgacatgcacaacaaggtgaccctggagtggctgctggcgctgggcgacaagctaggcatggtgcgcgtcccgggcatcggcctcgtctacaccgacctcacctccggcgtgccggccaacttctcccgcttcgtcaccaacctgccggcgttccaccgggtgctggtctttgtctgcgtcaagtccgtgacggtgccgcacgtgctccccgccgagcgctacctggtcggccgcgtcggcccgccgggccaccgctcctaccgctgcatcgtgcgctacggctaccgcgacgtgcaccaggacgtggactccttcgagacggagctcgtcgagagcctcgccacgttcatcaagctggacgcgctgttccgctgcagcgacgccggcggcgagcagcgggacagcagctactacgagcgcgagaacgcgctgacggtcatcgggagcaacccgctgcggcgccacatgagcctgggctacgacgactcccactcccacgacgacggcgcgtcgtctgactctgacagcgtggacggcatagagctcgcggcgtcggcgccggctccggcggccgtcaagaagcaggtgaggttcgcggtgccgccgcccaggagccccggggtggacgagagcgtgctggaggagctgcacgagctgtgcgaggcgcgggaggccggcacggcgttcatcctggggcactcgcacgtgaagaccaagcccgggtcgtcgttgctcaagaggctggccgtcggcgtcggctacaacttcctgcgccggaactgccgcggcccggacgtggcgctgcgcgtgccgccggcgtcgctgctcgaggtgggcatggtgtacgtgctgtgatcagaacgtggcggtgatgggtgactgcgatctctgcgtccggttttcgctgcgtaaactacggatcactctgcttttgtgcagtatgcagacctcgacttgttggtgtaaattgtaacgagatgccatgataatagaggatgccctgacatttcccagcgcgataagcgtttgactaaggattatataccattttataactttataatctctacaactaaaaagacccgaaggtcatcgtctct

SEQ ID NO: 3002 - DNA, 3045 bp, Setaria italica
ccattcccctgcccccattatcgatcctctcctgtggggctcaaagctccactaacttttatgtagctctcgcctggatatgtatgccagtgccgtccgtgatctcttggtgcttgctttcccctcctcgcgcccatattttattcccctccccgccggttccgttccgcgatcctcgttcgcattgtctgtcactcctcgattgtttttgtttcgagggctgcaaggcaggcgtagcttcatgatcggagcctagcttctccggttcagtttcttggttgatcccatctcgcatcgcagacatggatactgagttcggagttggcatggcgccccgaaagagggagtcatggcggacgacgctgctgctggcgtatcagagcctcggggtggtgtacggcgacctcagcatctcgccgctgtacgtgtacaagagcaccttcgcagaggacatcacgcactcggagaccaacgaggagatctacggcgccctctccttcgtcttctggacgctcaccctcatcccactcatcaagtacgtcaccatcgtcctgcgcgccgacgacaacggcgagggaggcaccttcgcgctctactccctcatctgccgccacgccaatgtcagcctcctccccaaccgccaggtcgccgacgaggagctctccacctacaagctcgagtgcccgcccgaggtcgcccagaggtcacgcgtcaaggagtggctcgagaagcacaagaagctgcacaccgcgctgctcgtcatggtcatgatcggcacatgcatggtcatcggggacggcgtcctcacgccggccatctcggtgttctccgctgtttcagggcttgagctctccttgtccaagcatcaacatgaatatgcggtcatcccgataacctgtgctatattagtattcctgtttgctctccagcattacggcacccaccgtgtcggatttctcttcgcaccgatcgtgctgtgctggcttctctgcatgagcgcaatcggcttgtacaacatcatccactggaacccccatgtttaccaggcactcaatccctgctacatgatcacattcctgaagaagaccaggaagtctggctggatgtctctgggaggaattttgctatgcatgacaggatccgaagcaatgttcgcagatcttggccatttctcctacagcgcaatccagcttgctttcacttctttagtgtatccatcactgattctgggatacatgggtcaagctgcttatttgtccaaacaccataactttgacgcaagctaccaaattggattctacatcgcagttcccgagagtgtaaggtggcctgtgctagtgctggcgatattggcgtcggtggttggaagccaagcaatcatcagtggaacattctccatcatcaaccagagccagtccctgagttgcttccccagggtgaaagttgtgcacacctctgccaaaattcatggtcagatatacatccctgaggtcaactggatgctaatgatcctctgcattgctgtgaccgttggtttccgtaataccaagcacatgggaaatgcatctggcttggcggtgatcacggtgatgatggtgacgacgtgtctcatgtcggtggtgatcatgctgtgctggcaccggtcgcctctgctagccctggcgttcttcctcttcttcgggtcgatcgaggcgctctacttctcggcgtcgctgatcaagttccttgaaggcgcgtgggtgccgatcctgctgtccctcatcctgttggccgtcatgttcgtgtggcaccacaccaccatcaagaagtacgagtacgacatgcagaacaaggtgaccctcgagtggctgctcgccctgggcgacaagctcggcatggtgcgtgtcccgggcatcggcctcgtctacaccgacctcacctccggcgtgccggcgaacttctcccgcttcgtaaccaacctcccagcgttccaccgggtgctcgtcttcgtctgcgtcaagtccgtgccggtgccgcacgtgctccccgccgagcgctacctcgtcggccgcgtcgggccgccgggccaccactcctaccggtgcatcgtgcgctacggctaccgcgacgtgcaccaggacgtggactccttcgagacggagctcgtcgagagcctcgccaccttcatcaagctcgacgcgctgttccggtgcagcgacgccggcggcgagcagcgggacagcagctactacgagcgcgagaacgcgctcaccgtcatcgggagcaacccgctgcggcgccacctgggcctgggatacgacgactcccacgacggcgtgtcgtcggcccacgaggccgctggcagcgcgaacgggatcgagctcgcggcggcggcgccggcgattaagaagcaggtgaggttcgcggtggagagcgcggcgccgaggagccccggcgtggacgagcgcgtgctggaggagctgcaggagctgtgcgaggcgcgggaggcggggacggcgttcatcctggggcactcgcacgtgcagactaagccggggtcttcggtgctgaagaagctggccgtcggcgtcggctacaacttcctgcggcggaactgccgcggcccggacgtggtgctgcgcgtgccgccggcgtcgctgctcgaggtcggcatggtctacgtgctatgacaacgtgattgcggatctccctgcttctttttgtcagtgcgtcaactacggatctctctgctttcgtgcagtatgcagatctcgacctgctgatgaaaattgtaattcgtaacgcgatgcgatgatatagaattatagatgccctgatatttgccagtggcaccatgtgttcaatatatggttgttgaatcaaattattggcaaattttacatacactggttacactgtccaataccttccatttgaagcctctaaatcagtaagaaatggcatataacaaaattcgctcaagttcagaagttgtgtggcgcacaacttgaagttggaaatttatgtttgatactttgattcttttccggaacgaactgattgtgt

SEQ ID NO: 3003 - DNA, 2781 bp, Panicum virgatum
tgtctttcttgtgttgctttcctccttccttcatctatcctctcgctgggcctgcttcaatccatcgcattgctcctctgctgctgctgatgcgcttccttcttggatatatcagggccgcaaattaaaagcaggcgcgcagcttcatgatcagcagaggctagcttctcaggttccaatttcttgattcatctcgcatcgcagccatggatcccgagttcggagtaggcacggcgccccgaaagagggagtcatggcggacgacgctgctgctggcgtaccagagcctcggggtggtgtacggcgacctcagcatctcgccactctacgtgtacaagagcaccttcgccgaggacatcaagcactcggacaccaacgaggagatcttcggcgccctctccttcgtcttctggacgctcaccctcatccccctcatcaagtacgtcaccgtcgtcctgcgcgccgacgacaacggcgaaggaggcactttcgcgctctactccctcatctgccgccacgccaatgtcagcctcctccccaaccgccaggtcgccgacgaggagctctccacctacaagctcgagtacccgcccgaggtcgcccagaggtcacgcgtcaaggactggctggagaagcacaagaagctgcacaccgcgctgctcgtcatggtcatgatcggaacatgcatgatcatcggggacggcgtcctcacgccggcgatctcggtgttctcggctgtttcagggctcgagctctccttgtccaaagatcaacatgaatacgcgatcattcccataacctgtgccatattagtattcttgttcgctctgcagcattatggcacccaccgtgtaggattcctcttcgcgccgatcgttctgtcctggctgctctgcatgagcggtatcggcttgtacaacatcatccactggaaccctcatgtttaccgggcactcaatccctcctacatgatcacattcctgaagaagaccaggaagtctggctggatgtcgctgggaggaattttgctatgcatgacaggatcggaagcaatgtttgcggatcttggccacttctcctacagcgcaatccagcttgctttcacttctttagtgtacccttcactgatattgggatacatgggtcaagctgcctatttgtccaaacaccataaccttgacgcaagctaccagattggattctacatcgcagttcccgagagtgtaaggtggcctgtgctagtgctggcgatattggcatcggttgtaggaagccaagcaatcatcagtggaaccttctccatcatcaaccagagccagtccctgagttgcttccccagggtgaaagttgtgcacacgtctgacaagattcatggccagatatacatccctgaggtcaactggatgctaatgatcctctgcattgcggtcaccgttggtttccgtaatacgaagcacatggggaatgcgtccggcctggccgtgatcacggtgatgctggtgacgacgtgcctcatgtccgtggtgatcatgctatgctggcaccggtcgcctctgctagccctggcattcttcctcttgttcggttcggtcgaggcgctctacttctcggcatcactgatcaagttcctggaaggtgcgtgggtgccgatcctcctctccctgatcctgctcgccgtcatgttcgtgtggcaccacgtgacgatcaggaaatacgagtacgacatgcacaacaaggtgaccctggagtggctcctcgctctcggcgacaagctgggcatggtccgcgtcccgggcatcggcctcgtctacaccgacctcacctccggcgtgccggccaacttctcccgcttcgtgaccaacctcccggcgttccaccgggtgctcgtcttcgtctgcgtcaaatccgtgccggtgccgcacgtgctccccgccgagcgctacctcgtcggccgcgtgggccccccggggcactgctcctaccggtgcatcgtgcggtacggctaccgcgacgtgcaccaggacgtggactcgttcgagacggagctcgtcgagagcctcgccacgttcatcaagctcgacgcgctgttccggtgcagcgacgccgggcagggaggcgcgggacagcagctgcggctacgaaaacgagcgcgagaacgcgctcacagtcatcgggagcaacccgctgcggcgccacctgcagctggggtacgacgagtcccacgacggcgtgtcgtcggcccacgagacgggcgtggacgggatcgagctcgcggcggcggcgccggcgatcaagaagcaggtgaggttcgcggcgaccccctgcaggagccccggcgtggacgagcgcgtgctggaggagctgcacgagctgtgcgaggcgcgggaggccggcacggcgttcatcctggggcactcgcacgtgcagaccaagcccgggtcgtcgctgctcaagaagctggccgtcggcgtcgggtacaacttcctgcggcggaactgccgcggcccggacgtggcgctgcgcgtgccgccggcgtcgctgctcgaggtcggcatggtctacgtgctgtgaggaacgtgacggcgatccatccgcgattgcgatctgtgcgtccggctttcagcgcgtctctctgccattgtattgtattgtgcacatctcgacttgctgatgtgaattgtagcgccatgcgatgccatgacatttttttctcgaatacgcaagagagttgcacatctttgtagtattaagaagaaaaaagtttacttgactactttttaa

SEQ ID NO: 3004 - DNA, 3597 bp, Oryza sativa
cctgggagtgccggatacgattcgcttcgcttttattcatatccatgtggcgtggaacggatcatcgatggcacatcgcgggatgctcgaggagatggccatgtgttcttggcaagaagaagaagaggttggagtgcgaattccaccattaacgcaatagtgatgatctaggggaggcttccctggtctgcattacattctgaaagcaaaagctcattgagtcggcacttcctgtgctgtgatgcgagaatgtgagttcacatgcttttgtccttggacccacatggcctgccttggctgttccattcggtcatatgcccaaaaagctctcgttaaatcccctacctgctgcactttgccatccatcgatttgattttatatgatgcaacttggtgttatcccaactttgtaagtttagtgtgattatctctttgaagcttaggtagaggagtgagcactagtagttgattaataggatttgtattgtaagtgtgatactgctccaccacacgtgtctatatcgcttccttccattccatcacctcgcattcattccaattagtgatcttgaggggctccatctgcaacttttcaccttggatatatttgcatccttgcttttcccagctctcctcgccctttccccttcttagagctgattctctcgattgattacctagtactactgcaattcacattgtcagctcttgcttgttcccaggaggatcagtttcttgctgagcaatggatcctgagttcgggagaggcatggcgcctcgaaagagagagccatggcggacgacgctgctgctggcgtaccagagcctcggggtggtgtacggcgacctgagcatctcgcccctgtacgtgtacaagagcaccttcgcggaggacatcacccactcggagtccaacgaggagatcttcggcgtcctctccttcgtcttctggaccctcaccctcatccccctcatcaagtacgtctccatcgtcctccgcgccgacgacaacggcgaaggagggacgtttgcgctctactctctgatctgcaggcacgccaatgtgagcctcctcccaaacaggcaggtcgccgacgaggagctctccacgtacaagctggagtacccgcctgaagtggctaacaggtctcgaatcaaggagtggcttgagaagcacaagactctgcagactgctctgctgatcatggtgatgattggaacctgtatggtcatcggggatggcgtcctcacgcccgcgatatctgtattctcagcggtttcagggcttgaactctccttgtccagggatcagcatgaatatgccgtcattccgataacatgtgtcatattagtgttcctgtttgcactccagcattacggtacccatcgtgtcggatttctctttgcaccaatagtcctagcctggttgatttgcatgagcatgcttggcttgtacaatatcatccactggaaccctcaagtttatcgcgctcttaatccctattacatgctcaaattcttgaggaagactaagaagtctgggtggatgtccctggggggaattttgctctgcatgacaggatctgaagcaatgtttgctgatcttggccatttctcctacagtgcaatccagcttgctttcactacattagtataccctgcactgattttgggatacatgggccaagctgcgtatttatcgaaacatcacactctgaactcaacctaccaaattggttactatatatcggttccagagagtgtaaggtggcctgtgcttgtgctggcaattttggcatcggtcgtcggaagccaagcaatcatcagtggaacattctccatcatcaaccagagccagtcactcagttgcttcccaagagtgaaagtggtgcacacatctgagaatatccatggccagatttacatccctgagatcaactggctgctcatggtcctctgcattgctgtgactgtcggttttcgcgataccaagcatatgggaaatgcatccggattggcagtgatcacggtgatgctggtgacgacatgcctgacatccttggtgatcatgctgtgttggcaccggagtccggcgctggcactcgtcttcttcctcttcttcggctccatcgaggtgctctacttctcggcgtcgctgatcaagttccgggagggggcgtggctgccgatcatgctggcgctcatcctcatggccgtcatgttcatctggcaccacaccaccatcaagaagtacgagttcgacctgcacaacaaggtgaccctggagtggctgctcgccctgggcgacaagctgggcatggtgcgcgtcccgggcatcggcctcgtctacaccgacctcacctccggcgtgccggccaacttctcccgcttcgtcaccaacctcccggcgttccaccgcgtgctggtgttcgtctgcgtcaagtccgtcccggtaccgcacgtgcttcccgccgagcgctacctcgtcggccgcgtcggcccggcggggcaccggtcgtaccggtgcatcgtgcggtacggctaccgcgacgtgcaccaggacgtggactcgttcgaggcggagctcgtcgagagcctcgccaccttcatcaagctggacgcgctgtaccaccgctgcagcgacgccggcagcgggagcgagcagctcgacgacggccgctacgagcgcgagaacgcgctcacggtgatcgggacgaaccctctccggcgatgcctcagctacgaggcctcccacgacggcgtgtcctcggtggacgccgcgcgcagcccgaacgggatagtggaggtcccggcggcggcggcggcggcgccggtgacgaagaaggtgaggttcgtggtggaggcggcgagcccggaggtggagaagggcgtggtggaggagctgcaggagctgtgcgaggcgagggaggccggcacggcgttcatcctggggcactcgcacgtgcagaccaagccgggctcgtcgctgctgaagaagctcgccgtcggcgtcgggtacaacttcctccggcgaaactgccgcggcccggacgtggtgctgcgcgtgccgccggcgtcgctgctcgaggtcggcatggtctacgtcctatgacgtcaccacgagatctcatcgatcaataccctgtaaaaaaaattcaaaatcaaatctctctgcttgtataagaattaagaagcagattggaagaaaattgggcgaattttctccgatttttcagctgcttttttggtccgtgatgaaaccggcgacggcgagacgccggtcaaacactcggaacgggcaacgtgggctgcgaatagaaatcggcccatttaatgtccggcccatgaacgtccacttgatgcagcctgttcgactcggctgacccatgggcttgaacggggatcttttgtggaataaccgtccctcaactttacaccgagtttgtgtgacatcccttatcctcaataccagaaatcttcacccctaaaatatactccctccgttttaaaatatttaataccgttgactttttagtatgtgtttgaccattcatcttattcaaaaaatttaagtaattatttattcttttcatataa

SEQ ID NO: 3005 - DNA, 3156 bp, Hordeum vulgare
ctttgaggcagccagggagaggagaggagaggagaggactggaccgcgcactagttgggagtatcgtggaggttgtaggtggatgggcccccaccacacgtgacacgtctccgcaatccactcggtgatgcccaccatgttttgttctcctcggatatgtatggactaggactatgccttttcttcattcttctcctcctcccctgtctatcttcttcctcgatctcttcgtccccttcttccccccttcaaaaaacactaaccttgattcctccgtatgctccaatagtatagtatagtgccgtatcccgtcattgccagcccccgcttctttcgaggtgtctttcgtctgcgtgcgtgccaatcttgctctcggcgggtggctcaatccgttcgacaaataacagtgctgcttttaccttgatgtgctctgttctcgaagctggcagaaggaattcataggagcgtagctgttacctcgccgacggccaacggatcctgcccgagctcgggagcgcagcagccatggagccaggaaagcgggagacatggcggacgacgatgttgctggcgtaccagagcctgggggtggtgtacggggacctgagcatctctccgctctacgtctacaagagcaccttcgccgacgacatcacgcacaccgactccaacgacgagatcctcggcgtcctctccttcgtcttctggacgctcaccctcgtcccgctcatcaagtacgtctccatcgtgctccgcgcccacgacaacggcgagggcggcaccttcgcgctctactccctcatctgcaggcacgccaacgtcagcctgctccccaaccgccagctcgccgacgaggagctctccacctacagcctcgagcgcccgccggaggaggtcgcccacggctcccgcgtcaggcgatggctcgagggccacaggagcctcaaaaccgccctgctcgtcatggtcatgattggcacctgcatggtcatcggcgacggcgtcctcacccccgtcatctccgtgttctcggctgtttctgggcttgagctctccttgtccaagcatcagcatgaatatgccgtcactccgataacctgtgccataatagtgttcctgtttgctctccagcattacggcacacaccgtgtcgggtttctcttcgctccgataattctagcctggctgatctgcatgagtgcgctcggcgtgtacaatatcatctactggaaccctcaggtttacatggcactcaatcccatgtacatgctcaaattcttgaggaagaccaagaagtctggttggatgtccctgggagggattgtgctctgcatgacaggatctgaagcaatgtttgcagaccttggccacttctcctacagtgcaatccagcttgctttcacttctttggtatatcctgcactgatcttaggatacatgggtcaagctgcctatttaaccagacaccataacttcgactcgagctaccaaattggatactacatctcagttccagaggctgtgagatggccagtgctggtgctggcgatcatggcgtcggtggtgggaagccaagcgatcatcagcggaacattctccatcatcaaccagagccaggccctcagctgcttcccgcgggtgaaggtcgtgcacacgtcggccaaggtccatggccagatctacatcccggagatcaactggatgctcatggtgctctgcattgccgtcaccgtgggcttccgcgacaccaagcacatggggaacgcgtccgggctggcagtgatcaccgtgatgctggtgaccacgtgcctgacctcgcttgtgatgatgctctgctggcagcggccgccggcgctggcgcttgccttcttcgtcttcttcggctccatcgaggcgctctacttctcggcgtcgctcacgaagttcctcgacggcgcgtgggtgccgctcctcctcgcgctcatcctcgtcgccgtcatgttcgtgtggcaccacaccaccgtcaagaagtacgagttcgacctccacaacaaggtcaccatggagtggctcctcgcgctctgcgacaggctgggcatggtccgcgtccccggcatcggcctggtctacaccgacctcacctccggcgtgcccgccaacttctcgcgcttcgtcaccaacctccccgcgttccaccgcgtgctcgtcttcgtctgcgtcaagtccgtgcccgtgccccgggtgctccccgccgagcgctacctcgtcggccgcgtcggcccggcgggccaccgctcgtaccgctgcatcgtgcgctacgggtaccgggacgtgcaccaggacgtggactcgtttgagacggagctcgtcgagagcctcgcgtccttcatccggctcgacgcgctgttccggtgcagcgacgcccgcagcgacgccgactacgagcgggagaacgcattcaccgtcatcggcagcaacccgctccggcgccgcatcagctacgacgacacccacgacagcgcctcgtccgtggagatacgcgtggacagcatgacaggcagcgggacgaataccgtagagctcgcggccgtgccgacggcggcgcgggttgtgaagagggtgaggttcctcgtggaccccgggagccccgaggtggaggacaagcagatgctggaggagctccacgagctgtgcgaggcgagggaggccggcacggccttcatcatgggccactcccacgtgaaggccaagcccgggtcgtcgctgctcaggaggttggccatcgggtacgggtataacttcctgcgccggaactgccgcggcccggacgtcgtgctccgcgtgccgccggcgtcgctgctcgaggtcggcatggtctacgtgctgtgattcacagacacggggcttctgttctgtctctagcttccggacatgctgctgtaaattgtaacgtgacggccggcatgacgcgtgatggaaatcttttatgttttgattgatgaaatgcaagcatcgtatgcggtcgccgggtgataatgtagaaaattaacagatattgtgaaccttgcaaattataagcaacatgtatacatcaatagcaggtggaaatcgttggttgcaaaaaatcaaggattcatggtccaatagcaggtggggactcacaattgcaaccttctg

SEQ ID NO: 3006 - DNA, 3074 bp, Triticum aestivum
gcgcactagttgtggaggtcgtaggtggacgggcccccaccacacgtgacacgtctctgcactccactcggtgtgatacccaccatgttttcctcggcggatatgtatccgatgcctttcttcattctcctcccctatctatctgcttcctcgatctcttcgtcctcttccgaacccccttcatatactcaccttgaatccttcgtatgctactagtatagtatagcgccgtatcctggcattgccagctcccgcttctttcgagtagtccgtccgtccgtccgttcgtgtgcttgtgacgaacttgttcttggcagctggttcaatctattcgactgttaacagcgttgcttttaccttgatgatgtgctctgttcttggagccagccagcacaaggaaatcataggagcgtagctgtctttttcgccgacggccgacggatcctggtcgagctcgggagcgcggcagccatggagcccggaaagcgggagacatggcggacgacgatgctgctggcgtaccagagcctgggggtggtgtacggggacctgagcatctccccgctctacgtctacaagagcaccttcgccgacgacatcacccacaccgactccaacgacgagatcctcggcgtcctctccttcgtcttctggacgctcaccctcatcccgctcctcaagtacgtctccatcgtgctccgagccgacgacaacggcgagggcggcaccttcgcgctctactccctcatctgcaggcacgccaacgtcagcctgctccccaaccgccagctcgccgacgaggagctctccacctacagcctcgagcgcccgccggaggaggtcgcccacggctcccgcgtcaggcgatggctcgaggcgcaccgcagcctcaagaccgccctgctcgtcatggtcatgatcgggacctgcatggtcatcggcgacggcgtcctcacccccgtcatctccgtgttctcggctgtttctgggcttgagctctccttgtccaagcatcagcatgaatatgccgtcactccgattacttgtgccataatagtgttcctgtttgcgctccagcattacggcacccaccgcgtcgggtttctcttcgctcccataattctagcctggctgatctgcatgagtgcgcttggcgtgtacaatatcatctactggaaccctcaggtttacatggcactcaatcccgtatacatgttcaaattcttgaagaagaccaagaagtctggttggatgtccctgggagggattctgctctgcatgacaggatctgaagcaatgtttgcagatcttggccacttctcctacagtgcaatccagcttgctttcacttctttggtgtaccctgcactgatcctaggatacatgggtcaagctgcctatttaaccaaacaccatgacttcgactcaagctaccaaattggatactacatctcagttccagaggctgtgagatggccagtgctggtgctggcgatcatggcgtcggtggtcggaagccaagcgatcatcagcggcaccttctccatcatcaaccagagtcaggccctgagctgcttcccgcgggtgaaggtcgtgcacacatcggcgaaggtccatggccagatctacatcccggagatcaactggatgctcatggtgctctgcatcgcggtcaccgtcgggttccgcgacaccaagcacatggggaacgcgtcggggctggcggtgatcacggtgatgctggtcaccacgtgcctcacgtcgctggtcatgatgctgtgctggcaccggccgccggtgctggcgctggccttcttcgtcttcttcggatccatcgaggcgctctacttctcggcatcactcaccaagttccttgacggcgcgtgggtgccgctcctcctcgcgctcatcctcgtcgccgtcatgttcgtgtggcaccacaccaccgtcaagaagtacgagttcgacctccacaacaaggtcaccatggagtggctcctcgcgctctgcgacaggctcggcatggtccgcgtccccggcatcggcctcgtctacaccgacctcacctccggcgtgcccgccaacttctcccgcttcgtcaccaacctcccggccttccaccgcgtgctcgtcttcgtctgcgtcaagtccgtgcccgtgccgcgcgtgctccccgccgagcgctacctcgtcggccgcgtcggcccgccgggccaccgctcgtaccgctgcatcgtgcgctacgggtaccgggacgtgcaccaggacgtggactcgttcgagacggagctcgtcgagagcctcgcgtccttcatccggctcgacgcgctcttccggtgcagcgacgcccgcagcgacgccgactacgagcgcgagaacgccttcaccgtcatcggcagcaacccgctccggcgccgcatcagctacgacgacacccacgacagcgcgtcgtccgtggagatacgcgtggagagcccgacgggcagcaacgggacgaacaccatggagctcacggccatgccggcggcggcgccgcgggtggtgaagagggtgaggttccttgtggaccccgggagccccgacgtggaggacaagcagatgctggaggagctccacgagctgtgcgaggcgagggaggccggcacggccttcatcatgggccactcccacgtgaaggccaagcccgggtcgtcgctgctcaggaggctggccatcgggtacggctacaacttcctgcgccggaactgccgcggcccggacgtcgtgctgcgcgtgccgccggcgtcgctgcttgaggtcggcatggtctacgtgctgtgactcacagacacggggcttctgttctgtctctagcttccggacatgctgctgtaaattgtaacgtgacggcgtggtgcgcgatggaaatattatgttttgatttgatgaaatgcaaaaatcatatgcggtcgcggggtgataatgttaaaagatcgaccgcctgatagccgtctgatctctcccatatgagctagccggcaacaaggctagtattgcgctcggccctcagcaacaggagccttgttgcaatatcc

SEQ ID NO: 3007 - DNA, 3118 bp, Secale cereale
cagggagatgagaggagaggactggactgcgcactagttgtggaggctgtaggtggacgggcccccaccacacatgacacgtctctgcactccactcggtgatacccaccatgttttcctcggatatgtatcgagtagaatgcctttcttcattcccctccactaccactatctatctgcttcctcgatctcttcgtcctcttccccccttgatatactcaccttgattccttcgtatactagtatagtatagtatagtgccgtatcttggcattgccagctcccgcttctttcgactagtccgtccgttcattagtgtgcttgtggcaaacttgttcttgtcaggtgcttcaatctgtccgactggtaacagtgttgcttctctttaccttgatgtgctctgttcttggagccggcacaaggaaatcaatcataggagcgtagctgcttcctcgccgacggccgacggatcctggtcgagctcgggagcgcgagcgccatggagcccggaaagagggagacatggcggacgacgatggtgctggcgtaccagagcctgggggtggtgtacggggacctcagcatctccccgctctacgtctacaagagcaccttcgccgacgacatcacgcacaccgactccaacgacgagatcctcggcgtcctctccttcgtcttctggacgctcaccctcgtcccgctcctcaagtacgtctccatcgtgctccgcgcccacgacaacggcgagggcggcaccttcgcgctctactcgctcatctgccgccacgccaacgtcagcctgctccccaaccgccagcccgccgaccaggacctctccacctacagcctcgagcgtccgccggaggaggccgcccatgggtcccgcgtcaggcgatggctcgaggcccaccgcggcctcaagaccgccctgctcatcatggtcatgatcgggacctgcatggtcatcggcgacggcgtcctcacccccgtcatctcagtgttctcggctgtttctgggcttgagctctccttgtccaagcatcagcatgaatatgccgtcacgccgataacctgtgccataatagtgttcctgttcgctctccagcattacggcacccaccgcgtcgggtttctcttcgctcccataattctagcctggctgatctgcatgagcacgcttggcgtgtacaacatcatcaaatggaacccccaggtttacatggcactcaatcccgtatacatgctcaaattcttgaagaagaccaagaagtctggttggatgtccctgggagggattctgctctgcatgacaggatctgaagcaatgtttgcagatcttggccacttctcctacagtgcaatccagcttgctttcacttctttggtataccctgcactgatcttaggatacatgggtcaagctgcttatttaaccagacaccataacttcgactcaagctaccaaattggatactacatctcagttccagaggctgtgagatggccagtgctggtgctggcgatcatggcgtcggtggtcggaagccaagcgatcatcagtgggacgttctccatcatcaaccagagccaggccctcagctgtttcccgcgggtgaaggtggtgcacacatcggccaaggtccacggccagatctacatcccggagatcaactggatgctcatggtgctctgcatcgccgtcactgtgggcttccgcgacaccaagcacatggggaacgcgtcggggctggcggtgatcacggtcatgctggtcaccacctgcctcacgtccctggtcatgatgctgtgctggcaccggccgccggcgctggcgctcgccttcttcatcttcttcggctccatcgaggctctctacttctcggcatcgctcaccaagttcctcgacggcgcgtgggtgcccctcctcctggccctcatcctcgtcgccgtcatgttcgtgtggcaccacaccaccgtcaagaagtacgagttcgacctgcacaacaaggtcaccatggagtggctcctcgcgctctgcgaccggctcggcatggtccgtgtccccggcatcggcctcgtctacacggacctcacctccggcgtgccagccaatttctcccgcttcgtcaccaacctcccggccttccaccgcgtgctcgtctttgtctgcgtcaagtccgtgcccgtgccacgcgtgctccccgccgagcgctacctcgtcggccgcgtcggcccgccgggccaccgctcgtaccggtgcatcgtgcgctacgggtaccgggacgtgcaccaagacgtcgactcgttcgagacggagcttgtcgagagcctcgcgtccttcatccggctggacgcgctcttccgctgcagcgacgcccgcagtgacgccgactacgagcgcgagaacgccttcaccgtcatcggcagcaacccgctccggcgccgcatcagctacgacgacacccacgacagtgcctcatccgtggagatacgcgtggaaagcccggcgggcagcaacgggacgaacaccattgagctcacgtccgtgccggcagtggcgccgcgggttgtgaagagggtaaggttcctggtggatcccggaagccccgacgtggaggacaagcagatggtggaggagctccacgagctgtgcgaggcgagggaggccggcacggccttcatcatgggccactcccacgtgaaggccaagcccgggtcgtcgctgctcaggaggctggccatcgggtacgggtataacttcctgcgccggaactgccgcggcccggatgtcgtgctccgtgtgccaccggcatcgctgctcgaggtcggcatggtctacgtgctgtgactcacagacacggggcttctgttctgtctctagcttccggacatgctgctgtaaattgtgacgtgacggcgtgacgcgtgatggaaatcttttatgttttgatcgataaactgcaaaaatcgcatgcggctgcggggagataatgcaaagatcgaccgcttccctgatagctgtccgatctctcccgtatgagctagccggcaataaggctagtattgcgctcggccctctgcatctgcaacaggagctttgttgcaatatccatgaacc

SEQ ID NO: 3008 - DNA, 1788 bp, Saccharum officinarum
cgcacaccaagaaaggggggcaccgagccaatgactcgcgaggagagagataggatttaggcacttggataggtgtggagactggtggagtgagagacgattggcacttggcagcctccagattctgaatctcctgcaatccgtctcgtcgctggagtttcaggcacgtgattatcgagtcaagaaaccatttgcaagcaatgaactctcagagtgttcttgcgatggagcaaatcgccactcccgacaaaacaggacatgcctctgcaccttcagtactgttcgatgctaaattagatcaccacagcttgatggatggcacattagcatccacgagtcagtcatcaaacatcaagactgagttgatccggtcatcaagcttgtcaaggagcctatcagttaaccttcagaaaagaagccctgaatctgatcctgatagcccgcagtctcacgtctcacatcctaaattttcagaacccatgttctcaaattcttcgacattctgcacaagcttgttttcgtcatcttcgacaaaaacagagccatgccgtcaaatgtgcactttacctttcctgcctcacccccctaagtgtgagcagcatgtttcagctgggcagtcatcaagctcctctctgctcttaagtggtgatactggcaatggtttagatgaagctgaacagtcagatgatctgaaagacttcctcgatctttccggagatgcttctgatggcagcttccgagaaaacaatgccttggcttttgatgaacagatggaatttcagttcctgtctgagcagctaggaattgccatcactgacaatgagaagagtcctcatttagatgacatatatggcacaccaccacagctgtcatcacttccagtatcatcttgtcccactcagagtatacagaatctaggatcaccagttaaggcccagcttagctcatctcagccatcttctagctctgcaacaactaacaagtcaaggttgaagtggacacttgagcttcatgagcgttttttggaggccgaaaaaaagcttgaaggacctgaaaaagcaactcctaagggtgtgctgaaactaatgaaggtagaaggtctaaccatttatcatgtgaagagccatctgcagaagtatcggcttgcgaaatatcttcctgggcctaaagaagataagaaggcttcttcggaggataaaaaagcacaatcaggaaagagcggcagtgattcaagcaaaaacaagaatttacaagtggcagaagctctaaggatgcaaatcgaggttcagaaacagcttcatgaacaattagaggtacaaaggcagttgcagctacggatagaggaacatgcaagatacttgcagaaaatactggaagagcaacagaaggccggcaatgtgtcactaaaagttccaactaagccacaggcgacagtgtcacctgaatcgacatcagatgagagaagcgaatctgaggtaggcaccatttctccgcggccatccaagaacaaaaacccgtttgtagacacagaatgcaaatcgccggcaaggatcaagaggacaaaggttcaggttgatcttgagaacgaggccccatgttcatagctgtgccggacatttgcacctcccgttttacttcaggagctatttgctattgtttgtaacctgaacgaccatagtatctctagttatctgttgatatcttggcatgaaatggacttcagatcttagccgttgtattatgtagttcgactttggaatgaaaaatggaagttaagaaatatgtttg

SEQ ID NO: 3009 - DNA, 1991 bp, Panicum virgatum
tagcatagttgccgggcgccaatgatttgcaagaagagggataggatttaggcagctggtaggtaggtttcagagagagagagagagagagagaggagccagattgggtctcggataggtcataggacagagtcgagagagtggagtgagagagattggccgctgccagattctgaatctcctacaatccgtgctcccacaatccctgtgtctcaggccagcctatcaagtcagtagtcagcataagaaaaatgagctcccagagtgttgctactggggagcagattattgctcctgaccaaatagtacacgcctgcacatccacacaaacttcagttcataagctgtttgatgctaaactggaccacgggttcttgatagatgacactttgtcatccacaagtcaatcatcaaacatcaagactgaattgatccggacatcgagcttgtcaaggagcctatcggttaaccttcacaaaagaagccctgaatctgatccagaaagcccgctgtctcacgtttcacatcccaaattttctgacccaatattgtctaactcgtcaacgttctgcacaagcttgttttcttcgtcttcaaaaaacacagatccatgccggcaaatgggcactttacctttcctgcctcaccctcctaagtgtgagcagcaggtttcagctgggcagtcatcgagctcctctcttctcttaagtggtgatactggcaatgctttagatgaagctggacagtcagatgatctgaaagattttctcaatctttctggagatgcttctgatgggagcttccatggagaaaacaataccttgtcttttgatgaacagatggaatttcagtttctgtctgagcagctgggaattgccatcactgacaacgaggaaagtcctcatttagatgacatatacggcacaccaccacaactgtcatcgcttccagtatcatcttgctccaaccagagtaaacagaatctagggtcaccagttaaagtccagcttagctcatctcggtcatcttctgactctgcaacaactaacaagtcgagattgaggtggacacttgagcttcatgagcgttttgtggaggctgtgaacaagcttgaaggaccagaaaaagcaactcctaaggctgtgctgaaacaaatgaaggtagaaggcctaacaatttatcatgtaaagagtcatctgcagaagtatcgacttgcgaaatatcttcctgagcctaaagaagacaagaaggcttcctctgaggataagaaagcacaattgggtagcagcagcagtgattccagcaaaactaagaatttacaagtagcagaagctctaaggatgcaaatggaggttcagaaacagcttcacgaacaattagaggtccaaaggcaattgcagctacggatagaggaacatgcaagatacttgcagaaaatactggaagagcaacagaaggctggcaacttgtcgatgaaagcgccaaccaaagcacaagcaggatcacctgagacgacttcaaaggagagaagcgaatctgagggaggcaccacttcgccgcggccatccaagaacagaaacccggacgtagacgcagaatgcaagtcgcctggagggagcaagagaacaaaggttcaggttgatcctgagagagtggccccgtgctcgtagccgtgcggccgaggccaatgactctctgaatgtttggcccccattctatcttctttcaggagctacttgctactgtctgtagcttgcacaaccgtagtatctctagactctagtcactgttgatatcttggcatgaattgtggaatgatgtttggtacggacttcaggtctttgccattgtatcatatagctccactttggaatggaaattggaagttaatgactctctgaatgtattgttgccgctatattttggcggtagcctcgatttggaacatccaaaaaaaatatagatacgtagctatgtggaattcgccaggc

SEQ ID NO: 3010 - DNA, 1957 bp, Panicum virgatum
cagagagagagagagagagagagagaggagccagattgggtctcggataggtcataggagtcgagagagtggagtgagagagattggccgctgccagattctgaatctcctcctacaatccgtgctcccaccatcgctgagtctcaggccagcctatcaagtcagtagtcagcataagaaaaatgagctcccagagtgttgctactggggagcagattattgctcctaaccaaatagtacacgcctgcacatccacacaaacttcagttcataagctgtttgatgctaaactggaccacgggttcttgatagatgacactttgtcatccacaagtcaatcatcaaacatcaagactgaattgatccggacatcgagcttgtcaaggagcctatcagttaaccttcagaaaagaagccctgaatctgatccagaaagcccgctgtctcacgtttcacatcccaaattttctgacccaatattgtcaaactcgtcaacgttctgcacaagtttgttttcttcgtcttcaaaaaacacagatccatgccggcaaatgggcactttacctttcctgcctcaccctcctaagtgtgagcagcaggtttcagctgggcagtcatcgagctcctctcttctcttaagtggtgatactggcaatgctttagatgaagctggacagtcagatgatcttaaagattttctcaatctttctggagatgcttctgatgggagcttccatggagagaacaatatcttggcttttgatgaacagatggaatttcagtttctgtctgagcagctgggaattgccatcactgacaacgaggaaagtcctcatttagatgacatatacggcacaccaccacaactgtcatcgcttccagtgtcatcttgctccaaccagagtaaacagaatctagggtcaccagttaaagtccagcttagctcatctcggtcatcttctgactctgcaacaactaacaagtcgagattgaggtggacacttgagcttcatgagcgttttgtggaggctgtgaacaagcttgaaggaccagaaaaagcaactcctaaggctgtgctgaaacaaatgaaggtagaaggcctaacaatttatcatgtaaagagtcatctgcagaagtatcgacttgcgaaatatcttcctgagcctaaagaagacaagaaggcttcctctgaggataagaaagcacaattgggtagcagcagcagtgattccagcaaaactaagaatttacaagtagcagaagctctaaggatgcaaatggaggttcagaaacagcttcacgaacaattagaggtccaaaggcaattgcagctacggatagaggaacatgcaagatacttgcagaaaatactggaagagcaacagaaggctggcaacttgtcgatgaaagcgccaaccgaagcacaagcaggatcacctgagacgacttcaaaggagagaagcgaatctgagggaggcaccacttcgccgcggccatccaagaacagaaacccggacgtagacgcagaatgcaagtcgcctggagggagcaagagaacaaaggttcaggttgatcctgagagagtggccccgtgctcgtagccgtgcggccgaggccaatgactctgaatgtttgccccccgttctatcttctttcaggagctacttgctactgtctgtagcttgcacaaccgtagtatctctagactctagtcacctgttgatatcttggcatgaattgtggaatgatgtttggtacggacttcaggtctttgccattgtatcatatagctccactttggaatggaaattggaagttaatgactctctgaatgtattgttgccgctatattttggcggtagcctcgatttggaacatccaaaaaaaatatagatacgtagctatgtggaattcgccaggtagcttgtcgaagtaaaaaaattcacctgttcggctt

SEQ ID NO: 3011 - DNA, 1016 bp, Zea mays
aacagaccctcgcttcgtttataaatacgcagcgccatacgcccacctcgaacctgagaacctgacgcggcatcatgcaaacaaaaccgatcagagagatggcggccgtctcctccaccgccaccgcctcctcgcagccggagctgccgacctccaccgcccaccctaccgccaatgccgccgccatcagcaggctggcgcggcggccacggcggaacaacagcttcgtgatggtggaggaggcgtcctatgccagcggcggcggcgacggcggggtggccaggacgaagagcctcacggaggacgacctggaggagctcaagggctgcgtcgacctcggcttcggcttcgcgtacagcgagatacccgagctctgcgggacgctgcccgcgctcgagctctgctactccatgacccggaggttcctcgacgagcagagggcgccgggacaggatgaggaggaggaggagcctgcgtcgccgccgctcccaaattggaggatctttgcaccgggtgacgatccggaggaagtgaaggccaggttgaagtattgggctcaagcagtagcatgcactgtcaagctctgcagctgaaccagaggctggttttaactgctgtctgttctgttagcgtatgctgcgacgggccgaaccgagggcctgttggaggttgaacagtctggttgtatgtgttttgggattcgggggagcgaagaactctcttcataggtttcttctctggctgcttctgcaagaacttgggagggcggaggagggatcatgatccgggacagcgacagaccccgattgagatccatggtttgagggttctacgccgcaagcctttgcaaaatgcaggacctgctgtttcgttgttaataataataatgatgatgatcactaggtgttctaactgtcgtagtcctgtaataattaatgacgcactgaatggaagtttcgagttttggctactaatccaagggttgattagctccaatttttgatctattttgtgcc

SEQ ID NO: 3012 - DNA, 1319 bp, Setaria italica
cccaccgcagaaatcagaccagatctccgccatttctcctcccccttccgcatcgcacgctcctccgcctttcccgtgtcccccggaggaggtttcgagcatggcggagcagccgcacgcggaaggcggcgcgagccccaagcacgagaccctgatggagaagctcgccgacaagctccacgctggcggcggcaagggcgactcctcgtcctcggactccgacaacgacgagcggccgcgcccctcggcgcccgccgccgaggtcaagccctccttctccgtctccgcagccgcggcggccgccgaggccagggccaaggtgttccgcctcttcggccgcgagcagcccatccacaaggccctcggaggaggcaaacctgctgatgtattcctgtggaggaacaggaacatctctgctggagtacttggtggtgtcactgcaatctggatcctctttgaatgccttggctaccatcttctgacctttgtttgccatggtctcatattctctctgggtgttctgtttctctggtctaatgcgtcttcgttcatcaacaagtctcccccacggatcccagaggtgatcattcctgaagatctggttgtcaacattgcactatctactcgttatgagatcaacagggcctttgtcaatcttcgccagattgctcttggccgggacataaagaagttccttatggtgattgctgggctttggttgctttctgttcttgggagctgctgcaatttcttgaccttggtttacatagtgtttgtggtgctgcacacggtccctgtcctctacgagaagtacgaggaccagatcgactcgtatggtgagaaggggtgggtcgaaatcaagaagcagtatgccgtgtttgatgagaaggttctgagcaaagtaccaagggggcccgcgaaagacaagaagcactagaaacacaagtgatccgtgttactctcggtagggaatgctagcaagtggttcgagtttgtcgggaggcatcacgactccctttttgtggtgcagcaccaatatgccaccaattgccttgtgttattatggctgccttgtttggtcttgaactcttgatgggagtagccgaatagctttgccctacaacagtgacgcagatgcagcatacgattttcttgtactgctgtttgattttgatctgtgttgtaagatgttgtgcgtgtactgtacccgtgatggtgtttttgctacttatatggatgtttaggatggttttggtgaaaaaggcctgtagcatgttcttgttgtactgttagtgctcagttttaggatatgatgcgca

SEQ ID NO: 3013 - DNA, 1210 bp, Leymus cinereus x Leymus triticoides
cccactcccacgcgcaccggcactacccagcggcgtgagggtttcggggagagcgtagagcgagccatggcggagcagccgcacgccgaggacgcgggtcacaagccggagaccctgatggagaagatagccgacaagctccacgtcggcggcggcgaccactcctcctcggactccgacaacgacgagcgcccgcgcccctcggcgccgcccgcccccgccgcctccgaggtcaccaccgcctccttcgccgactccgcctccgcggcggcggccgatgccaagaacaagatgttccgcctcttcggccgcgagcagccgatccacaaggtcctcggcggaggcaaacctgctgacgtgtttatgtggaggaacaagaacatctctgctggagtactaggtggtgcaactgcaatctggatcctttttgaattgcttggctatcatcttctggctttccttggccatgctctcatattctctctgggtgttctctttctctggtctaatgcctcatcattcattaacaagtctcccccaaggattcccgaggtgatcattcctgaagatttggttgtcaacattgcgctatctacacgtcatgagatcaacagagccttcgcaaaccttcgtcagattgctcttggccgtgacataaagaagttccttattgtgattgctggtctatggctgctttccattcttgggagttgctgcaacttcttgacgctgttctacgttgtttttgtggttctgcactcagttccagtaatctacgagaagtatgaagatcagattgatacctatggtgagaaggggtggattgaggttaagaaacagtatgctgtgtttgatgctaaggttctgagcaaagtgctgaggggccccttgaaagacaagaagaactagaaatgagtgataccgtgtaccatcggcgactggttcgtggctgcccttgtggtatgagcaccaaatttctcaccagttgtcttgtgttatgtaaggctgtttttgttgtttgcgactttgatgagagtagcctgggtagcttaccctccaacagtaatgcagaggcagcacttgtttcgctgtaccgctgtttgatttttgatctgttaaggtgtcgcatgggtacggtttctagacgctgattttgctacttgcattgctgcagattggagtattgatgatatttatcaactaaaaaaaa

SEQ ID NO: 3014 - DNA, 1339 bp, Zea mays
tcgcagcgcgaccagacctctcctccgcctttcccgtgtcgtgtcccccgcagcaatcaccgcgagggtttcttccaatcccgttcgttccgttccagttccagcatggcggagcagccgcaggaaggcggcgcgagccccaagcacgagtccctgatggagaagctcgccgacaagctccacgtcggcggcggcaagggcgactcctcgtcctcggactccgacagagacgagccgccccacccctcggcgccgcccaccgacgaggtcaagcagccctcattctccgactccaccgccacggcggccgccgaggccaaggccaaggtgttccgcctcttcggccgcgagcagcccatccacaaggcgcttggtggaggcaagcctgctgatgtgttcctgtggaggaacaggaacatctccgccggagtacttggtggagccacagcaatctggatcctatttgaattgcttggctaccatcttcttacttttgtttgccatggtctcatattctctctgggtgttctctttctctggtctaatgcttcatcgtttatccacaagtctcccccaaagatcccagaggtggtcattcctgaagatttagttgtcaacattgcggtatccactcgttatgagatcaacagggcctttgctaatctccgccgaattgctcttggccgggacattaagaagttcctaatggttattgctgggctttggttgctttctgtccttggaagttgctgcaacttattgaccttagtctacattgtgtttgtggtgctgcacacagtacctgtcctgtatgagaagtatgaggatcagattgacacctatggcgagaaggggtgggttgagattaagaagcagtacgccgtgttcgatgagaaggttctgagcaaagtaccaaggggtcccgcgaaagacaagaagcactagaagaagtgattcgaggtttggctctcagtagggaatggtagcaatcggtttgagtctcatcaggagacagcgcttgtgggtatgaagcgccaatttgccacctatgcatcgtgttgtgtatggctgctttttgtttgatatttgatgggagtagccgaattgctagctttacccttcatcagcgatgcatacacagcatacggtttttcggtagtgctgtttgattttgatctgtgttgtaagatgtcatgccaagactgtacctgagacactgtttttgataccgatgcagtttggaatttgatggtttttgtgctcttttggtgagcttaggtaacagcatgcttcttgagagtggcaacacgaaaacggcagaaacatggttcttgggtta

SEQ ID NO: 3015 - DNA, 2380 bp, Brachypodium distachyon
gcatctataaaaccccaccacgccaggtctccgcccattcctcccccaccttccccacgcgccaccccttttcttcggaccatcgcgagggtttcgggcaagagggacacagagcaatggcggagcaggcgcacgctgaggaagcgagccacaagtccgagaccctgatggagaagatcgccgacaagctccacgtcggcggcggcgacggctcctcctcgtcgtccgactccgaagccgacgagcgcccccgcccctctgcgccgcccgcccccgcccccacccccgccgtctccgaggtcaccaccgcctccttcgccgactccgcctccgcggcggcggccgacgccaaggccaagatgttccgcctcttcggccgcgagcagcccatccacaaggtcctcggcggaggcaaacctgctgatgtgttcatgtggagaaacaagaacatttctgctggagtactaggcggtgcgactgctatttggatcctttttgaattgcttggctaccatcttttggctttcctttgccatggtctcatattctctctgggtgttctctttctctggtctaacgcctcgtcattcattaacaagtcccccccacggatccctgaggtgatcattcccgaagatctggttgtcaacgttgcattatctacacgccatgagatcaacagagcctttgcaaatcttcgtgagattgctcttggccgtgacatcaagaagttccttattgtgattgctgggctatggctgctttctattcttgggagttgctgcaacttcttgaccctggtttacattgtttttgtggttctgcacacagtaccagttctctacgagaagtatgaagatcagattgactcctacggagagaaagggtgggttgaggttaagaagcagtactctgtgtttgatgccaaggttctgagcaaagtacccagggggcccttgaaagacaagaagaactagaaacgagtgagaaggtgttactaccggtacgaaatgatagcaactggtttgtggttctcaggacactttgtggctgccgttatggtatgagcaccaatatgccacctgttcccttgtgttatgtatggctgttttgttgtttgcgacttcgatgaaagtagcctcagtagcttccccgtgaacagtaatgcagatgcagcacatgttttgctgtgctccttgttttttgatctgttaagctgtcgcatgtcagaacctgcttgtggtttgtgacactgattttgctacttgcattgctgcagttttaagatgttgatgagctggttgagattagatgtcatctgctcgtttctgttgtatcagcgttgaaggtctacttaattgtgcaatggtgctaccttgtggtggtgaacgctatctggcgtgatgttaaattttctgtgcttaaactattcgcttggtccgtacagggtgaagtaagcaatattcgctggatctgtacaggttagaagtaagcaatactactttctatttcatcacactcaaagaaaagcctacagttgtctacagtaaaaaagactcccaactaaccaagtagtatgaactaactatacaaaagaagaagtgagattagcagtgacgatgtgcaaaaaacagaacaaaagaaatctgctccgcagattcattatttgtgtaatacaacatccgaacgctggcaaactatagtttaggtggagaaactgtttcttccatagcttgagaaagaaaaccggcttttatagcctgacattcctttactccctaatattttccgtttcaactcatgaacttacagatcaggctccaggcctattttctcgtggcaaaccctttctattctagtttctgaattatgtccatacacttgtgttcagaggaagtatgtcaactgctccttcttcctcgagcccccttcaccatacaactcattccattgcttcagttcacccattacggaaccttccgcagcaaaactcgctgccacctgcaattccaagtttgtgaaaatattagtgagttctgagatgtcaagttatgaagttatcaagttctactacatgcttgcatagtgaattctgcttggattgtagaacaaaatgggttcacctggttctttgcttctttcaaatccttcatgtttaatggccttaggatgatccccttgtccttttcttttatctttgaaggatctaatggagtacctccttgttcaagtttcttcttctcctggagatatttgagcattaacgtctatattgtgaacacatctgatgaataaaatgcttaagtatggtggtgattagactaccaattccttcttcctttccttctggatcagttccctcacagggcgatatgcggcc

SEQ ID NO: 3016 - DNA, 1527 bp, Sorghum bicolor
tataaaatcccagcgcacgaaggaagaccagatctcccccatttctcctccacgcctcctccgcctttcccgtgtcccccgcagcaatcaccgcgagcgcgagggtttccagcatggcggagcagtcgcagccgcacgaggaaggcggcgcgagccccaagcacgagtcgctgatggagaagctcgccgacaagctccacgtcggcggcggcggcaagggcgactcctcgtcgtcctcggactcggacaacgacgagcggccccgcccctcggcgccgcccgccgacgaggtcaagcagacctccttctccgactccgccgccacggcggccgccgaggccaaggcgaaggtgttccgcctcttcggccgcgagcagcccatccacaaggccctcggtggtggcaagcctgctgatgtgttcctgtggaggaacaggaacatctctgctggagtacttggtggtgccacagcaatctggatcctatttgaattgcttggctaccatcttcttacttttgtttgccacggtctcatattctctctgggtgttctctttctctggtctaacgcttcatcgtttatccacaaggctccccctaagatcccagaggtgatcattcctgaagatttagttgtcaacattgcgctatccactcgttatgagatcaacagggcctttgccaatctccgccagattgctcttggccgggacataaagaagttcctaatggttattgctgggttttggttcctttctgttcttggaagttgctgcaacttcttgaccttggtttacattgtctttgtggtgctgcacacagtacctgtgctgtatgagaagtatgaggatcacattgactcgtatggcgagaaggggtggattgagattaagaagcagtacgctgtgtttgatgagaaggttctgagcaaagtaccaaggggtcctgcgaaagacaagaagcactagaagcaagtgatgcaaggttgctcctagtagggaatgctagcaatcggttcgagtttctcaggaggcagcacttgtgggtgtgagcaccactatggcctatgcattatgttgtgtatggctgctttgttgtttggttttgatgggtgtagccgaattgctagctttgcccttcatgggtgtagccgaatttccggtagtgctgtttgattttgatctgtgttgtagacgtcgagcgcagactgtacctgtgacactgtttttgctacttatcaatgcagtttggaatttgatgatatttatggtcttttgctgagcttaggtaacaaatgcttggtttggttgttttgatgggtaaaaagactggttagctaggcagtttgggcaattgtaacttccagtcaagcagcagaaacatgtttcgtgagaagctctttccgttacactctgtttctgctgttctggggaacagtatggcaacatgaaagtctcttgaactctttgataaatgtatgctttgaagaatcaattgtgtccatttgcttatagtcgcatatatgct

SEQ ID NO: 3017 - DNA, 1347 bp, Zea mays
ttcccagcgcacaaggggaagaccagatctcccccatttctcctccacgccgccccctccgcatttcccgtgctcctctcgttccggcatggcggagcagacgcagccacaaggggaaggcggcgctagccccaagcacgagtccctgatggagaagctcgccgacaagctccacgtcggcggcggcaaggccgactcctcctcctcctcggactccgacagtgacgagcggccccgcccctcggcaccgcccgccgacgagctcaagcagccctccttctccgacgccgccgccacggcggccgccgaggccaaagccaaggtgttccgccttttcggccgcgagcagcccatccacaaggccctcggtggcggcaagcctgctgatgtgttcttgtggaggaacaagaacatctctgctggaatacttggtggtgccacagcaatctggatcttatttgaattgcttggctaccatctccttacttttgtttgccatggtctcatattcgccctgggtgttctctttctctggtccaatgcttcatcgtttatccacaaggctccaccaaagatcccagaggtgatcattcctgaagatttagttgtcaacattgcgctatccactcgttacgagatcaacagagcctttgccaatctccgccagattgctcttggccgggacctaaagaagttcctaatggttattgctgggttttggttgctttctgttcttggaagctgctgcaacttcttgaccttagtttacattgtctttgtggtgctgcacacagtacctgtcctgtacgagaagtacgaggatcagattgactcgtatggcgagaaggggtgggttgaaattaagaagcagtatgccgtgttcgatgagaaggttctgagcaaagtacccaggggtcctgcgaaagacaagaagcactagatgcaagtgattcgaggtccctgttagtagggaatgctagcaaaaccggttcgagtttctccggaggggggcagcacttgtgggtgtgagcaccagtttgccacctgtgcattacgttgcgtatggctgcttagttgtttggtcttgatgggagtaagccgaattgctagctttgcgcttcatccagtgatgcagacgcagcatacgaatttctgtagtgctgtttgagtttgatctgtgttgtatgatgtgtgcagactgtgcttgcgacacttttttggtacttatatattgatgcattttggaatttgatgatttttatggttttttttttgctgagcttagacaacacatacacgggctgttaaacattgttgctttgcccacccgactgctggagtcggcct

SEQ ID NO: 3018 - DNA, 1152 bp, Saccharum officinarum
gcagccgcagccgcacgaggaaggcggcgcgagcccgaagcacgagtcgctgatggagaagctcgccgacaagctccacgtcggcggcggcaagggcgattcctcgtcgtcctcggactccgacaacgacgagcggccccgcccgtctgcgccgcccgcgccgcccgccgacgaggtcaagcagccctccttctccgactccgccgccacggcggctgccgaggccaaggccaaggtgttccgcctcttcggccgcgagcagcccatccacaaggccctcggtggaggcaaacctgctgatgtgttcctgtggaggaacaggaacatctctgctggagtacttggtggggccacagccatctggatcctatttgaattgcttggctaccatcttcttactttcgtttgccatggtctcatattctctctgggtgttctctttctctggtctaacgcttcatcgtttatccacaaggctcccccaaagatcccagaggtggtcattcctgaagatttagttgtcaacattgcgctatccactcgttatgagatcaacagggcctttgccaatctccgccagattgctcttggccgggatataaagaagttcctaatggttattgctgggttttggttgctttctgttcttggaagctgctgcaacttcttgtccttggtttacattgtctttgtggtgctgcacacagtacctgtcctgtatgagaagtacgaggatcagattgactcgtatggcgagaaagggtggattgaaattaagaagcagtacgccgtgtttgatgagaaggttctgagcaaagtaccaaggggtcccgcgaaagacaagaagcactagaagcaagtgatccaaggttgctcttagtagggaatgctagcaatcggttccgagtttctcaggaggcagcgcttatgggtacgagcaccaatttgccacctatgcattatgttgtgtatggctgcttagttgtttggttttgatgggtgtagccgaattgctagctttgcccttcattggtgatgcaaacgcagcattaaattttcggtggtgctgtttgattttgatctgtgttgtaagatgtcgagcgcagactgtacctgcgacactgtttttgctacttattaatgcagtttgga

SEQ ID NO: 3019 - DNA, 1500 bp, Triticum aestivum
ccccgggctgcaggttctcttccccctcaactcccacgcgcaccggcaccaccccttttcttgcggagcagcgtgagggtttcggaaagctaagccatggcggagcagccgcacgccgaggacgcgggccacaagccggagaccctgatggagaagatcgccgacaagctccacgtcggcggcggcgaccactcctcctcgtcctccgactccgacaaggaggagcacccgcgcccctcggcgccgcccgctcccgcccccgcccccgccgcctccgaggtcaccaccgcctccttcgccgcctccgcctccgcggcggcggccgacgccaagaacaagatgttccgcctcttcggccgcgagcagcccatccacaaggtcctcggcggaggcaaacctgctgatgtgtttatgtggaggaacaagcacatctctgctggagtactaggtggtgcaactgcaatctggatcctttttgaattgcttggctaccatcttctggctttccttggccatgctctcatattctctctgggtgttctctttctctggtctaatgcctcatcattcattaacaagtctcccccaaggattcccgaggtgatcattcctgaagatctggttgtcaacattgcgctatctacacgtcatgagatcaacagagccttcgcaaaccttcgtcagattgctcttggccgcgacataaagaagttccttattgtgattgctggtctatggctgctttccattctcggcagttgctgcaacttcttgacgctgttctacattgtttttgtggttctgcacacagttccagtaatctacgagaagtatgaagatcagattgatacctatggtgagaaggggtggattgaggttaagaaacagtatgctgtgtttgatgccaaggttctgagcaaagtgccgaggggccccttgaaagacaagaagaactagaaacgagtggtaccgtgtggaatggaatgatggcgactggttcgtggctgcccttgtggtatgagcaccaaatttctcaccagttgtcttgtgttatgtaaggctgttttcgttgtttgcgactttgatgagagtagcctgggtagcttaccctccaacagtaatgcagaggcagcacttgtttcgctgtaccgctgtttgatttttgatctgttaaggtgtcgcatgggtacggtttctagacgctgattttgctgcttgcattgctgcagtttggagtattgatgatgtttatcaactcgttgggctttagatgtcatctactcgtttctattgtactactatcactgttattactgaaatcaaacaaacgatgttagcatttaattgcttgcttacttttgaaggcagagctactaatagcgatgtcgacaggttagccaagtttgctcattcactagatcagggtcgccacatgtggcttgatgctccccatgaccctttttgtatcccactacatgtggaatttgagtaataaagctt

SEQ ID NO: 3020 - DNA, 1165 bp, Pseudoroegneria spicata
  misc_feature (8)..(10): n is a, c, g, or t
  misc_feature (34)..(34): n is a, c, g, or t
  misc_feature (905)..(905): n is a, c, g, or t
  misc_feature (955)..(955): n is a, c, g, or t
  misc_feature (978)..(978): n is a, c, g, or t
  misc_feature (1089)..(1089): n is a, c, g, or t
  misc_feature (1112)..(1112): n is a, c, g, or t
  misc_feature (1114)..(1115): n is a, c, g, or t
ctccactnnnacgcgcaccggcaccatccctttncttgcggagcagcgtgagggtttcggggagagagaggagcgagagccatggcggagcagccgcacgccgaggacgctggccacaagccggagaccctgatggagaagatcgccgacaagctacacgtcggcggcggcgaccactcctcctcgtcctcggactccgaccacgacgagcgcccgcgcccctcggcgccgcccgcccccgcccccgcccccgccgcctccgaggtcaccaccccctccttcgccgcctccgcctcttcggcggcggccgatgccaagaacaagatgttccgcctcttcggccgcgagcagccgatccacaaggtcctcggcggaggcaaacctgctgacgtgtttatgtggaggaacaagcacatctctgctggagtactcggtggtgcaactgcaatctggatcctttttgaattgcttggctaccatcttctggctttccttggccatgctctcatattctctctgggtgttctctttctctggtctaatgcctcatcattcattaacaagtctcccccaaggattcccgaggtgatcattcctgaagatctggttgtcaacattgcgctatctacacgtcatgagatcaacagagccttcgcaaaccttcgtcagattgctcttggccgcgacataaagaagttccttattgtgattgctggtctatggctgctttccattctcggcagttgctgcaacttcttgacgctgttctacattgtttttgtggttctgcacacagttccagtaatctacgagaagtatgaagatcagattgatacctatggtgagaaggggtggattgaggttaagaaacagtatgctgtgtttgatgctaaggttctgagcanagtgccgaggggccccttgaaagacaagaagaactaggaacgagtgatanggtgtaccatcgaacggtatggnatgatggcaactggttcggggctgcccttgtggtatgagcaccaaatttctcaccagttgtcttgtgttatgtaaggctgttttcgttgtttgcgactttgatgagagtanccctgggtagcttaccctccaanannaatgcagaggcagcacttgtttcgctgtaccgctgtttgatttttgatca

SEQ ID NO: 3021 - DNA, 1726 bp, Saccharum officinarum
cacagagccacgcacacagcgaggggagctcctcaccccacccaaaaaaacgcattccgcacacgcgcggctggggctcggcggaggcgacggccgacggcgctgcgggcgtcgaggctgggagacgcggggaagctagctgctagcgtagccgggcgcggcgggcgggcggtctcgcgctgcgctgtcgctccatgtcggccaccggcgagagcggcggggatccggcggcggcgcgccgccgctgggatctcaccaacaaggggcccgagagcactacaatgttgaaagaggctgtggaaatgtctactgatgaagaatcagatggtgttgttatatgccatccaaatggtaacactgatggatgcgacgaagccattagtggcagtcgtgatgatgatagcccagaaggccaggaaactagttccattaaggaccctgatgtagaaggtgacacacaggaagacaagtgtgtaaatcaagattcactgaagttgattgatcaagagaagtctgctccccccaagtccccagcgaagtctgcgactgcaagttctggatcggagaggcctaaacgtgttattccccaaccattctctctttctactcaaagaaggtcatctggagtaaatggtggtgtgaccaatccattggcaaataaggataaatctggtgataaaagtagcatctctccagctagcatgacaaagaagagtacgacgatggcacctaggaagactttgcagcctgagcaggcatttcaccctctggacgaggactcttgttctgtgacttcttcaactacaacatcaacaagagctggcagaactaagacaactgttcccgttgccccatcatttgtgtgtgctaaccgtgctgacaagaggaaggagttctacacaaaattagaggagaaacataaagctttggaagcagagaaggacgaggccgaggccaggaaaaaggaagagcaagatgttgctttaaaacaactaaggaagtcattggtgattaaagcgaaacccatgccaagcttctatcaagaagggcccccaccaaaggctgaacttaagaaggtgcctcctactcgtgccaaatcgccaaagtttacaagttcgaggagaaagagctgcagtgatacaccacagacacctgaggggaaaactaccaatgcaacatctacccgatcacatcgtcacagcattgggagttctaaagacgctaacagagtacaatgctcgccgaagagtggtgtggcgaccaaaactagatctgtcaagcctgagctgaaggccctctgaagagcatggagcaaccaagcgctgcgattgactctgtacaaaccaaattgcctaactcttagacgattccatcgccatgaaatttttgtttcattttatacccaacatctccaccaaaagaaggctgtaaggccaatgacgttgtttgcgctgctggacgttgtccattttcttacattcgtcttgtactcgtaagaactctgttgctgggaccatgtgacatgtaaattacttgaggatccttgtaaagagtttgcctgtgcgtttggtccaccaaaaaatttgcaaccatctaatctattaagtatgtactatattttaaacataaaaaaaaaagggcggccgttttataggaactaatcttaatgtcgcgtgttggcaacatataactttttatattgtaccaaaaataaattaatgggcct

SEQ ID NO: 3022 - DNA, 1648 bp, Zea mays
aaaatagcaaatttctccacacggacacagcagcgagagaagagagtccactgtccaccccaccagaaaaacgcattccgcagacgcgcggcgagggagtaggaggggacggcgggtgccgaggcccgcaggcacggggaagctacctgcttgcgtagccgggcgggctcgcgctgtgctgtcgctccatgtcggtcgccggcgagagcggcggggatccggcggcggcacgccgccggtgggatctctccaacaagggccccgacagcactccaatgttgaaagaggctgtggaaatgtctacagatgaagaatcggatggcgttgttatatgccatccgaatggtaacactgatggatgtgacgaagccattagtggcagtcatgatgatgatagcccagaaggccaggaaactagttccatcaaggaccctgatgtagaaggtgacacacaggaagacaagtgtgtaaatcaagattcactgaagttgattgatcaagagacgtctgctccccccaagtccccagcgaagtccgcgactgcgagttctggaccagagaagcctaaacgtgttgtcacccaaccattgtctctttctactcaacgaaggtcatctggagtaaatggtggtgtgaccaatccatcacccaataaggataaatctggtgataaaagtagcatctctccagcaagcatgacaaagaagtgtacgccgttggcacctaggaagactttgcagcctgagcaagcatttcaccctctggaagaggactcttgttctgtgacttcctcgactacaacatcatcaagagctggcagaactaagacaactgttcctgttgccccatcatttgtgtgtgctaaccgtgctgacaagaggaaggagttctacacaaaattagaggagaaacataaagctttggaagcagagaaggacgaggctgaggccaggaaaaaggaagagcaagacgttgctataaagcaactaaggaagtcattggtgattagagcgaaacccatgccaagcttctatcaagaaggccccccaccaaaggctgaacttaagaaggtgcctcctactcgtgccaaatcaccaaagtttacaagctcaaggagaaagagctgcaatgacacaccacagacacccgagggaaaaaacaccaacgcaacatctaccacccggccacatcgtcacagcatcggggcttctaaagatgccagcagagtacagtgctcgccgaagagcggcgtggcgaccaaaactagatctgtcaagcctgagctgaaggccctctgaagcgcatgcgtagcattcaagtgctgcgattgtctctgtacaaacagaatcgcctgactcttagccgtttccatttgcatgcattttttttgttttgttttgttctatacccagcatctccaccaaaaagaaggctgtagggccaatgacgttgttcgcgctgctggaccttgtctccattttcgtcttgtactcgttaagaactctgttgctgctgggaccatgtgacattcattccatgtaaattacctggggatcccggtagggagctcgactggtgttttggtcttgtgaagtcctcaatgccttaactaatctgtgagctgaaaaactatcgatttggcattgtt

SEQ ID NO: 3023 - DNA, 1360 bp, Cenchrus ciliaris
  misc_feature (1351)..(1351): n is a, c, g, or t
gcgctgtcctgtcactcgatggcggccagcggcgacggaggcggggatccggcggcggcgcgccggcggtgggatctcaccaacaaggggcccgagagcgctccaattgtgaaagaggctgtggaaatttctacagatgaagaatcagatggtgtcgttatatgccatccaaatggtgacagtaacactgatggatgcgacgaagccactagtgacaatcatgatgatgatagcccagaagaccaagtgactagttctgtcaagaaatcggatgtggaaggtgacacacaagaagacaagtgtgtaaatcaagaatcactgaagttgattgatcaagagcagtccgctccccccaagtccccggcgaagtctgcaagttctggatcagagaggcctaaacgtgttgttccccaaccattctccctttctactcagagaaggtcttctggaggaaatggtggtgtgactagtccatccatcaataaggaaaaatccggtgataaaagtagcatctctccagcaagcatgacaaagaagagcacaccagcggcacctagaaagactttgcagcctgagcaggcatttcaccctcaggaagaggactcgtgttctgtgacttcctcaactacaacatccacaagagctggcagaactaagacaactgtccctgttcctccttcatttgtgtgtgctaaccgtgctgacaagaggagggagttctacacaaaactagaagagaaacataaggctttggaagcagagaaggatgaggctgaggcaaggaaaaaggaagagcaagaagctgctttaaaacaactaaggaagtcattggtcattagagcaaagcccatgccaagcttctatcaagaaggacccccaccaaaggttgaactaaagaaggtgcctcctactcgtgccaaatcaccgaagtttacaagttcaaggagaaagagttgtagtgatacaacacagacaccagaggggaaaaacacaagtgcatcttctgcccggtcacatcgtcacagcatcggaagttctaaagatgctaatagagtacagtgctcgccgaagaatggtgtggcgactaaaaccagagctgtcaagcctgagctgaaggccctttgaagaacctggagcagccaagctctgcgatagtcgctgtacaaacctaattacctaactcttagccatttccattttccatggcattttgctcttattttactccccacatctccacctaaagaaggctttagggccaaggccgatgcacgcactgctggatctcatccattttctttcattcgccatgtacttgtaagaactctgttgctgggaccatgtgatgctngatgttgta

SEQ ID NO: 3024 - DNA, 1672 bp, Setaria italica
cacacacacacacacagcgagagcgagcccccaagagaaggaaaaaaaaacgcattccacaacacgcggctgcgcggcgagggaggcggaggcgacggcgccgccaccctccgtgactggaggggtcccggcggtgaggaggcgtacgcggagggtctcgggttccggagcgggggagctacgctgcgagtagagcggcgggctcgcgctgccctgtcactcgatggcggccagcggcgagggcggcggggatccggcggcggcgcgccggcggtgggatctcaccaacaaggggcccgaaagcgctccaatcgtgaaagaggctgtggaaatttctacagacgaagaatcagatgttgttatatgccatccaaatggtgacagcaacactgatggatgcgacgaagccactagtggcaatcatgatgatgatagcccggaagaccaagtgactagttctgtgaaggacccgaatgtggaaggggacacacaggaagacaagtgtgtaaatcaagaatcattgaagttgattgatcaagagcagtctgctccccccaagtccccagcgaagtctgcaagttctggatcagagaggcctaaacgtgttgttccccaaccattctccctttctactcaaagaaggtcttctggaggaaatggtggtgtgtctagtccatccatcaataaggaaaaatccggtgataaaagtagcatctctccagcaagcatgacaaagaagagtacaccagtggcacctaggaagactctgcagcctgagcagacatttcaccctcaggaagaggactcgtgttctgtgacttcctcaactacaacatccacaagagctggcaggactaagacaactgtccctgttcccccttcatttgtgtgtgctaaccgtgctgacaagaggagggagttctacacaaaactagaagagaaacataaggctttggaagcagagaaggatgaggctgaggcaaggaaaaaggaagagcaagaagctgctttaaaacaactaaggaagtcattggtcattagagcaaaacccatgccaagcttctatcaagaaggccccccaccaaaggttgaacttaagaaggtgcctcctactcgtgccaaatcaccaaagtttacaagttcaaggagaaagagttgcagtgatacagcacagacaccagaggggaaaaacactagtgcatcatctgcccggacgcatcgtcacagcattggaagttctaaagatgctaatagagtacaatgctcgctgaagaatggtgtggcgactaaaaccagagctgttaagcctgagctgaaggccctttgaagaacatttagcagccaagctctgcgattgtcgcagtacaaacctaattatctaactcttagccattttcatttccatggcattttgctcttaatttacacccgacatctccaccaaaagaaggctgtagggccaaggccggtgcgcgctgctggaccttatccattttctttcattcaccctgtacttgtaagaactctgttgctgggaccatgtgatgctcgacgttgtaaattacttgagggtctttgtaaggagtctgtcagtcgatgtcttggtcctttgaagcccttgaactaatctgtgagctgaatagctgttggaatggcactgttctgattgatg

SEQ ID NO: 3025 - DNA, 1348 bp, Pennisetum glaucum
actcgatggctgccagcggcgagggcggcggggatccggcggcggcgcgccggcggtgggatctcaccaacaaggggcccgagagcgctccaattgtaaaagaggctgtggaaatttctacagatgaagaatcagatggtgttgttatatgccatccaaatggcgacagtaacactgatggatgcgacgaagccactagtggcaatcatgatgatgatagcccggaagatcaagtgactagttctgtcaagaaaccggatgcggaaggtgacacacaggaagacaagtgtgtaaatcaagaatcactgaggttgattgatcaagaacagcctgctccccccaaatctccggcgaagtctgcaagttctggatcggagaggcctaaacgtgttgttccccaaccattctccctttctactcaaagaaggtcttctggaggaaatggtggtgtgactagtccatccatcaataaggaaaaatccggtgataaaagtagcatatctgtagcaagcatgacaaagaagagcacaccagtggcacctaggaagactttgcagcctgagcagacagttcaccctcaggaagaggactcgtgttctgtgacttcctcaactacaacatccacaagagctggcagaactaagacaactgtccctgttcccccttcatttgtgtgtgctaaccgtgctgacaagaggagggagttctacacaaaactagaagagaaacacaaggctttggaagcagagaaagatgaggctgaggcaaggaaaaaggaagagcaagaatctgctttaaaacaattaaggaagtcattggtcattagagcaaagcccatgccaagcttctatcaagaaggcccaccaccaaaagctgaacttaagaaggtgcctcctactcgtgccaaatcaccaaagtttacaagttcaaggagaaagagttgcagtgatacagctcagacaccagaggggaaaaacactagtgcgtcatctgtccggtcacatcgtcacagcatcggaagttctaaagatgctaacagagtacagtgctcgccgaagaatggtgtggcgactaaaaccagagctgtcaagcctgagctgaaggccctttgaagaacctggagcagccaagctctgcggttgtcgctgtacaaacctaattacctaactgttagccattttcatttttccatggcattttgctcctattttttacaccagacatctccaccaaaagaaggctgtagggccaaggctggtgcactcgctgctggaccttatccattttctttgattcgccctgtacttgtaaggactctgttgctggtaccatgtgatgctcgatgttg

SEQ ID NO: 3026 - DNA, 1635 bp, Panicum virgatum
cccaaaagaagaaaaaaaaacgcattccacttccacccaagcggctgcggggcggggaggtggaggcgccgccagccgccgtgactagaggggacccggcggggaggcggcggctacggagggtctcgaggtccggaggggaaagctagagctacggtgctaatagaggagcggcgggctcgcgctgttctgtccctcgatggcggccagcggcgagagcggcggggatccggcggcggcgcgccggcggtgggatctcaccaataaggggcccgacagcaccccaattgtgaaagagactgtggaaatttctacagacgaagaatcagatggtgctgttatatgccatccaaatggtaacagtaatactgatggatgtgacgaagccactagtggcaatctcgatgatgatagcccggaaggccaagtaactagttctgttaaggacccggacatggaaggtgacacacaggaagacaagtgtgtaaatcaagattctctgaagttgattgatcaagagaagtctgctccccccaagtccccggcaaagtctgcaagttctggatcggagaggcctaaacgtgttgttccccaaccattctccctttcttctcaaagaaggtcttctggaggaaatggtggtgtgaccagtccacccatcaataagggaaaatccagtgacaaaaatagcatctctccagcaagcatgacaaagaagagtacgccaatggcacctaggaagattttgcagcctgagcagacatttcaccctcaggaagaagactcgtgttccgtgacttcttcaactacaacgtcaacaagagctggtagaactaagacaactgtccccgttgccccttcatttgtgtgtgctaaccgagctgacaagaggagggagttctacacaaaattagaagagaaacacaaggctttggaagcagagaaggatgaagctgaggccaggaaaaaggaagagcaagaagctgctttaaagcaactaaggaagtcattggtcattagagcaaaacccatgccaagcttctatcaagaagggcccccaccaaaggctgaacttaagaaggtgcctcctactcgtgccaaatcgccaaagtttacaagttcaagaagaaagagttgcagtgatacagcacagtcaccagaggggaaaaacactagtgcatcatctgcgcggtcacatcgtcacagtatcgaaagttctaaagatgctaatagagtacaatgctcaccaaagaatggtgtggcaactaaaaccagagctgtcaaacctgagctgaaggccctttgaagaacatggagcagccaagcgctgtgattgtctctgtagaaacctaattacctaactcttagccatttccattttccatgacattttgctcttattttacacctgaaatccccaccaaaagaaggctgtatggccaagtgcatgcgctgctggaccttatccattctctttcattcccctagtacttgtaagaaactaagaactctgttgctgggaccatgtgatgttccatgtaaattacttgaggctctttgtaaggagtctcacgatatcttggtccttcgaagcccttgaactaatctgtgggctgaaaagctggttggagtggc

SEQ ID NO: 3027 - DNA, 1585 bp, Panicum virgatum
gaagaaaaaaaaacgcattccgcttccacacaatcggctgcggggcggggaggcggaggcgccgccagccgccgtgactggagggaggcggcggctacggagggtctcgaggtccggaggggggagctagagctgcggtgctaaaacaggagcggcgggctcgcgctgttctgtccctcgatggcggccagcggcgagagcggaggggatccggcggcggcgcgccggcggtgggatctcaccaataaggggcccgacagcactccaattgtgaaagagactctggaaatttctacagacgaagaatcagatggtgttgttttatgccatccaaatggtaaaagtaatactgatggatgtgatgaagccactagtggcaatcacgatgatgatatcccggaagaccaagtaactagttctgttaaggactctgacgtggaaggtgacacacaggaagacaagtgtgtaaatcaagattcactgaagttgattgatcaagagaagtctgctccccccaagtccccagtgaagtctgcaagttctggatcggagaggcctaaacgtgttgttccccaaccattctccctttcttctcaaagaaggtcttctggaggaaatggtgttgtgaccagtccacccatcaataaggaaaaatctggtgacaaaaatagcatctctccagcaagcatgacaaagaagagtacgccaatggcacctaggaagactttgcagcctgagcaggcatttcaccctcaggaagaagactcgtgttctgtgacttcttcaactacaacgtcaacaagagctggtagaactaagacaactgtccctgttcccccttcatttgtgtgtgctaaccgagctgacaagaggagggagttctacacaaaactagaggagaaacacaaggctttggaagcagagaaggatgaggctgaggccaggaaaaaggaagagcaagaagctgcgttaaagcaactaaggaagtcattggtcattagagcaaaacccatgccaagcttctatcaagaaggccccccaccaaaggctgaacttaagaaggtgcctcctactcgtgccaaatcaccaaagtttacaagttcaaggagaaagagttgcagtgatacagcacagacaccagagggtaaaaacactatagcatcatctgcgcggtcacatcgtcacagtatcggaagttctaaggacgctaatagagtacaatgctcaccgaagaatggtgtggcaactaaaaccagagctgtcaaacctgagctgaaggccctttgaagagcgtggagcagccaagcgatgcgattgtctctgtagaaacctaattacctaactcttagccatttccattttccatgacattttgctcttattttacacccgaaatcgccaccaaaagaaggctgtatggccaagtgcatgcgctgctggaccttatccattctctttcattcgccttgtacttgtaagaactctgttgctgggaccatgtgatgttccatgttgtaaattactcgagggtctttgtaaggagtctcactcgatatattggtccttgaagcccttgaactaatct

SEQ ID NO: 3028 - DNA, 1717 bp, Zea mays
gggtcctcccactgggcttgggctccggcgctccgctactgaatgaagcggccgacccctcgtgcacgagggagccagtaagccacacacagacagtcagacacaggcacacagcgagggagtcctctcctcccccagaaaaggaaaagacgcattccgcacacgcgcggctgggtgtcgaggccgggagacgcggtgaagctagctgctagcgtagccgcgcgcggcgggcgggctcgagctgcgctgtcgctccatgtcggccaccgccgagagcggtggggatctgtcggcggcgcgccgccggtgggatctcaccaacaagggggccgagagcaccccaattttgaaagatgctgtggaaatatctacagatgaagaatcagatggtgttgttacatgccatccgaatggtaacactgatggatgcgaagaaactattagtggcagtcacgatgatgatagcccagaaggccaggaaactagttccattaaggaacctgatgtagaaggtgacacacaggaagacaaacgtgtaaatcaagattcactcaagttgattgatgaagagtctgctcctcccaagtccccagcaaaatccgcgactgcaagttctagatcggagaggcctaaacgtgttgttccccgaccattttctctttctaatcaaagaagtttgtttggagtaaatggtggtgtggccaatccattggccaataaggataaatctggtgataaaagtagcatctctccagcaagcatgacaaagaagagtacgcagatggcacttaggaagactttgcagcctgagaaggtatttcatcctctggaagaggactcttgttctgtgacatcctcatatcctttttctgtaactacaacatcaacaagagctggcagaactaagatgactgttcccgtcgctccttcatttgtgtgtgctaaccgtgctgacaagaggaaggagttctacacaaaattagaggagaaacataaagctttggaagcagagaaggacgaggctgaggccaggaaaaaggatgagcaagacgttgctttaaaacaactaaggaagtcattggtgattagagcgaaacccatgccaagcttctatcaagaagggcccccaccaaaggctgaactgaagaaggtgcctcctacccgtgccaaatcgccaaagtttacaagttcaaggagaaggagctgcagtgatacaccattgacacctggcggggaaaataccaacgcaacatctacccggccacatcgtcacagcatcgggagtcctagagacgctaacagagtacaacaatgctcgccaaagagcggtgtggcaaccaaaacaagatctgtcaaggctgagctgaaggccctctgaagagcatggagcagccgagtgatgtgtttctctgtacaaaccgaattgtctaaccgtttccatttccatgcatttttgcttctattttatacccaacatctccagcaaaagaaggctgtagggccaatgacgttgttcagcgccgctggaccttatccattttcttacattcgccttgtactcgtaagaactcttggtggcaccatgtgacattccatgtaaattacttgaggatccttgtagggagttcgtccggtgttttgctcctgttaagcccttggccttaactaatctgtgagctgaaaagactatcggaatggcactgttccgtttgatgca

SEQ ID NO: 3029 - DNA, 1857 bp, Panicum virgatum
cgggctccagcttgatttaccagctgagcttaactaaacgtaatcacctgcctgcgccgtgaaaacggatagttaatggctttgcgccgttggatttactgttactgttggttggagcatcaaacctcggtcacttgcacgtgggcccaggcggccatcacggctcgctcctcggtcctcccactgaatgaagcaccgacccctcgggcacgggggagccagcgagcccccagaagaaaaaaaaacgcattccgcttccacacaatcggctgcggggcggggaggcggaggcgccgccagccgccgtgactggagggaggcggcggctacggagggtctcgaggtccggaggggggagctagtgctgcggtgctaaaacaggagcggcgggctcgcgctgttctgtccctcgatggcggccagcggcgagagcggaggggatccggcggcggcgcgccggcggtgggatctcaccaataaggggcccgacagcactccaattgtgaaagggactctggaaatttctacagacgaagaatcagatggtgttgttttatgccatccaaatggtaaaagtaatactgatggatgtgatgaagccactagtggcaatcacgatgatgatatcccggaagaccaagtaactagttctgttaaggactctgacgtggaaggtgacacacaggaagacaagtgtgtaaatcaagattcactgaagttgattgatcaagagaagtctgctccccccaagtccccagtgaagtctgcaagttctggatcggagaggcctaaacgtgttgttccccaaccattctccctttcttctcaaagaaggtcttctggaggaaatggtgttgtgatcagtccacccatcaataaggaaaaatctggtgacaaaaatagcatctctccagcaagcatgacaaagaagagtacgccaatggcacctaggaagactttgcagcctgagcaggcatttcaccctcaggaagaagacgcgtgttctgtgacttcttcaactacaacgtcaacaagagctggtagaactaagacaactgtccctgttcccccttcatttgtgtgtgctaaccgagctgacaagaggagggagttctacacaaaactagaggagaaacacaaggctttggaagcagagaaggatgaggctgaggctaggaaaaaggaagagcaagaagctgcgttaaagcaactaaggaagtcattggtcattagagcaaaacccatgccaagcttctatcaagaaggccccccaccaaaggctgaacttaagaaggtgcctcctactcgtgccaaatcaccaaagtttacaagttcaaggagaaagagttgcagtgatacagcacagacaccagagggtaaaaacactatagcatcatctgcgcggtcacatcgtcacagtatcggaagttctaaggacgctaatagagtacaatgctcaccgaagaatggtgtggcaactaaaaccagagctgtcaaacctgagctgaaggccctttgaagagcgtggagcagccaagcgatgcgattgtctctgtagaaacctaattacctaactcttagccatttccattttccatgacattttgctcttattttacaccctaaatcgccaccaaaagaaggctgtatggccaagtgcatgcgctgctggaccttatccattctctttcattcgccttgtacttgtaagaactctgttgctgggaccatgtgatgttccatgttgtaaattactcgagggtctttgtaaggagtctcactcgatatattggtccttgaagcccttgaactagtctagtaatttgtgggctgaaagctgttggagtggcattgttc

SEQ ID NO: 3030 - DNA, 1241 bp, Saccharum officinarum
caaccgcacctcgctcttgattctctcgctcttctcttgtcgatttgtcatcctcaattcagagctcacgggagactcaaatccctgttccgcttcgccggacgccgagagagggcggcgggtgcgggacgcgaaggcgaagccctagctcccctccctgccgcggacgccgatggacccacctcgcgccgtcgccgttcttctcctcatactccttcccgtgctcgccccggtggcctccggcgtgcccttcgtcgtcctgcacgggattggcgacgagtgcgggaacgatggcctggcatccttcaccgagatgcttggggagtggtccggctccaaaggttactgcattgaaattggaagaggagcatgggactcttggttgatgccacttcaagagcaggcaaatacggtttgcaagaaggtcaagaaaatgaaagagctcagtgaaggttacaatatagttggcctgtctcaggggaacttaattggcagggctgtaatcgagtactgtgatggtggacctccggtcaagaatttcatatcaattgggggtcctcatgctggtacagcttcagtgccactttgtgggtctgggtttctttgtattcttattgatgatctgattaaatcagagatatattcagattacgtgcaggcacatcttgcccctagtggttacctaaagatacccactgatatggaagattatttaaaaggttgcagatttcttccaaagcttaacaatgagatcccaagtgcaagaaatactacctataaagaaagattcagcagcttggaaaacttggtactgatcatgtttgaggacgatgcagtattaatacctcgggaaacagcatggtttggttattaccctgatggagcctttagtccagtgttgccccctcaagagacgaagctgtatacagaagattggattggcttgaggaccctggacgaggctgggcgtgttaaattcgtgtctgtgccaggaggtcacctgcgtatctccagaagcgacatgaagaagtacatcgtgccttacttgacgccggaggcgtcatccaagcagagcatacaccggatgctgtcgctttgagcgaaccgttgtgcgtatctactatctagcaaggtctgtatcgctgcccactgtgccctgacacgtgggccctgtatcggcgccttgtaaacacgctgaacatgaagggaggaaatgaaagcgcagggaaagagtggatccg

SEQ ID NO: 3031 - DNA, 1410 bp, Zea mays
cgcgaaacgcgccaacaaccagatcaatggagtgaggcagtgactcagctcagggcctcgggcccagcacaccaaccctccagtagtatctctgacgtgcgggctccgccagacaacgagctcacgagtcacgatccaaatcccttttccactccgccggacgtcgagagaggcggtgggtgcgggacgcgaaggcgaagccctagccccctccctgccgcggacgccgatggacccacctcgcgccgtcgcctttcttctcatactcctgcccgtgctcgccccggtggcctccggtgtacctttcgtcgtcctacacgggattggcgacgagtgcgggaacgatgggctgtcatccttcaccaagatgcttggggagtggtcaggctccaagggttactgcattgaaattggaagaggagcatgggactcttggttaatgccacttcaagagcaggcaaatacggtttgtaagaaggtcaagaaaatgaaagagctcagtgaaggttacaatatagttggcctgtctcaggggaacttaattggcagggctgtaatcgagtactgtgattgtggacctccggtcaagaatttcatatcaattgggggtcctcatgctggtacagcttcagtgccactttgtggttctgggtttctttgtattcttattgatgatctgattaaatcagagatatattcagactatgtgcaggcgcatcttgcccctagtggttacctaaagatacccactgatatggaagattatttgaagggttgcaaatttcttccaaaacttaacaatgagatcccaagtgcaagaaatactacctataaagaaagattcagcagcttggaaaacttggtactgatcatgtttgaggacgatgcagtattaatacctcgggaaacagcgtggtttggttattaccctgatggagcctttagcccagtgctgccccctcaagagacgaagctgtatacagaagattggattggcttgaagaccctggacgaggctgggcgtgttaaattcgtgtctgtgccaggaggtcacctgcgtatcaccagaagcgacatgaagaagtacattgtgccttacttgacgccggaggcgtcatccaagaagaacatacacatacaccggatgctgtcgctttgagcgagtatctaacaaggtttgtatcggtggccattgtgccctgacacgtgggccatgtgttgacgccttgtaaatacgctgaacacgaagggaggaaatgatagctccttggaagagtggatccgaacttgtgaagtgaagcgtgtttggtcctttccgtttcctatctgacaaacaaatatgtccatgccgtggccacaacacgcataaatcattatgcacatttcctattgagtaaaatacaattccgg

SEQ ID NO: 3032 - DNA, 1317 bp, Setaria italica
ggcttcgtccgctccgctcttctccatcgattcagagctcgcgagacccaaatcctgtcgacgcttcgcttaactcggggagaggcggcgggcacgggaggcgaaccccaaccctagtccccctccccgccgtgggcgccgatggccgccctcgcgcctcgcgacgtcgccgtgctcctcctcttactcttccccgtgctcgcgccggtggcctctgccgtgcccttcatcgtcctgcacgggattggcgacgagtgcgggaacgatgggttggcgtccttcactgagatgcttggggagtggtccggctccaaaggctactgcattgaaattggaagaggagcatgggactcttggttaatgccacttcaagagcaggcaaatacagtttgtaagaaggtcaagaaaatgaaagagctcagtgaaggctacaacatagttggcttgtctcaggggaacttaattggccgggctgtaattgagtactgtgattgtggaccaccggtcaagaatttcatctcaattgggggtcctcatgctggtacagcttcagtgcccctttgtggttctgggtttctttgtattcttattgataatctgattaaattggagatatattcagactatgtccaggcacatcttgcccctagtggttacctgaagatacccaccgatatggaagattatttgaagggttgcagattccttcctaagcttaacaatgagatacgaagtgaaagaaatgctacatataaagaaagattcagcagcttggaaaacttggtattgatcatgtttgaggacgatgcggtcttaatacctcgggaaacagcatggtttggttattaccctgatggtgcctttaacccagtattgccccctcaagagacaaagctctataccgaagattggattggcttgaagaccctggacgaggctgggcgtgtcaaattcgtgtccgtgccaggtggtcacctgcgcatctccagaagtgacatgaagaagtacatcgtgccttacttgaagccggatgcgtcacccaagcagagcatacgccggatactgtcggtttgatagtgtacaaggcgtgcggctgctttattacatgcgaacgacgtgcgtatttgggaaatgtctgtatcatctggaccctgtatcgattgccttgtaaatacgctggaacgcgaagggaagaaatgaaagcctagtgatgtttgatcggttcttcagcttgggcctcggcctggtgtcgctgtcccatgtactcagaataagagggaatacgtactagctggaagataaagcgcgtaacatgac

SEQ ID NO: 3033 - DNA, 1644 bp, Panicum virgatum
ccgctctgagccgagccgagccgaagcgagctcgagccagctcgtgagcctcgagctatttttccagctcttccgctccgcccttctcatcgattcagagggcagagctcgagagacgcgagacccaaatcctttccacgcttcgccgagcgtggagggaggcggtggttgcgggagttgagggcgaggccccagacgcctatggccgcgcccgcgcctcgcgacgtcgccgtgctcctcctcttactcttccccgtgctcgcgccggtggcttccgccgtgcccttcgtcgtcctgcacgggattggcgacgagtgcgggaacgatgggttggcgtctttcaccaagatgcttggggagtggtcaggctccaaaggctactgcattgaaattggaaaaggagcatgggactcttggttaatgccacttcaagagcaggcaaatacagtttgcaagaaggtcaagaaaatgaaagagctcagcgaaggttacaatatagttggcctgtctcaggggaacttaattggacgggctgtagttgagtactgtgattgtgggccaccggtcaagaatttcatctcaattgggggtcctcatgctggtacagcttcagtgccactttgtggttctgggttactttgcattcttattgataatctgattaaattggagatatattcagactatgtccaggcacatcttgcccctagtggttacctaaagatacccactgatatggaagattatttgaagggttgcagatttcttcctaaacttaacaatgagataccaagtgaaagaaattctacatataaagaaagattcagcagcttggaaaacttggtattgatcatgtttgaggatgatgcagtcttaatacctcgggaaacagcatggttcggttattaccctgacggtgcctttaacccagtgctccctcctcaagagacaaagctctataccgaagattggattggcttgaagactctggacgaggctgggcgtgttaaatttgtgtctgtgccaggtggtcacctgcgcatctccagaagcgatatgaagaagtacatcgtgccttacttgaagccggatgcgtcatccaagtatagcatacgccggatcttgtcggtttgagagtgtataaggcgggcggctgctttattagaagcgaaccacgttcatatttgggaaatgtctgtatcaactggatcctgtattgatgtcttgtaaatacgctcaacgtgaagggaagaaatgaaagcctagtgataatgataatagggtccgattggtgggttgctctactaggggaaggcccaagcttacgctgggcttaagccgggcttgtccaagcttaccagggtggttgggcctcacataaatgtatgcaaatgtttggttgctggtagctctgcgtaggtccaagcttaccagggaggcagtgtttggattgtctaaaaaaaacaagtgcttggatacctgcattaggggttaggctgcgttgcagaatacaaaagagtgtgttagctggtcgtcgacaccaagctaacctccctggtaagcttaccgtcctatgcgaggcctttttacgtctctgtcagtgttcccctcaaaccttaatgcctattctcaccttttcatctc

SEQ ID NO: 3034 - DNA, 1492 bp, Panicum virgatum
cagagctcgagagacgcgagacccaaatcctttccacgcttcgccgagcgtggagggaggcggtggttgcgggagttgagggcgaggccccagacgcctatggccgcgcccgcgcctcgcgacgtcgccgtgctcctcctcttactcttccccgtgctcgcgccggtggcttccgccgtgcccttcgtcgtcctgcacgggattggcgacgagtgcgggaacgatgggttggcgtctttcaccaagatgcttggggagtggtcaggctccaaaggctactgcattgaaattggaaaaggagcatgggactcttggttaatgccacttcaagagcaggcaaatacagtttgcaagaaggtcaagaaaatgaaagagctcagcgaaggttacaatatagttggcctgtctcaggggaacttaattggacgggctgtagttgagtactgtgattgtgggccaccggtcaagaatttcatctcaattgggggtcctcatgctggtacagcttcagtgccactttgtggttctgggttactttgcattcttattgataatctgattaaattggagatatattcagactatgtccaggcacatcttgcccctagtggttacctaaagatacccactgatatggaagattatttgaagggttgcagatttcttcctaaacttaacaatgagataccaagtgaaagaaattctacatataaagaaagattcagcagcttggaaaacttggtattgatcatgtttgaggatgatgcagtcttaatacctcgggaaacagcatggttcggttattaccctgacggtgcctttaacccagtgctccctcctcaagagacaaagctctataccgaagattggattggcttgaagactctggacgaggctgggcgtgttaaatttgtgtctgtgccaggtggtcacctgcgcatctccagaagcgatatgaagaagtacatcgtgccttacttgaagccggatgcgtcatccaagcatagcatacgccggatcttgtcggtttgagagtgtataggcgggcggctgctttattagaagcgaaccacgttcatatttgggaaatgtctgtatcaactggatcctgtattgatgtcttgtaaatacgctaaacgtgaagggaagaaatgaaagcctagtgataatgataatagggtccgattggtgggttgctctactaggggaaggcccaagcttacgctgggcttaagccgggcttgtccaagcttaccagggaggttgggcctcacataaatgtatgcaaatgtttggttgctggttgctctgcgtaggtccaagcttaccagggaggcagtgtttggattgtctaaaaaaaacaagtgtttggatacctgcattaggggttaggctgcgttgcagaatacaaaagggtgtgttagctggtcgtcgacaccaagctaacctccctggtaagcttaccgtcctatgcgaggcctttttacgtctc

SEQ ID NO: 3035 - DNA, 1158 bp, Pennisetum glaucum
gcgacgttgcggtgctactcctcttactcttccccatgctcctgccggtggcttccgccgtgcccttcatcgtcctgcacgggattggggacgagtgcgggaacgatgggttggcgtccttcaccgagttgcttgaggaatggtccggctccaaaggctactgcattgaaattggaagaggagcatgggactcttggttaatgccacttcaagagcaggcaaatacggtttgcaagaaggtcaagacaatgaaagagcttagtgaaggttacaacatagttggcctgtctcaggggaacttaattggccgggctgtaattgaatactgtgattgtggaccaccggtcaagaatttcatctcaattgggggtcctcatgctggtacagcttcagtgccactttgtggttctgggtttctttgtgttcttattgataatctgattaaattggagatatattcagactatgtccaggcccacctcgcccctagtggttatctgaagatacccactgatatggaagattatttgaagggttgcagatttcttcctaagcttaacaatgagatacccagtgaaagaaatgctacatataaagaaagattcagcagcttggaaaatttggtattgatcatgtttgaggatgatgcagtcttaatacctcgggaaacagcatggtttggttattaccctgacggtgcctttagcccagtgctgcctcctcaaaagacaaagctctataccgaagattggattggcttgaagaccctagacgaggctgggcgtgttaaattcgtgtctgtgccaggtggtcacctgcgcatctccagaagtaacatgaagaagtacatcgtgccttacttgaagctggatgcgtcacccaagcagggcatacgcaggatattgtcggtttgatagtgtacaaggcgtgcgtctgctttattataagcgaacgacgtggtaacgtatttgggaaatgtctatcatctggaccctgtatagattgccttgtaaatacgctggaagtctggaacgcgaagggaagaaatgaaagcctagtgatgtttgatcggttcttcagcttgggccttggtcgtccaaaacatgtagaataagagggagtacatactagcatgactaaagactactcccttcgtcg

SEQ ID NO: 3036 - DNA, 1560 bp, Oryza sativa
cccccacgaagtcacgccgcctccgtcttctacctccgcctcgtcgtcacaagtcacaagcacaagaggcgaaagcgcggcgccgtcgcggagaggagaggagggcgacgagggggaggcgattcccaaaccctagctaccctcaccgccgccgccgccagcagcgatgatggcctacgcgctgcgcggtgccgccctcgtcggcgtcctcctcctcgtcgtggcctccccggcgctcgtcccggtggcctccgccgtgcccttcatcgtcctgcacgggatcggcgaccagtgcgagaacggtgggatggcgtccttcaccgaaatgcttggggaatggtccggctccaagggatactgcattgaaattggaagaggagcatgggactcttggctgatgccacttcaagagcaggcagacactgtttgcaagaaggtgaagaaaatgaaagaactccgtaaaggttacagcatagttggcctttctcaggggaacttaattggtcgggcagtaattgagtactgcgatggtggaccaccggtaaagaatttcatctcgattggtggtcctcatgctggtacggcatcagtaccactttgcggttctggcatcgtttgtgttcttattgatgctctgattaaattggagatatattcaaactatgtacaggcacaccttgctcctagtggttacctaaagatacccactgatatgacagattatttgaagggttgcaagtttcttccaaagcttaacaatgagataccaagtgaaagaaatgctacgtataaacaaagattcagcagcctggaaaatctagtattgattatgtttgaggacgacgcagtgttaataccccgggaaacggcatggttcgggtactatcccgatggcgccttcagtccagtgcagccacctcaaaagacaaagttgtacacggaggactggatcggcttgaaggctttggaggaggctgggcgtgttaagttcgtatcagtgccaggaggtcacctgagcatctccagaagtgacacgaagaagtacatagtgccatacttgaaaccggacggatcatccaggttcggcattcgtcgcatcttgtcggattgattcacgagaagaaggcgttccgagtgaccagttctaacgtcacatggacatggattgtatgtaagctctgaattgtggacttaattgttgatgccatgtaaataccttggtaaaggtaatggggtaatggaatacgtcgtgtactgtagggcaggtggttagcgtacctgaactgcagaactggcgatgctagaattgtgctgcctattagcaaaacgcaattgtgggcttttatgtagcagacctcactaggaaaaagtccaattcgacaatctcgtatatagttcggatttaattcaacaacagaaacagctataatgattcctccagttaggcttcctccaatggtgccttgtaagctatctcataacatgtccacatcatcatgtatcctatgtggaggaaagagaaggcaaaaaatcaatccatctatctcctattcccacgcc

SEQ ID NO: 3037 - DNA, 1360 bp, Triticum aestivum
ccgcggggcgacgagggtgagtcggagcgggagcgctgcgagagagggcgaagccctaaccctcgatccccgaccggaagccgatggccgcgctgtcccccgccgtctccctcctgctggtcctcgtcgtcgccgcctccgcggcgctcgcgccggtggcctccgcggtgcccttcatcgtcctgcacgggatcggggaccagtgcgggaacgacgggatcgcctccttcaccgatgagctcgcggagtggtcgggatccaagggatactgcatggaaattgggagaggatcatgggattcttggttaatgccacttcaagatcaggcaaatgtggtttgcaagaaggtaaaggaaatggaagaacttcgtgaaggttacagcataattggcctttctcaggggaacttaattgggcgggcagtaattgagtactgtgacggtggaccaccggtaaagaatttcatctcaattgggggtcctcacgctggtactgcttcagtgccactttgtggttctggttttctttgcgttcttgttgatgcgctgattcaactggagatatattcaaactatgtgcaggcacatcttgcccctagcggttacctaaagattcccactgatatgacagcttatttgcagggttgcaaatttcttccgaagcttaataatgagataccaagtgaaagaaacattacatataaagaaagatttagcagcttggagaacttggtactgatcatgtttgaggacgacgcagtcttgatacctcgggaaacagcatggtttggttattatcctgatggcgcctttaatccagtgctgcctcctcaagagacaaagctatataccgaagactggatcggcttgaggactttggatgaggctgggcgtgttaagtttgtgtcggtgcccggaggtcacctccgcatatcaaggagcgacatgaagaagtacatagtgccttatttgacaccgtcatgtggatcatccaagcagagtattcgtcgaatcttgtcatactgaggataggtaaaccacgcttgcggctgtaattgcacttgttctgggtctttgtaagcccaacccatgtctctctgcattattaccttataaatacattggcgaaacagactggaaccataacgttgctgtgttcggggtaaatagactagcgaggttgcagcaatggtctcatctttcggtcatcatggaatcagtttgagcaaatgttgtgactggtagtttgatcctagcatgtggtccagctaccgtggaaacggaatatcataacatcagttctgtacgtaaataataacataagaaatatatggtggaaacattgttttctgaaccttttc

SEQ ID NO: 3038 - DNA, 1194 bp, Pseudoroegneria spicata
  misc_feature (1161)..(1162): n is a, c, g, or t
cactcccctcggggcgacgagggcgaacgggagcgggagcgcgagagagggcgaagcccctaaccctcgatcctcgaccggaagccgatggcagcgctgtcccccgtcgtctccctcctgctggtcctcgtcatcgccgcctccgcggcgctcgcgccggtggcctccgcggtgcccttcatcgtcctgcacgggatcggggaccagtgcgggaacgacgggatcgcctccttcaccgatgagctcgcggagtggtcgggatccaagggatactgcatggaaattgggagaggatcatgggattcttggttaatgccacttcaagatcaggcaaatgtggtttgcaagaaggtaaaggaaatggaagaacttcgtgaaggttacagcattattggcctttctcaggggaacttaattgggcgggcagtaattgagtactgtgacggtggaccaccggtaaagaatttcatctcaattgggggtcctcacgctggtactgcttcagtgccactttgtggttctggtgttctttgcgttcttgttgatgtgctgattcaactggagatatattcaaactatgtgcaggcacatcttgcccctagcggttacctaaagattcccactgatatgacagattatttgaagggttgtaaatttcttccgaagcttaataatgagataccaagtgaaagaaacattacatataaagaaagatttagcagcttggagaacttggtactgatcatgtttgaagacgacgcagtcttgatacctcgggaaacagcatggtttggttattatcctgatggcgcctttaatccagtgctgcctcctcaagagacaaggctatataccgaagactggatcggcttgaggactttggatgaggctgggcgtgttaagtttgtgtcggtgccaggaggtcacctccgcatatcaaggagcgacatgaagaagtacatagtgccttatttgacaccgtcatgtggatcatccaagcagagtattcgtcgaatcttgtcatactgaggataggtaaaccacgcttgcggctgtaattgcacttgttctgggtctttgtaagcccaacccatgtctctctgcattattaccttattataaatacattggcgaaacagactggaaccataacgttgctgnngttcgggtaaatagactggcgagtttgcagca
